United States Patent 8,431,139 (NUCLEIC ACIDS AND PROTEINS FROM STREPTOCOCCUS GROUPS A AND B) - sequence listing, part 3

SEQ ID NO: 4846 - protein, 229 aa, Streptococcus agalactiae
MGKKILIIEDEKNLARFVSLELLHEGYDVVVETNGREGLDTALEKDFDLILLDLMLPEMDGFEITRRLQAEKTTYIMMMTARDSVMDIVAGLDRGADDYIVKPFAIEELLARVRAIFRRQEIETKTKEKGDSGSFRDLSLNTHNRSAMRGDEEISLTKREFDLLNVLMTNMNRVMTREELLEHVWKYDVAAETNVVDVYIRYLRGKIDIPGRESYIQTVRGMGYVIREK

SEQ ID NO: 4847 - DNA, 531 bp, Streptococcus agalactiae
gtgttacttacagaaatcaaaaaatcaccagaggggctttattttgataaaaaaatagatatcaaagagtcgcttatggagcgtcattcagagataatggatatttctgatattcaagtttcaggtcatgtggtgtatgaagatggtctctatctacttgactataatatggcttacgatattacattaccgtctagtcgttctatgaaaccagttgttttatctgaaaagcaaactattaatgaagtttttattgaagctgaaaatgttagcactaaaaaagagctcgttgatcaggagttggtcttaatattagaggaagatgatattaatttagaagaaagcgttatcgataatatcttgttaaatatacctcttcgtgttctggcagctgatgaggttggggtagaagcggatttatcaggtaaaaattggtcgttaatgactgaaaagcagtatgaagaaaaacaagctaaagaaaaagaaaaatctaatcctttcgcagccttagaaggtatgtttgatagtgat

SEQ ID NO: 4848 - protein, 177 aa, Streptococcus agalactiae
MLLTEIKKSPEGLYFDKKIDIKESLMERHSEIMDISDIQVSGHVVYEDGLYLLDYNMAYDITLPSSRSMKPVVLSEKQTINEVFIEAENVSTKKELVDQELVLILEEDDINLEESVIDNILLNIPLRVLAADEVGVEADLSGKNWSLMTEKQYEEKQAKEKEKSNPFAALEGMFDSD

SEQ ID NO: 4849 - DNA, 534 bp, Streptococcus pyogenes
atgatgttagctatttccgaaatcagaaaacacccagacggtctctcgtttgatcgtttatgtgatgtcaaaagtatgttacttgagcgtgaccaacagattattgacataaaggcagttaaagctgtcggtaatgttcgctatgataaggggctttatctgttagattatcaattgagttacgaagtgatattaccgtctagccgttctatggttccggtctgtttaagtgaagtccaacacattcaagaattatttatagaggcgacagatttagctgataagaaagagttggttgaagacaatctggtattagttttagacaaagacgctattaacctcgaagaaagtattgtggataatatcttacttgctattccggtacaggtcttgacagaggaagaaaagaaatcaaaagagttgccagcaggtcaaaattgggcagttttgacagaagaagactaccagtgtctaaaagaagaaaagcaaaaagaaaataatccttttgctagcttgcaagggttgtttgatgaa

SEQ ID NO: 4850 - protein, 178 aa, Streptococcus pyogenes
MMLAISEIRKHPDGLSFDRLCDVKSMLLERDQQIIDIKAVKAVGNVRYDKGLYLLDYQLSYEVILPSSRSMVPVCLSEVQHIQELFIEATDLADKKELVEDNLVLVLDKDAINLEESIVDNILLAIPVQVLTEEEKKSKELPAGQNWAVLTEEDYQCLKEEKQKENNPFASLQGLFDE

SEQ ID NO: 4851 - DNA, 888 bp, Streptococcus agalactiae
ttgctgtatcaacaaattgcaagtaataagagaaaaacagttgtcttgttaattgtcttcttctgtcttttagcagctattggagcagctgtaggttatttggtattaggcagctaccaatttgggcttgttctagctctaattattggggttatctatgcagtaagtatgatttttcaatcaactaatgttgttatgtcaatgaacaatgcgcgtgaagttacagaagatgaggcgccaaattattttcatattgttgaagatatggcaatgatagctcagatacctatgccacgcgttttcattgttgaagatgactccctaaatgcctttgccacaggctctaagccagaaaatgctgctgttgcagcaacgacaggcctattagctgttatgaaccgcgaagagttagagggtgttattggacatgaggttagtcatattcgtaattatgatatccgtatttcaaccattgcagtagctttagcgagtgctgtaactctaatatcaagcattggtagccgtatgttattttacggcggaggtcgtaggcgtgatgatgacagagaagatggtggaaacatcttggttttgattttctctattttatcactaatccttgcaccattagccgctagtttagttcaattagctatttcaagacagcgcgaatacttagcagacgctagttctgttgagttaacaagaaatccacaaggaatgatctctgctttagaaaaacttgatcgttctgaacctatggggcatccagtagatgatgctagtgcggctctctatatcaatgacccaacgaaaaaagaagggttaaagtctttattttatacgcatccaccaattgcagatcgtattgagcgtttgcgtcatatg

SEQ ID NO: 4852 - protein, 296 aa, Streptococcus agalactiae
MLYQQIASNKRKTVVLLIVFFCLLAAIGAAVGYLVLGSYQFGLVLALIIGVIYAVSMIFQSTNVVMSMNNAREVTEDEAPNYFHIVEDMAMIAQIPMPRVFIVEDDSLNAFATGSKPENAAVAATTGLLAVMNREELEGVIGHEVSHIRNYDIRISTIAVALASAVTLISSIGSRMLFYGGGRRRDDDREDGGNILVLIFSILSLILAPLAASLVQLAISRQREYLADASSVELTRNPQGMISALEKLDRSEPMGHPVDDASAALYINDPTKKEGLKSLFYTHPPIADRIERLRHM

SEQ ID NO: 4853 - DNA, 894 bp, Streptococcus pyogenes
atgctttatcaacagatttcacaaaataagcaacgaacagttgttttattagttggtttcttcgctctcttagcacttattggagcttcagcaggctatctgctgttagataattatgccatgggcttggtccttgctcttgtcattggggtgatttatgctaccagtatgatttttcaatccaccagtcttgtaatgagtatgaacaatgctagagaagttacagaaaaagaggctccaggctttttccatattgtcgaggatatggctatggtggcccagattccgatgccgagagtttttattattgaagatccttctttaaatgcttttgcgacaggatctagccctcaaaatgctgctgttgcagcaacgacaggtttacttgaagtcatgaatcgtgaagaacttgaaggtgttatcggccatgaaattagccacatccgaaattatgatatccgtatttcgactattgctgtagctttggcgagtgctgttaccgttatttctagtatcggtgggcgtatgctatggtatggtggcggttctcgcaggcaaagagatgacggagatgatgatgttttaagaatcattacattacttttgtcgttattatctttgcttttagcgcccctagtagcaagtttgattcagttggctatttctcgtcaaagagaatatctagctgatgctagttctgttgaactaacaagaaatccccaaggtatgattaaggctcttgaaaaattgcagttatctcagccaatgaagcatcctgttgatgatgctagtgcggccttgtatattaatgagcctcgcaaaaaaaggagcttcagttcattattcagcacccatcctcctattgaggagaggattgaaaggttaaaaaacatg

SEQ ID NO: 4854 - protein, 298 aa, Streptococcus pyogenes
MLYQQISQNKQRTVVLLVGFFALLALIGASAGYLLLDNYAMGLVLALVIGVIYATSMIFQSTSLVMSMNNAREVTEKEAPGFFHIVEDMAMVAQIPMPRVFIIEDPSLNAFATGSSPQNAAVAATTGLLEVMNREELEGVIGHEISHIRNYDIRISTIAVALASAVTVISSIGGRMLWYGGGSRRQRDDGDDDVLRIITLLLSLLSLLLAPLVASLIQLAISRQREYLADASSVELTRNPQGMIKALEKLQLSQPMKHPVDDASAALYINEPRKKRSFSSLFSTHPPIEERIERLKNM

SEQ ID NO: 4855 - DNA, 552 bp, Streptococcus agalactiae
atgggaactatgattttaatagcaattattgctttgtttgttatttggttgattgttgcttataacagtttagttagaagtcgcatgcatactaaagaatcatggagtcaaatagacgttcaattgaaacgtcgtaacgatttaattccaaacctaatcgaaactgttaaaggctatgctgcgtacgaagggaaaacacttgagaagattgcagaactgcgtgctcaagttgctaaagctaacacacctgctgaagcaatgacagcaagtaatgagctaacaagacagctttcaagtattttagcggttgctgaaaattacccagatttaaaagccaacaatagctttgttaaacttcaagaagaactaactaatacggaaaataaaatttcttattcacgtcagttatataacacaacaacatccaattataatgtgaaattagaaactttcccaagtaatattgttggaaaactatttgggttcaaaccaagccaattcttagaaactcctgaagaagaaaaagaagtgccaaaagtttcctttgacttt

SEQ ID NO: 4856 - protein, 184 aa, Streptococcus agalactiae
MGTMILIAIIALFVIWLIVAYNSLVRSRMHTKESWSQIDVQLKRRNDLIPNLIETVKGYAAYEGKTLEKIAELRAQVAKANTPAEAMTASNELTRQLSSILAVAENYPDLKANNSFVKLQEELTNTENKISYSRQLYNTTTSNYNVKLETFPSNIVGKLFGFKPSQFLETPEEEKEVPKVSFDF

SEQ ID NO: 4857 - DNA, 555 bp, Streptococcus pyogenes
atgccaacagttttgattatcttagtcgttttaggagtgcttgcgctatggttaatgattagttacaatagcctggttaaatctcggatgcacacaaaagaagcttggagtcagattgatgtgcaattaaagcgtcgtaatgacttgattccaaatcttattgaaaccgtaaagggatatgctagctacgagcaaaagacatttgaaaaaatcactgatttgcgtgcgcgtgttgcgaatgcctcaactcctcaagaaaccatggcggcttctaacgaattgagtaaacaagtgaccagtttgtttgccgttgctgaaaattacccagacttaaaagctaacgaaaacttcttgaaattacaagaagagttgaccaatacggaaaataaaatctcatattctcgtcaactctataattcaacaacgtctaattacaaccttcaattagaatctttcccaagcaatatcgctggtaaattatttggttttaaaccaagtgaattcttacaaacaccagaagctgaaaaagaagttccaaaagttgaatttaacttt

SEQ ID NO: 4858 - protein, 185 aa, Streptococcus pyogenes
MPTVLIILVVLGVLALWLMISYNSLVKSRMHTKEAWSQIDVQLKRRNDLIPNLIETVKGYASYEQKTFEKITDLRARVANASTPQETMAASNELSKQVTSLFAVAENYPDLKANENFLKLQEELTNTENKISYSRQLYNSTTSNYNLQLESFPSNIAGKLFGFKPSEFLQTPEAEKEVPKVEFNF

SEQ ID NO: 4859 - DNA, 723 bp, Streptococcus agalactiae
ttgaggtttactatgacaccccaagcattttatcaagttctgatagagcatggtattacacttactgacaaacagaaaaaacaatttgaaacttattttagacttcttgttgaatggaatgagaaaattaacctaacagctattacagataaggaagaggtttacttaaagcacttctatgattctattgcgccgattttacaaggttatattgacaatagtcctcttagcattttagatattggtgctggtgcaggttttcctagtattcctatgaaaatcctttatcctgaaattgatattactattattgattcactgaataaacgcattaattttctaaacatattagctaatgaacttgaactttcaggagttcacttcttccatgggcgcgctgaggactttggtcaagatagagtatttcgagctaaatttgatatcgtaacagctcgtgcagtagctaaaatgcaggttctagcagaattgacaataccttttcttaaagttaatggtcgcttgattgcactgaaagctgcagctgctgaagaggaattaatttctgcagaaaaagctttgaaaacactattttcacaagtaactgtaaataaaaattataagttacctaatggtgatgaccgaaatatcacaatcgttagcaagaaaaaagaaacgcctaataaataccctcgtaaagctggtactccaaacaagaagcctttg

SEQ ID NO: 4860 - protein, 241 aa, Streptococcus agalactiae
MRFTMTPQAFYQVLIEHGITLTDKQKKQFETYFRLLVEWNEKINLTAITDKEEVYLKHFYDSIAPILQGYIDNSPLSILDIGAGAGFPSIPMKILYPEIDITIIDSLNKRINFLNILANELELSGVHFFHGRAEDFGQDRVFRAKFDIVTARAVAKMQVLAELTIPFLKVNGRLIALKAAAAEEELISAEKALKTLFSQVTVNKNYKLPNGDDRNITIVSKKKETPNKYPRKAGTPNKKPL

SEQ ID NO: 4861 - DNA, 711 bp, Streptococcus pyogenes
atgacaccccaagacttttaccgaacactagaggaagatggtttttccttatcatcgaaacaaaaagaacaatttgacacctacttcaaatcactagtggaatggaacactaaaattaatttaacagctattacagaagaaaatgaggtttacctcaagcatttttatgattccatcgctcctattttacagggctttttagctaatgaaccaatcaaattattggacattggagctggagctggttttcctagcctacccatgaaaattcttttcccaaaccttgaggttaccattattgattctcttaataagcggatttcttttctgacactccttgctcaggaattgggcttggaaaatgtccacttttttcatggtagagcagaagatttcggacaggacaaggcctttcgaggtcaatttgatgttgttactgccagagcggttgctcggatgcaggttctatctgaattaaccatcccctttttaaaaattggaggaaaattaatcgccttaaaggcacaagctgctgaccaagagttagaagaagctaagaatgctctttgtcttctttttggtaaagtcattaaaaaccatagctaccaattgccaaatggagattctcgcttcatcaccattgttgagaagaaaaaggaaacacctaacaagtatccaagaaaagctggcttgcctaacaaaaaacctcta

SEQ ID NO: 4862 - protein, 237 aa, Streptococcus pyogenes
MTPQDFYRTLEEDGFSLSSKQKEQFDTYFKSLVEWNTKINLTAITEENEVYLKHFYDSIAPILQGFLANEPIKLLDIGAGAGFPSLPMKILFPNLEVTIIDSLNKRISFLTLLAQELGLENVHFFHGRAEDFGQDKAFRGQFDVVTARAVARMQVLSELTIPFLKIGGKLIALKAQAADQELEEAKNALCLLFGKVIKNHSYQLPNGDSRFITIVEKKKETPNKYPRKAGLPNKKPL

SEQ ID NO: 4863 - DNA, 102 bp, Streptococcus agalactiae
ttggtagtgttcattgttacacccacggttgctaaggcactagatgcctcaaagaaaagagaaaaaggatctatatggggattgagttccagaagaaggaga

SEQ ID NO: 4864 - protein, 34 aa, Streptococcus agalactiae
MVVFIVTPTVAKALDASKKREKGSIWGLSSRRRR

SEQ ID NO: 4865 - DNA, 1389 bp, Streptococcus agalactiae
ttgggagctagtatgaaacatttctttgattacaagacaatgtctgtcgcacgtaaactcagcattagttttatcgctgttatcctattgggaagtattttactttcacttccaatttttcaatatgctaacgcccctaaaacacattacattgatcaccttttcacgactgtttcaatggtatgtgtaactggtttatctgtttttcctatcagtaaggtttataacggttgggggcagattgtagctattttactcatgcaaacagggggacttggtttagtaacactaatgtcgttgtcttactataccctaagacgtaaaatgtcgttaaatgatcagacccttttgcagtcagcgataacttataacagttcgacagatttaaaaaaatatctctatatgatttttaaagtaactttaactttagaagttttagcagccagcattttagccatagattttattcctcgatttggtttgggtcatggtatctttaatagtatattcttagctgtctcagccttttgtaatgccggttttgataatctagaggcaacgagcttagctcaatttaaactaaatcctttggttaacattatcgtttgtttcttgattatttcaggaggacttggatttgccgtatggaaagatttaattgaagctactatacaaacatctcacaagggaccaaaattaatcaagacatttccaaaacgcctcagcaaccattctaaactggttttaaaaacaacaaccattattttactaacaggaactttgctttcttggttgttagagtttggaaattttagaacaattgctaatttatctctacctaaacaactaatggtcagctttttccaaacagttacgatgcgtaccgctggattttcaactattgattatacccaaactgatttcgcaaccaaccttgtttatattatccaaatgttaattggaggagctcctggtggaacggcaggaggatttaaagtcactgttatcgccattttactcttactatttaaagccgaactgagtggccaaagccaagtgacttttcattatcgaacaattccttccagtattattaaacaaacactatcgattttaactttcttttttatcatacttattagcggctatctccttcttctggaactcaatccccatatagatcctttttctcttttctttgaggcatctagtgccttagcaaccgtgggtgtaacaatgaacactaccaatcaattaactctgggcggtcgaattgtaattatgttcctcatgtttattggtcgagtcggtccaattaccgtactgctatcaattcttcagaaaaaagagaaggaaattcactatgctgaaacagaaattattctaggt

SEQ ID NO: 4866 - protein, 463 aa, Streptococcus agalactiae
MGASMKHFFDYKTMSVARKLSISFIAVILLGSILLSLPIFQYANAPKTHYIDHLFTTVSMVCVTGLSVFPISKVYNGWGQIVAILLMQTGGLGLVTLMSLSYYTLRRKMSLNDQTLLQSAITYNSSTDLKKYLYMIFKVTLTLEVLAASILAIDFIPRFGLGHGIFNSIFLAVSAFCNAGFDNLEATSLAQFKLNPLVNIIVCFLIISGGLGFAVWKDLIEATIQTSHKGPKLIKTFPKRLSNHSKLVLKTTTIILLTGTLLSWLLEFGNFRTIANLSLPKQLMVSFFQTVTMRTAGFSTIDYTQTDFATNLVYIIQMLIGGAPGGTAGGFKVTVIAILLLLFKAELSGQSQVTFHYRTIPSSIIKQTLSILTFFFIILISGYLLLLELNPHIDPFSLFFEASSALATVGVTMNTTNQLTLGGRIVIMFLMFIGRVGPITVLLSILQKKEKEIHYAETEIILG

SEQ ID NO: 4867 - DNA, 1389 bp, Streptococcus pyogenes
atgtctggaggaaacatgaaacgctcttttatcaaatctctttcagtcacacagcgcttaacatttagttttgccattgtgattctgattgggactctcttgttatccatgccctttacccattatcaaaatggtcctaataccgtctatcttgatcatttctttaatgtggtttccatggtttgtgtgactggactttctgttgttcccgtcgctgaagtgtataacggtatcggacaaaccattgctatggcactaatgcagattggttgtcttggcttggtgacgttaatagctgtgagtacttttgccctcaagcgaaaaatgcgattgagcgatcaaaccttgctccaatcagcgttaaatcgaggtgatagcaaagatttaaagcactaccttttttttgcttataaagtaacctttagtctagaagcctttgctgcgatagttatcatgattgacttcatcccccgcttcgggtggaaaaatggtatcttcaatagtatttttttagctgtgtcggcgttttgtaacgctggttttgacaatttaggatcttctagtttaaaagactttatgttaaatcctacattaaatgttatcattacgttcttgattatctctggtggacttggttttgcggtttgggttgatttaggagtagcttttaaaaaatacttttttgaaagacctcattgttatggggcaacttttcgtaaattatccaatcagtctcgtctagtactacaaaccacagctgttattctttttcttggaaccttcttaacctggtttttagaaaaagataacagcaaaaccattgccaattttagtttacatcagcaacttatggtttcattttttcaaacagtcactatgagaacagctggctttgcaacaatctcttataacgataccctagcaccgactaacattctttatatgattcaaatggttattggtggtgctcctggtggaacagctggtggtattaaagtgacgactgctgccattactttcttactctttaaagcggaactttcagggcaatcagaagttacctttcgtaaccgaattatcgcaaataagacaattaagcagaccatgacagttcttatcttcttttttgcagttcttatgataggttttattttattacttagcgtggagcctcatatcgctcctataccactcttatttgaatctatttctgccatcgcgacagttggggtatctatggatttgacaccacaattgtctactgctggacgtcttattgtcattgtcttgatgttcgtcggccgcgttggcccaattactgtcctcatcagtctgattcaacgaaaagaaaaaaccattcaatatgccactactgatattctagtgggt

SEQ ID NO: 4868 - protein, 463 aa, Streptococcus pyogenes
MSGGNMKRSFIKSLSVTQRLTFSFAIVILIGTLLLSMPFTHYQNGPNTVYLDHFFNVVSMVCVTGLSVVPVAEVYNGIGQTIAMALMQIGCLGLVTLIAVSTFALKRKMRLSDQTLLQSALNRGDSKDLKHYLFFAYKVTFSLEAFAAIVIMIDFIPRFGWKNGIFNSIFLAVSAFCNAGFDNLGSSSLKDFMLNPTLNVIITFLIISGGLGFAVWVDLGVAFKKYFFERPHCYGATFRKLSNQSRLVLQTTAVILFLGTFLTWFLEKDNSKTIANFSLHQQLMVSFFQTVTMRTAGFATISYNDTLAPTNILYMIQMVIGGAPGGTAGGIKVTTAAITFLLFKAELSGQSEVTFRNRIIANKTIKQTMTVLIFFFAVLMIGFILLLSVEPHIAPIPLLFESISAIATVGVSMDLTPQLSTAGRLIVIVLMFVGRVGPITVLISLIQRKEKTIQYATTDILVG

SEQ ID NO: 4869 - DNA, 669 bp, Streptococcus agalactiae
atgaaaacaaaaattattggtgtacttggtctaggaatatttggacaaacactcgcacaagaactaagtaactttgaacaagatgttattgctattgacagcaatcctgaaaatgtacaagctgtcgccgaagttgttacaaaagcagctatcggagacattactgatttagctttcctaaaacacatcgggatcagtgactgtgatactgttattattgctacaggaaacagtttagagagctcagtattggccgtaatgcactgtaaaaagttaggcgtcccacaagttattgctaaagctcgaaaccttgtatacgaagaagtactttatgaaattggtgctgatttggttatctctccggagcgagaatctgggcaaaatgttgctgcaaacctcatgagaaataaaattacagatgtcttccagattgaatctgatatttctgtcattgaatttaaaattcccaaatcatgggtagggaaaactgtcgaacaattaaatatccgtcacaagtttgatcttaacctcataggtatcagaaaagcaaaaaacaaacctgtcgataccgaagttccaatcaatagtccacttgaagaaggtattattctagtggctatcgctaactcagatgccttccaacgctatgactatttaggatactttaac

SEQ ID NO: 4870 - protein, 223 aa, Streptococcus agalactiae
MKTKIIGVLGLGIFGQTLAQELSNFEQDVIAIDSNPENVQAVAEVVTKAAIGDITDLAFLKHIGISDCDTVIIATGNSLESSVLAVMHCKKLGVPQVIAKARNLVYEEVLYEIGADLVISPERESGQNVAANLMRNKITDVFQIESDISVIEFKIPKSWVGKTVEQLNIRHKFDLNLIGIRKAKNKPVDTEVPINSPLEEGIILVAIANSDAFQRYDYLGYFN

SEQ ID NO: 4871 - DNA, 849 bp, Streptococcus agalactiae
ttgataatcaaggaggtaagaatggctaaacaattaattggttatcaagagggttatggctttctatacaggctatcaggtgccagtaagttactattttttattttagtttctgttgcttgcatgaccacttatgatacaagatttttaattgttgtttcattgggatcgctagtcttatttagattagcaaaaatcaaatggcaacaggtgtcctttgttatgactttagttgttgtattcgctgttttaaatattataatggtctatctttttgctccccattatggtgataagatttatggtagttcttctttattgttaaaaggaattggcccatatgatgtgactagccaagagttgttttacctctttaatctgattttaaaatacttttgtacagtgcctttagctcttttgtttttgatgacaactaatcctagtcagttcgcatcaagtttaaatcaattaggtttatcatataaaatagcttatgctgttagtttgacccttagatatatacctgatgttcaagaagaattttatacaatacgtcgagcacaagaggcaagaggaatagaattatcaaaaaaatcgaacttagtagcacgcattaaggggaatttgcagattgtcacaccattaatttttagctctctagaacgtattgatacagtagcaactgctatggaacttcgacgatttggtaaaaataaaagacgtacttggtactctaagcaatctttggaaaaaagtgacattgtcttaatcatacttgctctagctagtctgtttgtaagcctttatttaattcaccttaatcatggacgtttctataacccatggcaa

SEQ ID NO: 4872 - protein, 283 aa, Streptococcus agalactiae
MIIKEVRMAKQLIGYQEGYGFLYRLSGASKLLFFILVSVACMTTYDTRFLIVVSLGSLVLFRLAKIKWQQVSFVMTLVVVFAVLNIIMVYLFAPHYGDKIYGSSSLLLKGIGPYDVTSQELFYLFNLILKYFCTVPLALLFLMTTNPSQFASSLNQLGLSYKIAYAVSLTLRYIPDVQEEFYTIRRAQEARGIELSKKSNLVARIKGNLQIVTPLIFSSLERIDTVATAMELRRFGKNKRRTWYSKQSLEKSDIVLIILALASLFVSLYLIHLNHGRFYNPWQ

SEQ ID NO: 4873 - DNA, 1674 bp, Streptococcus agalactiae
atgaaagattttattgaatggaaggattttacctttcaatatgacgttcaatctgaaccaactttaaaagggattaacttaagcattcctaaaggtgaaaaggtcttgatattaggaccttcagggtcggggaagtcaacgcttggtcattgtttaaatggtattatcccaaatactcataaaggccaatatagtggtatttttacgattaaccataaaaatgcttttgacttgtcaatatatgacaagtctcatttagtttctacggttttacaagatccagatggccaatttataggattgacagtagcagaagatattgcttttgcattagaaaatgatgttgtagcacaggaagaaatggcctctatcgttgaaatgtgggcaaaacgtttagaaatagctcctcttttgtctaaacgtccacaagacttgtcgggaggacaaaaacaacgggttagtttagctggagttttagtagacgatagcccaattctattatttgatgagcctttggctaatctagatccacaatcgggacaagatatcatggcattggttgaccgtattcatcaagagcaagatgcgaccactattattattgaacatcgattggaagatgttttttatgagcgagtagatcgtgtagttctttttagtgatggacaaattatttataatggggagccggatcaacttttaaaaactaattttttatctgaatatggtattcgagaaccactgtatatttctgctctcaaaaatttaggatatgactttgaaaaacaaaatacaatgacgtctattgatgactttgatttcagtgaactattgatacctaaaatgcgagcattagatttagataaacatacagataaattattatcagtacagcatttgtcggtgtcatatgatttagagaataatactttagatgatgtttcgtttgatttatataaaggtcagcggttagctatcgttgggaaaaatggtgcaggtaaatctactttagctaaagcgttatgtcaatttatccctaataatgctactctaatttataataatgaagatgtcagtcaagactctataaaagaaagagcagaacgaattggctatgttttgcaaaatcccaatcagatgataagtcaagcgatggtttttgatgaagttgctctgggtctccgtttaagaggttttagtgataatgatatagaaagtcgtgtctacgatatattaaaggtttgtgggctctaccaatttaggaattggcctatatcggctctatcattcggtcagaaaaaacgtgttacgattgcttcgatactgattttaaatccagaagttattattttggatgaaccaacagctggtcaagatatgaagcattatactgaaatgatgtctttccttgataaactaagttgtgatggacataccattgttatgattacacatgatatgcagcttatgttagagtatacagatcgtgcaattgtaatcgacaatggtctgattgttgcagatgatcatcctattaacatcctttcaaatacagagcttttgaaaaagactcatttaaagaaaacgagtttatttgctttagcagacagattagggatatctccacagaaactaacacaatggtacattgataatcaaggaggtaagaatggc

SEQ ID NO: 4874 - protein, 558 aa, Streptococcus agalactiae
MKDFIEWKDFTFQYDVQSEPTLKGINLSIPKGEKVLILGPSGSGKSTLGHCLNGIIPNTHKGQYSGIFTINHKNAFDLSIYDKSHLVSTVLQDPDGQFIGLTVAEDIAFALENDVVAQEEMASIVEMWAKRLEIAPLLSKRPQDLSGGQKQRVSLAGVLVDDSPILLFDEPLANLDPQSGQDIMALVDRIHQEQDATTIIIEHRLEDVFYERVDRVVLFSDGQIIYNGEPDQLLKTNFLSEYGIREPLYISALKNLGYDFEKQNTMTSIDDFDFSELLIPKMRALDLDKHTDKLLSVQHLSVSYDLENNTLDDVSFDLYKGQRLAIVGKNGAGKSTLAKALCQFIPNNATLIYNNEDVSQDSIKERAERIGYVLQNPNQMISQAMVFDEVALGLRLRGFSDNDIESRVYDILKVCGLYQFRNWPISALSFGQKKRVTIASILILNPEVIILDEPTAGQDMKHYTEMMSFLDKLSCDGHTIVMITHDMQLMLEYTDRAIVIDNGLIVADDHPINILSNTELLKKTHLKKTSLFALADRLGISPQKLTQWYIDNQGGKNG

SEQ ID NO: 4875 - DNA, 636 bp, Streptococcus agalactiae
ttgtcaataaggtttcaaatcagcttgaaatatgataaaatagaacagattgtaagtgactgtttaagcttgtttttcagagaggtttttatgaatacaaacacaataaaaaaggttgtagcgactggaattggagctgcactttttatcattataggtatgctagttaatataccaacaccaattccaaatactaatattcaattgcagtatgcagttttagcattatttgcagttatttatggaccaggagttggtttttttactggttttatcggacacgcattgaaagattcgattcaatatggttctccgtggtggacttgggttttagttagtggtcttttaggtttgatgataggcttttttgctaaaaaattagctattcaattatctggcatgactaagaaggatttgcttctatttaatgtagttcaagttattgctaaccttataggttggtctgtcgttgcaccgtatggtgatattttcttttatagcgaacctgcaagcaaagtttttgcacaaggtttcttatcaagccttgtgaattccattactattggagtaggtggtacgcttttgttgctagcatacgctaaatcacgaccacaaaaaggtagtttatccaaagat

SEQ ID NO: 4876 - protein, 212 aa, Streptococcus agalactiae
MSIRFQISLKYDKIEQIVSDCLSLFFREVFMNTNTIKKVVATGIGAALFIIIGMLVNIPTPIPNTNIQLQYAVLALFAVIYGPGVGFFTGFIGHALKDSIQYGSPWWTWVLVSGLLGLMIGFFAKKLAIQLSGMTKKDLLLFNVVQVIANLIGWSVVAPYGDIFFYSEPASKVFAQGFLSSLVNSITIGVGGTLLLLAYAKSRPQKGSLSKD

SEQ ID NO: 4877 - DNA, 324 bp, Streptococcus agalactiae
gtgaacagaacgtctgtcgatgaatttaaggctgtctcacacgaatcctgtatcacccctacaatgaaaccaactcctacgacttgcattgcaacgtcatttgaaataccaaataagctacatgccaccggaatcaataaaagtgaaccaccagttacaccagaagctccacatgctgatacagcagcaaccacacttaataagaatgctgttggaaaatcaacagtaattcctaaagtatttactgctgctaaagtcaggatattaattgtaatagctgcaccagccatattgatagctgcaccaagcgggatagatactgag

SEQ ID NO: 4878 - protein, 108 aa, Streptococcus agalactiae
MNRTSVDEFKAVSHESCITPTMKPTPTTCIATSFEIPNKLHATGINKSEPPVTPEAPHADTAATTLNKNAVGKSTVIPKVFTAAKVRILIVIAAPAILIAAPSGIDTE

SEQ ID NO: 4879 - DNA, 558 bp, Streptococcus agalactiae
ttggtgggtacgatgttatttgtagctcttgtcgttaacccaatcattgcttttgttatgatgcgtaaaaatccttaccctttggtattacgatgcttaaaggattcaggtattacagctttctttacacgtagttctgcggcgaatattcctgttaatatgagactatgtgaggatttaggattagataaagacacttactcagtatctatcccgcttggtgcagctatcaatatggctggtgcagctattacaattaatatcctgactttagcagcagtaaatactttaggaattactgttgattttccaacagcattcttattaagtgtggttgctgctgtatcagcatgtggagcttctggtgtaactggtggttcacttttattgattccggtggcatgtagcttatttggtatttcaaatgacgttgcaatgcaagtcgtaggagttggtttcattgtaggggtgatacaggattcgtgtgagacagccttaaattcatcgacagacgttctgttcacggctgtagctgaaaaatcagtttttggaaaaaaa

SEQ ID NO: 4880 - protein, 186 aa, Streptococcus agalactiae
MVGTMLFVALVVNPIIAFVMMRKNPYPLVLRCLKDSGITAFFTRSSAANIPVNMRLCEDLGLDKDTYSVSIPLGAAINMAGAAITINILTLAAVNTLGITVDFPTAFLLSVVAAVSACGASGVTGGSLLLIPVACSLFGISNDVAMQVVGVGFIVGVIQDSCETALNSSTDVLFTAVAEKSVFGKK

SEQ ID NO: 4881 - DNA, 1212 bp, Streptococcus pyogenes
atgaaaaaaatatatgatttatgggttagggttagtctaatcaaaaaaataggtatcggtgttgtaataggagtcatgttgggcattttggctcctgatcttacaggttttagtattttaggaaagttatttgttggtggtttaaaggctatcgcacctttgcttgtatttgctttggtttcccaagctatctcccatcagaaaaaagggaaacagactaatatgacattaatcattgttctgtatttatttggtacctttgcgtcagctttagtagcagtactgacagcttatctattccctttgacgttagtgttaaatacacctgtaaatacagaattatcaccacctcaaggtgttgctgaagtttttcagtcacttctattaaaattagtggataatccgatcaatgctttagctactgccaattatattggtgtgctatcatgggcaattatttttggactagcattaaaggctgcaagtaaagaaacaaagcatcttataaaaacagcggcagaagttacttcacaaatagttgtttggatcatcaatctggcacctattgggattatgagtctggtgttcactacgatttctgaaaacggtgttggaatcttatctgattatgcttttttgatactagttttagtaggaacaatgctttttgtcgccttagtggttaatccacttattgcggttttgattacacgacaaaatccttatccccttgtcttgagatgtttacgtgagtcaggtcttacagcatttttcacacgaagttctgcagccaatattccagtcaatatgcaattatgccaaaaaattggattgagtaaagatacttattcagtgtcaattccacttggagcaactattaatatgggtggggcagcaattaccatcaatgtcctaacgcttgctgctgtacacacttttggtattcctattgattttctaacagccctcttacttagcgttgttgctgctgtctctgcttgtggtgcttctggtgttgctgggggatcgttgttacttattcctgtagcatgtagtttgtttggcatttcaaatgatcttgcgatgcaggtggttggtgttggttttattgttggtgttatccaggattcttgtgagacagccttaaattcgtcaaccgatgttctttttacagctattgctgaaaatgctttttggaaacgtaaaaaagca

SEQ ID NO: 4882 - protein, 404 aa, Streptococcus pyogenes
MKKIYDLWVRVSLIKKIGIGVVIGVMLGILAPDLTGFSILGKLFVGGLKAIAPLLVFALVSQAISHQKKGKQTNMTLIIVLYLFGTFASALVAVLTAYLFPLTLVLNTPVNTELSPPQGVAEVFQSLLLKLVDNPINALATANYIGVLSWAIIFGLALKAASKETKHLIKTAAEVTSQIVVWIINLAPIGIMSLVFTTISENGVGILSDYAFLILVLVGTMLFVALVVNPLIAVLITRQNPYPLVLRCLRESGLTAFFTRSSAANIPVNMQLCQKIGLSKDTYSVSIPLGATINMGGAAITINVLTLAAVHTFGIPIDFLTALLLSVVAAVSACGASGVAGGSLLLIPVACSLFGISNDLAMQVVGVGFIVGVIQDSCETALNSSTDVLFTAIAENAFWKRKKA

SEQ ID NO: 4883 - DNA, 771 bp, Streptococcus agalactiae
atgtctccagataaggtggagcaaaagacgaaatttaaaaatatttctctaagttctaataaactgttggctaaggaaaacactatgtctgtcctttggtatcaaaattctgcagaagccaaggctttatatttacaaggttataatgttgctaaaatgaagttagatgattggttacaaaagcccagtgaaaaaccatattcaattatcttagatttagatgaaacagttttagataatagcccatatcaagcaaagaatattaaagatggctctagtttcacgccagagagttgggataaatgggtgcaaaagaaatcagctaaggctgttgcgggtgccaaagaatttttgaagtatgctaatgaaaagggaataaaaatttattatgtctcagatcgtacagatgctcaagttgatgcgactaaagaaaatttagagaaggaaggtatacctgttcaagggaaagaccacttgcttttccttaaaaaaggaatgaaatctaaagagagtcgccgtcaggcagttcaaaaagataccaatttaattatgctttttggagataatttagttgattttgctgatttttctaaatcatctagtacagatagagaacaactactaactaaacttcaaagtgagtttggtagtaaatttattgttttcccaaatcctatgtacggttcttgggaaagtgctatttatcaaggaaaacatctggatgttcaaaaacaattgaaagaacgacaaaaaatgttgcattcgtatgat

SEQ ID NO: 4884 - protein, 257 aa, Streptococcus agalactiae
MSPDKVEQKTKFKNISLSSNKLLAKENTMSVLWYQNSAEAKALYLQGYNVAKMKLDDWLQKPSEKPYSIILDLDETVLDNSPYQAKNIKDGSSFTPESWDKWVQKKSAKAVAGAKEFLKYANEKGIKIYYVSDRTDAQVDATKENLEKEGIPVQGKDHLLFLKKGMKSKESRRQAVQKDTNLIMLFGDNLVDFADFSKSSSTDREQLLTKLQSEFGSKFIVFPNPMYGSWESAIYQGKHLDVQKQLKERQKMLHSYD

SEQ ID NO: 4885 - DNA, 852 bp, Streptococcus pyogenes
atgaaatccaaaaaagttgttagtgttatatcacttaccttatccctttttttggtgacaggttgtgctaaagttgataacaacaaatcagttaatcttaagcctgctactaaacaaacctataatagctatagtgatgaccaattaagatcgcgtgaaaataccatgtctgttttatggtaccagcgagctgcggaaactcaagcgctttatttacaggggtatcagttagcaacggatcgcttaaaagaacaactcaataaaccaacggataaaccttattcaattgtattagatattgacgaaacagttcttgataatagcccttatcaagctaaaaatgttttggaaggaacaggatttacacctgaaagctgggattattgggtacaaaagaaagaagcaaaaccggttgctggtgctaaagactttttgcaatttgcagaccaaaatggtgttcaaatttactacatttcagacagatcaactactcaagtagatgctacaatggaaaatctccaaaaagaaggtattccagtacaaggtcgtgatcatcttctattcttagaaaaaggcgtaaaatcaaaggagagtcgtcgtcaaaaggtcaaagaaacaactaatgtaacgatgctatttggtgataatcttctagattttgctgatttttcaaaaaaatctcaagaagatagaacagctttattatcagatttacaagaagagtttggaagacgctttatcattttccctaatcctatgtatggttcatgggaaggtgccatttataaaggtgaaaagctggatgtgcttaagcaactagaggaacgccgtaaaagtttaaaaagctttaaa

SEQ ID NO: 4886 - protein, 284 aa, Streptococcus pyogenes
MKSKKVVSVISLTLSLFLVTGCAKVDNNKSVNLKPATKQTYNSYSDDQLRSRENTMSVLWYQRAAETQALYLQGYQLATDRLKEQLNKPTDKPYSIVLDIDETVLDNSPYQAKNVLEGTGFTPESWDYWVQKKEAKPVAGAKDFLQFADQNGVQIYYISDRSTTQVDATMENLQKEGIPVQGRDHLLFLEKGVKSKESRRQKVKETTNVTMLFGDNLLDFADFSKKSQEDRTALLSDLQEEFGRRFIIFPNPMYGSWEGAIYKGEKLDVLKQLEERRKSLKSFK

SEQ ID NO: 4887 - DNA, 1194 bp, Streptococcus agalactiae
atggctaaattgactgttaaagacgttgatttgaaaggtaaaaaagtcctcgttcgtgttgactttaatgtgcctttgaaagacggcgttatcactaacgacaaccgtatcactgcggctcttccaacaatcaagtatatcatcgaacaaggtggtcgtgctatcctcttctctcaccttggacgtgttaaagaagaagctgacaaagaaggaaaatcacttgcaccggtagctgctgatttagctgctaaacttggtcaagatgttgtattcccaggtgttactcgtggtgcaaaattagaagaagcaatcaatgctttggaagatggacaagttcttttggttgaaaacactcgttttgaagatgttgacggtaagaaagaatctaagaatgacgaagaacttggtaaatactgggcttcacttggagatggaatcttcgttaacgatgcatttggtacagcacaccgtgctcatgcatcaaacgtaggtatttcagcaaacgttgaaaaagctgtagctggtttccttcttgaaaacgaaattgcttacatccaagaagcagttgaaactccagaacgcccattcgtagctattcttggtggctcaaaagtttctgataagattggtgttatcgaaaaccttcttgaaaaagctgataaagttcttatcggtggtggtatgacttacacattctacaaagctcaaggtatcgaaatcggtaactcacttgtagaagaagacaaattggatgttgctaaagacctccttgaaaaatcaaacggtaaattgatcttgccagttgactcaaaagaagcaaacgcatttgctggttatactgaagttcgcgacactgaaggtgaagcagtttcagaagggttccttggtcttgacatcggtcctaaatcaatcgctaaatttgatgaagcacttactggtgctaaaacagttgtatggaacggacctatgggtgtctttgaaaaccctgacttccaagctggtacaatcggtgtaatggacgctatcgttaaacaaccaggcgttaaatcaatcatcggtggtggtgattcagcagcagctgctatcaaccttggccgtgctgacaaattctcatggatctctactggtggtggagcaagcatggaattgctcgaaggtaaagtattaccaggtttggcagcattgactgaaaaa

SEQ ID NO: 4888 - protein, 398 aa, Streptococcus agalactiae
MAKLTVKDVDLKGKKVLVRVDFNVPLKDGVITNDNRITAALPTIKYIIEQGGRAILFSHLGRVKEEADKEGKSLAPVAADLAAKLGQDVVFPGVTRGAKLEEAINALEDGQVLLVENTRFEDVDGKKESKNDEELGKYWASLGDGIFVNDAFGTAHRAHASNVGISANVEKAVAGFLLENEIAYIQEAVETPERPFVAILGGSKVSDKIGVIENLLEKADKVLIGGGMTYTFYKAQGIEIGNSLVEEDKLDVAKDLLEKSNGKLILPVDSKEANAFAGYTEVRDTEGEAVSEGFLGLDIGPKSIAKFDEALTGAKTVVWNGPMGVFENPDFQAGTIGVMDAIVKQPGVKSIIGGGDSAAAAINLGRADKFSWISTGGGASMELLEGKVLPGLAALTEK

SEQ ID NO: 4889 - DNA, 1194 bp, Streptococcus pyogenes
atggctaaattgactgttaaagacgttgatttgaaaggtaaaaaagtcctcgttcgtgttgactttaatgtgcctttgaaagacggcgttatcactaacgacaaccgtatcactgcggctcttccaacaatcaagtatatcatcgaacaaggtggtcgtgctatcctcttctctcaccttggacgtgttaaagaagaagctgacaaagaaggaaaatcacttgcaccggtagctgctgatttagctgctaaacttggtcaagatgttgtattcccaggtgttactcgtggttcaaaattagaagaagcaatcaatgctttggaagatggacaagttcttttggttgaaaacactcgttttgaagatgttgacggtaagaaagaatctaagaatgacgaagaacttggtaaatactgggcttcacttggagatggaatcttcgttaacgatgcatttggtacagcacaccgtgctcacgcatcaaacgtaggtatttcagcaaacgttgaaaaagctgtagctggtttccttcttgaaaacgaaattgcttacatccaagaagcagttgaaactccagaacgtccattcgtagctattcttggtggatcaaaagtttctgataagattggtgttatcgaaaatcttcttgaaaaagctgataaagttcttatcggtggtggtatgacttacacattctacaaagctcaaggtatcgaaatcggtaactcacttgtagaagaagacaaattggatgttgctaaagacctccttgaaaaatcaaatggtaaattgatcttgccagttgactcgaaagaagcaaacgcatttgctggttacactgaagttcgcgacactgaaggtgaagcagtttcagaaggcttccttggtcttgacatcggtcctaaatcaatcgctgagtttgaccaagcacttactggtgctaaaacagttgtttggaatggtccaatgggtgtctttgaaaaccctgacttccaagctggtacaatcggtgtcatggacgctatcgttaaacaaccaggcgttaaatccatcatcggtggtggtgattcagcagctgctgctatcaaccttggccgtgctgacaaattctcatggatcagtactggcggaggcgctagcatggaacttctcgagggtaaagtattaccaggtttggcagcattgactgaaaaa

SEQ ID NO: 4890 - protein, 398 aa, Streptococcus pyogenes
MAKLTVKDVDLKGKKVLVRVDFNVPLKDGVITNDNRITAALPTIKYIIEQGGRAILFSHLGRVKEEADKEGKSLAPVAADLAAKLGQDVVFPGVTRGSKLEEAINALEDGQVLLVENTRFEDVDGKKESKNDEELGKYWASLGDGIFVNDAFGTAHRAHASNVGISANVEKAVAGFLLENEIAYIQEAVETPERPFVAILGGSKVSDKIGVIENLLEKADKVLIGGGMTYTFYKAQGIEIGNSLVEEDKLDVAKDLLEKSNGKLILPVDSKEANAFAGYTEVRDTEGEAVSEGFLGLDIGPKSIAEFDQALTGAKTVVWNGPMGVFENPDFQAGTIGVMDAIVKQPGVKSIIGGGDSAAAAINLGRADKFSWISTGGGASMELLEGKVLPGLAALTEK

SEQ ID NO: 4891 - DNA, 537 bp, Streptococcus agalactiae
atgaaaacgttaaaaaaattattatctaattacaagtttgatattaaaaagtttaaattgggaatgagaacatttaaaacaggcttatcggtctttttagttttattggtttttcatttatttggttggaaagggcttcaaattggtgctctaactgctgtatttagtttaagagaagactttgataaaagcgtgcactttggtttttctagaattattggtaatagtataggtggcttactctccttagtattttttgcattcaatgagatatttcatcaagctttttgggtcactttattaattgttcctatttgtaccatgttatgtatcatgattaatgttgcttgtaataataaatcaggtattattgggggaacagccgcattacttattataactttatctatcccaagcggagagacaattctatatgtttttgcacgtatttttgaaactttttgtggtgtttttattgcaatgatggttaatacagatattgaaatacttcggaaaaaactaaaaaataacaaatta

SEQ ID NO: 4892 - protein, 179 aa, Streptococcus agalactiae
MKTLKKLLSNYKFDIKKFKLGMRTFKTGLSVFLVLLVFHLFGWKGLQIGALTAVFSLREDFDKSVHFGFSRIIGNSIGGLLSLVFFAFNEIFHQAFWVTLLIVPICTMLCIMINVACNNKSGIIGGTAALLIITLSIPSGETILYVFARIFETFCGVFIAMMVNTDIEILRKKLKNNKL

SEQ ID NO: 4893 - DNA, 549 bp, Streptococcus pyogenes
atgaaaacgttaagaaaattattatctaattacaagtttgatattaaaaagtttaaattgggaatgagaacattgaaaacaggcttatcggtctttttagttttattggtttttcatttatttggttggaaagggctccaaattggtgctctaactgctgtatttagtttaagagaagactttgataaaagcgtgcactttggcttttctagaattattggtaatagtataggtggcctactctccttagtattttttgcattcaatgagatatttcatcaagctttttgggttactttattaattgttcctatttgtaccatgttatgtatcatggttaatgttgcatgtaataataaatcaggtattattggggcagtggctgctcttttgattattacactgtctattccaacaggacaaacgtttatttatgtgacttcgcgggtatttgaaacattttgtggcgtctttgtagctattttagttaatactgatgttgaacttattaaaaataaatggtttaacaaaaaacacagtgatgttaga

SEQ ID NO: 4894 - protein, 183 aa, Streptococcus pyogenes
MKTLRKLLSNYKFDIKKFKLGMRTLKTGLSVFLVLLVFHLFGWKGLQIGALTAVFSLREDFDKSVHFGFSRIIGNSIGGLLSLVFFAFNEIFHQAFWVTLLIVPICTMLCIMVNVACNNKSGIIGAVAALLIITLSIPTGQTFIYVTSRVFETFCGVFVAILVNTDVELIKNKWFNKKHSDVR

SEQ ID NO: 4895 - DNA, 369 bp, Streptococcus agalactiae
atgaaagaaagagaacttaggcgtacaatggctgtattcccgattggagctgttatgaagttgacagatttgactgccagacaaattcgctattatgaggatcaagggttaatcacacctgaacgtactgaaggtaaccgccgcatgttttcactgaatgatatggaccgcttactggaaataaaagacttcattagcgatggtttgcatatttctgatattaaaaatgaatacatgcaaagacaacataagtccaaagagaaacaaaagtcattatcagatgccgaggttcgtcgacttttacaagatgagctccgtaatcaagggcgtttttcaagtccttcacagcacattggaaatatgcatttg

SEQ ID NO: 4896 - protein, 123 aa, Streptococcus agalactiae
MKERELRRTMAVFPIGAVMKLTDLTARQIRYYEDQGLITPERTEGNRRMFSLNDMDRLLEIKDFISDGLHISDIKNEYMQRQHKSKEKQKSLSDAEVRRLLQDELRNQGRFSSPSQHIGNMHL

SEQ ID NO: 4897 - DNA, 369 bp, Streptococcus pyogenes
atgaaagaaaaagaacttagacgctcaatggctgtttttcctattggaacggtgatgacattaacagatctctctgcgagacaaattcgctattatgaagatcaaggtttaattaagcctgaacgaacgcaagggaatcggcgtatgttttccttaaatgacatggaccgacttttggaaattaaagattttttgtctgagggattaaatattgcagctattaaacgcgaatatgtcgagcgtcaaggtaagttaatgcaaaaacaaaaagctctaacagatgcagatgtcagacggatcttacatgatgaaatgctgacacaaagcggtttttctactccctcacagcatattggtaattttcgtatt

SEQ ID NO: 4898 - protein, 123 aa, Streptococcus pyogenes
MKEKELRRSMAVFPIGTVMTLTDLSARQIRYYEDQGLIKPERTQGNRRMFSLNDMDRLLEIKDFLSEGLNIAAIKREYVERQGKLMQKQKALTDADVRRILHDEMLTQSGFSTPSQHIGNFRI

SEQ ID NO: 4899 - DNA, 1344 bp, Streptococcus agalactiae
atgactatcacagcagaagatattcgtcgcgaagttaaggaaaaaaatgttaccttcctccgtttgatgttcacagatatcttaggagtaatgaaaaatgtcgaaattccggctacagatgaacaattagacaaagttttatcaaataaagcaatgtttgatggatcttctattgagggctttgttcgtatcaatgaatctgatatgtatttatatcctgatttagatacttggattgtctttccttggggagatgaaaatggagctgttgcaggtctaatctgtgatatctatacagcagaaggagaaccttttgccggagatccacgtggaaatcttaagcgtaatatgaaacgtatgcaagagatgggctataagtcatttaacttaggaccagaacctgaatttttcctatttaaaatggatgaaaatggtaacccaacacttgatgttaatgacaaaggaggctactttgacttagctccaacagacttagcagataatacacgtcgtgaaattgttaatgtcttaacacaaatgggctttgaagttgaagctagtcatcatgaagtagcagttggacagcatgaaattgactttaaatatgatgatgttttaaaagcctgtgacaacattcaattatttaaattggttgttaaaacaattgctcgtaagcatggtttatatgctacttttatggcaaaacctaagtttggtatcaatggttcaggtatgcattgtaatatgtctctttttgataatgaagggaacaatgctttctttgatccagaagatccacgtggaatgcaattatcagaggatgcctactactttttaggtgggttaatgaaacacgcttacaattacacagctatcattaatccaactgttaattcttataaacgtttggtaccaggatacgaagcaccagtttacgttgcttgggcaggtcgcaatcgttcgccacttattcgtgtacctgcatctcgaggtatgggaacacgcctagaattgcgctcggttgacccaacagcaaatccttatcttgctttatcagtacttttgggatcaggacttgagggaatcgagaataaaattgaagcaccagaaccaattgagacaaatatctatgctatgactgtagaagaacgtcgtcaagcaggtattgttgatttaccatctactcttcataatgctcttgaagcacttgaagaagatgaagtggtaaaagcggccctaggaactcatatctatactaatttcttagacgctaagcgtattgaatgggcaagttatgcgacttatgtttcacaatgggaaattgataattacctagatttatat

SEQ ID NO: 4900 - protein, 448 aa, Streptococcus agalactiae
MTITAEDIRREVKEKNVTFLRLMFTDILGVMKNVEIPATDEQLDKVLSNKAMFDGSSIEGFVRINESDMYLYPDLDTWIVFPWGDENGAVAGLICDIYTAEGEPFAGDPRGNLKRNMKRMQEMGYKSFNLGPEPEFFLFKMDENGNPTLDVNDKGGYFDLAPTDLADNTRREIVNVLTQMGFEVEASHHEVAVGQHEIDFKYDDVLKACDNIQLFKLVVKTIARKHGLYATFMAKPKFGINGSGMHCNMSLFDNEGNNAFFDPEDPRGMQLSEDAYYFLGGLMKHAYNYTAIINPTVNSYKRLVPGYEAPVYVAWAGRNRSPLIRVPASRGMGTRLELRSVDPTANPYLALSVLLGSGLEGIENKIEAPEPIETNIYAMTVEERRQAGIVDLPSTLHNALEALEEDEVVKAALGTHIYTNFLDAKRIEWASYATYVSQWEIDNYLDLY

SEQ ID NO: 4901 - DNA, 1344 bp, Streptococcus pyogenes
atggcaataacagtagctgacattcgtcgtgaagtcaaagaaaaaaatgtaacgtttcttcgcttgatgttcactgatatcatgggcgttatgaaaaatgtggagattcctgcaactaaagaacagttagacaaagtattgtctaacaaggttatgtttgatggttcatctatcgaaggttttgtacggatcaatgagtcagatatgtacctttaccccgatttagacacttggattgtttttccctggggagatgaaaatggagcagttgcaggtttaatttgtgatatttatacagcagaaggaaagccttttgcaggagatcctagaggaaatttaaaaagagccctgaaacacatgaacgagatcggctacaaatcatttaatcttggaccagaaccagaatttttcctttttaagatggatgataaaggtaatccgacacttgaagttaacgataatggtggttattttgatttagcgccaattgacttagcagacaacacgcgccgtgaaattgtgaatattttaacgaaaatgggttttgaagtggaagctagtcatcatgaagtggctgttggtcaacatgagattgattttaaatatgcagatgttttgaaagcttgtgataatattcaaatttttaagctagttgtaaaaacgattgcccgtgaacatggactttatgctactttcatggctaaaccaaaatttggaatagctggatcagggatgcactgtaacatgtctttgtttgataaccaaggtaataatgctttttatgatgaagctgataagcgagggatgcagttatcagaagatgcttattatttcttgggaggactaatgaagcatgcttataactacactgctatcactaaccctacagtgaattcttataaacgattagttccaggttatgaggcacctgtttatgtcgcttgggctggaagtaatcgttcaccgcttatccgtgttccagcatcacgtggtatgggaacgcgtttggagttacgttcggttgatccgacagctaatccttatttagccttggctgttctcttggaagctggattagatggtatcattaacaaaattgaagctccagaacccgttgaagctaacatttataccatgacaatggaagaacgaaatgaagcaggcattattgatttgccatcaacgcttcataatgccttaaaagctcttcaaaaagatgatgtggtacaaaaggcactaggttaccatatctacactaatttcttagaagcaaaacgaattgaatggtcttcctatgcaacttttgtttctcaatgggaaattgaccattatattcataattat

SEQ ID NO: 4902 - protein, 448 aa, Streptococcus agalactiae
MAITVADIRREVKEKNVTFLRLMFTDIMGVMKNVEIPATKEQLDKVLSNKVMFDGSSIEGFVRINESDMYLYPDLDTWIVFPWGDENGAVAGLICDIYTAEGKPFAGDPRGNLKRALKHMNEIGYKSFNLGPEPEFFLFKMDDKGNPTLEVNDNGGYFDLAPIDLADNTRREIVNILTKMGFEVEASHHEVAVGQHEIDFKYADVLKACDNIQIFKLVVKTIAREHGLYATFMAKPKFGIAGSGMHCNMSLFDNQGNNAFYDEADKRGMQLSEDAYYFLGGLMKHAYNYTAITNPTVNSYKRLVPGYEAPVYVAWAGSNRSPLIRVPASRGMGTRLELRSVDPTANPYLALAVLLEAGLDGIINKIEAPEPVEANIYTMTMEERNEAGIIDLPSTLHNALKALQKDDVVQKALGYHIYTNFLEAKRIEWSSYATFVSQWEIDHYIHNY

SEQ ID NO: 4903 - DNA, 507 bp, Streptococcus agalactiae
atggaggaaaacatgaacataaaacaattaaagtctaaaacaatgcttggaacagtggctttggtgtccgctttttcatttgcttcaacaaatgcagatgcgaatacatataactatgcagtagatgtagactacctagcaagtgcggaggaaattgctcaagcacatccagctagtaatacgtttccactaggtcaatgcacatggggtgtaaaggagatggcaacatgggcaggtaactggtggggaaacggtggtgattgggctgcgagcgccgcatcagctgattatacagtagggacacaaccgcgcgtgggttctatcgtatgttggactgatggtagttatggacatgtggcttatgttacagctgtagatcctgtcactaataaaattcaggttttagaatctaattatgcaggtcatcaatggattgataattatcgtggttggtttgatccacaaaatacagtaacaccaggggtagttagctacatttatccgaat

SEQ ID NO: 4904 - protein, 169 aa, Streptococcus agalactiae
MEENMNIKQLKSKTMLGTVALVSAFSFASTNADANTYNYAVDVDYLASAEEIAQAHPASNTFPLGQCTWGVKEMATWAGNWWGNGGDWAASAASADYTVGTQPRVGSIVCWTDGSYGHVAYVTAVDPVTNKIQVLESNYAGHQWIDNYRGWFDPQNTVTPGVVSYIYPN

SEQ ID NO: 4905 - DNA, 90 bp, Streptococcus agalactiae
atggtattgattaatttattgacacttgttgtattaccagggattgggcttgatgagaaaatcacagtatcaccaggctgcaaagtaact

SEQ ID NO: 4906 - protein, 30 aa, Streptococcus agalactiae
MVLINLLTLVVLPGIGLDEKITVSPGCKVT

SEQ ID NO: 4907 - DNA, 1677 bp, Streptococcus agalactiae
atgtcaaatatcaacttaaaacccgaagaagttggggtttatgcgattggtggtctcggtgaaatcggaaaaaatacttacggtatcgaatatcaagacgaaattattattgtagacgctggtattaaattccctgaagatgatcttttgggaatagattatgttatcccagactattcatatatcgttgaaaacattgaccgtatcaaggcccttgttataactcatgggcacgaggaccacatcggtggtattccttttctattaaaacaagctaatttaccgatttatgcaggtcctctcgctcttgctctaatcaaaggtaagttagaagaacatggtttacttcgtgacgctacattatacgaaatccacgctaatacagagctgacttttaaaaacttaagcgttacatttttccgcactactcactccattcctgaaccattaggtattgttattcatacccctcaaggtaaggttatttgtacaggtgacttcaaatttgactttacacctgttggggagcccgctgacttacatcgtatggctgctctaggtgaagatggtgtcctctgccttttatcagactcgacaaatgctgaagttccaaccttcactaattccgaaaaaattgttgggcaatctattatgaagattatcgaaggtatcgagggacgtattattttcgcctcttttgcttcaaacatcttccgactccaacaggctgctgaagctgctgttaaaactggtcgtaaaattgctgtttttggacggtcaatggaaaaggcaattgttaacggtattgaacttggctatattaaagttccaaaaggtaccttcattgagccaagcgaacttaaaaatcttcatgctagtgaagttttaattatgtgtacaggtagtcaaggtgagtctatggcagcacttgctcgtatcgctaatggtactcatcgtcaagttactttgcagcctggtgatactgtgattttctcatcaagcccaatccctggtaatacaacaagtgtcaataaattaatcaataccattcaagaagctggtgtcgatgttattcatggtaaaattaacaatatccatacctccggccatggtggtcaacaagaacaaaaattaatgttacgcttgattaaaccaaagtatttcatgcccgtacacggtgagtatcgcatgcaaaaagtccatgctggtttagcagttgacacaggtattcctaaagagaatatcttcattatggaaaacggtgatgttttagctttaacgagcgactctgctcgtattgctggacatttcaatgctcaagatatctacgttgatgggaatggtattggcgatattggtgcggcagttctacgtgaccgccacgacttatctgaagatggtgttgtccttgccgttgctaccgttgatttcgattcaaaaatgattttagctggaccagacatccttagccgaggctttatctatatgagagaatctggggaccttattcgcgaaagccaacatatcttattcaatgctattcgtattgcactgaaaaataaagatgcaagtatccaatcagtaaatggagctattgttaatgccttacgcccattcttatatgaaaaaactgagcgtgagcctatcattattcctatggtccttacccctgataaa

SEQ ID NO: 4908 - protein, 559 aa, Streptococcus agalactiae
MSNINLKPEEVGVYAIGGLGEIGKNTYGIEYQDEIIIVDAGIKFPEDDLLGIDYVIPDYSYIVENIDRIKALVITHGHEDHIGGIPFLLKQANLPIYAGPLALALIKGKLEEHGLLRDATLYEIHANTELTFKNLSVTFFRTTHSIPEPLGIVIHTPQGKVICTGDFKFDFTPVGEPADLHRMAALGEDGVLCLLSDSTNAEVPTFTNSEKIVGQSIMKIIEGIEGRIIFASFASNIFRLQQAAEAAVKTGRKIAVFGRSMEKAIVNGIELGYIKVPKGTFIEPSELKNLHASEVLIMCTGSQGESMAALARIANGTHRQVTLQPGDTVIFSSSPIPGNTTSVNKLINTIQEAGVDVIHGKINNIHTSGHGGQQEQKLMLRLIKPKYFMPVHGEYRMQKVHAGLAVDTGIPKENIFIMENGDVLALTSDSARIAGHFNAQDIYVDGNGIGDIGAAVLRDRHDLSEDGVVLAVATVDFDSKMILAGPDILSRGFIYMRESGDLIRESQHILFNAIRIALKNKDASIQSVNGAIVNALRPFLYEKTEREPIIIPMVLTPDK

SEQ ID NO: 4909 - DNA, 1680 bp, Streptococcus pyogenes
atgacaaatatcagtttaaaacctaatgaagttggggtgtttgccattggtggtctgggagagattgggaagaatacttatggtattgagtatcaagacgaaatcattatcgttgatgccggtatcaaattcccagaagatgatcttttgggaattgattacgttattccagactattcttacattgtcgataacttagaccgggtcaaagctcttgttattacacatggtcacgaagaccacattggtggtattccatttcttctcaaacaggctaatatccctatctacgcaggacctttagcacttgctcttatccgtggtaaattggaagaacatggtctttggcgtgaagcaactgtttacgaaatcaatcacaacaccgagttaacttttaaaaacatgagcgtcactttcttcaagactactcattccattccagaaccggtcggtattgttatccacacccctcaaggtaagattatctgtactggtgattttaaatttgacttcacgccagtaggagatcctgcagatttacaacgtatggcagcgcttggtgaagaaggtgtcctttgcttattatcagactcaactaatgctgaaatcccaacctttactaactctgaaaaagttgttggccaatccattttaaaaattatcgaaggtattcatggtcgtattatttttgcttccttcgcttcaaacatctaccgtttgcaacaggctgcagaagctgctgttaaaacgggacgtaaaattgccgtttttggtcgttctatggaaaaagcaattgttaacggtattgaacttggctatattaaagttccaaaaggtaccttcattgagccaagcgaacttaaaaatcttcatgctagtgaagttttaattatgtgtacaggtagtcaaggtgagtctatggcagcacttgctcgtatcgctaatggcactcatcgtcaagtaactttacagcctggtgatactgtgattttctcatcaagtccaatccctggtaataccacaagtgtcaataaattaatcaataccatccaagaagctggtgttgatgttattcatggaaaagtcaataatattcatacttctggtcatggaggacagcaagaacaaaagctcatgcttagtttgattaaaccaaaatatttcatgccagtacatggtgagtatcgcatgcaaaaagttcatgcaggactggcgatggatattggtattccaaaagaaaatatctttattatggaaaatggagacgttctagctttaaccagtgacagtgcgcgtattgctggtcactttaatgcccaagacatctacgtggatggtaatggcatcggggatattggagcagccgttttacgggaccgccgtgatttgtcagaagatggtgttgtcttagctgttgcaactgttgattttaacacacaaatgattttagctggaccagatattctgagccgtggtttcatttatatgcgtgagtcaggtgacttgatccgcgaaagccaacgtgtgctctttaacgctatccgtattgctttaaaaaataaggatgctagcatccaatcagttaacggtgctatcgtcaatgctcttcgtccattcttgtatgaaaagactgagcgtgaaccaattatcattccgatggtcttaacacctgataagcac

SEQ ID NO: 4910 - protein, 560 aa, Streptococcus pyogenes
MTNISLKPNEVGVFAIGGLGEIGKNTYGIEYQDEIIIVDAGIKFPEDDLLGIDYVIPDYSYIVDNLDRVKALVITHGHEDHIGGIPFLLKQANIPIYAGPLALALIRGKLEEHGLWREATVYEINHNTELTFKNMSVTFFKTTHSIPEPVGIVIHTPQGKIICTGDFKFDFTPVGDPADLQRMAALGEEGVLCLLSDSTNAEIPTFTNSEKVVGQSILKIIEGIHGRIIFASFASNIYRLQQAAEAAVKTGRKIAVFGRSMEKAIVNGIELGYIKVPKGTFIEPSELKNLHASEVLIMCTGSQGESMAALARIANGTHRQVTLQPGDTVIFSSSPIPGNTTSVNKLINTIQEAGVDVIHGKVNNIHTSGHGGQQEQKLMLSLIKPKYFMPVHGEYRMQKVHAGLAMDIGIPKENIFIMENGDVLALTSDSARIAGHFNAQDIYVDGNGIGDIGAAVLRDRRDLSEDGVVLAVATVDFNTQMILAGPDILSRGFIYMRESGDLIRESQRVLFNAIRIALKNKDASIQSVNGAIVNALRPFLYEKTEREPIIIPMVLTPDKH

SEQ ID NO: 4911 - DNA, 228 bp, Streptococcus agalactiae
atgatttataaagttttctatcaagaaacaaaagaacgcaacccacgtcgtgagcaaaccaaaacactttacgttactattgatgcagctaatgaattagaaggtcgcattgctgcacgtaaactagttgaagaaaatacagcttacaatatcgaattcatcgagttactttcagacaaacaccttgaatatgaaaaagaaactggtgttttcgagctcactgagttc

SEQ ID NO: 4912 - protein, 76 aa, Streptococcus agalactiae
MIYKVFYQETKERNPRREQTKTLYVTIDAANELEGRIAARKLVEENTAYNIEFIELLSDKHLEYEKETGVFELTEF

SEQ ID NO: 4913 - DNA, 228 bp, Streptococcus pyogenes
atgatttataaagttttctatcaagaaacaaaggatcaaagcccacgtcgtgaaagtactaaagcactctatcttaatattgatgctactgatgaactcgatggccgtatcaaggctcgtcgtctcgttgaagataacacctattataacgtggaatttatcgagctactttctgacaaacacctcgattacgaaaaagagaccggtgtttttgaattaacggagttc

SEQ ID NO: 4914 - protein, 76 aa, Streptococcus pyogenes
MIYKVFYQETKDQSPRRESTKALYLNIDATDELDGRIKARRLVEDNTYYNVEFIELLSDKHLDYEKETGVFELTEF

SEQ ID NO: 4915 - DNA, 690 bp, Streptococcus agalactiae
atgatgaaagttttagcctttgatacttcaagcaaagcactatcagtggctgtactaaacaatatggaatgtttagcgactgtcactatcaatatcaaaaagaatcatagcattaatttgatgccagccattgattttttaatgcaatcaattgatttagaacctcaagatttggaccgtatcgtagtagcagagggtccaggatcttatacgggcttacgtgtagctgttgctacagcaaaaatgctagcttatacgcttaagattgacttagttggagtatctagcctgtacgctttaacaaatggattttcagaaaatgatttattggtaccacttatagatgcacgacgtaataatgtttatgttggtttctatcaaaatggtgatactgttaaaccagactgtcacacttctcttgaagaagtcttacaagaggtggggaataaagccaatgttcattttgtcggagaggttgcagcattttttgatcagattaagaaagccttaccacatgctaaaattacagaaactttaccttgtgcagtagcaattgggcgcaaaggacaaaaaatgaaaagcgttaatgtagatgcgtttgttccacgatacttaaaacgtgttgaagctgaggaaaattggttaaaaaaccactgtgaaacgaatacagaagaatatattaagagagtt

SEQ ID NO: 4916 - protein, 230 aa, Streptococcus agalactiae
MMKVLAFDTSSKALSVAVLNNMECLATVTINIKKNHSINLMPAIDFLMQSIDLEPQDLDRIVVAEGPGSYTGLRVAVATAKMLAYTLKIDLVGVSSLYALTNGFSENDLLVPLIDARRNNVYVGFYQNGDTVKPDCHTSLEEVLQEVGNKANVHFVGEVAAFFDQIKKALPHAKITETLPCAVAIGRKGQKMKSVNVDAFVPRYLKRVEAEENWLKNHCETNTEEYIKRV

SEQ ID NO: 4917 - DNA, 729 bp, Streptococcus pyogenes
ttgatactagaacttgcagtagaaaggcataaaatgaagacacttgcatttgatacctcaaataaaaccttgtcccttgctatacttgatgatgagacacttctagcagatatgacccttaacattcagaaaaaacatagtgttagccttatgcctgctattgattttttgatgacttgtactgatcttaaacctcaagatttagaaagaatagtggttgcaaaaggccctggatcttacacaggtttacgagtggcagttgctactgcaaaaacgttagcgtacagtttaaatattgcattggtcgggatttcgagtctatatgctttggctgcgtctacttgtaaacagtatccaaatactttggtggtgccattgattgatgctagaaggcaaaatgcgtatgtaggttattatcggcaaggaaaatcagtgatgccacaagcccatgcttcactagaagttattatagaacaattagtagaagaaggacagctgatttttgttggggagactgctccttttgctgagaaaattcaaaagaaactacctcaggcgatactacttccaacccttccttctgcttacgaatgtggtcttttggggcaaagtttggcaccagaaaatgtagacgcctttgtccctcaatatctcaagagagtggaagctgaagaaaactggctcaaagataatgagataaaagatgatagtcactacgttaagcgaatc

SEQ ID NO: 4918 - protein, 243 aa, Streptococcus pyogenes
LILELAVERHKMKTLAFDTSNKTLSLAILDDETLLADMTLNIQKKHSVSLMPAIDFLMTCTDLKPQDLERIVVAKGPGSYTGLRVAVATAKTLAYSLNIALVGISSLYALAASTCKQYPNTLVVPLIDARRQNAYVGYYRQGKSVMPQAHASLEVIIEQLVEEGQLIFVGETAPFAEKIQKKLPQAILLPTLPSAYECGLLGQSLAPENVDAFVPQYLKRVEAEENWLKDNEIKDDSHYVKRI

SEQ ID NO: 4919 - DNA, 444 bp, Streptococcus agalactiae
gtgaaacgaatacagaagaatatattaagagagtttgagatggaatcatcagaacaagcactggctatatggagcgtactatctgatgtctatgacaaatctccgtggagtttatcgcagatttcagaagatttaaaaaaagattcaacagattatttttttgtttataatgacggtgaagtcattggttttttggctcttcaacaattggtaggtgaagtagaaattactaatattgctgttaaaaaaaattatcaaggtaaaggttatgcttaccagttaatgtcaatgatcgctgatatagaggtgccagtttttcttgaggttcgttattcaaatatcgtagcacaaaaactttatgagaggtgtggttttgtagttttaagaaagcgcaaaaattattaccatgatccaattgaagatgctatagtgatgcgcaaggga

SEQ ID NO: 4920 - protein, 148 aa, Streptococcus agalactiae
MKRIQKNILREFEMESSEQALAIWSVLSDVYDKSPWSLSQISEDLKKDSTDYFFVYNDGEVIGFLALQQLVGEVEITNIAVKKNYQGKGYAYQLMSMIADIEVPVFLEVRYSNIVAQKLYERCGFVVLRKRKNYYHDPIEDAIVMRKG

SEQ ID NO: 4921 - DNA, 453 bp, Streptococcus pyogenes
atgatagtcactacgttaagcgaatctaatatgaaaacagttgaagaacaagcaaaaaatatttatcagcttttggaaatggtttatggcacgtctccttggactttagaacaagtattaatcgatatacggcgggatcaaacagattatttcctactatatgatcatgataaattgctaggttttttagctattcaagatttagctggtgaagttgaaatgactcaaattgctatactacctagtcatcaagaacttgggctagcgtctcaattgatgacgcatttagatagcattgaaagtgacatctttttagaggttagagaatctaatcatagagcacagggtttatatcagaagtttggttttaaatttattggcaaaagaccagactactatagaaatcctatagaaacagctttattgatgaaacgggaaggaaaacatgacaga

SEQ ID NO: 4922 - protein, 151 aa, Streptococcus pyogenes
MIVTTLSESNMKTVEEQAKNIYQLLEMVYGTSPWTLEQVLIDIRRDQTDYFLLYDHDKLLGFLAIQDLAGEVEMTQIAILPSHQELGLASQLMTHLDSIESDIFLEVRESNHRAQGLYQKFGFKFIGKRPDYYRNPIETALLMKREGKHDR

SEQ ID NO: 4923 - DNA, 108 bp, Streptococcus agalactiae
atgtgcttcctttcaggcggctgttttggatattttattggccaaaactcaaaaagctttgctaaagtatccagtgaaaactttagtcgttgctggtggagttgcagc

SEQ ID NO: 4924 - protein, 36 aa, Streptococcus agalactiae
MCFLSGGCFGYFIGQNSKSFAKVSSENFSRCWWSCS

SEQ ID NO: 4925 - DNA, 1008 bp, Streptococcus agalactiae
atgaaagatagatatattttagcagtggaaagttcatgtgatgaaactagtgttgctattttaaaaaatgataaagagttactagctaatattattgcaagtcaagttgaaagtcacaaacgttttggtggtgttgttcctgaagtggcaagccgtcatcacgttgaagtagtaacaacctgttttgaggatgctcttcaagaagcaggtattgttgctagcgatttggatgctgttgctgtaacatatggtccgggattagtaggagccttattggtaggtatggctgcagcaaaagctttcgcttgggcaaataaattacctctaattcctataaaccacatggcaggtcatttaatggcagcacgtgacgttaaggaacttcaatacccattgttagctttgcttgtcagtgggggacatacagaattagtatatgtttctgaaccgggagattacaaaatagtaggagaaactcgggatgatgctgttggagaagcttatgataaagtaggccgtgttatgggcttaacttatccagcaggtcgcgagattgatcagttagctcataagggtcaagatacttaccattttcctagagcgatgatcaaagaagatcatcttgaattttctttttctggattaaaatctgcatttatcaatttacatcataatgcagaacaaaagggtgaagcattggttcttgaagatttatgtgcttcctttcaggcggctgttttggatattttattggccaaaactcaaaaagctttgctaaagtatccagtgaaaactttagtcgttgctggtggagttgcagctaatcaaggacttcgggaacgcttggctactgatatttctcctgatattgatgtggttattcctcctcttagattatgtggggataatgcaggaatgattgcattagcagcagcgatagagtttgaaaaagagaattttgcttctttaaaattgaatgccaaacctagtttagcttttgagagttta

SEQ ID NO: 4926 - protein, 336 aa, Streptococcus agalactiae
MKDRYILAVESSCDETSVAILKNDKELLANIIASQVESHKRFGGVVPEVASRHHVEVVTTCFEDALQEAGIVASDLDAVAVTYGPGLVGALLVGMAAAKAFAWANKLPLIPINHMAGHLMAARDVKELQYPLLALLVSGGHTELVYVSEPGDYKIVGETRDDAVGEAYDKVGRVMGLTYPAGREIDQLAHKGQDTYHFPRAMIKEDHLEFSFSGLKSAFINLHHNAEQKGEALVLEDLCASFQAAVLDILLAKTQKALLKYPVKTLVVAGGVAANQGLRERLATDISPDIDVVIPPLRLCGDNAGMIALAAAIEFEKENFASLKLNAKPSLAFESL

SEQ ID NO: 4927 - DNA, 1026 bp, Streptococcus pyogenes
atgacagataggtatattttagcagttgagagttcttgtgatgagaccagtgtagcgattttaaaaaacgaaagtaccctcttaagtaatgtcattgcaagtcaggttgagagccacaaacgctttggtggtgtggtgccagaagtagctagtagacaccatgtcgaagtgattacgacttgctttgaggatgctttgcaagaagctggcatcagtgcttcagatttatcagcagttgcggtaacttatggccctggacttgttggagccttgttagttggattagcagctgcgaaggcttttgcttgggcaaatcatttacctttgattccggttaatcatatggcaggtcacttaatggcagcgcgtgaacaaaagcctttagtttatcctttaatagcactgttggtttcaggaggacacacagaattggtttatgtcccagagccaggggattatcatattattggcgagacgcgtgacgacgctgttggtgaggcttatgataaagttgggcgtgtgatgggcttaacctatccggcaggacgtgaaattgaccagttggctcataaaggtcaagatacttatcatttccctcgtgctatgataacagaagaccacttagaattttccttttcaggactcaagtccgcttttatcaatcttcatcataatgctaagcaaaaaggcgatgaactgattctagaagatttgtgtgcatcttttcaagcagctgttctagatattttattggccaaaacaaaaaaagctctgagcagataccctgcaaagatgcttgtagtggctggtggtgtagcggcaaatcaaggattacgagatagattagcacaagaaattacacatatagaagttgtgattcctaaactaagactctgtggagataacgcgggtatgattgctttagcagcagctattgagtatgacaaacagcattttgctaatatgagcctaaacgcgaagcctagtttagcttttgaccagtttccagacagttttgtaataaac

SEQ ID NO: 4928 - protein, 342 aa, Streptococcus pyogenes
MTDRYILAVESSCDETSVAILKNESTLLSNVIASQVESHKRFGGVVPEVASRHHVEVITTCFEDALQEAGISASDLSAVAVTYGPGLVGALLVGLAAAKAFAWANHLPLIPVNHMAGHLMAAREQKPLVYPLIALLVSGGHTELVYVPEPGDYHIIGETRDDAVGEAYDKVGRVMGLTYPAGREIDQLAHKGQDTYHFPRAMITEDHLEFSFSGLKSAFINLHHNAKQKGDELILEDLCASFQAAVLDILLAKTKKALSRYPAKMLVVAGGVAANQGLRDRLAQEITHIEVVIPKLRLCGDNAGMIALAAAIEYDKQHFANMSLNAKPSLAFDQFPDSFVIN

SEQ ID NO: 4929 - DNA, 192 bp, Streptococcus agalactiae
atgaacacctataaactctcaaaagctaaactaggtttggcattcaattttaaagaagcaaaattctctttttcaaactctatcgctgctgctaatgcaatcattcctgcattatccccacataatctaagaggaggaataaccacatcaatatcaggagaaatatcagtagccaagcgttcccgaagtcct

SEQ ID NO: 4930 - protein, 64 aa, Streptococcus agalactiae
MNTYKLSKAKLGLAFNFKEAKFSFSNSIAAANAIIPALSPHNLRGGITTSISGEISVAKRSRSP

SEQ ID NO: 4931 - DNA, 120 bp, Streptococcus agalactiae
atgattgaatattcaaaaatattagcaaatgatattgtcgctatttttttaactaataaaggagttaaggaatgttacattttgaaaatgattataataaaggagctcatccagagcttt

SEQ ID NO: 4932 - protein, 40 aa, Streptococcus agalactiae
MIEYSKILANDIVAIFLTNKGVKECYILKMIIIKELIQSF

SEQ ID NO: 4933 - DNA, 849 bp, Streptococcus agalactiae
gtgggtggtactcaaacaaatcaagtagttatcagtagtatgcttgcttcttatgaaggagttattgctgcagaaacaggtcatgtgagtagtcatgaagcaggagccatagaattttcagggcataaggtattgactttaccttctcataatgggaaattactcgcaagcgaagtcgcaacttatattgagactttttatgctgatggtaattaccaacacatggtttttccaggaatggtttatatatcacatccaacagaatatggaacactttatagtaaagcagaactagaagagttatcgaagatttgtaaacattatcaaatccccttatttattgacggtgctcgtctggggtatggtttggctgcgaaagatacagatgttgatttcccaacgattgcagccttatcagatgttttttatattggtggaaccaaaatgggggctcttgctggggaagcagttgttttcacaaagaaaaatcgtccaaaacagtttactacaattgtaaagcagcatggtgcgttattagccaagggaagattgctggggcttgcttttgatcgtttctttacggataacctttacttaaaaattggaaagcatgcgatcgacttagcagaggaattaaaaatcattttagaagaaaaaggttactcattctatttaaaatcaccaactaatcaacaatttattattgtagaaaatacaaaactagcagatttagcaaagaatgtagcttatagtttttgggaaaaatatgatgaccatcatactgtaatacgtctagcaactagttggtcaactagtcgcgaagatgtaactgctttaagaaatgtcttg

SEQ ID NO: 4934 - protein, 283 aa, Streptococcus agalactiae
MGGTQTNQVVISSMLASYEGVIAAETGHVSSHEAGAIEFSGHKVLTLPSHNGKLLASEVATYIETFYADGNYQHMVFPGMVYISHPTEYGTLYSKAELEELSKICKHYQIPLFIDGARLGYGLAAKDTDVDFPTIAALSDVFYIGGTKMGALAGEAVVFTKKNRPKQFTTIVKQHGALLAKGRLLGLAFDRFFTDNLYLKIGKHAIDLAEELKIILEEKGYSFYLKSPTNQQFIIVENTKLADLAKNVAYSFWEKYDDHHTVIRLATSWSTSREDVTALRNVL

SEQ ID NO: 4935 - DNA, 114 bp, Streptococcus agalactiae
atgccaatttatttattttcaaaaagcccggtatgccaagataccgagctttttattattataaatactgataaaattcttttagttaatcccaaaaacaagactattattttg

SEQ ID NO: 4936 - protein, 38 aa, Streptococcus agalactiae
MPIYLFSKSPVCQDTELFIIINTDKILLVNPKNKTIIL

SEQ ID NO: 4937 - DNA, 267 bp, Streptococcus agalactiae
atggctaagaaatcaaaaattgctaaatttcaaaaacagcaaaaactcgtagaacaatatgctgaactacgtcgtgagttaaaagaaaagggtgattacgaagcacttcgtaaacttcctaaagattctaaccctaaccgacttaaaaatcgtgatttaatcgatggccgtcctcacgcttacatgcgtaaattcggtatgagtcgtattaacttccgtaacctagcttacaaaggccaaattcctggcattaaaaaagcaagctgg

SEQ ID NO: 4938 - protein, 89 aa, Streptococcus agalactiae
MAKKSKIAKFQKQQKLVEQYAELRRELKEKGDYEALRKLPKDSNPNRLKNRDLIDGRPHAYMRKFGMSRINFRNLAYKGQIPGIKKASW

SEQ ID NO: 4939 - DNA, 267 bp, Streptococcus pyogenes
atggcaaaaaagtcaaaaattgctaaataccaaaagcagctccaactgattgaacagtacgctgaccttcgtcgtgacttaaaagcgaagggcgattatgaatcactgcgcaaattgcctcgtgattcaaatccaaaccgcttgaagaaccgcgacaaaattgacggccgtcctcatgcttacatgcgtaagtttggtgttagccgtatcaatttccgtgacttagctcacaaaggacagcttcctggcgtcactaaagctagctgg

SEQ ID NO: 4940 - protein, 89 aa, Streptococcus pyogenes
MAKKSKIAKYQKQLQLIEQYADLRRDLKAKGDYESLRKLPRDSNPNRLKNRDKIDGRPHAYMRKFGVSRINFRDLAHKGQLPGVTKASW

SEQ ID NO: 4941 - DNA, 780 bp, Streptococcus agalactiae
atgtgttacaataacagtatgaatgaaagatatatccgatttaaccctaatatcgcgaaacaaaaacccagcaataaagacaaatgtccattttgtgataaaagccaattaggaaaaatcctagacgtgaaagacgatatgatctgggtagaaaataaatacccaactttagaagaaacctatcaaacattggtgattgaatcaaatgatcacaatggggatatttcagtttatagtgagtcaaagatgcgccaattgttagattatcttttgtcaaaatggcaattaatggaagaaagtggtcattaccgttcggtcgttctttatcgaaattttgggcccttatctggcggaagtttacgacatcctcatagccaaattgttggcttaaaaaacgtagatgcttatgaaacgttgaacttagattggtttgatggtatcgaggtttgttcggaaacgagtcaacaagcagagattagtattgccaatcgtcctatgcttgatttcacagagttcacaattaaagtatccaaattggaaaacgctattttgattgcagatagtttaccaattttgtgtcattatattttaaatgaattcttgggagggcgctgtaaatcttataatctctttttctataagcatgatgggggtcttatttgtaaaattgttcctcgttttatagtatccccttatcagattgggtatgctattcatcaggtaaatttaccagatgaattggaaaaaatcaaagaagccttaagagccaaatattatctt

SEQ ID NO: 4942 - protein, 260 aa, Streptococcus agalactiae
MCYNNSMNERYIRFNPNIAKQKPSNKDKCPFCDKSQLGKILDVKDDMIWVENKYPTLEETYQTLVIESNDHNGDISVYSESKMRQLLDYLLSKWQLMEESGHYRSVVLYRNFGPLSGGSLRHPHSQIVGLKNVDAYETLNLDWFDGIEVCSETSQQAEISIANRPMLDFTEFTIKVSKLENAILIADSLPILCHYILNEFLGGRCKSYNLFFYKHDGGLICKIVPRFIVSPYQIGYAIHQVNLPDELEKIKEALRAKYYL

SEQ ID NO: 4943 - DNA, 1170 bp, Streptococcus agalactiae
atgaagcattatgacacaataattataggtggtggacctgctggaatgatggcagctatttcctcaaatttttacggcaacaaaacacttcttattgagaaaaataaacgtttaggcaaaaaactagctggaacaggtggtggccgctgtaatgttaccaataatggaaaccttgatgagctcttagctggtatacctggaaatggccgtttcctatatagcgtcttctcacaatttgataaccatgatattattaacttctttcaagacaacggcgtcacactaaaagaagaagatcatgggcgtatgttccctactactgataaatctcgtactatcattaacgcccttgaaaataaaataaaagaacttggtggtcaaattatgactgacacagaagttgtctctgtcaaaaagataggagattcattctatatcaaaactaaagatacacagttcgcatccgataaacttatcgtaacaactggtggtaaatcctatccgtctacaggttctactggtttcggtcatgacattgctcgtcactttaaattagaagtcacagatatggaagccgccgaaagccctcttttaactgattttccccataaaaaactacaaggtatctccttagatgatgtcactttgtcatttgaaaagcatattattacacacgatcttctctttactcattttggattatcaggaccagcagccttgcgaatttctagctttgtcaaaggcggagaaactatatacctagatgttttgcccaatatctctgttaaagaattggaaatacacttccaaaatgaaagagaaaaatctttgaaaaacgctcttaaaatacttcttcctgagcgtttagctgaattttacgctgaagacttacccgaaaaagtaaaacaagtatctgtaaaagacttagaaatgttaattcaaaaacttaaaaaacttcctattttagtaactggcaagatgtctctagcaaaatcctttgtaacaaaagggggagttgatcttaaagaaataaaccccaaaacacttgaaagtaaaaaggtagctggtttacattttgctggtgaagtcctagacatcaatgctcatacgggagggtttaacattacttctgccttatgtacaggctgggtagctggtagcttacactat

SEQ ID NO: 4944 - protein, 390 aa, Streptococcus agalactiae
MKHYDTIIIGGGPAGMMAAISSNFYGNKTLLIEKNKRLGKKLAGTGGGRCNVTNNGNLDELLAGIPGNGRFLYSVFSQFDNHDIINFFQDNGVTLKEEDHGRMFPTTDKSRTIINALENKIKELGGQIMTDTEVVSVKKIGDSFYIKTKDTQFASDKLIVTTGGKSYPSTGSTGFGHDIARHFKLEVTDMEAAESPLLTDFPHKKLQGISLDDVTLSFEKHIITHDLLFTHFGLSGPAALRISSFVKGGETIYLDVLPNISVKELEIHFQNEREKSLKNALKILLPERLAEFYAEDLPEKVKQVSVKDLEMLIQKLKKLPILVTGKMSLAKSFVTKGGVDLKEINPKTLESKKVAGLHFAGEVLDINAHTGGFNITSALCTGWVAGSLHY

SEQ ID NO: 4945 - DNA, 1167 bp, Streptococcus pyogenes
atgactcaatacgatacgattattattggaggtggccctgctggcatgatggccgccatctccagcagctactatggctataaaactctcttaattgaaaaaaatcgccgcttaggcaaaaaattagcgggaaccggtggtggacgctgtaatgtcactaatagtggtaaccttgatgtccttatggctggcattcctggaaatggccgctttttatatagtgttttttcccagtttgacaaccatgacatcattgcctttttcgaggaaaacggcgtcaaactcaaagaagaagaccatggacggatgttccccacaacagataaatcaaggacaatcattgatgctctggagaaaaaaatcaaggctcttgggggtcaggtgctaaccagcactgaagtggtttccgttaaaaaacaagatgacctcttctacctcaaatctgcagaccagactttcacctgccaaaaattgattgtgaccacaggaggcaagtcctacccttcaacgggttcaacaggttttggacatgatattgcacggcattttaaactgaccgtgactgatttagaagctgctgagagccctctgttaactgattttcctcacaaagtcttgcaaggtatttccctagacgacgttactcttagttatgacaaacacgtcatcacacacgacttactcttcacccactttggcctttcaggacctgcagctcttcgtctgtcctcttttgtgaaaggtggagaaattgcagagctggactttttgccacacttatcaacagatgacttaaccgcttatctgagtgatcaacgtgataaaaacatcaaaaatgctcttaaaggcctactgcctgaacgagtagctgattttttatcagaagattaccccgaaaaggtcaaacaactctctccaaaacaagaaaaggaattgcttgataaactcaaacacctccagatacccattacaggaaaaatgtctttggctaaatcatttgtgaccaaaggaggcgtagatttaaaagaaatcaaccctaaaaccttggaaagcaagaaagttcctggcctgtatttcgctggagaggtcttagatattaatgctcataccggagggtttaatattacctcagctctttgttcaggatggatcgcagggaagtcttca

SEQ ID NO: 4946 - protein, 389 aa, Streptococcus pyogenes
MTQYDTIIIGGGPAGMMAAISSSYYGYKTLLIEKNRRLGKKLAGTGGGRCNVTNSGNLDVLMAGIPGNGRFLYSVFSQFDNHDIIAFFEENGVKLKEEDHGRMFPTTDKSRTIIDALEKKIKALGGQVLTSTEVVSVKKQDDLFYLKSADQTFTCQKLIVTTGGKSYPSTGSTGFGHDIARHFKLTVTDLEAAESPLLTDFPHKVLQGISLDDVTLSYDKHVITHDLLFTHFGLSGPAALRLSSFVKGGEIAELDFLPHLSTDDLTAYLSDQRDKNIKNALKGLLPERVADFLSEDYPEKVKQLSPKQEKELLDKLKHLQIPITGKMSLAKSFVTKGGVDLKEINPKTLESKKVPGLYFAGEVLDINAHTGGFNITSALCSGWIAGKSS

SEQ ID NO: 4947 - DNA, 576 bp, Streptococcus agalactiae
gtgatattcttttataagaaaatcagtacaaaagaggaagttatgacagttgaaaagacggttagtgaattagctgaaattttaggggttagtcgtcaagcgatgaataacagagttaaaacactccctgaagaatgtgtggaaaagaatagtaaaggcgttacagttgttaatcgtgatggcttgattaaattggaagaaatctataaaaaaactattttggaagaggaaccaattgacgaagaagcatcaagacgagaacttttagaaattctcgttgatgagaagaatactgaaatcacacgtttatatgaacagttaaaagcaaaagatattcagattgcttcaaaagacgagcagttacatgtaaaagatattcaaatagcagagaaagataagcaattagatcaacaacagcaattgactttaactgctatggaagatacgcaacgtctgcaacttgagttaaatgaagctaaagcagaggttgaggagattcaagaagccaaagaagaaaaaattcaagaattagaagctgttaaaaaaagtttctttggacgtttcttcaataaaaaa

SEQ ID NO: 4948 - protein, 192 aa, Streptococcus agalactiae
MIFFYKKISTKEEVMTVEKTVSELAEILGVSRQAMNNRVKTLPEECVEKNSKGVTVVNRDGLIKLEEIYKKTILEEEPIDEEASRRELLEILVDEKNTEITRLYEQLKAKDIQIASKDEQLHVKDIQIAEKDKQLDQQQQLTLTAMEDTQRLQLELNEAKAEVEEIQEAKEEKIQELEAVKKSFFGRFFNKK

SEQ ID NO: 4949 - DNA, 579 bp, Streptococcus pyogenes
atggtactatttttaataagaatattcagtgatagtgataaagaggaaaatatgggaattgaaaagacagttagtgaactagctgatattttgggagtgagtcgtcaggccgtcaataatcgtgttaagtctttacccgaagaagatcttgacaaaaatgaaaaaggcgttactgtggttaagcgcagtggtcttgttaagctggaagagatctataaaaaaacaatttttgacgatgagcctatcagtgaagaaacgaaacaacgtgagcttttagagattctcgtggatgagaagaacactgaaatcacgcgcctttatgagcaactcaaagccaaagatgctcaacttgcctcaaaagatgagcaaatgcgtgttaaagacgtgcagatcgctgaaaaagataaacaattggatcagcagcaacaattaactgctaaagccatggctgataaagaaaccctaaaattagaattggaagaagctaaagcagaagccaaccaagctcgcttacaagtcgaagaagttcaggctgaagttggccctaaaaaaggctttttcacccgcttgtttgcgaaa

SEQ ID NO: 4950 - protein, 193 aa, Streptococcus pyogenes
MVLFLIRIFSDSDKEENMGIEKTVSELADILGVSRQAVNNRVKSLPEEDLDKNEKGVTVVKRSGLVKLEEIYKKTIFDDEPISEETKQRELLEILVDEKNTEITRLYEQLKAKDAQLASKDEQMRVKDVQIAEKDKQLDQQQQLTAKAMADKETLKLELEEAKAEANQARLQVEEVQAEVGPKKGFFTRLFAK

SEQ ID NO: 4951 - DNA, 606 bp, Streptococcus agalactiae
ttgcgctttttaggagaaataatgaaacaattacaagaatatatagcttttgatttagagtttaacacggttggtgagcatagccatattattcaagtgtcggccgttaaatattctaatcatcaagagattgctttatttgatacttatgttcacacaaaagttccattacaaagctttattaatggtttaacaggtattacagctagagatattataggggctcctaaaattgagatagttttgacagactttcagagttttgttggagatacaccactgattggttataatgggtataaatcggatttaccccttttagttgaaaatggtttggatctaactagtcaatatcaggtggacttatatgatgaagcttttgtgagacgcagtacagatttaaatggtattgtcaaccttaaattgactactgttgctgactttttaggaataaagggtaaagcacataatagcttagaggatgcccgtatgactgcgcgtgtttatgaaaaatttctggacttggatgaaaataaaatctatttaaaacagcaaaaagaggtagcagttgatagcccatttgcgactttaggaaatttgtttgat

SEQ ID NO: 4952 - protein, 202 aa, Streptococcus agalactiae
MRFLGEIMKQLQEYIAFDLEFNTVGEHSHIIQVSAVKYSNHQEIALFDTYVHTKVPLQSFINGLTGITARDIIGAPKIEIVLTDFQSFVGDTPLIGYNGYKSDLPLLVENGLDLTSQYQVDLYDEAFVRRSTDLNGIVNLKLTTVADFLGIKGKAHNSLEDARMTARVYEKFLDLDENKIYLKQQKEVAVDSPFATLGNLFD

SEQ ID NO: 4953 - DNA, 624 bp, Streptococcus pyogenes
atgacgaaggccctatcagggtcttttttggaggaaaacatgaaacacttagatacttatattgcctttgatttagaatttaacactgtcaatgacgttagtcatatcattcaagtatcagcagtcaaatatgaccaccataaagaagttgacagctttgacacctatgtttacacagatgttcccttacagagctttatcaatggcctaacaggaatcacatctgacaagattgctgcggaaccaaaagtagaggaggttatggctgcgtttaaaaattttgtgggagagttaccactgattggttataatgctcaaaaatctgacctgcctattctagctgaaaatggcttggatttaagggaccaataccagattgacctctttgatgaagcttacgatagacgtagcgcagacttaaatgggattgctaaccttcgtctgcaaacagtggcaacctttttaggcattaagggtcgaggtcataatagcttagaagatgccagaatgacagcagtaatctataagtcttttttagaaacagatacaaacaaagcatatctcagccagcaagaagaggtaaccacagataaccctttcgcagctttgggagactttttcgac

SEQ ID NO: 4954 - protein, 208 aa, Streptococcus pyogenes
MTKALSGSFLEENMKHLDTYIAFDLEFNTVNDVSHIIQVSAVKYDHHKEVDSFDTYVYTDVPLQSFINGLTGITSDKIAAEPKVEEVMAAFKNFVGELPLIGYNAQKSDLPILAENGLDLRDQYQIDLFDEAYDRRSADLNGIANLRLQTVATFLGIKGRGHNSLEDARMTAVIYKSFLETDTNKAYLSQQEEVTTDNPFAALGDFFD

SEQ ID NO: 4955 - DNA, 723 bp, Streptococcus agalactiae
atgtcagaaaaatattccactggtgacttagctaaagaagcaggagttactgttcgtactgttcagtactatgacaaaagaggaattttatccccatcagaactatctgaaggaggtaggagggtttatagtattgctgatttagaaaagcttagacaaattatttatttacgagatttagatttttcaattgataatatcaaaaatctatttactgaagacaatgctagccagattttagagctttttttacaagtgcagataagagaattaaggctagctattgatagtaaaaaagacaaacttgacaaagctgtcaacctactaaaaactgtagaaaaacaagatagtaaaacattaggctatctttctgacattgtgcttatggaagaaaacaaaagaaaatggggtatactacaaaaaagcatagtgctacaagtcgttatgattattatggtctatattacgttaataatagcagcagtttctctaaatcaaagatggcttatgtggatagcagtaacagtattcttaatagctatgaatggtatggtttggtattttaaacaacaggttgtttatctttgtccaaattgtcatcaaacctttacaccgacatatcaagcatttaatctagcgaaacatacccctaagacgcgaaaagtattctgtccacattgtcaccaaaagtcacattgtatagagttagccagagaagaacgt

SEQ ID NO: 4956 - protein, 241 aa, Streptococcus agalactiae
MSEKYSTGDLAKEAGVTVRTVQYYDKRGILSPSELSEGGRRVYSIADLEKLRQIIYLRDLDFSIDNIKNLFTEDNASQILELFLQVQIRELRLAIDSKKDKLDKAVNLLKTVEKQDSKTLGYLSDIVLMEENKRKWGILQKSIVLQVVMIIMVYITLIIAAVSLNQRWLMWIAVTVFLIAMNGMVWYFKQQVVYLCPNCHQTFTPTYQAFNLAKHTPKTRKVFCPHCHQKSHCIELAREER

SEQ ID NO: 4957 - DNA, 1188 bp, Streptococcus agalactiae
atggttatggatagtctaatcataaaacagttgattaagagtacatttgatatacccttacaagtcacttatccaaatgggaatattgaaacttataatggtagcaatccccacgtcaaacttaaactaaacaaaaatttctccgtctcggagctatcaaaagacccttccatagtattgggtgaagctgttatggatggagacattgaaatttatggttctatacaagaattaattttatcagcttaccgctgtggagacagctttctacgtaatagtaaatttagcaaattgattcctaaacaatttcatgataaaaaacacagtaaatccgacattcaaaagcattatgacatcggaaatgatttctataaactgtggcttgatgataccatgacttattcatgcgcctattttaaacatgaaaatgatagtctagagcaagctcaactaaacaaagtacaccatattcttaataaattaaatgctcagccgggagggaaattactagacatcggttgtggctgggggacacttatcattactgctgctaaagaatatggcttaaatgcgacaggtatcaccttaagtgaagagcaggcttctttcattactaagcgtatcaaggaagaagggttggaaaataaagtaacagtcctcattaaagattatcgtgacattcgtgaaacatacgattatatcactagtgttggtatgtttgaacatgtaggaaaagaaaatttatctcaatacttccaaaccatttctaaaagactcaacatcaatggtctagctcttattcatggtattactggacaagtgggtggtaatcatggtagtggaactaattcttggattaataagtatatcttcccaggaggatatatccctcgtttaactgaaaatttaaatcatatagctagtgctggacttcaaattgctgacttagaaccgcttcgtcgtcactatcaaaagactctcgaattatggacaaaaaatttccacaatgcccttcctgaagttcagaaaactcatgataagcgttttatcaatatgtgggacctctatcttcaatcttgtgcggcctcttttgaatctggcaatattgatatttttcaatacttgctttcaaaaggtgtttcaaaagacactatgcctatgacacgcgattatatgtattctgctaat

SEQ ID NO: 4958 - protein, 396 aa, Streptococcus agalactiae
MVMDSLIIKQLIKSTFDIPLQVTYPNGNIETYNGSNPHVKLKLNKNFSVSELSKDPSIVLGEAVMDGDIEIYGSIQELILSAYRCGDSFLRNSKFSKLIPKQFHDKKHSKSDIQKHYDIGNDFYKLWLDDTMTYSCAYFKHENDSLEQAQLNKVHHILNKLNAQPGGKLLDIGCGWGTLIITAAKEYGLNATGITLSEEQASFITKRIKEEGLENKVTVLIKDYRDIRETYDYITSVGMFEHVGKENLSQYFQTISKRLNINGLALIHGITGQVGGNHGSGTNSWINKYIFPGGYIPRLTENLNHIASAGLQIADLEPLRRHYQKTLELWTKNFHNALPEVQKTHDKRFINMWDLYLQSCAASFESGNIDIFQYLLSKGVSKDTMPMTRDYMYSAN

SEQ ID NO: 4959 - DNA, 297 bp, Streptococcus agalactiae
atgatgaatatgcaaaatatgatgcgtcaagcacaaaagcttcaaaaacaaatggaacaaaagcaagctgatttagcagctagccagtttactggaaaatctgctcaagagctcgttaccgtgacatttacaggcgataaaaagctaatttcaattgattacaaagaagctgtggtagaccctgaagatattgaaacactacaagacatgacaactcaagctatcaatgacgctttaagccaagttgacgatgctacaaaaaaaattatgggagcatttgcgggtaaaatgccattc

SEQ ID NO: 4960 - protein, 99 aa, Streptococcus agalactiae
MMNMQNMMRQAQKLQKQMEQKQADLAASQFTGKSAQELVTVTFTGDKKLISIDYKEAVVDPEDIETLQDMTTQAINDALSQVDDATKKIMGAFAGKMPF

SEQ ID NO: 4961 - DNA, 297 bp, Streptococcus pyogenes
atgatgaacatgcaaaacatgatgaagcaagcacaaaagcttcagaaacaaatggagcaaaagcaggcggatttggctgctatgcaatttactggaaaatcagctcaagaccttgtcactgccactttcacgggtgataaaaaattggttgggattgacttcaaagaagctgttgtagatcctgaagatgtagaaacgcttcaagacatgaccactcaagccattaatgatgcccttacgcaaattgatgaaacaactaagaaaacattaggcgcttttgctggtaaattaccattc

SEQ ID NO: 4962 - protein, 99 aa, Streptococcus pyogenes
MMNMQNMMKQAQKLQKQMEQKQADLAAMQFTGKSAQDLVTATFTGDKKLVGIDFKEAVVDPEDVETLQDMTTQAINDALTQIDETTKKTLGAFAGKLPF

SEQ ID NO: 4963 - DNA, 90 bp, Streptococcus agalactiae
gtgaaagttgaagctgaaacaccttgtgtagaaccaagagctacgaatgctcctccagcaaacattgctgagacaagaccaagtttcaaa

SEQ ID NO: 4964 - protein, 30 aa, Streptococcus agalactiae
MKVEAETPCVEPRATNAPPANIAETRPSFK

SEQ ID NO: 4965 - DNA, 444 bp, Streptococcus agalactiae
atgaacaaacttattacagaaaaaaaagtcaacaacgtctcaactgctaactatttgaaacttggtcttgtctcagcaatgtttgctggaggagcattcgtagctcttggttctacacaaggtgtttcagcttcaactttcacagcaccgcaagcaacacctccaaaagcagaacgtcagttaacggattcagaactttatgaacgtgcccaaaaacaagtattgccaagatatatccaaggttctctctcaggtatccttaaccagcattcaacactttacaaacaacaaaatgcagcagtgacaccgcaagtatcaagccccaaatcagaacgtcagttaacagattcagaaatctatgaacgtgctcaaaaacaagtattgccaaattatattcaaggttctctctcaggtatcctcaaccaacattcaactttaaatgct

SEQ ID NO: 4966 - protein, 148 aa, Streptococcus agalactiae
MNKLITEKKVNNVSTANYLKLGLVSAMFAGGAFVALGSTQGVSASTFTAPQATPPKAERQLTDSELYERAQKQVLPRYIQGSLSGILNQHSTLYKQQNAAVTPQVSSPKSERQLTDSEIYERAQKQVLPNYIQGSLSGILNQHSTLNA

SEQ ID NO: 4967 - DNA, 114 bp, Streptococcus agalactiae
ttgtgtatatctaaacacttatcaaaacttttcgtgggatatcctcaacttaagcaaaattttcttgatttccttgccgaacaccttatggattgccaatctaatgttggcgaa

SEQ ID NO: 4968 - protein, 38 aa, Streptococcus agalactiae
MCISKHLSKLFVGYPQLKQNFLDFLAEHLMDCQSNVGE

SEQ ID NO: 4969 - DNA, 897 bp, Streptococcus agalactiae
atgacattaccaatctttctagagttggtagaaatgaaagccaaaacagctagtgttttaccatttttgattggtttgtgttttagtgcttattactacaattcagtacaccctgtatatgtcggtttattcttcgttgctatgtttttattcaatatgttcgttgacatttggaataattacaatgattatcggaatgctgtggatttggattataagaatgacactaacattattggtcgtgagaacctatccctacgccaaatagaagttattatggcaagtttagtcattacttctagtatgattggtttagttttagtttcccaagttggtctgcctcttttatggatgggacttttttgttttggaattggtgttttatattcctttggtccaagacctttatctagtctgcccttaggagaagtattttctggcttgacaatgggatttatgattagtttaatttgtgtatatctaaacacttatcaaaacttttcgtgggatatcctcaacttaagcaaaattttcttgatttccttgccgaacaccttatggattgccaatctaatgttggcgaataatctgtgcgacaaagaagaagatgaaaaaaatcatcgctatacccttgtacattatacagggataagaggtggactcttgctgtttgctatttctaatagtatagctttattggcaattgtttttgaatttctttttggacttgcgcctgttacagtactcttgagtttgttattaataccatttatttataagcagacaaaactattgtggcaaaaacaggttaagagagaaacatttgtttgtgcggtacgtattctagcactgggatctgcaacccaagtcttaacgtatctaattggaatcattttt

SEQ ID NO: 4970 - protein, 299 aa, Streptococcus agalactiae
MTLPIFLELVEMKAKTASVLPFLIGLCFSAYYYNSVHPVYVGLFFVAMFLFNMFVDIWNNYNDYRNAVDLDYKNDTNIIGRENLSLRQIEVIMASLVITSSMIGLVLVSQVGLPLLWMGLFCFGIGVLYSFGPRPLSSLPLGEVFSGLTMGFMISLICVYLNTYQNFSWDILNLSKIFLISLPNTLWIANLMLANNLCDKEEDEKNHRYTLVHYTGIRGGLLLFAISNSIALLAIVFEFLFGLAPVTVLLSLLLIPFIYKQTKLLWQKQVKRETFVCAVRILALGSATQVLTYLIGIIF

SEQ ID NO: 4971 - DNA, 1206 bp, Streptococcus agalactiae
atgaaagaaatcctagttttaggtgctggttatgccggtttgaaagcagttcgtaatttacaaaaacaatcaggtgattttcatattacccttgttgacatgaatgattatcactacgaagctacagaattacatgaagtagctgcaggctctcagccaaaagaaaaaattacattcccaattaaggatgttatcaacactaataaggttaacttcatgcaagatgaggtgcttagagtcgatgctgaaaataaaacagtaacagttaaaaataacggtgaactccattatgattatgtcgtagttgccttaggctttgtatctgaaacttttggcatcaagggtgctatggagaatgctttgcagatgaccaatatttcgcaagcagaaaacatccataatcacattgttaatacaatgaagttgtaccgtgagacaaaagatgaaaatcttctcaaactcttagtatgtggtgctggttttacaggtattgagttagccggagctatggttgatgagcgaccaaaatatgctgctttagcgggtgtaaaacctgaacaaattgaaattatttgtgtagaggcagcaactcgcatcctaccaatgtttgatgatgaattagcgcaatatggtgtcaacttaattaaggatttaggtattaatttgatgcttggaagtatgattaaggaaatcaaaccgggtgaagttgtttatggtactagtaaagaggatgaagaactcaaatctattaccgcaggtactatcatttggacaacaggtgttagtggaagtccggttatgggagaatcaggatttgatcaacgtcgtggacgtgtaatggtcaacagtgatttgcgtgatccaaaatacgataatgtttatgttatcggtgatgtgtctgcatttatggacactgagtctggtcgcccattcccaacaacagctcaaattgcaactcgtatgggagctcatgttgctaaaaaccttttacatcaaatcaaaggtgaagctacagaagacttttcgtatagtccgcaaggcacagttgcttcagtaggaaatacgcatggacttggtgttgttggaaaaactaaaattaaaaaataccctgcgtcggttatgaagaagattatcatgaacaaatcacttgttgatatgggtggacttaaagaacttctagctaagggacgttttgatttatatcat

SEQ ID NO: 4972 - protein, 402 aa, Streptococcus agalactiae
MKEILVLGAGYAGLKAVRNLQKQSGDFHITLVDMNDYHYEATELHEVAAGSQPKEKITFPIKDVINTNKVNFMQDEVLRVDAENKTVTVKNNGELHYDYVVVALGFVSETFGIKGAMENALQMTNISQAENIHNHIVNTMKLYRETKDENLLKLLVCGAGFTGIELAGAMVDERPKYAALAGVKPEQIEIICVEAATRILPMFDDELAQYGVNLIKDLGINLMLGSMIKEIKPGEVVYGTSKEDEELKSITAGTIIWTTGVSGSPVMGESGFDQRRGRVMVNSDLRDPKYDNVYVIGDVSAFMDTESGRPFPTTAQIATRMGAHVAKNLLHQIKGEATEDFSYSPQGTVASVGNTHGLGVVGKTKIKKYPASVMKKIIMNKSLVDMGGLKELLAKGRFDLYH

SEQ ID NO: 4973 - DNA, 1425 bp, Streptococcus agalactiae
atgacaattgaaactttagctcgttttcaatttgcgatgactacagttttccactttttctttgtaccatttacaattggtacatgcctagtggttgctattatggagacaatgtatgttatcacaaaaaatgaagagtataaaaaattgacaaaattttggggtaatatcatgctccttagttttgcggttggtgttgtgacaggtatcattcaagagttccaatttggaatgaactggtcagactattcacgtttcgtaggtgatatttttggagctccattggctattgaagctttattagctttctttatggaatctactttccttggtttatggatgtttacatgggataacaaaaaaattagtaaaaaattacatgtgacattcatttggctagtggtttttggctcattaatgtcagcgatgtggattcttactgctaatagcttcatgcaacatcctgttggttatgaagttgtaaacggtagagcgcaaatgactgattttcttgcacttgtaaaaaatccacagttcttctatgaatttacccatgttatttttggtgccattacgatgggtggtacagtggttgctggtatgtcagccttccgcctcttaaaatcagaacagctgaaagatacaacggttgaactttataagaaatcggttcgtattggtttagtagtagcacttcttggttcaatttcagttatgggagttggggatttacaaatgaaagccttgattcacgatcaaccaatgaaatttgctgctatggaaggtgattatgaagattcgggtgatcctgcagcttggagtgtagttgcttgggcaaatgaagcagaacacaaacaagtttttgggattaagattccttatatgttgagtattttatcttacgggaaaccatctggttctgtgaaaggtatggatacagctaataaagaattggttgctaagtatggtaaagataactactatccaatggttaacctacttttctatggtttccgtacaatggcggcgatgggaacagctattatgggtgtttctgttttaggactctttttaactcgtaagaaaaaaccaattctttataaacacaaatggatgctttggattgttgctttaacaacctttgcaccattcttagccaatacatttggttggattgtgacagaacaaggacgatacccttggactgtctatggtcttttcaagattaaggactctgtctctccaaacgtttcagttgcatcattatttgtttccaatactgtgtatttcttgttgtttggtggtttagcggtgatgatgataagcctaacaataagagaattgaagaaagggccagagtatgaagatgaacacggacatcatggtgcatatacttcaattgatccctttgaggaaggagcatac

SEQ ID NO: 4974 - protein, 475 aa, Streptococcus agalactiae
MTIETLARFQFAMTTVFHFFFVPFTIGTCLVVAIMETMYVITKNEEYKKLTKFWGNIMLLSFAVGVVTGIIQEFQFGMNWSDYSRFVGDIFGAPLAIEALLAFFMESTFLGLWMFTWDNKKISKKLHVTFIWLVVFGSLMSAMWILTANSFMQHPVGYEVVNGRAQMTDFLALVKNPQFFYEFTHVIFGAITMGGTVVAGMSAFRLLKSEQLKDTTVELYKKSVRIGLVVALLGSISVMGVGDLQMKALIHDQPMKFAAMEGDYEDSGDPAAWSVVAWANEAEHKQVFGIKIPYMLSILSYGKPSGSVKGMDTANKELVAKYGKDNYYPMVNLLFYGFRTMAAMGTAIMGVSVLGLFLTRKKKPILYKHKWMLWIVALTTFAPFLANTFGWIVTEQGRYPWTVYGLFKIKDSVSPNVSVASLFVSNTVYFLLFGGLAVMMISLTIRELKKGPEYEDEHGHHGAYTSIDPFEEGAY

SEQ ID NO: 4975 - DNA, 1017 bp, Streptococcus agalactiae
atgagtgctttacaattcttttggtttttcctaatcggcctcctattttcaggattcttcttccttgaaggattcgactttggggttgggatggctgttcaaactttaacacataatgagcatgaaaaagatcaagtagtagaaaccattggcccagtttgggatggtaatgaagtttggcttcttaccggtggtggagcaatgtttgcttcttttccatactggtatgcttcactatttagtggttactatttgattctccttacgattctctttggattaattattcgtggtgtttccttcgaatttagacataaagttcctgcagagaaaaagcagttttggaactggaccttaacaattggttccgctattgttccattcttctttgggattatgtttataagtttgattcaaggtatgccacttgatgccagtggtaacttatcagctcaattcagtgattactttaatatattctcgttggtgggtggagttgcaatggtattgctagcctatcttcatggtttaaactacattgcattgaagacagaagggccaattagagagcgtgcccgtaattatgctcagttgctttattgggtactctatcttggtttagccttgtttgcagttctcttgtatttcaagacagatttctttagcaatcatccgatagttacgacaattatggttttggttattgttgtattagctgtattagcgcatgcttcaacttttaaaggagcagagatgacagcatttttagcgagtggtctcagtcttgtttcagtggttgttctgttgttccaaggtctattcccacgagttatgatttcatcaattagccctaaatatgatttgctgattcaaaatgcatcctcaacgccatatactttaaaagtaatgtcgattgtcgcaattactctagttccctttgttctagcttatacagcatgggcatattatatctttagaaaacgtattaccttgccagtgattgtgacaggagaaaaa

SEQ ID NO: 4976 - protein, 339 aa, Streptococcus agalactiae
MSALQFFWFFLIGLLFSGFFFLEGFDFGVGMAVQTLTHNEHEKDQVVETIGPVWDGNEVWLLTGGGAMFASFPYWYASLFSGYYLILLTILFGLIIRGVSFEFRHKVPAEKKQFWNWTLTIGSAIVPFFFGIMFISLIQGMPLDASGNLSAQFSDYFNIFSLVGGVAMVLLAYLHGLNYIALKTEGPIRERARNYAQLLYWVLYLGLALFAVLLYFKTDFFSNHPIVTTIMVLVIVVLAVLAHASTFKGAEMTAFLASGLSLVSVVVLLFQGLFPRVMISSISPKYDLLIQNASSTPYTLKVMSIVAITLVPFVLAYTAWAYYIFRKRITLPVIVTGEK

SEQ ID NO: 4977 - DNA, 93 bp, Streptococcus agalactiae
atggataaagttgtaaaaaagtctaaagcaaacgttgataaaataccaattttcaaagtactcattgttgctttacgaaaagattcactagtt

SEQ ID NO: 4978 - protein, 31 aa, Streptococcus agalactiae
MDKVVKKSKANVDKIPIFKVLIVALRKDSLV

SEQ ID NO: 4979 - DNA, 1716 bp, Streptococcus agalactiae
atgctagataaagcggttatgcgcttgtcaggtattcataagttgttaggattgcttgcgggacttgatgttcttcaagcaatctttattatcggacaagcttattatttgagtctttctataactggtttgtgggaagggcaaaaactttcttctcaaacggtttatattttgttatttatggtctcatatttaggccgtcatgttattgattacatcaaaaatagaaaacttgatgacttttcaacagcacaatctagtcttttgagacgtcaattattagataagttatttgatctaggtcctaaagtcgttcaagaacaaggaactggtaatgttgttacaatggcattagatggcgtttctttagttgaaaattatttacgtttagtcttgaataagatgattaacatgtctattatcccatggattattctagcttatattttctatttagatattgaatcaggtgcaattttacttatcgtttttcctttaattatcatctttatgattattttaggctatgcggctcaagctaaagcagataaacaatatgaatcctatcaagtactttctaatcattttttagattcattacgaggcattgatactctcaaatattttggtcttagtaaacgttatggtaaaagcatttatcaaactagtgaatcttttcgtaaagcaacaatgagtactttgaaaattggtattttatcaacgtttgctttagacttttttacaactttatccattgctatcgttgctgtttttctaggtttacgattattaaatgagcagatttaccttttaccggctttaacaattttgattttatcccctgaatactttttacccgtaagagatttttctagtgattatcatgcaacgttagacgggaaaaatgcatttcaagcgattcaaaaagttctaaacaaaactggtattaaaggtgagcaattagtcatagatgattggtctaaagagagtcgtttggatttagaaaacattgctattgcgtacgaccaaaaacgtgttgttgaggatgtaaccttacgatttagaggacatcaaaaggttgctttagtaggagttagtggttcaggtaagtctagcttaattaaccttctgagtggttttttagggcctgataatggttctttaaaagtggatggtagagaagtgactaaccttgatcaagaagattggcataaacagatgatctatattcctcaaactccttatgtttttgaaatgtcattacgtgataatattaccttctatactcccaatgctagtgacgaagaggtggtaagagcgattcatatggtaggtttagatagcttgctaagcgagttacctgacggtttagaaacgcgtattggtaatggagcgcgtccgcttagtggaggacaagcccagcgtatagctctggctcgtgcttttcttgatcaaaatcgtcgtattatggtttttgatgaaccaactgctcatttagatattgaaacagagttagaattaaaagagaaaatgttgccactgatgtcagatcgtttagttatctttgcaactcatcgtcttcactggttgaaccaaatggatgttatagtcgttatggagaaggggagagttgcagaagtaggctcttatcaggaattattagctaaaaaaggatatctctatcaactgaagcatgctatgggaggaaatgatgtt

SEQ ID NO: 4980 - protein, 572 aa, Streptococcus agalactiae
MLDKAVMRLSGIHKLLGLLAGLDVLQAIFIIGQAYYLSLSITGLWEGQKLSSQTVYILLFMVSYLGRHVIDYIKNRKLDDFSTAQSSLLRRQLLDKLFDLGPKVVQEQGTGNVVTMALDGVSLVENYLRLVLNKMINMSIIPWIILAYIFYLDIESGAILLIVFPLIIIFMIILGYAAQAKADKQYESYQVLSNHFLDSLRGIDTLKYFGLSKRYGKSIYQTSESFRKATMSTLKIGILSTFALDFFTTLSIAIVAVFLGLRLLNEQIYLLPALTILILSPEYFLPVRDFSSDYHATLDGKNAFQAIQKVLNKTGIKGEQLVIDDWSKESRLDLENIAIAYDQKRVVEDVTLRFRGHQKVALVGVSGSGKSSLINLLSGFLGPDNGSLKVDGREVTNLDQEDWHKQMIYIPQTPYVFEMSLRDNITFYTPNASDEEVVRAIHMVGLDSLLSELPDGLETRIGNGARPLSGGQAQRIALARAFLDQNRRIMVFDEPTAHLDIETELELKEKMLPLMSDRLVIFATHRLHWLNQMDVIVVMEKGRVAEVGSYQELLAKKGYLYQLKHAMGGNDV

SEQ ID NO: 4981 - DNA, 1761 bp, Streptococcus pyogenes
atgatggaaacagaagatacaatatcaaggggaaaaaggaaaagactgttaaaacgattacgtgaacgaattgcaccaaaaaggtatttgctttatgtgtcagcctttttatcttggttacaatttgtgatgaggatgatcagtttttacctcattgccaaaacgttttcgacctttattttgggtcatgctattgccttaggacgcttggcaggtttactcctacttttaaatgtggtaggctttgttcttgctatattaggcaagcaactgcaagggatcgcttcacaatttgctagagattcactcaaacaatctttctttgaggcttttattgatttagacgggcaatttgatgctcatgccagtgatgctgatattttaacgttggcttcacaggggattgatagtttggatacttattatggttactatttgtctttgtctatgagaaccaagtggaactgcacaactattatgatactagtctttttaatttatccattggcaggccttgtctttttaggagttctgcctctgattccactttcaatcgttgctatgcaaaagcggtctcagccaaacatgagtcattattggtcctcttatatggatgttggtaatttatttatggatgacttaaaaggtcttaatacactgtattcttatcaagcaacagaacgttacgagcaagaattttcgggtaaggcagaacagtttcgaaaggctaccatgtctttgcttggctttcagttacaagcagttggttatatggatgcagttatgtatctgggaattggtttgtcaggttttttagccgttcaagctttggcaacaggccagttatctttttttaatttcctattttttctcttgattgctacagaattttttacaccgattcgtgagcagggttatggcatgcacttggtcatgatgaataccaaaatggctgaccgtatctttagtttcttggatagtgttccagcaagaaaagataacaagagtaaaacagcaataaactttaaccagattgacatccaaaatatttctttagcttatgagaaaaaaacagtgcttagtggggttaccatgacattaacgaagggccaactaacagctatcgcgggggtgtcaggacaaggaaaaacaagtctagctcaactcctcttgaaacgccagtctgcaacgactgggcatattttatttgacggtttagacagtgacaatttgtcgcaagaaactatcaaccagcaggttctttatgtatcggaccaatctaccttattgaaccgtagcatttacgataatttaaggttagcagcaaatctctctaaaaaagaaatcttagattggatagatcaacatggtttgttaagcttcatcaactggctaccagatggtcttgacacaatagttggtgaaaatggtaacctgttatcaccaggccaaaagcaacaggtgatttgcgcaagagctctattaagtaagaggtctctttatatctttgatgaggcaacatctagtctagatgcagaaaatgaacgtattattgacaatttaataacgagattagctaagacagcaatagttattgtgattactcataagatgtctcgactgaaaggagctaaccaagtactctttttaaacacagggcagcctgcttgtttaggcaaaccttgcgacctttatcgggaccaaccaacttatcgtcacctagttgatactcaagcaagactggaggcaagtatttatggc

SEQ ID NO: 4982 - protein, 587 aa, Streptococcus agalactiae
MMETEDTISRGKRKRLLKRLRERIAPKRYLLYVSAFLSWLQFVMRMISFYLIAKTFSTFILGHAIALGRLAGLLLLLNVVGFVLAILGKQLQGIASQFARDSLKQSFFEAFIDLDGQFDAHASDADILTLASQGIDSLDTYYGYYLSLSMRTKWNCTTIMILVFLIYPLAGLVFLGVLPLIPLSIVAMQKRSQPNMSHYWSSYMDVGNLFMDDLKGLNTLYSYQATERYEQEFSGKAEQFRKATMSLLGFQLQAVGYMDAVMYLGIGLSGFLAVQALATGQLSFFNFLFFLLIATEFFTPIREQGYGMHLVMMNTKMADRIFSFLDSVPARKDNKSKTAINFNQIDIQNISLAYEKKTVLSGVTMTLTKGQLTAIAGVSGQGKTSLAQLLLKRQSATTGHILFDGLDSDNLSQETINQQVLYVSDQSTLLNRSIYDNLRLAANLSKKEILDWIDQHGLLSFINWLPDGLDTIVGENGNLLSPGQKQQVICARALLSKRSLYIFDEATSSLDAENERIIDNLITRLAKTAIVIVITHKMSRLKGANQVLFLNTGQPACLGKPCDLYRDQPTYRHLVDTQARLEASIYG

SEQ ID NO: 4983 - DNA, 1764 bp, Streptococcus agalactiae
atgctatgggaggaaatgatgtttaaaatccctttgtttaaagaattaaagacagatcaatggataaaaccatttttcaaacaatataaagtttccttagtaattgctcttttccttggttttatgactttcttttctgccagtgctcttatgtttaattcgggctatctgattagtaagtcagcttcactaccgagtaatattcttctagtatatgttccaattgtactaacacgtgcttttggcattggacgtcctgtttttcgttatatagaacgcctaacgagtcacaattgggtattacgaatgacttcacagctgcgcttgaagctttaccattccttagaaagcaatgctatctttatgaagcgtgattttcgtttaggagatgttatggggcttttagcggaggatattaattatttgcaaaatttgtatcttaggacaatatttccaacgattatagcgtggatattatatagctttattattattgcaacaggcttcttttctctatggtttgctttaatgatgttgctttatttagctattatgatttttctttttccactttggtcgattttagctaatggtgctcgtcagactcgtgaaaaagaattaaaaaatcatctttatactgatttgacggataatgtcttaggtatttcagactggatttttagtcaacgtggtcaagagtacgtcgccttgcatgagcgttcggaaagtgaactcatggctgttcagaaaaaaattcgttcctttgataatcgtagagctcttattgtggaattagtttttggctttctagctattttggttattatttgggctagtaatcagtttattggtcacagaggtggcgaagctaactggattgcagcatttgttctaacagtatttcccttgtcagaggcatttgctggtttgtctgctgctgctcaagaaacaaataaatattctgattcaattcatcgtcttaatgaattatcagaaacgtattttgaaacaactcaaaatcagttgcctaataagccatacgatttttccgtcaagaatttaagtttccagtataagccacaagagaaatgggttttgcatcatttagatttggatattaaagaaggagaaaaaattgctattttagggcgtagtggttctggcaagagtaccttagccagtctacttcgtggcgacttgaaagcaagtcaaggggagattaccctaggcgatgctgatgtttcaatagttggtgattgcatttctaactatattggagtgatacaacaagcgccctacctttttaatacaaccctgctaaataacattcgcattggaaaccaagatgctagtgaagaagatgtatggaaagttcttgaacgagttggattgaaagagatggtcactgatttatcagatggtctctatacaatggttgatgaagctggacttaggttttcaggtggcgaaaggcatagaattgctttggctagaatcttactaaaagatgtcccaattgttatcttagatgagccaactgttggacttgatcctattactgaacaagccttactaagggtatttatgaaagaattggaaggtaagaccttagtttggattacacatcacttaaaaggtattgaacatgctgatcgtatcttatttatagaaaatgggcaattagagttggaaggttctcctcaagaattgtctcaaagtagccaacgttaccgtcagctgaaagcctctgatgatggtgatcta

SEQ ID NO: 4984 - protein, 588 aa, Streptococcus agalactiae
MLWEEMMFKIPLFKELKTDQWIKPFFKQYKVSLVIALFLGFMTFFSASALMFNSGYLISKSASLPSNILLVYVPIVLTRAFGIGRPVFRYIERLTSHNWVLRMTSQLRLKLYHSLESNAIFMKRDFRLGDVMGLLAEDINYLQNLYLRTIFPTIIAWILYSFIIIATGFFSLWFALMMLLYLAIMIFLFPLWSILANGARQTREKELKNHLYTDLTDNVLGISDWIFSQRGQEYVALHERSESELMAVQKKIRSFDNRRALIVELVFGFLAILVIIWASNQFIGHRGGEANWIAAFVLTVFPLSEAFAGLSAAAQETNKYSDSIHRLNELSETYFETTQNQLPNKPYDFSVKNLSFQYKPQEKWVLHHLDLDIKEGEKIAILGRSGSGKSTLASLLRGDLKASQGEITLGDADVSIVGDCISNYIGVIQQAPYLFNTTLLNNIRIGNQDASEEDVWKVLERVGLKEMVTDLSDGLYTMVDEAGLRFSGGERHRIALARILLKDVPIVILDEPTVGLDPITEQALLRVFMKELEGKTLVWITHHLKGIEHADRILFIENGQLELEGSPQELSQSSQRYRQLKASDDGDL

SEQ ID NO: 4985 - DNA, 1704 bp, Streptococcus pyogenes
atgcttaaagacgcaatcttacgttataaatggtatgctttaggctcattttttatggttattggggttgttgcaagtagtctcttgcaaccacattatcttaaatctgtgctaagcgctgttattcaaaataatcaagagaaaatttatgaggttgggaaaccattacttattattgcccttttagggttaatgtctggagcgattaatacggttttagctgctaaaatagctcaaggtgtatctgctgatatgagggagaagacctttcgaaaaatccaagacttttcatatgccaatattgaagcttttaatgctggtaatcttgtggttaggctaactaatgatatcaatcaaatccaaagtttagtcatgatgatgtttcaaattctctttcgtttgccgatcctttttattggcgcgtttattatggcagttcagacattccctcaattatggtgggtcattgttgtaatggttatcttaattgccctcatcatgggtttggtgatgcgtcaaatgggtcctcgttttggtaaatttcaacggttaatggataagattaatcgcatcgctaaggaaaatctccgtggcgttcgcgtggttaaatcatttgtacaagaacaacaacaatacactaaatttaaagaaacgtccaatgatcttttggcgttaaatttatctattggttatggtttttcactaatgcagccggctttaatgttggtgtcttatttggcagtttatgtttctataaatgttgtttcgaccatggtcgaaacagatccaacagtgattgggaatattgcctctttcatgacttatatgatgcaaattatgttttcaattattgtggttggttccatggggatgcaagttagtcgtgcttttgtttctatggctagaattaggcaaatattgtctacagaacctgccatgacatttgaaaatgaaaaggaagaaaccatctcaggaagcattgtatttgacgatgttagttttacatatcctaatgatgatgagccaaccttgaagcacatttcttttgctattgaacctgggcaaatggtcggcatcgttggtgcaacaggatctgggaaatcaacgcttgcacagctcatccctcgcttatttgatcctcaagatggccaaattttgttaggaggaaagccgattaaaaccctaagtcaaacaaccctgcgccaatcggtttccatcgtgttgcaaaaggctattctcttttcaggaacgatagctgataaccttcgccaaggctcagcaaaagctgatattgatgctatgcaaaaagccgctcaaatcgcgcaagcaaaagaatttattgatcgtatggatagccgttatgagagccaagttgaagagcgaggtagtaacttgtctggcggacaaaagcaacgtctgtctattgcacgtggtgtcattaatcatcccaaaattcttatattagacgattccacttcagctcttgatgcaaaatctgaaaaacgcgttcaagaagccttaagtcataaattagaaggtacaactacagttattgttgctcaaaaaatttcatcggtagttaaggcagataagatcttagtccttgaccaaggacagttaattggagaaggaacacacgcagagttggtggctaataatgcgatttatcgtgaaatttatgagacacaaaaaggaagggaggag

SEQ ID NO: 4986 - protein, 568 aa, Streptococcus pyogenes
MLKDAILRYKWYALGSFFMVIGVVASSLLQPHYLKSVLSAVIQNNQEKIYEVGKPLLIIALLGLMSGAINTVLAAKIAQGVSADMREKTFRKIQDFSYANIEAFNAGNLVVRLTNDINQIQSLVMMMFQILFRLPILFIGAFIMAVQTFPQLWWVIVVMVILIALIMGLVMRQMGPRFGKFQRLMDKINRIAKENLRGVRVVKSFVQEQQQYTKFKETSNDLLALNLSIGYGFSLMQPALMLVSYLAVYVSINVVSTMVETDPTVIGNIASFMTYMMQIMFSIIVVGSMGMQVSRAFVSMARIRQILSTEPAMTFENEKEETISGSIVFDDVSFTYPNDDEPTLKHISFAIEPGQMVGIVGATGSGKSTLAQLIPRLFDPQDGQILLGGKPIKTLSQTTLRQSVSIVLQKAILFSGTIADNLRQGSAKADIDAMQKAAQIAQAKEFIDRMDSRYESQVEERGSNLSGGQKQRLSIARGVINHPKILILDDSTSALDAKSEKRVQEALSHKLEGTTTVIVAQKISSVVKADKILVLDQGQLIGEGTHAELVANNAIYREIYETQKGREE

SEQ ID NO: 4987 - DNA, 978 bp, Streptococcus agalactiae
atgtcatcttattggaataactatcctgaacttaaaaaaaatattgatgaaaccaatcaactaattcaagaaagaatacaggtcagaaataaagatattgaagcggcgctaagccaactcacagctgcgggaggaaaacagctcagaccagcattcttttaccttttttctcaacttggtaataaggagaatcaagatactcagcaactaaagaaaatcgctgcttctttagaaatccttcacgttgctacattaatccatgatgatgtcattgatgactcaccactaagacgtggaaatatgaccattcaaagcaagtttggcaaagacatcgcagtttacactggggatttacttttcacagtctttttcgatcttattttagaatctatggctgatacaccatttatgaggattaatgcaaaatctatgcgtaaaattctcatgggagaattggaccagatgcaccttcgttacaatcaacaacaaggtatccatcactatttacgtgcgatttcaggtaagacagccgaactctttaaattagctagcaaagaaggagcttactttggtggtgcagagaaggaggttgttcgtctagcaggccatatcggctttaacattggtatgacattccaaattttggatgatatcctggattatactgcagataaaaaaacatttaacaagcctgtcttagaggatttagcacaaggcatttacagccttcctctacttcttgccattgaagaaaatcctgatattttcaaacctattttagataaaaaaacagatatggctactgaagacatggaaaaaattgcttatctcgtcgtttcccatagaggtgttgacaaagctcgccatctagctcgtaaatttactgaaaaagctattagtgacataaataagctaccccagagctctgcaaaaaaacagttgctacaattaactaattaccttttaaaacgcaaaatt

SEQ ID NO: 4988 - protein, 326 aa, Streptococcus agalactiae
MSSYWNNYPELKKNIDETNQLIQERIQVRNKDIEAALSQLTAAGGKQLRPAFFYLFSQLGNKENQDTQQLKKIAASLEILHVATLIHDDVIDDSPLRRGNMTIQSKFGKDIAVYTGDLLFTVFFDLILESMADTPFMRINAKSMRKILMGELDQMHLRYNQQQGIHHYLRAISGKTAELFKLASKEGAYFGGAEKEVVRLAGHIGFNIGMTFQILDDILDYTADKKTFNKPVLEDLAQGIYSLPLLLAIEENPDIFKPILDKKTDMATEDMEKIAYLVVSHRGVDKARHLARKFTEKAISDINKLPQSSAKKQLLQLTNYLLKRKI

SEQ ID NO: 4989 - DNA, 2283 bp, Streptococcus agalactiae
atgcgttataatcaattcagctacattccaactaaacctaacgaagcttttgaagagctcaaaggactaggttttccattaaacaaaaagaattctgataaagctaatttggaagcttttctcagacattcttttttaaatcaaactgatactgattacgctcttagtctccttatcgttgatgcaaaaaccgatgctctaaccttttttaaatcaaatagtgacttaacactagaaaatttacaatggatttatttacagttattaggctttatcccttttgtagactttaaagaccctaaagcattcttacaagatattaacttcccagtctcatatgacaatatttttcaaagtctacatcacttactcgcctgtcgtggaaaatctggcaatacattaatcgaccaattagttgctgatggtttacttcatgcagataatcactaccattttttcaatgggaagtctctggccactttcaatactaaccaattgattcgcgaagttgtctatgttgaaacatccttagatactatgtctagtggtgaacatgatttagtaaaagttaacattatcagacccactaccgagcatactatccctacgatgatgacagctagcccctatcatcaaggtatcaatgatcctgccgcagaccaaaaaacataccaaatggagggtgcgctagcagttaaacaacctaaacacatacaagttgacacaaaaccatttaaagaagaagtaaaacatccttcaaaattacccatcagccctgcaactgaaagcttcacacacattgacagttatagtctcaatgactattttctttctcggggttttgctaatatatacgtttcaggtgtgggtactgctggctctacgggtttcatgaccagtggggattaccaacaaatacaaagctttaaagcagtcattgattggttaaatggtaaggttactgcattcacaagtcataaacgagataaacaagtcaaggctaattggtcaaatggccttgtagcaaccacaggtaaatcttatcttggtaccatgtcaactggtttagcaacaactggcgttgaggggctgaaagtcattatcgctgaagccgcaatctccacatggtatgattattatcgagaaaatgggcttgtgtgtagtccaggcggctaccccggtgaagatttagacgttttaacagaattaacatactcacgaaacctcttagctggtgattacatcaaaaacaacgattgctatcaagcattgttaaatgaacaatcaaaagcaattgaccgtcaaagtggggattacaaccaatactggcatgaccgtaattacctaactcacgtcaataatgtcaaaagtcgagtagtttacactcatggactacaggattggaatgttaagccaagacatgtctataaagttttcaatgcattgcctcaaaccatcaaaaaacacctttttttacatcaaggtcaacatgtgtatatgcataattggcagtcgattgattttcgtgaaagcatgaatgccttactaagccaagaactacttggcattgacaatcatttccaattagaagaggtcatttggcaagataatactactgagcaaacttggcaagttttagatgctttcggaggaaaccatcaagagcaaattggtttaggtgatagtaaaaaacttattgataaccattatgacaaagaagcctttgatacttattgtaaagacttcaatgtgttcaaaaatgatcttttcaagggaaataataaaaccaatcaaatcactattaatcttcctctaaagaaaaattatctcctgaatggacagtgcaaactccatctacgtgttaaaactagtgacaaaaaggccattttatcagcccaaatcttagactatggtcctaaaaaacgattcaaagatacaccaaccatcaaattcttaaacagccttgataatggtaaaaattttgccagagaagctttacgtgaactcccgtttactaaagatcattatcgtgtcatcagtaaaggtgtcttgaaccttcaaaatcgtacagacttacttacaattgaggctatcgagccagaacaatggtttgatatcgagtttagcctccaaccaagtatatatcaattgagtaaaggtgataatctaaggattatcctttatacaactgattttgaacataccattcgagataatgctagttactctataacagtagatttaagtcaatcttatttaactatcccaactaatcaaggaaat

SEQ ID NO: 4990 - protein, 761 aa, Streptococcus agalactiae
MRYNQFSYIPTKPNEAFEELKGLGFPLNKKNSDKANLEAFLRHSFLNQTDTDYALSLLIVDAKTDALTFFKSNSDLTLENLQWIYLQLLGFIPFVDFKDPKAFLQDINFPVSYDNIFQSLHHLLACRGKSGNTLIDQLVADGLLHADNHYHFFNGKSLATFNTNQLIREVVYVETSLDTMSSGEHDLVKVNIIRPTTEHTIPTMMTASPYHQGINDPAADQKTYQMEGALAVKQPKHIQVDTKPFKEEVKHPSKLPISPATESFTHIDSYSLNDYFLSRGFANIYVSGVGTAGSTGFMTSGDYQQIQSFKAVIDWLNGKVTAFTSHKRDKQVKANWSNGLVATTGKSYLGTMSTGLATTGVEGLKVIIAEAAISTWYDYYRENGLVCSPGGYPGEDLDVLTELTYSRNLLAGDYIKNNDCYQALLNEQSKAIDRQSGDYNQYWHDRNYLTHVNNVKSRVVYTHGLQDWNVKPRHVYKVFNALPQTIKKHLFLHQGQHVYMHNWQSIDFRESMNALLSQELLGIDNHFQLEEVIWQDNTTEQTWQVLDAFGGNHQEQIGLGDSKKLIDNHYDKEAFDTYCKDFNVFKNDLFKGNNKTNQITINLPLKKNYLLNGQCKLHLRVKTSDKKAILSAQILDYGPKKRFKDTPTIKFLNSLDNGKNFAREALRELPFTKDHYRVISKGVLNLQNRTDLLTIEAIEPEQWFDIEFSLQPSIYQLSKGDNLRIILYTTDFEHTIRDNASYSITVDLSQSYLTIPTNQGN

SEQ ID NO: 4991 - DNA, 2280 bp, Streptococcus pyogenes
atgcgctataatcaattttcctatattccaactagtctagaaagagcggctgaagaattaaaagaattgggctttgatctggatctgcaaaaaactgccaaagctagcctagaaagctttttacgtaaactcttcttccactaccctgatagtgattatcctttaagtcatctaatcgccaaaaatgacatggacgcattgagcttttttcaatcagagcaagagttatccaaagaggtttttgatttactggccctgcaagtccttggctttattcctggagttgattttacagaggccgatgctttccttgataaactggcctttcctatccactttgacgaaacagaaattatcaagcatatccaccacttattagcgacccgttgtaagtctggcatgaccctgattgatgatttggtcagccaaggaatgcttactatggacaatgattaccacttcttcaacggtaaatcattagctacctttgacacgtcacagctgattcgagaagttgtttacgttgaagcacctcttgataccgatcaagatggccaacttgatcttattaaggttaatatcattcgtcctcaatctcaaaaaccattaccaactttgatgacacctagtccataccatcaaggtatcaatgaagtagccaacgacaaaaaactttatcgtatggaaaaagagttagtcgttaaaaaaaggagacaaatcactgtcgaagacagggattttattcctcttgagacacagccttgcaaacttcctataggtcaaaatctagaaagctttagctacattaactcctatagcctcaacgattatttcctcgcacgtgggtttgctaatatctatgtttcaggtgtgggaactgctggttccactggctttatgacgagtggaaactatgctcaaattgaaagctttaaagccgttattgattggctaaatggaagagccacagcctacaccagccactcaaaaacccaccaagtgagagctgattgggcaaatggtctagtttgtacgactggaaagtcctacttgggaactatgtctactggtttagccactacaggcgtagacggattagccatgattattgcagaatcagctatttcttcttggtacaactactaccgcgaaaatggcttagtttgtagtcctggtggctatcctggagaggatctagatgtcttaactgagctcacctactcgcgtaatttattggctggcgattatcttcgccataatgatcgttatcaagaattgctaaaccaacagtctcaggcgttagaccgacaatctggtgattataatcaattttggcacgaccgcaattacttaaaaaatgctcatcaaataaagtgtgatgtcgtttatactcatggcttacaagactggaatgtcaaaccaagacaggtctatgagattttcaatgcgcttccttccacaatcaacaagcacctctttttacatcaaggtgagcatgtttacatgcataattggcaatccattgattttcgcgaaagcatgaatgcccttttatgtcaaaaactcttaggcctagctaatgattttagccttcctgaaatgatctggcaggataacacctgcccacaaaactggcaggagcgtaaagtctttggaacctcaaccatcaaagagcttgacctcggtcaggaactgcttttaattgataatcactatggtgaagatgaatttaaagcttacggtaaagatttccgtgcgttcaaagcagctctctttaaaggcaaggccaatcaagccctgattgatattttactggaagaggacttacctattaacggtgaaattgtcctacagttaaaagtgaaatcaagtgaaaataaaggacttctatctgcacaaatccttgactatggtaagaaaaaacgcttgggcgatcttcctattgctctcacccaatcaagtattgacaatgggcaaaatttctctagggaaccccttaaagagctaccatttagagaagattcttaccgtgttatttcgaaaggtttcatgaatttacaaaatcgcaataatttgtcgtcaattgaaactattcctaataataaatggatgactgttagacttcctttgcaaccaaccatctatcatctagaaaaaggagatacccttcgagtcatcttatacacaaccgattttgaacatactgtccgtgacaacagcaactatgctttaactatcgatctcagtcagtctcaattgattgtgccaatagcatcaaat

SEQ ID NO: 4992 - protein, 760 aa, Streptococcus pyogenes
MRYNQFSYIPTSLERAAEELKELGFDLDLQKTAKASLESFLRKLFFHYPDSDYPLSHLIAKNDMDALSFFQSEQELSKEVFDLLALQVLGFIPGVDFTEADAFLDKLAFPIHFDETEIIKHIHHLLATRCKSGMTLIDDLVSQGMLTMDNDYHFFNGKSLATFDTSQLIREVVYVEAPLDTDQDGQLDLIKVNIIRPQSQKPLPTLMTPSPYHQGINEVANDKKLYRMEKELVVKKRRQITVEDRDFIPLETQPCKLPIGQNLESFSYINSYSLNDYFLARGFANIYVSGVGTAGSTGFMTSGNYAQIESFKAVIDWLNGRATAYTSHSKTHQVRADWANGLVCTTGKSYLGTMSTGLATTGVDGLAMIIAESAISSWYNYYRENGLVCSPGGYPGEDLDVLTELTYSRNLLAGDYLRHNDRYQELLNQQSQALDRQSGDYNQFWHDRNYLKNAHQIKCDVVYTHGLQDWNVKPRQVYEIFNALPSTINKHLFLHQGEHVYMHNWQSIDFRESMNALLCQKLLGLANDFSLPEMIWQDNTCPQNWQERKVFGTSTIKELDLGQELLLIDNHYGEDEFKAYGKDFRAFKAALFKGKANQALIDILLEEDLPINGEIVLQLKVKSSENKGLLSAQILDYGKKKRLGDLPIALTQSSIDNGQNFSREPLKELPFREDSYRVISKGFMNLQNRNNLSSIETIPNNKWMTVRLPLQPTIYHLEKGDTLRVILYTTDFEHTVRDNSNYALTIDLSQSQLIVPIASN

SEQ ID NO: 4993 - DNA, 669 bp, Streptococcus agalactiae
ttggaggaagtcatgaatcatcaaattttacaaaattacattaatagtcataatcttccaattatcgaaaaagactaccataaataccttacatttgaaagtttagaagaagactatacttatatcctaaaagatggtattgttaaacaaagtgttctctctaaatatggtactgagttcaatctgcgttatgtgacaggcttagaaatcacttctatcctaaatacagactactcccaacacatgggagaaccttacaacgttcgaatcgaatccgaaactgcccacttttacaaagtacgtcgctctaccttcctaaaagatatcaataatgatattgaactgcaaggatatgtgaaagatttctatcataaccgccttgaaaaatctatgaaaaaaatgcaatgtatgctcactaatggtcgaattggtgctatctccacacaattatatgacctcagtaagatgtttggtgaagaacgagataacggtgatatctatattaattttgttatcacgaacgaagaacttggtaaattttgcggaatatccacaggaagtagcgtgagccgcattttgaaacaactaaaagacgatcatattattcgtattgaaaaacaacatatcattattacaaatgttgagaaattaaaagatcatattgtattt

SEQ ID NO: 4994 - protein, 223 aa, Streptococcus agalactiae
MEEVMNHQILQNYINSHNLPIIEKDYHKYLTFESLEEDYTYILKDGIVKQSVLSKYGTEFNLRYVTGLEITSILNTDYSQHMGEPYNVRIESETAHFYKVRRSTFLKDINNDIELQGYVKDFYHNRLEKSMKKMQCMLTNGRIGAISTQLYDLSKMFGEERDNGDIYINFVITNEELGKFCGISTGSSVSRILKQLKDDHIIRIEKQHIIITNVEKLKDHIVF

SEQ ID NO: 4995 - DNA, 717 bp, Streptococcus pyogenes
atgttaatttctcttgaagatacaaattatacattggtaaaagaatatttggagaaaagcgtgaatcatcacattttgcaacggtatattgataatcataactttcctatcattgaaaaaagttatcacaagtacttgacttttgaaagtctcgaagaggacttcacttatattttaaaagacggcattgtgaaacagagtgttctttcaaaatatggaatggaatttaatttgagatatgttacaggacttgaaattacttctgttctcaacactggttattcaaaagatatgggagagccttataatgttcgcatcgagtcagagaaagctagtttttacaaggttcgccgctcagcatttttaaaagatataaacgaagatattgaactacaaggatatgtgaaggacttttaccataatcgtcttcaaaaatccatgaaaaaaatgcaatgtatgttaactaacggccgtatcggtgccatttctactcaaatatatgacttaatgaccctatttggcgaagaactaccaaatggccaaattttaattaattttgtcattactaatgaggaactcggtaaattctgtggcatttctaccgctagcagcgtcagccgtattctaaaacagttgaaagaaaaaaacatcattcgcattgataaacaacatattatcattaccaatcttgataaattaaaagataatatcgttttc

SEQ ID NO: 4996 - protein, 239 aa, Streptococcus pyogenes
MLISLEDTNYTLVKEYLEKSVNHHILQRYIDNHNFPIIEKSYHKYLTFESLEEDFTYILKDGIVKQSVLSKYGMEFNLRYVTGLEITSVLNTGYSKDMGEPYNVRIESEKASFYKVRRSAFLKDINEDIELQGYVKDFYHNRLQKSMKKMQCMLTNGRIGAISTQIYDLMTLFGEELPNGQILINFVITNEELGKFCGISTASSVSRILKQLKEKNIIRIDKQHIIITNLDKLKDNIVF

SEQ ID NO: 4997 - DNA, 1200 bp, Streptococcus agalactiae
ttggaagacaaattattcaacaaacattttataggcattactattttaaactttattgtttatatggtctattatttgtttaccgttatcatagcttttattgcgactaaagagttaggtgttagcactagccaagcaggattagcaacggggatttatattgtagggactttgattgctcgtcttatatttggcaagcaattagaagttctaggacgtaagttagttttacgtggaggggctattttttacttactaacaactttagcttatttttatatgccaagtatcggagtaatgtatttagttcgtttcctaaatggttttggttatggcgtcgtgtcaacagcaactaatactattgtaacagcctatataccagctgataaaagaggtgaggggattaacttttacggtctatcaacaagtttagccgcagctattggtccttttgtaggaacatttatgctagacaaccttcatattaactttaaaatggttattgtattatgtagtattttaattgcgattgtagtgttgggagcatttgttttcccagtcaaaaatattactttaaatccagaacagttagctaaatcaaaatcatggactattgatagtttcattgagaaaaaagcaatttttatcacaattattgcatttttgatgggtatctcctatgcttccgtgttaggtttccaaaaattatatacaacagaaattaatttgatgacagtaggagcttatttctttattgtttatgcacttgtcatcactttaaccagaccatctatgggaagattaatggacgctaagggagataagtgggtgctttatccaagttatctgttcttaactttgggacttgctttattagggagtgctatgggaagtgttacctaccttctatcaggtgctttgattggttttggttatggcacctttatgtcttgtggccaagcagcatcaatcaaaggtgttgaggaacatcgtttcaatacagccatgtcaacttacatgataggtcttgatttagggttaggtgctggaccttacattttgggacttgttaaagatggttttcttggagctggtgtgcaatcctttagagaattattctggatagcagcgattattcctgttgtttgtggtattctatatttcttaaaatcatctagacaagttgaaactaaaactata

SEQ ID NO: 4998 - protein, 400 aa, Streptococcus agalactiae
MEDKLFNKHFIGITILNFIVYMVYYLFTVIIAFIATKELGVSTSQAGLATGIYIVGTLIARLIFGKQLEVLGRKLVLRGGAIFYLLTTLAYFYMPSIGVMYLVRFLNGFGYGVVSTATNTIVTAYIPADKRGEGINFYGLSTSLAAAIGPFVGTFMLDNLHINFKMVIVLCSILIAIVVLGAFVFPVKNITLNPEQLAKSKSWTIDSFIEKKAIFITIIAFLMGISYASVLGFQKLYTTEINLMTVGAYFFIVYALVITLTRPSMGRLMDAKGDKWVLYPSYLFLTLGLALLGSAMGSVTYLLSGALIGFGYGTFMSCGQAASIKGVEEHRFNTAMSTYMIGLDLGLGAGPYILGLVKDGFLGAGVQSFRELFWIAAIIPVVCGILYFLKSSRQVETKTI

SEQ ID NO: 4999 - DNA, 1299 bp, Streptococcus pyogenes
ttgctaatgccctttgatagtaacacttatattataccattgaaatatattatattctgctttttttgtaaaatgtttatgaaaatagagaggagttcattttcaatggaagaaaaattgtttaacaaacattttgtggccatcacagtaataaactttatagtctatatggtctactatctttttacagttattattgcctttgtggcgactagagagctaggagctcagactagccaggcaggattggcaacagggatttatattctagggactttattagcccgtttgatttttggaaagcagttggaggtgtttggtcgtcgtttggttttaagaggaggtgctattttttacctcttaacgaccttagcctacttttatatgccaacgattagcatgatgtacttggttcgtttcttgaacggatttggttatggtgtagtatcaactgcgacaaataccattgtaacagcctatattccagctcgtaaaagaggagaaggaattaatttttatggcttgtcaaccagtctagcagcagctattggcccttttgtaggaacctttatgttggataatcttcatattgattttcgcatgattattgtcttatgtagcgtcttgattgggtgtgtggttgttggtgcttttgcttttccagtcaaaaacatgtctttaaatgcggagcaattggctaaaaccaaatcgtggactgtggatagtttcattgagaaaaaagccttgtttatcactgcaatcgcctttttaatggggattgcctatgcttcagttttaggatttcaaaaattatacacgtctgaaattcatttgacaacagtaggcgcttatttctttgtggtctatgccttaatcattaccatcactcgtccagcaatgggacgtttaatggatgctaaaggcgataaatgggtcttgtacccaagttatctttttttagcaatgggactcttcttgctaggtagtgtatcgtctggaggaagctatttgctttcaggagccttgattggctttggttatggcacttttatgtcttgtggtcaagccgcctccatacaaggagtggatgagcaccgctttaatacggctatgtctacttatatgattggtcttgatttaggtttaggtgctgggccttacctcttgggcttgattaaagatttggcacttggtagtggtgtggcttcctttaggcacttattctggttagctgctgtgattccactgatttgtaccttgctttacttgttaaaaacaaagacaagacaggttgtgtct

SEQ ID NO: 5000 - protein, 433 aa, Streptococcus pyogenes
LLMPFDSNTYIIPLKYIIFCFFCKMFMKIERSSFSMEEKLFNKHFVAITVINFIVYMVYYLFTVIIAFVATRELGAQTSQAGLATGIYILGTLLARLIFGKQLEVFGRRLVLRGGAIFYLLTTLAYFYMPTISMMYLVRFLNGFGYGVVSTATNTIVTAYIPARKRGEGINFYGLSTSLAAAIGPFVGTFMLDNLHIDFRMIIVLCSVLIGCVVVGAFAFPVKNMSLNAEQLAKTKSWTVDSFIEKKALFITAIAFLMGIAYASVLGFQKLYTSEIHLTTVGAYFFVVYALIITITRPAMGRLMDAKGDKWVLYPSYLFLAMGLFLLGSVSSGGSYLLSGALIGFGYGTFMSCGQAASIQGVDEHRFNTAMSTYMIGLDLGLGAGPYLLGLIKDLALGSGVASFRHLFWLAAVIPLICTLLYLLKTKTRQVVS

SEQ ID NO: 5001 - DNA, 450 bp, Streptococcus agalactiae
atgacacaaaaatatgagcgtattcttattgctattgatgggtcttacgagtcagaattggcggtagaaaaagggataaatgttgctcttcgtaatgatgctgaattactgctaacgcatgttatagatgctcacgcttaccaaagtgagggagtctttagtgactatgtttttgataggcaagaacaagagtcagcagatgtgctagcctattttgagaaattagcacattcaaaaggccttacaaagattaaaaaaattactgaaatcggaaatcctaagactcttttggcaaaggatatccccataagggaaaaagcagatttaattatggtaggcgcaacaggattaaacacttttgaaagactattgatcggctcaacttcagaatacattttacgtcattcgaaagttgatatgctagtcgttcgtgatagtaagaaaacctta

SEQ ID NO: 5002 - protein, 150 aa, Streptococcus agalactiae
MTQKYERILIAIDGSYESELAVEKGINVALRNDAELLLTHVIDAHAYQSEGVFSDYVFDRQEQESADVLAYFEKLAHSKGLTKIKKITEIGNPKTLLAKDIPIREKADLIMVGATGLNTFERLLIGSTSEYILRHSKVDMLVVRDSKKTL

SEQ ID NO: 5003 - DNA, 846 bp, Streptococcus agalactiae
ttgatcgaaatcacttggactgtgaagtatatcacagaatttatcgcaaccgcttttcttatcatcttaggaaatggggctgtagctaacgttgacttaaaaggcacaaaaggaaataattcaggttggattattattgcaattggttatggtttaggtgttatgatgccagcgcttatgtttggtaatgtctctggaaaccatattaacccagctttcacacttggattggcattttcaggtcttttcccttgggcacacgttggacaatacattcttgcacaaattttaggagcaatgtttggacagttagttgtcgttatggtttatcaaccttactttgttaagacagaaaatccaaatcatgttcttggatcattttcaactatttctgcattagatgatggacagaaatcaagtcgtaaagcggcttacattaatggtttcttaaatgaattcgttggttcttttgttcttttctttggagctttggctttaacgaagaactattttggtgtagaacttgttggtaaacttgttcaagctggttatgaccaaacgacagcagcgacaaggatttcaccatacgtaactggttcacttgctgtagctcacttaggtattggtttcttggtaatgactctagttgcttctttaggtggaccgactggacctgcattgaaccctgcgcgtgaccttggtccacgtattgttcaccgcttattaccaaaacaaattcttggacaagctaaagaagattcaaaatggtggtatgcatgggtgccagttttagcaccaatcgtagcaagtatactcgctgtagccttgttcaaactattatatctt

SEQ ID NO: 5004 - protein, 282 aa, Streptococcus agalactiae
MIEITWTVKYITEFIATAFLIILGNGAVANVDLKGTKGNNSGWIIIAIGYGLGVMMPALMFGNVSGNHINPAFTLGLAFSGLFPWAHVGQYILAQILGAMFGQLVVVMVYQPYFVKTENPNHVLGSFSTISALDDGQKSSRKAAYINGFLNEFVGSFVLFFGALALTKNYFGVELVGKLVQAGYDQTTAATRISPYVTGSLAVAHLGIGFLVMTLVASLGGPTGPALNPARDLGPRIVHRLLPKQILGQAKEDSKWWYAWVPVLAPIVASILAVALFKLLYL

SEQ ID NO: 5005 - DNA, 945 bp, Streptococcus pyogenes
atgatcattttatttattattttattacctttacattcatcaataagcctgttaaaatggtatttgttatattttattatttggaggaaaccagaaaacatggaaatgacatggactgtgaaatacatcacagaatttatcgcaacggcttttttgattattttgggaaatggagctgttgctaacgtcgacttaaaaggaacaaaaggacataactcaggttggttagtgattgcttttggctatggcttaggagttatgatgccagctttgatgtttggtaatgtatctggaaaccatattaatcctgctttcacagttggactagcagtatcaggcttgttcccatgggctcacgtcttacaatacgttgtggcacaattacttggagctatctttggtcagttggtagtggtaatggtttataaaccttactttatgaaaactgaaaatccaaatcatgttttaggctcattctcaacgatttcatctcttgataatggtcaaaaagacagtcataaagcctcttatatcaatggtttcttaaacgaatttgtaggttcatttgttcttttctttggtgctttggctttgactaaaaactactttggggtagagttagttggtaaattgattgaagcaggctacgaccaaacaactgcagcaacacaaatttcaccatacgtgacaggctcattggcggttgctcacattggtattggtttcttagttatggtcttggttacttcattaggtggaccaactgggccagcactaaacccagcgcgtgattttgggcctcgtttgttacaccacttcttaccaaaatcagttcttggtcaagccaaaggtgattcaaaatggtggtatgcatgggttcctgtagttgcacctatcttagcggcgatagtagccgtagcagcgtttaaatacctttatatcaga

SEQ ID NO: 5006 - protein, 315 aa, Streptococcus pyogenes
MIILFIILLPLHSSISLLKWYLLYFIIWRKPENMEMTWTVKYITEFIATAFLIILGNGAVANVDLKGTKGHNSGWLVIAFGYGLGVMMPALMFGNVSGNHINPAFTVGLAVSGLFPWAHVLQYVVAQLLGAIFGQLVVVMVYKPYFMKTENPNHVLGSFSTISSLDNGQKDSHKASYINGFLNEFVGSFVLFFGALALTKNYFGVELVGKLIEAGYDQTTAATQISPYVTGSLAVAHIGIGFLVMVLVTSLGGPTGPALNPARDFGPRLLHHFLPKSVLGQAKGDSKWWYAWVPVVAPILAAIVAVAAFKYLYIR

SEQ ID NO: 5007 - DNA, 957 bp, Streptococcus agalactiae
ttgtgctctcaataccataaagtcaaattgacagtttcactatttttttgtagactggatattatgaatgaaacactactattacatgggattcagcttattctgattatcgccatgattatcactttttatcagattgttagacatattaggtctcaaaaaataaatcctttcaaacgatttttcactggtttgtggatcggttttgtaactgatgctctcgatactcttggtatcggctcttttgcaacaacgaccacattttttaaactaactaagcttgttgaagacgatcgtaagatacccgcaacaatgacagctgcacacgtacttccagttttgttgcagtcactctgttttatttttgttgtaaaagtagaggctttaacactaataacaatggctggtgcagcttttattggggcttttgttggagctaaaatgactaaaaattggcacgctcctactgttcaacgtattctaggaacactgctcatcacagctgctattattatgctctatcgtatgatcactaaccctggcgctggtatttcagattcagtgcatggtctacacggcatttggttatttgttggtatcggcttcaattttattattggtgtattaatgactatgggactaggtaattatgctcccgaacttatcttcttctccctaatgggactgagtcctgcagttgctatgcctgtcatgatgctagatgcagctatgataatgacagcttctagtacacaatttatcaagagtggtcgtgttaattggaacggctttgccggtctggttactgggggaatattaggcgttattgtcgctgttctcttcttaactaaccttgatcttaacagcttgaaaacactggttgtaggtattgttttatttactggagcaatgttaatacgttcttcctttaaaaaaactatgcccaaaagtcatcat

SEQ ID NO: 5008 - protein, 319 aa, Streptococcus agalactiae
MCSQYHKVKLTVSLFFCRLDIMNETLLLHGIQLILIIAMIITFYQIVRHIRSQKINPFKRFFTGLWIGFVTDALDTLGIGSFATTTTFFKLTKLVEDDRKIPATMTAAHVLPVLLQSLCFIFVVKVEALTLITMAGAAFIGAFVGAKMTKNWHAPTVQRILGTLLITAAIIMLYRMITNPGAGISDSVHGLHGIWLFVGIGFNFIIGVLMTMGLGNYAPELIFFSLMGLSPAVAMPVMMLDAAMIMTASSTQFIKSGRVNWNGFAGLVTGGILGVIVAVLFLTNLDLNSLKTLVVGIVLFTGAMLIRSSFKKTMPKSHH

SEQ ID NO: 5009 - DNA, 930 bp, Streptococcus pyogenes
ttgacggctaaggtttttttttgtaaactagtctttatgaacgaaatgcttatccttagactgatacaagctttgctagtttcggcaatgctttttattttctttatgttagtaaaacatcttaaaaaaaataagatcaatccttttaaacgcttttggacggggttttggattggcctgctaacagatgcccttgacacccttgggatagggtcttttgctactaccacaacgtgctttaagttaactaaattagtcactgacgatagacaattgcctggcactatgaccgtagctcatgtgcttccggtgctcattcaatctctttgctttatttttgtcgtaaaagttgaggttctaactttacttgctatggctgcagcagcctttattggagcttattttgggactcatattacaaaaaactggcatgctccaactgtccaacgaatccttggtagtcttttaatcatagcagctataatcatgatcattagaataatctaccatccaggagaacacctttcagacaccattcatggcctccatggcatctggctttttgttggaattggttttaattttatcgttggagtcttgatgactatggggttaggcaattatgctccagaattgattttcttttcattaatgggtcttagcccaacagttgctatgcctgttatgatgctagatgcagctatgattatgacagcttctagtagccagtttatcaaagcaaaccgtgtcagttgggatggttttgctggaattgtttctggtggtattattggcgttttactagctgtgtttttcttaacgaatttagatattaatagcttgaaacttctggtcatcgctatcgttttcttcactggtggaatgctgattcgttcctcctttacctctcataagcaacaaacaaataga

SEQ ID NO: 5010 - protein, 310 aa, Streptococcus pyogenes
LTAKVFFCKLVFMNEMLILRLIQALLVSAMLFIFFMLVKHLKKNKINPFKRFWTGFWIGLLTDALDTLGIGSFATTTTCFKLTKLVTDDRQLPGTMTVAHVLPVLIQSLCFIFVVKVEVLTLLAMAAAAFIGAYFGTHITKNWHAPTVQRILGSLLIIAAIIMIIRIIYHPGEHLSDTIHGLHGIWLFVGIGFNFIVGVLMTMGLGNYAPELIFFSLMGLSPTVAMPVMMLDAAMIMTASSSQFIKANRVSWDGFAGIVSGGIIGVLLAVFFLTNLDINSLKLLVIAIVFFTGGMLIRSSFTSHKQQTNR

SEQ ID NO: 5011 - DNA, 753 bp, Streptococcus agalactiae
atgacgttatttcattcattgacatttaaacacccagtattacgtgttaataatagagacttgaatattgcattttatcaggagtctcttggatttaaattgataagtgaagaaaatgcaatcgcagttttctcagcatggcagaacaaagaggctagctttattattgaggaatccccaacttatcgtactcgtgcggtgaatggtactaagaagttagcaaagattattgttaagtctcaagatgcaaaagatattgaaaagcttttggcaaatggtgcgcaagccattcaagtatatcaaggtcaaaatggttatgcctatgaaacagtttcgcccgagggagaccttttcttacttcatgctgaagatgatttgtcacaattagtggcaattgagcgcccagagttagaaaaaaaagatgacactacaggtctatcaaactttgctttccaatctattagtttgaatgtacctgatgccgtgaaagctgaagctttttacgataaagtatttgctgggaagttcccaattaatttatctttcaaagaagcacagggacaagatttgcaaattgctccaaatgaaacttgggatattgagatactagaatgctgtgttaatgaagatactaatttaaatgacttgaaatcaacttttgaatcattgggacttgatgtttaccttgattctaaagaaaagattttagtcatctctgacactagtaatattgagatttggatttcaaaagaa

SEQ ID NO: 5012 - protein, 251 aa, Streptococcus agalactiae
MTLFHSLTFKHPVLRVNNRDLNIAFYQESLGFKLISEENAIAVFSAWQNKEASFIIEESPTYRTRAVNGTKKLAKIIVKSQDAKDIEKLLANGAQAIQVYQGQNGYAYETVSPEGDLFLLHAEDDLSQLVAIERPELEKKDDTTGLSNFAFQSISLNVPDAVKAEAFYDKVFAGKFPINLSFKEAQGQDLQIAPNETWDIEILECCVNEDTNLNDLKSTFESLGLDVYLDSKEKILVISDTSNIEIWISKE

SEQ ID NO: 5013 - DNA, 750 bp, Streptococcus pyogenes
atgactttaatggaaaatattacctttaaaactccagtattacgcgttaatgatcgcgaccttaatattgcattttatcaaaataatttagggcttcgtttagtatctgaagaaaatgcgattgctatcttttcatcttggggagaagggcaggaatgttttgtaattgaagagtcaccttcagttagaacgcgtgcggtagaaggccctaaaaaggttaatacgattgtcatcaaaacaaatcaacctaaagaaatcgaacaattattagctcatggagcacattatgacgctctttttaaaggtcaaaatggctatgcctttgagactatttccccagaaggagaccgattcttgttgcatgctgaacaagatattaaacatctccaaggtactgatttaccatcgcttgaaaaagatgcgacttttaaaggtttaactcaatttaagtttgatattattgttttaaatgttattagtgaagaacgctcaaaagctttttatcgggatctgtttagtgatcagttacctattactatggattttattcaagaagaaggtcccgatttggcaattgatccccatattgcttgggatttagaaattttagaatttcaagtctcaaaggactatgatatgaaggtcctaaaagcaactttagaagaagacgggcacaaggtctacattgataaaaaacacaaagtattggtcctttctgatccaagtcagatcgaagtatggtttacgaaa

SEQ ID NO: 5014 - protein, 250 aa, Streptococcus pyogenes
MTLMENITFKTPVLRVNDRDLNIAFYQNNLGLRLVSEENAIAIFSSWGEGQECFVIEESPSVRTRAVEGPKKVNTIVIKTNQPKEIEQLLAHGAHYDALFKGQNGYAFETISPEGDRFLLHAEQDIKHLQGTDLPSLEKDATFKGLTQFKFDIIVLNVISEERSKAFYRDLFSDQLPITMDFIQEEGPDLAIDPHIAWDLEILEFQVSKDYDMKVLKATLEEDGHKVYIDKKHKVLVLSDPSQIEVWFTK

SEQ ID NO: 5015 - DNA, 942 bp, Streptococcus agalactiae
ttggatttcaaaagaatgattaaaactaatactgttttagaactcattaaggagcaaatcaaagataatctttatcatggtgcaagcttagctatttatgaaaatggagagtggcacgaacattacttggggacaattgatggcaatgagaaagttaaagcgggattggtctatgatctagccagtgtatcaaaagttgtcggcgtgggaactttactagcaaagttagtttatcaagggactattgatattgataagccattaaggtattattaccctacgtttcatcatcagacgttaactgtaaggcaattagctacacatagcagtggaattgacccttttattccaaatcgtgatcagttgaatgctactcagctgaaagatgccattaatcatatcaaggttttggaagataaatcgtttaaatacactgatattaattttcttttacttggttttatgttagaagaggtattaggggatagtttggataaacttttcaaacgttatattttcactccttttcagatgaaagaaacctcttttggtcctagagtagaagctgttccaactgtagtcggtattaacgatggtattgtacacgatcctaaagctaaggtattaggaaagcatactggttctgcaggtttattttcaactattgatgatttacaaagattttctattcattatttaaaagatgattttgcgaagcctttgtggaataattatagtttgagtaaatcaagatcattagcttgggatatagataaggattggataaaccatactggttatactggtccttttattgcactaaattatcaaaagcaggcagcagctatttttttgacaaacagaaccttttcctatgatgaccgtccactttggattaagaaacgacgacatgtacaagaggcgataacatcgtactttgaa

SEQ ID NO: 5016 - protein, 314 aa, Streptococcus agalactiae
MDFKRMIKTNTVLELIKEQIKDNLYHGASLAIYENGEWHEHYLGTIDGNEKVKAGLVYDLASVSKVVGVGTLLAKLVYQGTIDIDKPLRYYYPTFHHQTLTVRQLATHSSGIDPFIPNRDQLNATQLKDAINHIKVLEDKSFKYTDINFLLLGFMLEEVLGDSLDKLFKRYIFTPFQMKETSFGPRVEAVPTVVGINDGIVHDPKAKVLGKHTGSAGLFSTIDDLQRFSIHYLKDDFAKPLWNNYSLSKSRSLAWDIDKDWINHTGYTGPFIALNYQKQAAAIFLTNRTFSYDDRPLWIKKRRHVQEAITSYFE

SEQ ID NO: 5017 - DNA, 372 bp, Streptococcus agalactiae
atgttaaatcacaaatttcttcaagttctaaaatatgagggtgtcgtttcgataacaagctggatcgaattagctcctcacgttacaaacacttggaatagctacctgactattacagatgaccagcgtatattagctcctgcagcaggaatgactcatcttgaaaatgatctcaataataattctaaaattattatgactctgggcagccgtgaagtcgagggtcgtgatggttatcaaggtacaggctttagaattgaaggaactgctaagctattagaagcaggaagcgattttgaaattgttaaagaaaaatacccttttctgcgtaaagtattggaagtaactcccataaatgttatccaactttta

SEQ ID NO: 5018 - protein, 124 aa, Streptococcus agalactiae
MLNHKFLQVLKYEGVVSITSWIELAPHVTNTWNSYLTITDDQRILAPAAGMTHLENDLNNNSKIIMTLGSREVEGRDGYQGTGFRIEGTAKLLEAGSDFEIVKEKYPFLRKVLEVTPINVIQLL

SEQ ID NO: 5019 - DNA, 114 bp, Streptococcus agalactiae
ttgttagaagggttagcacctggtgagaagaattctactttagaaaggtttacactaccatcttcattgagatatactcctttatgtaccggtgagttaccagtttgtttagag

SEQ ID NO: 5020 - protein, 38 aa, Streptococcus agalactiae
MLEGLAPGEKNSTLERFTLPSSLRYTPLCTGELPVCLE

SEQ ID NO: 5021 - DNA, 2328 bp, Streptococcus agalactiae
atgtttaaggagaaaactatggcaacagttaaaacaaacacagatatctttgaacaagcttgggaaggctttaaaggtgttgattggaaagaaaaagcaagtattgctcgcttcgttcaagcaaactatgcaccttacgatggagatgaaagcttcttagctggagcaactgaacgttcacttcacatcaaaaaagtgattgaagaaacaaaagctcactatgaagaaactcgcttcccaatggatactcgtgttgcttcaatttctgaattaccagctggttttatcgacaaagataacgagcttatctttggtattcaaaacgacgagcttttcaaattgaacttcatgcctaaaggtggtatccgtatggcggaaactacacttaaagaaaatggttatgaacctgatccagctgttcacgaaatcttcactaagtacgctacaacagtaaatgatggtatcttccgcgcttatacttctaacattcgtcgtgctcgccatgcacacactgttactggtcttccagacgcttattcacgcggacgtatcattggtgtatatgctcgtctagctgtttacggtgctgactacttgatgcaagaaaaagttaatgactggaatgcattgaatgatattgatgaagagtcaattcgtcttcgtgaagaaatcaaccttcaataccaagctcttggtgaagttgtaaaacttggtgacctttacggcgtagatgttcgtaaaccagccatgaacactaaagaagccattcaatgggtgaacattgctttcatggctgtatgtcgtgttatcaatggtgctgcaacatcacttggacgtgttcctattgtccttgatatctttgcagaacgtgacctcgctcgcggtacattcacagaatcagaaatccaagaatttgttgatgattttgtccttaaactccgtactgtaaaatttgctcgtactaaagcttatgatgccctttactcaggtgacccaacctttatcacaacttcaatggcaggtatgggagctgatggacgtcatcgtgttaccaaaatggactatcgtttcttaaatacacttgacaatatcggtaactcaccagaaccaaacttaactgttctttggtcagatcaattaccatatgctttccgtcgctactgtatgtcaatgagtcataaacactcttcaatccaatatgaaggtgtatcaacaatggctaaagaaggctacggtgaaatgtcatgtatttcatgttgtgtatctccacttgatccagaaaacgaagacaaacgtcacaaccttcaatattttggtgctcgtgttaacgttatgaaagcacttcttactggtcttaacggtggttatgatgatgttcataaagattacaaagtatttgacatcgacccaattcgtgacgaagtactcaactttgacactgtaaaagctaactttgaaaaatctcttgactggttgactgatacttatgttgatgcgatgaatatcatccactacatgactgataaatacaactatgaagctgtacaaatggcattcttaccttcacatgtacgtgctaatatgggatttggtatctgtggttttgcaaatactgtcgattcattatctgcgattaaatacgctactgttaaaccaatccgtgacgaagatggttacatctacgactacgaaacagttggtgacttcccacgttatggtgaagatgatgatcgtgttgactcaatcgctgaatggttacttgaagccttccatggacgccttgctaaacacaaactttataaagatgctgaagcaactgtttctcttcttacaatcacatcaaacgttgcttactctaaacaaactggtaactcaccggtacataaaggagtatatctcaatgaagatggtagtgtaaacctttctaaagtagaattcttctcaccaggtgctaacccttctaacaaagctaaaggtggctggttacaaaacttgaattcactttctaaacttgatttcgctcatgcaaatgatggtatttcattgacaactcaagtttctccacgcgctcttggtaaaacatttgatgaacaagttgataacttggtaacagtccttgatggttactttgaaaacggtggtcaacacgttaacttgaatgtcatggaccttaaagatgtctatgacaagattatgaatggtgaagatgttatcgttcgtatctcaggttactgtgtcaatactaaatatctaactcctgagcaaaaaactgagttgacacaacgtgtcttccatgaagtactttcaatggacgatgcattaactaac

SEQ ID NO: 5022 - protein, 776 aa, Streptococcus agalactiae
MFKEKTMATVKTNTDIFEQAWEGFKGVDWKEKASIARFVQANYAPYDGDESFLAGATERSLHIKKVIEETKAHYEETRFPMDTRVASISELPAGFIDKDNELIFGIQNDELFKLNFMPKGGIRMAETTLKENGYEPDPAVHEIFTKYATTVNDGIFRAYTSNIRRARHAHTVTGLPDAYSRGRIIGVYARLAVYGADYLMQEKVNDWNALNDIDEESIRLREEINLQYQALGEVVKLGDLYGVDVRKPAMNTKEAIQWVNIAFMAVCRVINGAATSLGRVPIVLDIFAERDLARGTFTESEIQEFVDDFVLKLRTVKFARTKAYDALYSGDPTFITTSMAGMGADGRHRVTKMDYRFLNTLDNIGNSPEPNLTVLWSDQLPYAFRRYCMSMSHKHSSIQYEGVSTMAKEGYGEMSCISCCVSPLDPENEDKRHNLQYFGARVNVMKALLTGLNGGYDDVHKDYKVFDIDPIRDEVLNFDTVKANFEKSLDWLTDTYVDAMNIIHYMTDKYNYEAVQMAFLPSHVRANMGFGICGFANTVDSLSAIKYATVKPIRDEDGYIYDYETVGDFPRYGEDDDRVDSIAEWLLEAFHGRLAKHKLYKDAEATVSLLTITSNVAYSKQTGNSPVHKGVYLNEDGSVNLSKVEFFSPGANPSNKAKGGWLQNLNSLSKLDFAHANDGISLTTQVSPRALGKTFDEQVDNLVTVLDGYFENGGQHVNLNVMDLKDVYDKIMNGEDVIVRISGYCVNTKYLTPEQKTELTQRVFHEVLSMDDALTN

SEQ ID NO: 5023 - DNA, 2352 bp, Streptococcus pyogenes
ttgttactagaatttaaggagaaatttatggcaactgttaaaaccaatacagatgttttcgaaaaagcttgggaaggctttaaaggaactgactggaaagaaaaagcaagtgtctcacgttttgtacaagctaactacaccccatacgatggcgatgaatctttcttggctggtgctactgaacgttcacttcacatcaaaaaagttatcgaagaaacaaaagcacactatgaagctacacgtttcccatacgatactcgtccaacttcaattgctgacattcctgctggtttcatcgataaagaaaatgaattaatttatggtattcaaaacgatgaattgttcaaattgaacttcatgccaaaaggtggtatccgtatggcggaaacgacccttaaagaaaacggctatgaaccagacccagcagtacatgaaatctttactaagtatgtgacaactgttaacgacggtatcttccgcgcttatacttcaaatattcgtcgcgctcgtcatgcccacactgtaactggtcttccagatgcttactcacgtggacgtatcatcggtgtttacgctcgtcttgctctttacggtgctgactacttgatgcaagaaaaagtcaatgactggaatgctatcactgaaatcgatgaagaatccattcgtcttcgcgaagaagttaaccttcaataccaagctcttggtgaagtggttaaacttggtgacctttacggagttgatgttcgtcgcccagcacaaaacgttaaagaagctatccaatgggtaaacatcgctttcatggctgtatgtcgtgtgatcaacggtgctgctacttctcttggacgtgtgccaatcgttcttgatatctttgcagaacgtgaccttgctcgcggtacctttacagaatcagaaatccaagaatttgttgatgattttgtccttaaactccgtaccgtaaaatttggtcgtacgaaagcttacgatgcgctttactcaggtgacccaacattcatcacaacttctatggctggtatgggtaacgatggtcgtcaccgtgtaactaagatggactaccgtttcttgaacacgcttgataatattggtaactctccagaaccaaacttgactgttctttggactgaccaactgccagaaacattccgtcgctactgtatgaaaatgagccacaagcactcttctatccaatatgaaggtgtgacaacaatggctaaagaaggttatggtgaaatgtcatgtatttcatgttgtgtgtcaccacttgacccagaaaatgaagaacaacgtcataacatccaatacttcggtgctcgtgtaaacgttcttaaagcccttcttactggtcttaacggtggttacgatgatgttcacagagactacaaagtgtttaacgttgttgaaccaatcacatcagaagttcttgagtacgacgaagttatggctaactttgagaaatctcttgactggttgacagatacttatgtagatgcgcttaacatcatccactacatgactgataaatacaactacgaagcagttcaaatggccttcttgccaacacaccaacgtgctaacatgggattcggtatctgtggtttcgctaacacagttgataccttgtcagctattaaatacgcaactgttaaaactatccgcgatgaaaatggctacatctatgactacgaagtaacaggtgacttccctcgttacggtgaagatgacgaccgtgttgatgacatcgcgaaatggttgatggaagcttaccacacacgtcttgcaagccacaaactttacaagaatgctgaggcttcagtatcacttcttaccatcacttcaaacgttgcttactctaaacaaactggtaactctccagttcaccgcggcgtcttcttaaacgaagatggtacagttaacactagccaagtggaattcttctcaccaggtgctaacccatctaacaaagcaaaaggtggctggttacaaaaccttaactcacttgctaaactggaattctcacatgctaacgatggtatctcattgactactcaagtatcacctcgtgctcttggtaaaacatttgacgaacaagttgacaacttggtaacagtgcttgacggttactttgaaaatggtggtcagcacgttaacttgaacgttatggaccttaacgatgtttatgacaaaatcatgaacggcgaagacgttatcgtacgtatctctggttactgtgtcaacaccaaataccttacaccagaacaaaaaactgaattgacacaacgtgtcttccacgaagtgctttccatggacgatgctgctgaagctatttcaagtaaa

SEQ ID NO: 5024 - protein, 784 aa, Streptococcus pyogenes
LLLEFKEKFMATVKTNTDVFEKAWEGFKGTDWKEKASVSRFVQANYTPYDGDESFLAGATERSLHIKKVIEETKAHYEATRFPYDTRPTSIADIPAGFIDKENELIYGIQNDELFKLNFMPKGGIRMAETTLKENGYEPDPAVHEIFTKYVTTVNDGIFRAYTSNIRRARHAHTVTGLPDAYSRGRIIGVYARLALYGADYLMQEKVNDWNAITEIDEESIRLREEVNLQYQALGEVVKLGDLYGVDVRRPAQNVKEAIQWVNIAFMAVCRVINGAATSLGRVPIVLDIFAERDLARGTFTESEIQEFVDDFVLKLRTVKFGRTKAYDALYSGDPTFITTSMAGMGNDGRHRVTKMDYRFLNTLDNIGNSPEPNLTVLWTDQLPETFRRYCMKMSHKHSSIQYEGVTTMAKEGYGEMSCISCCVSPLDPENEEQRHNIQYFGARVNVLKALLTGLNGGYDDVHRDYKVFNVVEPITSEVLEYDEVMANFEKSLDWLTDTYVDALNIIHYMTDKYNYEAVQMAFLPTHQRANMGFGICGFANTVDTLSAIKYATVKTIRDENGYIYDYEVTGDFPRYGEDDDRVDDIAKWLMEAYHTRLASHKLYKNAEASVSLLTITSNVAYSKQTGNSPVHRGVFLNEDGTVNTSQVEFFSPGANPSNKAKGGWLQNLNSLAKLEFSHANDGISLTTQVSPRALGKTFDEQVDNLVTVLDGYFENGGQHVNLNVMDLNDVYDKIMNGEDVIVRISGYCVNTKYLTPEQKTELTQRVFHEVLSMDDAAEAISSK

SEQ ID NO: 5025 - DNA, 1107 bp, Streptococcus agalactiae
atgggggagagaacaatgttaatttttcctttaataaatgatacgtcgcgtaaaattatccacattgatatggatgctttttttgcatctgtggaagagcgtgacaatccctctcttaaaggaaagcctgttattattggttctgatcccagaaaaaccggcggcagaggggttgtttctacttgtaattatgaggctcgaaagtttggagttcattcagctatgtcttcaaaagaagcgtatgaacgatgccctcaagctatctttatttcgggaaattaccaaaaatatcgccaagtaggaatggaagtacgagatatatttaaaaagtatacggatttggttgaaccgatgagtatagacgaagcttatttagatgtaactgaaaataaaatgggaataaaatcagctgttaaacttgctaaaatgatacaatacgatatttggaatgatgtccatttgacctgttcagcgggtatttcctacaataaatttttggcaaaattggcttctgactttgagaaaccaaaaggacttaccctcatcctaccagatcaagctcaagatttcttgaagcccttaccaatagagaaatttcatggtgttggtaaacgctccgtcgaaaaattacatgctttaggggtttatactggtgaggacctcctttccttatctgaaatttctttaattgatatgtttggtcgtttcgggtatgacctttatcgtaaggcaagagggattaatgcttccccggtaaaacctgatagagttcgtaaatcaataggaagtgagaaaacctatgggaaattactatataacgaagcagatatcaaagctgagatttcaaagaacgttcagagagttgttgcttctctggagaaaaataagaaagttggtaagacaatcgttttaaaagttagatatgcggattttgaaacattgacgaaacgtatgacattagaagagtatactcaagattttcaaatcattgatcaagttgctaaagcgatatttgataccttagaagagtcagtttttggcatacgactcttaggtgttacagtaacgaccctggaaaatgaacatgaagctatctatttagatttt

SEQ ID NO: 5026 - protein, 369 aa, Streptococcus agalactiae
MGERTMLIFPLINDTSRKIIHIDMDAFFASVEERDNPSLKGKPVIIGSDPRKTGGRGVVSTCNYEARKFGVHSAMSSKEAYERCPQAIFISGNYQKYRQVGMEVRDIFKKYTDLVEPMSIDEAYLDVTENKMGIKSAVKLAKMIQYDIWNDVHLTCSAGISYNKFLAKLASDFEKPKGLTLILPDQAQDFLKPLPIEKFHGVGKRSVEKLHALGVYTGEDLLSLSEISLIDMFGRFGYDLYRKARGINASPVKPDRVRKSIGSEKTYGKLLYNEADIKAEISKNVQRVVASLEKNKKVGKTIVLKVRYADFETLTKRMTLEEYTQDFQIIDQVAKAIFDTLEESVFGIRLLGVTVTTLENEHEAIYLDF

SEQ ID NO: 5027 - DNA, 1092 bp, Streptococcus pyogenes
atgcttatttttccactgattaatgacacgtcacgaaaaatcatccatattgacatggatgccttttttgctgcagttgaggaaagggataaccctgctttaaaaggaaagcctgttgtgattgggaaagatccaagagaaacaggtggtcgcggagttgtttccacttgtaattacgaagcgagaaaatatggcattcattcggccatgagctctaaggaagcttatgagcgttgtcccaaagccatttttatttcaggaaattatgaaaagtatcgaacagttggagaccagatccgccgtatttttaagcgttatactgatgtggtagagcctatgtccattgacgaggcttaccttgatgtgactgataataagttggggattaagtcagccgtcaaaatagccaagctgattcagcatgatatctggaaagaagtaggattgacctgttcagcaggtgtgtcttataacaaatttttggctaaattggctagtgattttgaaaaacctcatggcctcactctagtcttgaaagaagatgccctgtgctttttagccaaactccccattgaaaagtttcatggtgttggtaaaaaatcagttaaaaaactgcatgacatggggatttatacaggacaggatttgttggcagttcctgaaatgaccttgattgatcattttggtcggtttggttttgacctttaccgtaaagcgagaggcatcagcaattctcctgtcaagtatgatcggatacgcaagtcaattggcagtgagagaacctacgctaaactgctttatcaagaaacagacatcaaggcagagatcagtaaaaatgttaagcgcgtggccgctctcttacaagaccataaaaagttaggcaagaccattgtgctcaaagtgcgttatgctgattttaccaccttgacaaaacgtgtcaccttgccagaattaaccagaaatgccgcacaaattgagcaagtagctggggatatttttgacagcttaagcgaaaatcctgctggtatccgcctgttaggggtaaccatgaccaatttggaggataaggtagctgatatttccttggaccta

SEQ ID NO: 5028 - protein, 364 aa, Streptococcus pyogenes
MLIFPLINDTSRKIIHIDMDAFFAAVEERDNPALKGKPVVIGKDPRETGGRGVVSTCNYEARKYGIHSAMSSKEAYERCPKAIFISGNYEKYRTVGDQIRRIFKRYTDVVEPMSIDEAYLDVTDNKLGIKSAVKIAKLIQHDIWKEVGLTCSAGVSYNKFLAKLASDFEKPHGLTLVLKEDALCFLAKLPIEKFHGVGKKSVKKLHDMGIYTGQDLLAVPEMTLIDHFGRFGFDLYRKARGISNSPVKYDRIRKSIGSERTYAKLLYQETDIKAEISKNVKRVAALLQDHKKLGKTIVLKVRYADFTTLTKRVTLPELTRNAAQIEQVAGDIFDSLSENPAGIRLLGVTMTNLEDKVADISLDL

SEQ ID NO: 5029 - DNA, 480 bp, Streptococcus agalactiae
atggtttcatatgaaaaagtccgccgctctctgcgcacagctacaatcactatcattgtattaaatagtttgtctttagtattcagattgtttacaggaatttcagtgcagctagccaaaactgaaattaataaagggaacacaggtaatcttcctaaagaacatatcgaagcagtcttgagcgccacaacaccatttatgctatttgtcactgctttaatagtattagtcaacattgccattgttattttctgtattaaaaatttaagagcaattaaaagaaatcaaacggttaattaccttccttattaccttggcttcgccattactgtaggacttgttattttgggttttctaactactaaagcaccatgggcaatagctataaatatcgtcttccaagctattttcggtcttctttatttccatgcttatcaaaaagcacaaaaactcaacgaacgtgatcttgaagagactaac

SEQ ID NO: 5030 - protein, 160 aa, Streptococcus agalactiae
MVSYEKVRRSLRTATITIIVLNSLSLVFRLFTGISVQLAKTEINKGNTGNLPKEHIEAVLSATTPFMLFVTALIVLVNIAIVIFCIKNLRAIKRNQTVNYLPYYLGFAITVGLVILGFLTTKAPWAIAINIVFQAIFGLLYFHAYQKAQKLNERDLEETN

SEQ ID NO: 5031 - DNA, 480 bp, Streptococcus pyogenes
atgatttcttatgaaaaagtgcgtcaggcactcaaaacgtctactattgccattattattctaaacgggcttggagttgtactgtcattaatgggatttgcagggattttctacttacaaagccaactcaagaatgaagcatttcgggcccaattaacaactgagcaattggcacagctacaaagcagcatgacaccatttatgattttcttatctgtcttaaatgtccttgctattattgctatcattgtcttttgtgctcaaaacttatctaaattaaaacaaggtctaacggttagttatattccttatatcttaggccttatcctttctgttatcggcttggttaaccagttcacaacaaccatgtcaatggttggaactatccttatccttatacaagctgctctttatggctttgctttttacaaggctaaaacccttaacgaaaaaggtgatgatacagaccaagctatgctg

SEQ ID NO: 5032 - protein, 160 aa, Streptococcus pyogenes
MISYEKVRQALKTSTIAIIILNGLGVVLSLMGFAGIFYLQSQLKNEAFRAQLTTEQLAQLQSSMTPFMIFLSVLNVLAIIAIIVFCAQNLSKLKQGLTVSYIPYILGLILSVIGLVNQFTTTMSMVGTILILIQAALYGFAFYKAKTLNEKGDDTDQAML

SEQ ID NO: 5033 - DNA, 2418 bp, Streptococcus agalactiae
atggaagtattttttacaggaaccattgaacgcattatatttgaaaatgccagcaatttttttaaaatattacttctggaaatcgaagatacggatagcgattttgatgatgtagaagtaattattactggtactatggccgacgttatagagggagaagaatatactttttggggaacactaacccaacatccaaaatacggcgagcaactacaaagtgtacgctatgaaagagccaagcctacttcaggtggccttgtgaaatacttttctagcgaacaatttaaaggaattggtaaaaagactgcccaacgcatcgtagaactctatggagataataccattgataaaatccttgaatcccctgaacagttaagtacaatctcaggactatcaaaaattaatagagaagcattcatcgctaaactgaaactcaattatggaacagagcaagttttagctaaactcgctgaatatgggttaagcaatcgtgctgctattcaaatatttgatcactataaagaagaatcacttgaagtgataaacgaaaatccttatcaacttgttgaggatatccaaggtatcggttttaaaatagctgaccaacttgctgaacaagtcggtattgaaagtgattctcctaaacgctttcgtgctgctattattcatactttagttgagtcttctatggagcaaggagatacctatattgaggctcgtactctcttggaaaaaaccattactctccttgaagaagctcgtcaaatcgaactagatccttcaattgttgctaaggaattgacaaatttaattgcagaagataaagtgcaacatattggaactaaaatttttagtaatactctattttttgccgaagaaggcatcaaaaaaaacttacaacgaatactaaatcagcctcttgataaacaactaaatcacaaagatattgaccgtgaaatcagagatattcaaaaatctttaaatatccactacgataatatccaagaaaaagctattagagaagctttactaagtaaggtatttatcttgactggtggcccaggaacaggtaaaacaacagttataaatggtattattgaagcctattccgagttacatcatattgatttaaacaaaaatgatattcctattgtacttgctgctcctacaggtcgtgctgctagacgcatgaatgaacttaccggtttaccgagtgctactattcataggcatttgggattaaacggagatagtgactatcaaagtctagatgactatctagattgttccttaattatcattgatgaattttcaatggttgacacttggcttgctaatcaattatttgacgctttggactcgcacacacaagttattattgtcggagatagtgatcaattaccgtctgtaggtccaggacaagttctagcagatcttttaaatataaatgcacttccacacgttaaacttgaaaagatttttagacaatcagaagaatcaactattgtgactttagctaatcaaatgagacagggctttttgccagaggactttacagctaaaaaagccgatcgctcatactttgaagcatctgctaatatcatcccaaatatgatttctaaaattgttcaatctgcacttaagagcggtattgaagctcatgaaattcaaattttagctcctatgtatcgcggccaagcaggtattaataatcttaaccttatcatgcaaaatctcctcaatccattaaaagataataaccaatttacttttaatgatataaatttccgaataggagataaagtgttacatttagtcaacgatacagagcttaatgtttttaatggggatattggttacataacggaccttataccagccaaatatactgagagcaagcaagatgagatttatatgacttttgacggtcaagaagttatctatcaacgcaaagaatggcttaaaataacactagcctatgctatgagtattcataaatcacagggttctgaatttcaagttgttattctgccaataacgagacagagtggtcgaatgttacagcgaaaccttatttatacagctattacgagatctaaaagtaaactaatacttttaggagaaattggtgcatttgatttcgctgttaaaaacgagggggcaaagcgcaatacttatctgatagaaagatttgaaaacaagcaagaaatagctaattctcaaaaaattgaagatagctcaatagatcaaaagattgacaacacaataattaatacgtccattccaaaaacagcaacaccaattgagcagactaatctttcaaaaataacttatcgcctaactgaagaaaattatttaacaatcgatccaatgattggtattaatcaacaagatataagtgcaatttttgatagtaaa

SEQ ID NO: 5034 - protein, 806 aa, Streptococcus agalactiae
MEVFFTGTIERIIFENASNFFKILLLEIEDTDSDFDDVEVIITGTMADVIEGEEYTFWGTLTQHPKYGEQLQSVRYERAKPTSGGLVKYFSSEQFKGIGKKTAQRIVELYGDNTIDKILESPEQLSTISGLSKINREAFIAKLKLNYGTEQVLAKLAEYGLSNRAAIQIFDHYKEESLEVINENPYQLVEDIQGIGFKIADQLAEQVGIESDSPKRFRAAIIHTLVESSMEQGDTYIEARTLLEKTITLLEEARQIELDPSIVAKELTNLIAEDKVQHIGTKIFSNTLFFAEEGIKKNLQRILNQPLDKQLNHKDIDREIRDIQKSLNIHYDNIQEKAIREALLSKVFILTGGPGTGKTTVINGIIEAYSELHHIDLNKNDIPIVLAAPTGRAARRMNELTGLPSATIHRHLGLNGDSDYQSLDDYLDCSLIIIDEFSMVDTWLANQLFDALDSHTQVIIVGDSDQLPSVGPGQVLADLLNINALPHVKLEKIFRQSEESTIVTLANQMRQGFLPEDFTAKKADRSYFEASANIIPNMISKIVQSALKSGIEAHEIQILAPMYRGQAGINNLNLIMQNLLNPLKDNNQFTFNDINFRIGDKVLHLVNDTELNVFNGDIGYITDLIPAKYTESKQDEIYMTFDGQEVIYQRKEWLKITLAYAMSIHKSQGSEFQVVILPITRQSGRMLQRNLIYTAITRSKSKLILLGEIGAFDFAVKNEGAKRNTYLIERFENKQEIANSQKIEDSSIDQKIDNTIINTSIPKTATPIEQTNLSKITYRLTEENYLTIDPMIGINQQDISAIFDSK

SEQ ID NO: 5035 - DNA, 2451 bp, Streptococcus pyogenes
atggaatacgtttttacaggtactgttgatcgtatcatttttgaaaaccaggctaatttctttaaaattctcctccttgccattgaggatacagacagtgacattgacgactttgaaatcattatcacaggaacgatggctgacattattgaaggagatgactacaccttttggggggaattgacccagcaccctaaatatggacagcaactcaaactaagccgttaccaaaaaatcaaacctagttcatctggtttggttaattatttctctagcgaccattttaaggggattggtaaaaaaacagcggagaaaatcattgcgctatatggtcataataccattgaccatattttagaagacccaagcaaattagaaactatctctggcctatctaaggctaatcgtcaagcctttgtcgctaaactaaaattgaattacggcacagagcaactgattgctggtctcgtcgaacttggccttagcaaccgttttgcccttcaagcgtttgaaaagtataaagaagaggctcttgaccttgttaaagaaaatccctatcagttagtcgaagatctacaaggttttgggtttaaaatggcagatgctctcgctgaaaacttagggattgaaagcgactctccgaaacgttttcgtgcagccctccttcactgtctcttggaagaatccatcaatcgaggagatacttatgtccaagcacgacaattattagactttgccatcacactccttgaagatgcacgtcaagtagaatgtgatcctgctgctgtggctgaacaactaagcgagttaatcatagagggcaaaatcaaaaacagtgacaccaaactgtttgatgctagcctttattttgctgaagaagggattgctaacaacatctctcgtctcttagatactcctttaagtcagtcatttagtcatgataccattcaaacaaccatccaagccgttcaaaaagactttgccatcacctatgaccaagtgcagcaagaagccattactaaggctttaaccagcaaggtctttctcctaacaggtggtcccggaacaggaaaaacaactgttattcgaggcattttgcaggcttacgcgaacctgcatcagattgatttggataaaaaagaccttcctatcttgttagcagctccaacaggtcgggctgcacgtcgcatgaatgagttgactggacttcctagcgcaaccatccacaggcacttaggcctcaatggcgacaacgattaccaagccatggaggattatctagactgcgacctgctgattgtcgatgaattttcaatggtggatacctggcttgccaaccagttgttaggagctattaactcaacaactcaagtgattattgtcggagatagtgaccagcttccttcggttggacccggtcaagtcctgtcagatcttttaaaagtcaatagcctgccccaaatcgccttgcaaaagatatttcgtcaatcccaagaatctactattgtcaatttggcagaccagatgcgtcgaggaatcttagctgctgactttcgtgataaaaaagctgaccgttcttattttgaagcccaagcagcctttatccctgacatgattcaaaaaattgtcctatctgctattaaaagtggcatccctgctgaggaaattcaaattttagcacctatgtacaaaggacaagctggcatcaatcatcttaatcaactcatgcaagaacttctcaatcccttgcaaggacaaacagaatttctgttcaatgatacgcattttcgtaaaggtgataaagtcctccacttagtcaacgatgctcagttgaatgtctttaacggagatattggttatattacagatttgattcctgctaaatacaccgaatctaagcaagacgaattaatcttagattttgacggtagcgaagtcacgtaccctagaaatgaatggctaaaattaaccctggcctatgccatgagcattcataaatcgcaagggagtgagtttcaagtggtgattttacctatcacacgccaaagcggccgactcttgcaacgaaatgtgatttacacggccattactcggtctaaaagtaagttaattctgttgggagaatatactgcctttgagtatgctattaaacacgaaggcgataaacgccaaacctacttgatcgaacgcttccaagaacaatccgacttagcctcctctcaacctaaccaagagctaaaatcaaaagagcagacctcccttttttctaatacggcaacccttgaggacgactctcaaaaatcttcctctcaatcaacaaactctaaccccactgagaactctcagtcagataatgatgattttaggttaacacctgagaattattcgactatcgattcgatgatagggcttacagaatcagatattgccctctttttccagaaaaaatcc

SEQ ID NO: 5036 - protein, 817 aa, Streptococcus pyogenes
MEYVFTGTVDRIIFENQANFFKILLLAIEDTDSDIDDFEIIITGTMADIIEGDDYTFWGELTQHPKYGQQLKLSRYQKIKPSSSGLVNYFSSDHFKGIGKKTAEKIIALYGHNTIDHILEDPSKLETISGLSKANRQAFVAKLKLNYGTEQLIAGLVELGLSNRFALQAFEKYKEEALDLVKENPYQLVEDLQGFGFKMADALAENLGIESDSPKRFRAALLHCLLEESINRGDTYVQARQLLDFAITLLEDARQVECDPAAVAEQLSELIIEGKIKNSDTKLFDASLYFAEEGIANNISRLLDTPLSQSFSHDTIQTTIQAVQKDFAITYDQVQQEAITKALTSKVFLLTGGPGTGKTTVIRGILQAYANLHQIDLDKKDLPILLAAPTGRAARRMNELTGLPSATIHRHLGLNGDNDYQAMEDYLDCDLLIVDEFSMVDTWLANQLLGAINSTTQVIIVGDSDQLPSVGPGQVLSDLLKVNSLPQIALQKIFRQSQESTIVNLADQMRRGILAADFRDKKADRSYFEAQAAFIPDMIQKIVLSAIKSGIPAEEIQILAPMYKGQAGINHLNQLMQELLNPLQGQTEFLFNDTHFRKGDKVLHLVNDAQLNVFNGDIGYITDLIPAKYTESKQDELILDFDGSEVTYPRNEWLKLTLAYAMSIHKSQGSEFQVVILPITRQSGRLLQRNVIYTAITRSKSKLILLGEYTAFEYAIKHEGDKRQTYLIERFQEQSDLASSQPNQELKSKEQTSLFSNTATLEDDSQKSSSQSTNSNPTENSQSDNDDFRLTPENYSTIDSMIGLTESDIALFFQKKS

SEQ ID NO: 5037 - DNA, 591 bp, Streptococcus agalactiae
atgaaagaatttattaaagaatggggtgtctttatcctcatcctctcactttttttactatcgcgtatctttttatggcaattcgttaaagttgacggacactccatggatccaactttagctgacaaggaacagctagtagttctcaaacaaacaaaaatcaatcgattcgatattgtagtggctaacgaagaagaaggcggccaaaagaaaaaaattgttaaacgtgtcattggtatgccaggtgatgtcatcaaatataaaaatgacaccttaactattaacaataaaaaaacagaagaaccttacctcaaggaatatactaaattatttaaaaaggataaattacaggaaaaatattcgtataacccacttttccaagacctagcacaaagctctaccgctttcaccactgacagcaatggcagcagcgaatttactactgtcgtgcctaaaggccactactatcttgttggtgatgaccgaattgtctctaaagatagtcgtgccgtcggtcccttcaaaaaatcaacgattgtgggagaggttaaattccgcttctggccaattcgtcgttttggaactatcaac

SEQ ID NO: 5038 - protein, 197 aa, Streptococcus agalactiae
MKEFIKEWGVFILILSLFLLSRIFLWQFVKVDGHSMDPTLADKEQLVVLKQTKINRFDIVVANEEEGGQKKKIVKRVIGMPGDVIKYKNDTLTINNKKTEEPYLKEYTKLFKKDKLQEKYSYNPLFQDLAQSSTAFTTDSNGSSEFTTVVPKGHYYLVGDDRIVSKDSRAVGPFKKSTIVGEVKFRFWPIRRFGTIN

SEQ ID NO: 5039 - DNA, 657 bp, Streptococcus pyogenes
gtgctaaacttcacttcgccaacactcacaaagcgcaagcgcttctcactaaataaaaggaatcatatgaaacagtttattaaagaatggggcccattcactctctttttaattctctttggtctatctcgtctttttttgtggcaggctgttaaagtagacggccattctatggacccaactctagctcatggcgaacgccttatcgtttttaatcaagctagaattgatcgctttgatattgtagttgctcaggaagaagaaaacggacaaaagaaagaaatcgtaaaaagagttattggattgccaggcgataccatttcttataatgatgacacactttatattaatggtaaaaaaacagttgagccgtatttggctgagtatctaaaacaatttaaaaacgataaactccaaaaaacttacgcctataataccctattccaacagttagcagaaacatctgatgcttttacaactaattctgagggacaaacacgctttgagatgagtgttccaaaaggagaataccttcttcttggtgatgatcgtattgtttccagggatagtcgcgaagttggtagtttcaaaaaagaaaaccttatcggtgaagtgaaagctcgtttttggccactcaataaaatgaccgtttttaat

SEQ ID NO: 5040 - protein, 219 aa, Streptococcus pyogenes
VLNFTSPTLTKRKRFSLNKRNHMKQFIKEWGPFTLFLILFGLSRLFLWQAVKVDGHSMDPTLAHGERLIVFNQARIDRFDIVVAQEEENGQKKEIVKRVIGLPGDTISYNDDTLYINGKKTVEPYLAEYLKQFKNDKLQKTYAYNTLFQQLAETSDAFTTNSEGQTRFEMSVPKGEYLLLGDDRIVSRDSREVGSFKKENLIGEVKARFWPLNKMTVFN

SEQ ID NO: 5041 - DNA, 897 bp, Streptococcus agalactiae
ttgtctatgaacacaatcgtcatgcaagcagataaaaaattgcaagaaaagataagaaccgatttagctcaacatcatataagtaataacaatccttatgtggtattttcagctaaaatatcaggagctactgttcttttatatacttctggaaaacttgtcttccagggttctaacgcttcacatatcgcccaaaagtatggttttattgagcaaaaagaaagttgttcctctgagagtcaagatattcccataattggtactgatgaagtgggaaatggctcttactttggtggactggcagtggtagctagttttgtaactcctaaggaccatgcttacctcaaaaaattaggtgttggtgattcaaaaacacttactgatcaaaaaattaagcaaatcgcgcctcttttggaaaaagcaattccacacaaagcattattgttatcgcctcaaaaatataatcaagtggttagtccaaataacaaacataatgctgtctccgtaaaagttgctttacacaatcaagctatcttccttcttcttcaagatggttttgaaccagaaaaaatcgttattgatgcttttactagctccaaaaactatcaaaattatttgaaaaatgaaaagaatcaatttaaacaaacgattactctggaagaaaaagctgaaaataaatatctagctgtagcggtcagttctattattgcacgtaatctattcttagaaaaccttaacaaattaagcgacgacgtaggatataaacttccaagtggagctggtcaccaatctgataaggtcgctagccaattactcaaagcttatggtatctcttcgcttgaacactgcgcaaaacttcattttgccaacaccaaaaaagcacaagcattattaaaa

SEQ ID NO: 5042 - protein, 299 aa, Streptococcus agalactiae
MSMNTIVMQADKKLQEKIRTDLAQHHISNNNPYVVFSAKISGATVLLYTSGKLVFQGSNASHIAQKYGFIEQKESCSSESQDIPIIGTDEVGNGSYFGGLAVVASFVTPKDHAYLKKLGVGDSKTLTDQKIKQIAPLLEKAIPHKALLLSPQKYNQVVSPNNKHNAVSVKVALHNQAIFLLLQDGFEPEKIVIDAFTSSKNYQNYLKNEKNQFKQTITLEEKAENKYLAVAVSSIIARNLFLENLNKLSDDVGYKLPSGAGHQSDKVASQLLKAYGISSLEHCAKLHFANTKKAQALLK

SEQ ID NO: 5043 - DNA, 900 bp, Streptococcus pyogenes
atgaataccttagttttgaaaatagatgctatactgagtaaacatttaaaaaaacagctagccccctacaccatcagtagccaaaatacctatgtagcctttgctgctaaaaaaaatggggttactgttttgctgtacaaatccggaaaattagttctccagggaaacggtgcaaatgctttagctcaagagcttaatcttccagtagctaagacagtttttgaagcaagcaacaatagccaagatatacctataatcggcagtgatgaggtgggtaatggctcttattttggtgggattgctgttgtggcaagttttgtcgatcctaaagatcattccttcctgaaaaagcttggggttgatgattctaaaaaattatcggataaaaccattcaacagattgcgcctctgttagagaaacaaatacctcatcaatcacttctcctatcacctaaaaaatataacgaattggttggtaaaagtaaaccatataatgccatttctatcaaagttgctcttcataaccaagctatttttttgttgttacaaaaaggcattcaacctaaacaaattgttattgatgctttcactagccaatcaaattatgaaaagcatctaaaaaaggaaaaaaaccatttcccaaatcctctaacctttcaagaaaaggcagaaagtcactatttggctgtggctgttagctctatcattgctagaaatctatttttagacaatctcgatcaattaggtcaagatttaggttaccaactcccaagcggtgctggttcagcttcagataaagttgctagccaactcttagccgcttatggtatgtctagcttagaatatagtgctaaacttcacttcgccaacactcacaaagcgcaagcgcttctcactaaa

SEQ ID NO: 5044 - protein, 300 aa, Streptococcus pyogenes
MNTLVLKIDAILSKHLKKQLAPYTISSQNTYVAFAAKKNGVTVLLYKSGKLVLQGNGANALAQELNLPVAKTVFEASNNSQDIPIIGSDEVGNGSYFGGIAVVASFVDPKDHSFLKKLGVDDSKKLSDKTIQQIAPLLEKQIPHQSLLLSPKKYNELVGKSKPYNAISIKVALHNQAIFLLLQKGIQPKQIVIDAFTSQSNYEKHLKKEKNHFPNPLTFQEKAESHYLAVAVSSIIARNLFLDNLDQLGQDLGYQLPSGAGSASDKVASQLLAAYGMSSLEYSAKLHFANTHKAQALLTK

SEQ ID NO: 5045 - DNA, 309 bp, Streptococcus agalactiae
atggaaacaaaaataaataatagtcagaaaaatcgttataaatttgtctttggagataagcctctcacattgacgacagataaagacaacctttttatggaagagattgagcgtgtagctacagaaaagtatgaagctattaaagaaaaattacctaatgctgataatgaaacgattgctattctcatggcaattaatgctttatcagtgcaactaagtcgagaaattgacattgaaaaaatggaagatgagctcaataagttacgctccaaaacgatttcggacattaaagaaaaagtgagtgaggat

SEQ ID NO: 5046 - protein, 103 aa, Streptococcus agalactiae
METKINNSQKNRYKFVFGDKPLTLTTDKDNLFMEEIERVATEKYEAIKEKLPNADNETIAILMAINALSVQLSREIDIEKMEDELNKLRSKTISDIKEKVSED

SEQ ID NO: 5047 - DNA, 306 bp, Streptococcus pyogenes
atgaaaagtattaatcgctataaattcacctttggtgaaaaaacattaacattgacaactgacaaagacaatctctttatggaagaagttgagcgggtagctaaagaaaagtatcaggctcttaaaaatcatttaccagaagctgatgacgagactatcgctattttaatggctatcaataccttgtcaacacaattaagcagagagattgccattgaaaaaatggaagctgaaattttagatttacgtcaaaaaaccttggttggtcttcaagaaaaagctaatcaaatagatgtgaatgaggtt

SEQ ID NO: 5048 - protein, 102 aa, Streptococcus pyogenes
MKSINRYKFTFGEKTLTLTTDKDNLFMEEVERVAKEKYQALKNHLPEADDETIAILMAINTLSTQLSREIAIEKMEAEILDLRQKTLVGLQEKANQIDVNEV

SEQ ID NO: 5049 - DNA, 540 bp, Streptococcus agalactiae
atgctatcattgcttttgctgattattgttatttggcatttttatattggctacagtagaggtatttttttacaagtcttttacgtgttaatgtcaatggtatctttgatgattgctagtcaattttaccaagaattagctagtcagattacgttatgggtaccgtattctaatcctgtacaaggagtagaagtttacttttttaaagatattagcaaatttcaattgagtcatgtttattatgcaggtgttgcctttgtttttatctacagtttatcttacttagtaggtcgcttgttaggtgttttactacatttagcaccagttgaacattttgatagcttgcaaaataatattattagtggttttttagccgttctggtttgtctcttatttatgagtatgtgtttgactattctggcaacagtccctatgtcatttgttcaagaaaagttatggaatagtctgtttgttagatttttaattaacgacttaccattcttctcacagtttttggtaaggacttgggcggtaggtctt

SEQ ID NO: 5050 - protein, 180 aa, Streptococcus agalactiae
MLSLLLLIIVIWHFYIGYSRGIFLQVFYVLMSMVSLMIASQFYQELASQITLWVPYSNPVQGVEVYFFKDISKFQLSHVYYAGVAFVFIYSLSYLVGRLLGVLLHLAPVEHFDSLQNNIISGFLAVLVCLLFMSMCLTILATVPMSFVQEKLWNSLFVRFLINDLPFFSQFLVRTWAVGL

SEQ ID NO: 5051 - DNA, 543 bp, Streptococcus pyogenes
atgttatctttattgatagtgcttattttaacttggaatttttatattggttatagtagaggtattattcttcaatcgttttatgtcttaggagccctactttctcttttggtagctaatcgattttatattggattagcccataagctaacgctttggattccttattctaacccggtagaaggaacatcagtctttttctttaaatcagttgatatctttgttttagataaggtttattatgcaggccttgccttttttatcattttcttattggggtatgcattgagtcgctttcttgggatttttgttcatttccttttgctaaattattttgataaccagtggacaaaatgtttgagtggcggactagcgtttctagtatcgcttctttttttgaacatgttactgtctatttttgcaacggtccctatgccttttttacagcactatttgcactctagttttcttgctcgtttggtgatcgaacaccttccaccattgacaataattattcaaaaattgtggattcaagccattatt

SEQ ID NO: 5052 - protein, 181 aa, Streptococcus pyogenes
MLSLLIVLILTWNFYIGYSRGIILQSFYVLGALLSLLVANRFYIGLAHKLTLWIPYSNPVEGTSVFFFKSVDIFVLDKVYYAGLAFFIIFLLGYALSRFLGIFVHFLLLNYFDNQWTKCLSGGLAFLVSLLFLNMLLSIFATVPMPFLQHYLHSSFLARLVIEHLPPLTIIIQKLWIQAII

SEQ ID NO: 5053 - DNA, 2364 bp, Streptococcus agalactiae
gtgataaatttaggtataatgaagagtatgaataacaagattttagaacagttagaatttaacaaagttaaggaattgatattaccttatctcaagacagaacaatcacaagaagaattatcagagctggagccgatgacggaggctcctaaaatagaaaaaagttttaatgaaatttctgacatggaacagatttttgttgaacatcactcatttggcatagtcagcctaagttcaatctctgagagtttaaaacgcttagagctttcagctgatcttaatattcaagaacttttggctatcaaaaaagttttacagagttcttcggatatgattcacttttattctgatttggataatgtttctttccaatctttggatcgtttgtttgaaaatttggaacaattccctaatctgcaagggtcttttcaagctatcaatgatggtggttttttagaacattttgcgagtccagaattagagcgtatccgtcgtcaattaacaaacagtgaacgacgggttcgtcagattttacaggatatgcttaaggaaaaagcagagcttttatcagagaatctaatcgctagtcgtagtggacgaagtgtcctaccagtaaaaaatacttatcggaatcgtatttctggtgtggttcatgacatctcttcttcaggaagtactgtttatattgagcctcgtgctgtagttacactaaacgaagagataacgcagcttagagctgacgaacgtcatgaagaaagtcgtattttacacgcattttcagacttgttaagaccccatgtcgccactattagaaataatgcatggattcttgggcatcttgattttgtaagggctaaatatctttttatgtctgataataaggcgacgatacctgagatttctaatgacagcacgttagcattaatcaatgttcgtcatcctctgttaagtaaccctgtggctaatgacttacattttgatcaagatttaactgcaattgtcatcactggtcccaatactggtggtaagacgattatgctaaaaacactcggtttagcacaattaatgggacagtctggtttgccagtattagcggataaaggtagtaaaattgcagtatttaacaatatctttgcagatattggcgatgagcaatctattgaacaaagtctatcaactttttctagtcatatgacgcacatagtcagtattttaaacgaggctgaccacaatagtttagtcctctttgatgaactgggagcaggaacggatcctcaagaaggtgctagtttggctatggctattttagaacaccttaggttaagtaatatcaaaacgatggcgaccacgcactatccagaattaaaagcttatgggattgagacaaattttgtagagaatgcgagcatggaatttgatgccgaaacgcttagccctacgtatcgctttatgcaaggagttcctggacgatcaaatgcatttgaaattgcttctcgccttggtttagctccatttattgttaaacaagctaagcagatgacagattctgactcagatgttaaccgtattattgaacagttagaggcacagacacttgagacacgtagaagactggatcatattaaagaagttgaacaagaaaacctcaaattcaatcgtgcggttaagaaactctataatgaattttcacatgagcgcgataaagagttagaaaaaatctatcaagaagctcaagaaattgtagatatggctttgaatgagagtgatactatcttaaaaaaactcaatgataagagccaattaaaacctcacgaaattatagatgctaaggcacaaataaaaaaattagcacctcaagttgatttatcaaaaaataaagtcttaaataaggctaaaaaaattaaagcagctcgtgctcctagaattggtgatgatattatagtgactagctatggacagcgaggtaccttaactagtcaattaaaagatggacgttgggaagcacaagtgggaattatcaaaatgacattaacacaagatgaatttacccttgttagagtccaagaagaacagaaagtcaaaagtaaacagattaatgtggttaaaaaggctgatagttctggaccaagagctcgacttgatcttagaggtaaaagatacgaagaagctatgcaagagttagataattttattgatcaagcattgcttaacaatatgggacaagttgatatcattcatggtattggtacaggcgttatccgtgagggagtgacaaaatatcttcgtcgtaataagcacgttaagcattttgcttatgccccacaaaatgcagggggatctggcgccacaattgtaacgttaggg

SEQ ID NO: 5054 - protein, 788 aa, Streptococcus agalactiae
MINLGIMKSMNNKILEQLEFNKVKELILPYLKTEQSQEELSELEPMTEAPKIEKSFNEISDMEQIFVEHHSFGIVSLSSISESLKRLELSADLNIQELLAIKKVLQSSSDMIHFYSDLDNVSFQSLDRLFENLEQFPNLQGSFQAINDGGFLEHFASPELERIRRQLTNSERRVRQILQDMLKEKAELLSENLIASRSGRSVLPVKNTYRNRISGVVHDISSSGSTVYIEPRAVVTLNEEITQLRADERHEESRILHAFSDLLRPHVATIRNNAWILGHLDFVRAKYLFMSDNKATIPEISNDSTLALINVRHPLLSNPVANDLHFDQDLTAIVITGPNTGGKTIMLKTLGLAQLMGQSGLPVLADKGSKIAVFNNIFADIGDEQSIEQSLSTFSSHMTHIVSILNEADHNSLVLFDELGAGTDPQEGASLAMAILEHLRLSNIKTMATTHYPELKAYGIETNFVENASMEFDAETLSPTYRFMQGVPGRSNAFEIASRLGLAPFIVKQAKQMTDSDSDVNRIIEQLEAQTLETRRRLDHIKEVEQENLKFNRAVKKLYNEFSHERDKELEKIYQEAQEIVDMALNESDTILKKLNDKSQLKPHEIIDAKAQIKKLAPQVDLSKNKVLNKAKKIKAARAPRIGDDIIVTSYGQRGTLTSQLKDGRWEAQVGIIKMTLTQDEFTLVRVQEEQKVKSKQINVVKKADSSGPRARLDLRGKRYEEAMQELDNFIDQALLNNMGQVDIIHGIGTGVIREGVTKYLRRNKHVKHFAYAPQNAGGSGATIVTLG

SEQ ID NO: 5055 - DNA, 2454 bp, Streptococcus pyogenes
gtgagtttcacctttaggttctttatttacgagaaactgtttagaaataaagagaacgcatgggaacttagtgactttcttgccccattttccatcattttaggtataatgaagagtatgaataacaagattttagagcagttagaatttaacaaagttaaggaattgctattaccttatctcaagacagaacaatcacaagaagaattattagagctggagccgatgacggaggctcctaaaatagaaaaaagttttaatgaaatttctgacatggaacagatttttgttgaacatcactcatttggcatagtcagcctaagttcaatctctgagagtttaaaacgcttagagctttcaactgatcttaatattcaagaacttttggctatcaaaaaagttttacagagttcttcggatatgattcacttttattctgatttggataatgtttctttccaatctttggatcgtttgtttgaaaatttggaacaattccctaatctgcaagggtcttttcaagctatcaatgatggtggttttttagaacattttgcgagtccagaattagagcgtatccgtcgtcaattaacaaatagtgaacgacgggttcgtcagattttacaggatatgcttaaggaaaaagcagagcttttatcagagaatctaatcgctagtcgtagtggacgaagtgtcctaccagtaaaaaatacttatcggaatcgtatttctggtgtggttcatgacatctcttcttcaggaagtactgtttatattgagcctcgtgctgtagttacactaaacgaagagataacgcagcttagagctgacgaacgccacgaagaaggtcgtattttacacgcattttcagacttgttaagacctcatgtcgccactattagaaataatgcatggattcttgggcatcttgattttgtaagggctaaatatctttttatgtctgataataaggcgacgatacctaagatttctaatgacagcacgttagcattaatcaatgttcgtcatcctctgttaagtaatcctgtggctaatgacttacattttgatcacgatttaactgcaattgtcatcactggtcccaatactggtggtaagacgattatgctaaaaacactcggtttagcacaattaatgggacagtctggtttgccagtattagcggataaaggtagtaaaattgcagtatttaacaatatctttgcagatattggcgatgagcaatctattgaacaaagtctatcaactttttctagtcatatgacgcacatagtcagtattttaaacgaggctgaccacaatagtttagttctctttgatgaactaggagcaggaacggatcctcaagaaggtgctagtttggccatggctattttagaacaccttaggttaagtcatatcaaaacgatggcgaccacgcactatccagaattaaaagcttatgggattgagacaaattttgtagagaatgcgagcatggaatttgatgcagaaacgcttagccccacatatcgctttatgcaaggagttcctggacgctcaaatgcatttgaaattgcttctcgccttggtttagctccatttattgttaaacaagctaagcagatgacagattctgactcagatgttaaccgtattattgaacagttagaggcacagacacttgagacacgtagaagactggatcatattaaagaagttgaacaagaaaacctcaaattcaatcgtgcggttaagaaactctataatgaattttcacatgaacgcgataaagagttagaaaaaatctatcaagaagctcaagaaattgtagatatggctttgaatgagagtgatactatcttaaaaaaactcaatgataagagccaattaaaacctcacgaaattatagatgctaaggcacaaataaaaaaattagcacctcaagttgatttatcaaaaaataaagtcttaaataaggctaaaaaaatcaaagcagctcgtgcccctagaattggtgatgatattatagtgactagttatggacagcgaggtaccttaactagtcaattaaaagatggccgttgggaagcacaagtgggaattatcaaaatgacattaacacaagatgaatttagcctcgttagagtccaagaagaacagaaagtcaaaaataaacagattaatgtggttaaaaaggctgatggttctggaccaagagctcgacttgatcttagaggtaaaagatacgaagaagcaatgcaagagttagatcattttattgatcaagcattgcttaacaatatgggacaagttgatatcattcatggtattggtacaggcgttattcgtgagggagtgacaaaatatcttcgtcgtaataagcatgttaagcattttgcttatgccccacaaaatgcagggggatctggtgccacaattgtaacgttaggg

SEQ ID NO: 5056 - protein, 818 aa, Streptococcus pyogenes
VSFTFRFFIYEKLFRNKENAWELSDFLAPFSIILGIMKSMNNKILEQLEFNKVKELLLPYLKTEQSQEELLELEPMTEAPKIEKSFNEISDMEQIFVEHHSFGIVSLSSISESLKRLELSTDLNIQELLAIKKVLQSSSDMIHFYSDLDNVSFQSLDRLFENLEQFPNLQGSFQAINDGGFLEHFASPELERIRRQLTNSERRVRQILQDMLKEKAELLSENLIASRSGRSVLPVKNTYRNRISGVVHDISSSGSTVYIEPRAVVTLNEEITQLRADERHEEGRILHAFSDLLRPHVATIRNNAWILGHLDFVRAKYLFMSDNKATIPKISNDSTLALINVRHPLLSNPVANDLHFDHDLTAIVITGPNTGGKTIMLKTLGLAQLMGQSGLPVLADKGSKIAVFNNIFADIGDEQSIEQSLSTFSSHMTHIVSILNEADHNSLVLFDELGAGTDPQEGASLAMAILEHLRLSHIKTMATTHYPELKAYGIETNFVENASMEFDAETLSPTYRFMQGVPGRSNAFEIASRLGLAPFIVKQAKQMTDSDSDVNRIIEQLEAQTLETRRRLDHIKEVEQENLKFNRAVKKLYNEFSHERDKELEKIYQEAQEIVDMALNESDTILKKLNDKSQLKPHEIIDAKAQIKKLAPQVDLSKNKVLNKAKKIKAARAPRIGDDIIVTSYGQRGTLTSQLKDGRWEAQVGIIKMTLTQDEFSLVRVQEEQKVKNKQINVVKKADGSGPRARLDLRGKRYEEAMQELDHFIDQALLNNMGQVDIIHGIGTGVIREGVTKYLRRNKHVKHFAYAPQNAGGSGATIVTLG

SEQ ID NO: 5057 - DNA, 354 bp, Streptococcus agalactiae
ttgtacaataggcttatcattaagatgaaatggagaaaaaagatggcattagaagtaacagatgctacatttgtagaagaaactaaagaaggtttagtactcattgatttttgggcaacttggtgtggtccatgtcgtatgcaagcaccaatcttagaacagttatctcaagaaatcgatgaagatgaactcaaaattttgaaaatggatgttgatgagaatccggaaactgcccgtcagtttggtattatgtcaattccaacattgatgtttaaaaaagacggagaagtggttaaacaagttgcaggtgttcatactaaagaccaactgaaagctattattgctgaattgagt

SEQ ID NO: 5058 - protein, 118 aa, Streptococcus agalactiae
MYNRLIIKMKWRKKMALEVTDATFVEETKEGLVLIDFWATWCGPCRMQAPILEQLSQEIDEDELKILKMDVDENPETARQFGIMSIPTLMFKKDGEVVKQVAGVHTKDQLKAIIAELS

SEQ ID NO: 5059 - DNA, 354 bp, Streptococcus pyogenes
ttgtacaataggcttatcattaagatgaaatggagaaaaaagatggcattagaagtaacagatgctacatttgtagaagaaactaaagaaggtttagtactcattgatttttgggcaacttggtgtggtccatgtcgtatgcaagcaccaatcttagaacagttatctcaagaaatcgatgaagatgaactcaaaattttgaaaatggatgttgatgaaaatccggaaactgctcgtcagtttggtattatgtcaattccaacattgatgtttaaaaaagacggagaagtggttaaacaagttgcaggtgttcatactaaagaccaattgaaagctattattgctgaattgagt

SEQ ID NO: 5060 - protein, 118 aa, Streptococcus pyogenes
LYNRLIIKMKWRKKMALEVTDATFVEETKEGLVLIDFWATWCGPCRMQAPILEQLSQEIDEDELKILKMDVDENPETARQFGIMSIPTLMFKKDGEVVKQVAGVHTKDQLKAIIAELS

SEQ ID NO: 5061 - DNA, 591 bp, Streptococcus agalactiae
atggaaattggtcagcaaattattcgctaccgtaaacaacaagcgctctcgcaagaagaattagccgagaaagtctatgtaagccgtcagagcatatctaactgggaaaatgacaaaacttacccagacatccatagcctcttactcctaagtcaaatttttcaagtgagcttagaccaactaattaaaggagacattgagaaaatgaaatataccatcactcaggttgataaaaagaattttgaacgagataccaaagtaatggtgacattgatgatactattaatgatttcaagttatccattagtctatttcttagagtggctaggacttggcatttttgttttattatcgataattactatgacttatgctaatcgtgtggaacgttttaagaaaaaatatgatgtgcaaacttataaggaaatcctagctgtttcaagtggaaaattattagacgaaatcgaaaaacgggaagaaagagcaaaacttccttatcagaaaccccttattgtcactgtatttttcctcattactgttgccaccttttttgcaagtcgttttattttcacatggttgttccatttaagt

SEQ ID NO: 5062 - protein, 197 aa, Streptococcus agalactiae
MEIGQQIIRYRKQQALSQEELAEKVYVSRQSISNWENDKTYPDIHSLLLLSQIFQVSLDQLIKGDIEKMKYTITQVDKKNFERDTKVMVTLMILLMISSYPLVYFLEWLGLGIFVLLSIITMTYANRVERFKKKYDVQTYKEILAVSSGKLLDEIEKREERAKLPYQKPLIVTVFFLITVATFFASRFIFTWLFHLS

SEQ ID NO: 5063 - DNA, 999 bp, Streptococcus agalactiae
atgttgcaacaaacacaagttaatacagttatcccttattataaacgttttctagagtggtttcctcaaataaaagatttggcagacgctcctgaagaacaattactaaaggcatgggagggactaggctattattctcgggtgcgtaatatgcaaaaggctgcacagcaagtgatggttgattttggtggcatatttcctcacacttatgatgatattgcttcattaaaagggattggtccttatactgcaggtgctatcgccagcatctcattcaacttaccagagcctgctgttgatggcaatgtgatgcgtgtcatggctcgtttgtttgaagttaattatgacatcggtgaccctaaaaatcgtaaaatttttcaagctattatggaaatactaattgaccctgacagacccggtgattttaaccaagcacttatggatctgggtacagacatcgaatccgctaagacacctagacctgatgaaagccctattcgtttctttaatgctgcttatttgaatggtacttatagtaaatatcccataaaaaatactaagaaaaagcctaaaccaatgcgaattcaggcttttgtcattcgtaaccaaaatggtcaatatctactggagaaaaatactaaagggagacttctagggggtttttggtcatttcctattatcgaaacgtcacctctttctcaacaattagatttatttgatgacaatcaatccaaccccataatctggcaaacccaaaatgaaactttccaaagagaatatcaattaaagccccaatggactgataatcactttccaaatattaagcacacttttagtcaccagaagtggacaatagaactcatagagggggtggtcaaagcaacagatttacctaatgctcctcacctaaagtgggtagcaattgaggacttttctctgtatccctttgcaacaccacaaaagaaaatgctagagacctacttaaaacagaaaaatgct

SEQ ID NO: 5064 - protein, 333 aa, Streptococcus agalactiae
MLQQTQVNTVIPYYKRFLEWFPQIKDLADAPEEQLLKAWEGLGYYSRVRNMQKAAQQVMVDFGGIFPHTYDDIASLKGIGPYTAGAIASISFNLPEPAVDGNVMRVMARLFEVNYDIGDPKNRKIFQAIMEILIDPDRPGDFNQALMDLGTDIESAKTPRPDESPIRFFNAAYLNGTYSKYPIKNTKKKPKPMRIQAFVIRNQNGQYLLEKNTKGRLLGGFWSFPIIETSPLSQQLDLFDDNQSNPIIWQTQNETFQREYQLKPQWTDNHFPNIKHTFSHQKWTIELIEGVVKATDLPNAPHLKWVAIEDFSLYPFATPQKKMLETYLKQKNA

SEQ ID NO: 5065 - DNA, 1152 bp, Streptococcus pyogenes
atgattgaattaaaagattatggtattaatatgtgggataatgagacaatcgcttcttttcgtcgcacacttttagagtggtatgaccaagaaaaacgtgatctcccttggcgaagaactactaatccatattatatttgggtttctgaaatcatgttgcaacaaacacaagttaatacggtaatcccttattataaacgttttctagagtggtttcctcaaataaaagatttggcagacgctcctgaagaacaattactaaaggcatgggagggactaggctattattctcgggtgcgtaatatgcaaaaggctgcacagcaagtgatggttgattttggtggcatatttcctcacacttatgatgatattgcttcattaaaagggattggtccttatactgcaggtgctatcgccagcatctcattcaacttaccagagcctgctgttgatggcaatgtgatgcgtgtcatggctcgtttgtttgaagttaattatgatatcggtgaccctaaaaatcgtaaaatttttcaagctattatggaaatactaattgaccctgacagacccggtgattttaaccaggcacttatggatctaggtacagacatcgaatccgctaagacacctaggcctgatgaaagccctattcgtttctttaacgctgcttatttgaatggtacttatggtaaataccccataaaaaatccaaagaaaaagcctaaaccaatgcgaattcaggcttttgtcattcgtaaccaaaatggccagtatctactggagaaaaatactaaagggagacttctaggaggattttggtcatttcctattatcgaaacatcacctctttctcaacaattagatttatttgatgacaatcaatccaaccccataatctggcaaacccaaaatgaaactttcgaaagagaatatcaattaaagccacaatggactgataatcactttccaaatattaagcacacttttagtcaccagaagtggacaatagaactcatagagggggtggtcaaagcaacagatttacctaatgctcctcacctaaagtgggtagcaattgaggacttttctctttatccctttgcaacaccacaaaagaaaatgctagagacctacttaaaacagaaaaatgct

SEQ ID NO: 5066 - protein, 384 aa, Streptococcus pyogenes
MIELKDYGINMWDNETIASFRRTLLEWYDQEKRDLPWRRTTNPYYIWVSEIMLQQTQVNTVIPYYKRFLEWFPQIKDLADAPEEQLLKAWEGLGYYSRVRNMQKAAQQVMVDFGGIFPHTYDDIASLKGIGPYTAGAIASISFNLPEPAVDGNVMRVMARLFEVNYDIGDPKNRKIFQAIMEILIDPDRPGDFNQALMDLGTDIESAKTPRPDESPIRFFNAAYLNGTYGKYPIKNPKKKPKPMRIQAFVIRNQNGQYLLEKNTKGRLLGGFWSFPIIETSPLSQQLDLFDDNQSNPIIWQTQNETFEREYQLKPQWTDNHFPNIKHTFSHQKWTIELIEGVVKATDLPNAPHLKWVAIEDFSLYPFATPQKKMLETYLKQKNA

SEQ ID NO: 5067 - DNA, 834 bp, Streptococcus agalactiae
atgaataagaaaaaacgtcttaaccttacttttgtttatattttattgatagtactatcaattatgtggctctttcccattgtttgggtcgttctcacaagcttccgtggtgaaggaagtgcctttgtcaactactttattcctaaaacttggacattagacaactacgctaaactcttcacccaaaacacattcccatttggtcaatggttcttaaatacattatttgtcgctacatgtacttgtatactatcaactttaatcactgtagcaatggcttattctctcagcagaatcaaattcaaacaccgtaatggtttcctaaagctagctttagtcttgaatatgtttcctgggttcatgtcaatgattgcagtttactacatcctaaaagctctaaatctagaccaaacattaaccgctttaatatttgtctattctgcaggagcagcattaaccttctacatcgcaaaaggtttctttgatactattccatactctttggatgagtctgctatgattgatggggcgacccgtttggatattttccttaaaatcaccctaccattgtcaaaacccattatcgtttatactgcattaatcgcttttatgggcccttggatggactttatctttgcaaaagttattttaggtgatgctacgagcaagtacacagtcgctattggtctcttttcaatgttgcaacaagataccatcaaccagtggttcatgtcatttacagcaggatctgttattattgcaattccaatcacaatacttttcatgttcatgcaaaaatactatgttgaaggtattacaggtggatctgtaaaa

SEQ ID NO: 5068 - protein, 278 aa, Streptococcus agalactiae
MNKKKRLNLTFVYILLIVLSIMWLFPIVWVVLTSFRGEGSAFVNYFIPKTWTLDNYAKLFTQNTFPFGQWFLNTLFVATCTCILSTLITVAMAYSLSRIKFKHRNGFLKLALVLNMFPGFMSMIAVYYILKALNLDQTLTALIFVYSAGAALTFYIAKGFFDTIPYSLDESAMIDGATRLDIFLKITLPLSKPIIVYTALIAFMGPWMDFIFAKVILGDATSKYTVAIGLFSMLQQDTINQWFMSFTAGSVIIAIPITILFMFMQKYYVEGITGGSVK

SEQ ID NO: 5069 - DNA, 834 bp, Streptococcus pyogenes
atgaaaaacaaacgtcgatttcaacttggacttgtttatgctactttaatcatcctctcaatcatttggctcttcccaatcgcttgggttattcttactagcttccgtagcgaaggaactgcttacgtcaattattttattcctaagacttttacattaaatcactacattaatctttttactaatgaaacctttccttttggaaaatggtttatgaatactcttattgtagccacttttacatgtattatttcaaccttcataactgttgccatagcctactctcttagccgaattaagtttaagtttcgcaatggctttttaaaactagcccttattttaaatatgttccctggtttcatgagcatgattgccatctactatatcttaaaggccttaggtttgacgcaaaccctaacagcacttgtccttgtttattcctcaggtgcagcccttggtttttacattgcaaaaggattttttgataccattccttattcacttgatgaatcagctatgattgatggcgctactcgtatggatattttctttaaaataacccttcctttagcaaaaccaatcattgtctatactgcccttcttgcttttatggggccttggattgactttatctttgcacaagttattttaggtgatgctacaagtaaatataccgttgctattggactattttcaatgcttcagccagataccattaacaactggtttatggccttcactgctggttctgtcttaattgccgtcccaatcactctcctcttcatgtttatgcaaaaatactatgttgaaggcatcacaggtggttctgttaaa

SEQ ID NO: 5070 - protein, 278 aa, Streptococcus pyogenes
MKNKRRFQLGLVYATLIILSIIWLFPIAWVILTSFRSEGTAYVNYFIPKTFTLNHYINLFTNETFPFGKWFMNTLIVATFTCIISTFITVAIAYSLSRIKFKFRNGFLKLALILNMFPGFMSMIAIYYILKALGLTQTLTALVLVYSSGAALGFYIAKGFFDTIPYSLDESAMIDGATRMDIFFKITLPLAKPIIVYTALLAFMGPWIDFIFAQVILGDATSKYTVAIGLFSMLQPDTINNWFMAFTAGSVLIAVPITLLFMFMQKYYVEGITGGSVK

SEQ ID NO: 5071 - DNA, 1368 bp, Streptococcus agalactiae
atgaataaaaaactgatctcacttgatggtatgtccctaaaagaggtctttcaaaaaggtgatttagcaactaaactatcattcttaattatgggacttgctaacctcaaaaataaacaaattgtcaagggacttttatttttaatcagtgaaattctgtttttaattacctttgtttaccaagttatcccagctgtaaaaggtcttatttccttagggacccaagaacaaggtatgacaactaaaactgtggatggtattaaaatccaagttgcgacacaaggtgataactctatgttaatgctaatttttggattagcttcgcttatcttctgttgcgtatttgcctatatttactggtcaaacattaaaagcgcagcacatttattgaccttgaaagaagaaggaagagaaattccatccttcaaaaaagatattaaaagcttgacagatggacgcttccatatgactttaatgtctattcctttaataggggtgcttctatttacaatccttccgttagtttatatgatttgtttggcatttactaactatgatcataaccacttaccgccaaaaagtttatttgactgggttggttttgctaacttcggtaatatctttagcgggcgtatggccagtactttcttccctgttctatcttggacattaatttgggctgttttcgctactgtaacgaatttcttctttggtattattcttgccttactaattaatacaaaaggtttgaaattcaaaaagatgtggcgtactatttttgttattaccatggctgtccctcaatttatctctctcttaatcatgagaaacctcttaagtgacgctggaccggttaacgccttgttaataaaatggggacttatttcttcagcacatccccttccattcctttctgatccggtctgggcgaaattctcaatcatctttgttaatatgtgggttggtattcctgtaacaatgcttgttgctactggtatcatcatgaatttacctgcagaacaaattgaagctgctgaaattgatggggcgaataagttccaagtctttcaatcaattactttcccacaaattttgttgattatgactcctactttaattcaacaatttatcggaaatattaacaacttcaacgttatctacctactcactcaaggtggaccaacaaactcaacatactaccaagcaggtagcaccgatttacttgtcacttggctatacaatttgacagtaactgctgcagattataacttagcatctgttgttggtatcttaatctttattctttcagcagtatttagtttactagcttacacaagaacaaattcttacaaggaaggggcagctaaa

SEQ ID NO: 5072 - protein, 456 aa, Streptococcus agalactiae
MNKKLISLDGMSLKEVFQKGDLATKLSFLIMGLANLKNKQIVKGLLFLISEILFLITFVYQVIPAVKGLISLGTQEQGMTTKTVDGIKIQVATQGDNSMLMLIFGLASLIFCCVFAYIYWSNIKSAAHLLTLKEEGREIPSFKKDIKSLTDGRFHMTLMSIPLIGVLLFTILPLVYMICLAFTNYDHNHLPPKSLFDWVGFANFGNIFSGRMASTFFPVLSWTLIWAVFATVTNFFFGIILALLINTKGLKFKKMWRTIFVITMAVPQFISLLIMRNLLSDAGPVNALLIKWGLISSAHPLPFLSDPVWAKFSIIFVNMWVGIPVTMLVATGIIMNLPAEQIEAAEIDGANKFQVFQSITFPQILLIMTPTLIQQFIGNINNFNVIYLLTQGGPTNSTYYQAGSTDLLVTWLYNLTVTAADYNLASVVGILIFILSAVFSLLAYTRTNSYKEGAAK

SEQ ID NO: 5073 - DNA, 1359 bp, Streptococcus pyogenes
atgactcagtcaaacttgacaccaaatatatctgtaatagaagccttaaaaagaggcagttgggatattaaactttcgagtattatcatgggatttgccaactttgctaacaaacagtttatcaaaggaatcttatttttaataagtgaacttatctttctagtagcttttgtctcccaaatcatccctgctatccgtggccttgtcactcttggtactcaaactcagggaatgactacaaaaactattgatgggattaacatccaagttgctgttgatggcgataactctatgttaatgcttatttttggtttagcatcactcattttctgcctagtctttgcttacatttactggtgtaatctcaaaagtgctcgtaacctttatcttttcaaacaaaaaggtcagaagataccaagcttcaaagaagatcttgccacacttacaaatggtcgctttcatatgactttaatggctatcccactgattggtgtgcttttattcaccattcttcctttgatttacatgatctgtttggcctttaccaattttgatcataatcacttgcctccaaaatctttatttgattgggtgggacttgctaactttggaaatgttttaagcggccgtatggcaggaaccttttttcctatcttctcatggactttgatttgggctgtttttgccacagtaactaatttcttctttggtattattcttgctttgttaatcaataccaaaggattaaagtggaaaaaaatgtggcgaaccatctttgttatcaccattgcagttccacaattcatctcattattgattatgcggaacttactcaatgacgaaggcccactaaatgctcttctcaataaaatcggcttgattaatggctcactgccatttttatctgatcctctttgggcaaaattctcaatcatttttgtcaacatgtggatcggtattccatttaccatgctgattgcgactggtattatcatgaaccttccaagtgaacaaattgaggctgctgaaattgatggcgctagcaaattccaagtcttcaagtctatcacgttccctcaaattctcttgatcatgacaccaaacttgattcaacaatttatcggaaatatcaataactttaacgtcatttacctccttactggtggtggtccaacaaattcagaatactatcaggcaggaacaacagacttgctggtcacttggctttataaattaaccgtcacagctgctgactacaatttagcttctgttatcggtatcttaatctttacagtttcagctatctttagcttacttgcttatacaaggacagcatcctacaaggaaggagcggctaaa

SEQ ID NO: 5074 - protein, 453 aa, Streptococcus pyogenes
MTQSNLTPNISVIEALKRGSWDIKLSSIIMGFANFANKQFIKGILFLISELIFLVAFVSQIIPAIRGLVTLGTQTQGMTTKTIDGINIQVAVDGDNSMLMLIFGLASLIFCLVFAYIYWCNLKSARNLYLFKQKGQKIPSFKEDLATLTNGRFHMTLMAIPLIGVLLFTILPLIYMICLAFTNFDHNHLPPKSLFDWVGLANFGNVLSGRMAGTFFPIFSWTLIWAVFATVTNFFFGIILALLINTKGLKWKKMWRTIFVITIAVPQFISLLIMRNLLNDEGPLNALLNKIGLINGSLPFLSDPLWAKFSIIFVNMWIGIPFTMLIATGIIMNLPSEQIEAAEIDGASKFQVFKSITFPQILLIMTPNLIQQFIGNINNFNVIYLLTGGGPTNSEYYQAGTTDLLVTWLYKLTVTAADYNLASVIGILIFTVSAIFSLLAYTRTASYKEGAAK

SEQ ID NO: 5075 - DNA, 1293 bp, Streptococcus agalactiae
ttgcataatataggtgtaattaaaatattctctaggaggagaaccaaaatggaaaaaaatacttggaaaaaattacttgttagtactgctgctctttcagtagttgcaggaggagcaattgctgctactcactctaactcagttgatgctgcttcaaaaacaactatcaaactttgggtcccaacagattcaaaagcgtcttataaagcaattgttaaaaaattcsagaaggaaaacaaaggcgttactgtaaaaatgattgagtctaatgactccaaagctcaagaaaacgtaaaaaaagacccaagcaaggcagccgatgtattctcacttccacatgaccaacttggtcaattagtagaatctggtgttatccaagaaattccagagcaatactcaaaagaaattgctaaaaacgacactaaacaatcacttactggtgcacaatataaagggaaaacttatgcattcccatttggtattgaatctcaagttctttattataataaaacaaagttaactgctgacgacgttaaatcatacgaaacaattacaagcaaagggaaattcggtcracagcttaaagcagctaactcatatgtaacaggtcctmttttcctttctgtaggcgacactttatttggtaaatctggtgaagatgctaaaggcactaactggggtaatgaagcaggtgtttctgtccttaaatggattgcagatcaaaagaaaaatgatggttttgtcaacttgacagctgaaaatacaatgtctaaatttggcgatggttctgttcatgcttttgaaagtggaccatgggattacgacgctgctaaaaaagctgtcggtgaagataaaatcggtgttgctgtttacccaacaatgaaaatcggtgacaaagaagttcaacaaaaagcattcttgggcgttaaactttatgccgttaaccaagcacctgctggttcaaacactaaacgaatctcagctagctacaaactcgctgcatatctaactaatgctgaaagtcaaaaaattcaattcgaaaaacgtcatatcgttcctgctaactcatcaattcaatcttctgatagcgtccaaaaagatgaacttgcaaaagcagttatcgaaatgggtagctcagataaatatacaacggttatgcctaagttgagtcaaatgtcaaccttctggacagaaagtgctgctattcttagcgatacttacagtggtaaaatcaaatctagcgattaccttaaacgtctaaaacaattcgataaagacatcgctaaaacaaaa

SEQ ID NO: 5076 - protein, 431 aa, Streptococcus agalactiae
  MISC_FEATURE (1)..(431): Xaa = Any Amino Acid
MHNIGVIKIFSRRRTKMEKNTWKKLLVSTAALSVVAGGAIAATHSNSVDAASKTTIKLWVPTDSKASYKAIVKKFZKENKGVTVKMIESNDSKAQENVKKDPSKAADVFSLPHDQLGQLVESGVIQEIPEQYSKEIAKNDTKQSLTGAQYKGKTYAFPFGIESQVLYYNKTKLTADDVKSYETITSKGKFGXQLKAANSYVTGPXFLSVGDTLFGKSGEDAKGTNWGNEAGVSVLKWIADQKKNDGFVNLTAENTMSKFGDGSVHAFESGPWDYDAAKKAVGEDKIGVAVYPTMKIGDKEVQQKAFLGVKLYAVNQAPAGSNTKRISASYKLAAYLTNAESQKIQFEKRHIVPANSSIQSSDSVQKDELAKAVIEMGSSDKYTTVMPKLSQMSTFWTESAAILSDTYSGKIKSSDYLKRLKQFDKDIAKTK

SEQ ID NO: 5077 - DNA, 1245 bp, Streptococcus pyogenes
atgaaatcatggcaaaaagttatcgtcggcggagcaagtttgacacttgcaagtaccttgttagtgggatgtggatcaggttcaaaagataaaaaggaagctggcgctgactcaaagactattaaactttgggtaccgactggctctaaaaaatcatatgcagataccattgcaaaatttgaaaaagattctggttacaccgttaaagtggttgaatcagaagatccaaaagcacaagaaaaaatcaaaaaagatgcctcaactgctgccgatgtcttttcacttcctcatgatcaacttggtcaacttgtagaatctggtactattcaagaagttccagaaaagtacaataaagaaattgctgctacttctactgatcaggcgctcgtcggtgcacagtacaaagggaaaacatatgctttcccatttggtattgaatcacaagttcttttctacaataaatcaaaattagctgctgaagacgttacttcatatgatacaattactacaaaagcaacttttggtggtacctttaaacaagctaacacttacgctactggtccattattcatgtcagttggtaacactttatttggggaaaacggtgaagatgtaaaaggtactaactggggcaatgaaaaaggcgctgctgttcttaaatggatcgcagaccaagcttcaaataaaggttttgttagcttagatgctaacaacgttatgtctaaatttggtgacggttcagtagcttcctttgaatcaggaccgtgggactatgaagctgctcaaaaagctatcggtaaagaaaaccttggtgttgctatttatccaaaagtaactattggaggcgaaacggttcaacaaaaagcattcttgggtgtaaaactttacgcagtcaaccaagcaccagctaaaggtgatacaaaacgtatcgcagctagctacaaattggcatcctacttgactaatgctgaaagccaagaaaaccaattcaaaactcgtaacattgtcccagccaacaaagaagttcaatcttcagaagctgttcaatcaaacgaacttgctaaaaccgttatcactatgggttcttcttcagactacactgtcgtaatgccaaaacttagccaaatgggcacattctggactgaaagtgctgctattcttagtgatgccttcaacggtaaaatcaaagaaaacgactaccttactaagttgcaacaattcgacaaagatatcgctgcaacaaaa

SEQ ID NO: 5078 - protein, 415 aa, Streptococcus pyogenes
MKSWQKVIVGGASLTLASTLLVGCGSGSKDKKEAGADSKTIKLWVPTGSKKSYADTIAKFEKDSGYTVKVVESEDPKAQEKIKKDASTAADVFSLPHDQLGQLVESGTIQEVPEKYNKEIAATSTDQALVGAQYKGKTYAFPFGIESQVLFYNKSKLAAEDVTSYDTITTKATFGGTFKQANTYATGPLFMSVGNTLFGENGEDVKGTNWGNEKGAAVLKWIADQASNKGFVSLDANNVMSKFGDGSVASFESGPWDYEAAQKAIGKENLGVAIYPKVTIGGETVQQKAFLGVKLYAVNQAPAKGDTKRIAASYKLASYLTNAESQENQFKTRNIVPANKEVQSSEAVQSNELAKTVITMGSSSDYTVVMPKLSQMGTFWTESAAILSDAFNGKIKENDYLTKLQQFDKDIAATK

SEQ ID NO: 5079 - DNA, 192 bp, Streptococcus agalactiae
  MISC_FEATURE (1)..(192): n = a, c, g, or t
atggtaactataaaagatgttgctgccaaagctggtgttaatccatcgacagtaagtcgtgtactaaaagataatgcatctatttcaagtaagacgaaagagcgcgtgaaaaaagctatggaagagctgggctatgttcctaatgttgcagcacaaatgttggctagtggtttaacgcaaaatattnnnnnt

SEQ ID NO: 5080 - protein, 64 aa, Streptococcus agalactiae
  MISC_FEATURE (1)..(64): Xaa = Any Amino Acid
MVTIKDVAAKAGVNPSTVSRVLKDNASISSKTKERVKKAMEELGYVPNVAAQMLASGLTQNIXX

SEQ ID NO: 5081 - DNA, 1092 bp, Streptococcus pyogenes
ttgtataatggaaacgaaatacatgacaaacccatgataaggtttatctttggtaaatatagtaacgaggttaatatggtaacaataaaagatgtcgctcaaaaggcaggtgttaacccttcgacggtgagtagggtattaaaagataatcgatctatttctatgaagacaaaagagaaggttagaaaagcgatggcagatttgggatatgttccaaatgtcgcagcacagattctagcgagtggtttgacacacaatataggacttgtttttcctcctattacaactagcgatagattaagtgaacctttctttatggaaattttgtcgactattactaacgaagctaaagaatctcattttactgtgtcgattgctacaggtatatctcttgatgacctgatagagcaagtgaaactgatgcatcttcaaaaacgagttgatggttttattattctttattctgatcaagatgatcctgtcaaaaaatatttgatgacaaataacttaccatttgtcattgtaggtgctccacaaggtgacactaataaaaccacttatattgataatgataatcagctaatggctaaaacagcagtagaacacctttatcaaaaaggccatcacaacatattatttataacagatgatttactatcagaagtaacttctgagcgttatcttggctatttgaagggttgttttaagcgatctttaaaaacaaagccaatgctgttatttgatcgtaaggatcctgttagcgtagaaatattgatggaaactatatcttcctttaaagcaactgccttggttgttgttggtgatgttctggctattcgtatggtacagttattatctttttatgatataaaagtgccagatgatatgtcaattatcacttttaataattctaattacgctaaattaattcacccttatttaacgacatttgatataaatgttgaaaatcttggaaaaatgtcttttaagcaattacttgatattatcaattccaatgaacagaatcttagtcagactatttttgttccttttagtttaaaacaaagagaaagcgtccgtgatattagtcat

SEQ ID NO: 5082 - protein, 364 aa, Streptococcus pyogenes
LYNGNEIHDKPMIRFIFGKYSNEVNMVTIKDVAQKAGVNPSTVSRVLKDNRSISMKTKEKVRKAMADLGYVPNVAAQILASGLTHNIGLVFPPITTSDRLSEPFFMEILSTITNEAKESHFTVSIATGISLDDLIEQVKLMHLQKRVDGFIILYSDQDDPVKKYLMTNNLPFVIVGAPQGDTNKTTYIDNDNQLMAKTAVEHLYQKGHHNILFITDDLLSEVTSERYLGYLKGCFKRSLKTKPMLLFDRKDPVSVEILMETISSFKATALVVVGDVLAIRMVQLLSFYDIKVPDDMSIITFNNSNYAKLIHPYLTTFDINVENLGKMSFKQLLDIINSNEQNLSQTIFVPFSLKQRESVRDISH

SEQ ID NO: 5083 - DNA, 756 bp, Streptococcus agalactiae
ttggcagttagttttcatgaagtatttggttgggattctgctttttttattatgattatcaatattccattgctccttctttgctactttggcttaggtaaacaaacctttttaaaaactgtctatggttcttggatttttcctgtttttattaagttaacacaaagtgtaccaactttgacccacaacccactcctcgcagcactttttggaggtgttattgtaggatgtggtttggggattgttttttggagcgactcttcaactggtggaacggggattatcattcaattcttaggaaaatatactcctataagccttggacaaggggttatattgattgatggacttgttacaattgttggtttcctagcttttgacagtgatacggttatgttttctattattgggttgataactattagttatattattaatgctatccaaactggatttacaaccttaagcactgtcttaatcgtttctcaagagcaccaaaaaattaagacatatatcaatactgtcgcagatagaggagtaacagaaattcccgttaaagggggatattctggaactaatcaaatcatgcttatgacaactattgctggttatgagtttgctaaattacaagaggcaatagcagaaattgacgaaacagccttcataacagtaactccaacatcacaagcttctggacgtggatttagtcttcaaaaaaatcatggacgtcttgatgaagacattcttatgccaatg

SEQ ID NO: 5084 - protein, 252 aa, Streptococcus agalactiae
MAVSFHEVFGWDSAFFIMIINIPLLLLCYFGLGKQTFLKTVYGSWIFPVFIKLTQSVPTLTHNPLLAALFGGVIVGCGLGIVFWSDSSTGGTGIIIQFLGKYTPISLGQGVILIDGLVTIVGFLAFDSDTVMFSIIGLITISYIINAIQTGFTTLSTVLIVSQEHQKIKTYINTVADRGVTEIPVKGGYSGTNQIMLMTTIAGYEFAKLQEAIAEIDETAFITVTPTSQASGRGFSLQKNHGRLDEDILMPM

SEQ ID NO: 5085 - DNA, 870 bp, Streptococcus pyogenes
atgaaaaaacgagggattgatttactacttgtcacaattggctcattcataacagctattggtttcaatacaatgtttgtcgacaatcatattgcatcagggggtatggttggtattgcagttgttataaaagctctatttggcattagtccgtcgctttttttaatggctagtaatattcccttattattaatgtgttacttctttcttggaaaacaaaattttattaaaacactttatggttcttggatatatcctattgccatccgttcaaccaattcattacctactctgacacacaatcagttgttagcagctatttttggtggtattatctgtggcattggtttaggaatggttttttggggaaactcttcgacaggaggaactggaattctaacacaaatacttcataaatactctcctttatctcttggagttgcaatgacaattgtagatggtattagtgtccttatgggatttattgcactttctgcagatgacgtgatgtattctacgattggacttttcgtaattggttatgtgattagcgttatggaaaatggctttgactcatccaaaaatgttatgattatttccaaagattatcaagctattcgagaatatatcacaactgttatggatcgtggagtgactaaacttcctattcgcggtggttatactacttctgataaaattatgttaatggctattgtatcaagtcacgaattacctactctccaagaaaaaatcctcgaaattgacgatacagcctttattgttgtcatgccagcagctcaagttatgggaagaggatttagtttgactaaacaatacaaacgtgaagacaaagacgttttattgcctatg

SEQ ID NO: 5086 - protein, 290 aa, Streptococcus pyogenes
MKKRGIDLLLVTIGSFITAIGFNTMFVDNHIASGGMVGIAVVIKALFGISPSLFLMASNIPLLLMCYFFLGKQNFIKTLYGSWIYPIAIRSTNSLPTLTHNQLLAAIFGGIICGIGLGMVFWGNSSTGGTGILTQILHKYSPLSLGVAMTIVDGISVLMGFIALSADDVMYSTIGLFVIGYVISVMENGFDSSKNVMIISKDYQAIREYITTVMDRGVTKLPIRGGYTTSDKIMLMAIVSSHELPTLQEKILEIDDTAFIVVMPAAQVMGRGFSLTKQYKREDKDVLLPM

SEQ ID NO: 5087 - DNA, 1617 bp, Streptococcus agalactiae
ttgcttacagtttcagatgtttcactacgttttagtgatcgcaaattatttgatgaagttaacattaactttacagcaggaaatacctatggtcttatcggagcaaatggcgctggtaaatcaactttccttaaaattttagctggtgatattgaaccaacaacaggacatattgcacttggcccagatgaacgcctttctgtacttcgccaaaatcattttgattatgaagatgagcgcgtcattgatgtcgttatcatgggtaatgaaacactttatagtatcatgaaagaaaaggatgctatctacatgaaagaagatttttctgatgaagatggtgttcgcgctgcggaattagaaggagaatttgctgaactcggtggatgggaggctgaaagtgaggcttctcaattactccaaaatctaaatatttcagaagagcttcattatcaaaatatgagtgaactagctaatggagacaaagttaaagttctccttgcaaaagctctctttggtaaaccagatgtacttctccttgacgagcctaccaatggacttgatatccagtctattacttggttagaagatttcttgattgactttgaaaatacagttattgtagtttcccacgaccgtcatttcttgaataaagtatgtacacatatggctgaccttgattttggaaaaattaaactgttcgtcggtaactatgatttctggaaagaatcatcagaattagcagctcgtttacaagctgatcgtaatgctaaagcagaagaaaaaattaaacaacttcaagaattcgttgcacgattttcagcgaatgcttcaaaatcaaaacaagcaacttctcgtaaaaaaatgcttgataaaattgaacttgaagagattgtaccatcaagccgtaaatacccattcgttaactttaaagccgaacgcgaaatgggaaatgatttattgaccgttgaaaatctctctgtcactattgatggggaaaaaatccttgataatatcagtttcattcttcgtcctggtgataaaactgcacttattggacaaaatgatatccaaactactgcacttattcgagcattgatgggggatatcgaatatgaaggaacaatcaaatggggagtaacaactagtcgttcttaccttccaaaagacaattcacgagattttgcttctggcgagtcaatcttagaatggcttcgtcaatttgctagtaaagaagaagacgataataccttcttacgtggtttcctaggtcgtatgcttttctctggagatgaggttaacaaatctgttaatgtcttatctgggggtgaaaaagtacgcgttatgctttcgaaattaatgctattaaaatctaatgttcttgttcttgatgatccaacaaaccacttagatttggaatctatttcaagtctcaacgatggactaaaagatttcaaagaatctattatttttgcaagtcatgaccacgagtttattcaaactttagcgaaccatattattgttctttctaaaaacggagttatcgatcgtatcgatgaaacttacgatgaatttcttgaaaataccgaagtacaagctaaggtcgctcaactctggaaa

SEQ ID NO: 5088 - protein, 539 aa, Streptococcus agalactiae
MLTVSDVSLRFSDRKLFDEVNINFTAGNTYGLIGANGAGKSTFLKILAGDIEPTTGHIALGPDERLSVLRQNHFDYEDERVIDVVIMGNETLYSIMKEKDAIYMKEDFSDEDGVRAAELEGEFAELGGWEAESEASQLLQNLNISEELHYQNMSELANGDKVKVLLAKALFGKPDVLLLDEPTNGLDIQSITWLEDFLIDFENTVIVVSHDRHFLNKVCTHMADLDFGKIKLFVGNYDFWKESSELAARLQADRNAKAEEKIKQLQEFVARFSANASKSKQATSRKKMLDKIELEEIVPSSRKYPFVNFKAEREMGNDLLTVENLSVTIDGEKILDNISFILRPGDKTALIGQNDIQTTALIRALMGDIEYEGTIKWGVTTSRSYLPKDNSRDFASGESILEWLRQFASKEEDDNTFLRGFLGRMLFSGDEVNKSVNVLSGGEKVRVMLSKLMLLKSNVLVLDDPTNHLDLESISSLNDGLKDFKESIIFASHDHEFIQTLANHIIVLSKNGVIDRIDETYDEFLENTEVQAKVAQLWK

SEQ ID NO: 5089 - DNA, 1617 bp, Streptococcus pyogenes
ttgcttacagtttctgatgtatcactacgctttagtgatcgaaaactatttgatgatgttaatatcaaattcacagccggcaatacttacggcttaatcggtgccaatggtgccggaaaatcaacttttcttaaaatccttgcaggagatattgaaccaagtactggtcatatctctttaggacctgacgaacgcttatctgttcttcgccaaaatcattttgattatgaagaagaacgtgcgattgatgttgtaatcatgggtaatgaacaactctacaatatcatgaaagaaaaagacgctatctatatgaaagcagatttttcagaagaagatggggttcgtgccgctgagctagaaggtatctttgctgaattaggtggctgggaggcagaaagtgaagcttctcaacttctccaaaatctaaatattccagaagaccttcactaccaaaatatgagtgaactggctaatggagataaagtgaaagtccttcttgctaaagcgctctttggtaagcctgacgttttattacttgacgagccaaccaatggtcttgatattcaatctatttcatggttggaagatttcttgattgattttgaaaatacagtcatcgttgtttcccatgaccgtcacttcttgaataaagtatgtactcacatggccgaccttgactttggtaaaatcaaactctttgtgggtaactacgatttctggaaacaatcttctgagctggccgctcgtttacaagctgaccgcaatgctaaagcagaagagaaaatcaaagaattacaagaattcgttgcccgtttctcagcaaacgcatctaaatcaaaacaagcaacctctcgtaaaaaaatgcttgataagattgaattagaagaaattgttccctcaagccgtaaatacccatttattaattttaaagcagagcgtgaaatgggaaatgacttcctcactgttgaaaatctttctgtaacgatcgatggagagaaaatcattgataatatcagtttcattttacgtccaggtgacaaagctgctattattggtcaaaatgatattcagacaactgctcttatgcgtgctttagcagatgatattgactacgaaggaaccattaaatggggagtgacaacaagtcgttcttacttgcctaaagacaattcaaaagattttgccacggaagaatctattcttgaatggttacgtcaatttgcctcaaaaggtgaagatgatgatacctttttacgtgggttcttaggacggatgcttttctctggagacgaagttaaaaaatctgttaacgttctttccggtggcgaaaaagtgcgtgtcatgctttctaagttgatgctattgaaatcaaacgttcttattcttgatgacccaactaatcacttagatttggaatctatttcaagtcttaatgatggaatcaaagacttcaaagaatctgttatctttgccagtcatgaccatgaatttattcaaacgattgctaaccacatcgttgttatttcaaaaaatggtgttatcgaccgtatagatgaaacttatgacgaattccttgacaatccagaagtccaagcccgagttgctgaactttggaaa

SEQ ID NO: 5090 - protein, 539 aa, Streptococcus pyogenes
LLTVSDVSLRFSDRKLFDDVNIKFTAGNTYGLIGANGAGKSTFLKILAGDIEPSTGHISLGPDERLSVLRQNHFDYEEERAIDVVIMGNEQLYNIMKEKDAIYMKADFSEEDGVRAAELEGIFAELGGWEAESEASQLLQNLNIPEDLHYQNMSELANGDKVKVLLAKALFGKPDVLLLDEPTNGLDIQSISWLEDFLIDFENTVIVVSHDRHFLNKVCTHMADLDFGKIKLFVGNYDFWKQSSELAARLQADRNAKAEEKIKELQEFVARFSANASKSKQATSRKKMLDKIELEEIVPSSRKYPFINFKAEREMGNDFLTVENLSVTIDGEKIIDNISFILRPGDKAAIIGQNDIQTTALMRALADDIDYEGTIKWGVTTSRSYLPKDNSKDFATEESILEWLRQFASKGEDDDTFLRGFLGRMLFSGDEVKKSVNVLSGGEKVRVMLSKLMLLKSNVLILDDPTNHLDLESISSLNDGIKDFKESVIFASHDHEFIQTIANHIVVISKNGVIDRIDETYDEFLDNPEVQARVAELWK

SEQ ID NO: 5091 - DNA, 2577 bp, Streptococcus agalactiae
atgacaattaaccactataagcttcgtataccttactatacaataagctttctacttcccttcataatcatagtctgtatcctctttactaagaatatttattggggaagtccaacaaccatattagcaagcgatggctttcatcaatatgttatctttaatcaagcattaagaaatattcttcatggttcaaacagcttattctatacctttacaagcggtttaggtttaaatttttatgctctgagtagttactatttgggaagttttttatccccaatagtttatttctttaacctaaaaaatatgcctgatgctatctaccttttaacaatatgtaaaatagggttgataggtttgtcaatgtttgtcactctttgtaaacgtcattgtaaagttaatcgtgtcttacttttagtaatttctacttgctatagcttaatgagtttctcaattagccaaattgaaattaatatgtggctagatgtatttattctaattccccttgttgttttaggagttgatcagctactatgggaaagaaaacctatactttatttcctctctctgacagccttattcatccaaaactattattttggttttatgactgccatctttactagcctttacttcatcgtacaaataacccgtaatactgatagtaaggttgcatttaaacaatttcttcattttacctttttatctcttttagctggtatgactagtagcattatgattttgccaacttattttgatttaactactcatggtgaaaagttgacaaaggtatcgaagatgtttacagaaaattcttggtacatggatttgtttgctaaaaatatgattggagcctatgatacaacaaaatttggctctattcctatgatttatgtaggtttacttcctttactcctttctttactttactttacaataaaggaagttcctcgaaggactagattagcatatggatttttaataatatttgttattgctagtttttatataacacctctagatttattttggcaagggatgcatgctccaaatatgtttctccatcgctactcttgggtactttcagtacttatctgtctgctagctgctgaatgccttgagtatttagacaacatttcttggaaaaagattttaggggtcaatttaattttagtaagtggtttcataatcacgtttttatttaaaaagcattatcattaccttaatcttgaattacttcttttaaccttaactttcctctcagcttatattattctaactattagttttgtcagtaagcaaatccctaaattagttttttatccctttcttattggttttgttgtattagagatgacattaaacaccttttaccaactaaatagtcttaacgatgaatggatatttccatctaggcaaggatatgctaaatataatcacagcattagcaaacttgtcagaaagactgagagaaataactctacattcttccgtacagagcgctggttaggacaaaccggcaacgactctatgaaatataattataatggtatttcacaattttcatctattagaaatcgttcttcaagtcaagtgcttgatagacttggctttaaatcagatggtacaaatttaaatttacgttatcaaaataatactttgatcgcagatagtctatttggtgtgaagtataaccttacagaatatccttttgataaatttggttttatcaaaaaagctcaagataaacaaaccattctttacaaaaatcagtttgccagtcaattagctatactaacgaatcaagtatatcaagataaaccatttactgtgaatactttggataatcagacaactcttttaaatcaattaagtggtttgaaagagacgtattttgagcatcttattccaaatagcgtttctgggcaaaccactcttaataaacaagtatttgttaaaaagaataaacaagggaatactgaaattacctataacataactatccctaaaaacagtcagttatatgttagtatgccgtttataaattttaataatgaggaaaataaaattgttcaaatctccgttaataatggaccatttgtacctaatactcttgataatgcttattcattttttaatattggttcctttgctgaaaacagtcgtatcaaagtaaaatttcaatttccacacaatgatcaagtttctttcccaattcctcacttttatgggctcaagttagaagcttatcaaaaagctatgactgttattaataaacgaaaagtaaaagtaagaactgatcacaataaagttattgctaattatacaagtcctaatagaagttctcttttcttcactattccctatgataggggttggaaagcttatcaaaataataaagaaataaaaattttcaaagctcagaaaggttttatgaaaataaatattcctaaaggaaaaggcaaagtaacattaatttttatcccttacggctttaaatttggggtaggcctatctattactggaatagtattatttactgtctattattttaaatttggaaaaaataaaatagga

SEQ ID NO: 5092 - protein, 859 aa, Streptococcus agalactiae
MTINHYKLRIPYYTISFLLPFIIIVCILFTKNIYWGSPTTILASDGFHQYVIFNQALRNILHGSNSLFYTFTSGLGLNFYALSSYYLGSFLSPIVYFFNLKNMPDAIYLLTICKIGLIGLSMFVTLCKRHCKVNRVLLLVISTCYSLMSFSISQIEINMWLDVFILIPLVVLGVDQLLWERKPILYFLSLTALFIQNYYFGFMTAIFTSLYFIVQITRNTDSKVAFKQFLHFTFLSLLAGMTSSIMILPTYFDLTTHGEKLTKVSKMFTENSWYMDLFAKNMIGAYDTTKFGSIPMIYVGLLPLLLSLLYFTIKEVPRRTRLAYGFLIIFVIASFYITPLDLFWQGMHAPNMFLHRYSWVLSVLICLLAAECLEYLDNISWKKILGVNLILVSGFIITFLFKKHYHYLNLELLLLTLTFLSAYIILTISFVSKQIPKLVFYPFLIGFVVLEMTLNTFYQLNSLNDEWIFPSRQGYAKYNHSISKLVRKTERNNSTFFRTERWLGQTGNDSMKYNYNGISQFSSIRNRSSSQVLDRLGFKSDGTNLNLRYQNNTLIADSLFGVKYNLTEYPFDKFGFIKKAQDKQTILYKNQFASQLAILTNQVYQDKPFTVNTLDNQTTLLNQLSGLKETYFEHLIPNSVSGQTTLNKQVFVKKNKQGNTEITYNITIPKNSQLYVSMPFINFNNEENKIVQISVNNGPFVPNTLDNAYSFFNIGSFAENSRIKVKFQFPHNDQVSFPIPHFYGLKLEAYQKAMTVINKRKVKVRTDHNKVIANYTSPNRSSLFFTIPYDRGWKAYQNNKEIKIFKAQKGFMKINIPKGKGKVTLIFIPYGFKFGVGLSITGIVLFTVYYFKFGKNKIG

SEQ ID NO: 5093 - DNA, 2574 bp, Streptococcus pyogenes
atgaaaaataataataaatggataattgctggacttgctagttttttgttccctcttagtattatatttatcatccttctatcgatgggcatttattataatagtgataaaacaattctagctagtgatgcttttcatcagtatgttatttttgcgcagaactttcgtaacatcatgcacggttctgatagttttttttatacctttacaagcggactagggataaatttttatgctttaatgtgttattatcttggcagtttcttttctccattacttttcttttttaatttaacctctatgccagatgctatctatttgtttaccttgataaaatttgggttaataggattagctgcatgctattcttttcatagattatatccaaaaatcagtgctttcttgatgatttccatctcagttttttatagcttaatgagcttcttgacaagtcaaatggaactaaattcttggttagatgttttcattcttcttccacttgttatacttggattaaataaacttatcacagaaaataaaaccagaacttattatctttcgatatcattattattcattcaaaattactactttggctacatgattgctcttttttgtattctttacgccttagtttgtcttttacgtctcaatgattttaacaaaatgtttatcgcttttgttaggtttacagctgtgtcaatatgtgctgctttaacaagtgctctagtaatacttcctacctatctagatttgtcaacttatggagagaatctatccccgataaaacagttagttacgaacaatgcttggtttttggatatacctgctaagctctcaataggagtgtacgatactaccaagtttaatgctctgcctatgatttacgtaggattatttcccctaatgcttagtgttatttattttactttagaaagtatccctttaaaaataaaattagccaatgcctgcttgttaacttttattataataagtttttacctacagccacttgatcttttttggcaggggatgcactcaccaaatatgtttttgcatcgctacgcttggtctttttccatagttatcctattactcgcatgtgagactctctctcgactaaaagaagtgactcaaataaaagcaggttttgcttttattttcctcattatactgacatctcttccttatagcttttctcaacaatataattttctacctttaactctttttttacttagtgtttttttattattaggttatactatttcactattttcgtttagaaattctcaaatcccatctacttttatttctgctttcatacttatctttagccttcttgaatcagggttaaacacctactaccagcttcaaggaattaataaggagtggggattcccatcacgacagatatataatagtcaattaaaggatattaacaaccttgtcaactctgtgtcaaaaaatagtcaacctttttttagaatggaaaggctacttccccaaacagggaacgatagcatgaaatttaattattacggcatttcacaattttcctctgtaagaaatagactatctagttctttattggatcgattgggatttcagtctaaaggcacaaatttaaaccttagataccaaaacaatactattattatggacagtctacttggtataaaatataatcttagcgaaggacctccaaataaatttggatttacaaaactaaaaactagcgggaatactactctttatcaaaatcactatagtagccctttagctatattaacacgtaatgtttacaaagatgtcaacctaaatgtcaatacccttgataaccaaaccaaattacttaaccaactaagtgggaaatctttaacctattttaacttacagccagctcaacttatttctggtgctaatcaatttaacggacaaatatctgcacaagcttctgattatcaaaactccgttacccttaattatcaaattaacatccctaaacatagtcaactctatgttagcatacccaatattatattttcaaatcctgatgctaaagagatgcgtattcagacagataatcataatttcatatatactacagataacgcttactctttttttgatttaggatatttcgccgatgccaaagttgctacattttcgtttgtttttccaaaaaataaacaaattagttttaaggaacctcatttttatagtttgtctattgaatcttaccttgaagcaatgaatagcattaaacaaaaaaatgttcatacttacgctaaaagtaatacggtaatcactgattataattcaaaaacgaaaggttctcttatttttacacttccttacgataaaggttggtcagcacaaaaagatgggaaaaatcttccagtcaaaaaagcacaaggaggatttctatcagttactattcctaaaggaaagggacgtgttatccttacctttattcctaatggttttaaattagggttatctctatcttgtgtaggaattatcgcttatatgcttttgtataagtacatagatataaagtctaaattactt

SEQ ID NO: 5094 - protein, 858 aa, Streptococcus pyogenes
MKNNNKWIIAGLASFLFPLSIIFIILLSMGIYYNSDKTILASDAFHQYVIFAQNFRNIMHGSDSFFYTFTSGLGINFYALMCYYLGSFFSPLLFFFNLTSMPDAIYLFTLIKFGLIGLAACYSFHRLYPKISAFLMISISVFYSLMSFLTSQMELNSWLDVFILLPLVILGLNKLITENKTRTYYLSISLLFIQNYYFGYMIALFCILYALVCLLRLNDFNKMFIAFVRFTAVSICAALTSALVILPTYLDLSTYGENLSPIKQLVTNNAWFLDIPAKLSIGVYDTTKFNALPMIYVGLFPLMLSVIYFTLESIPLKIKLANACLLTFIIISFYLQPLDLFWQGMHSPNMFLHRYAWSFSIVILLLACETLSRLKEVTQIKAGFAFIFLIILTSLPYSFSQQYNFLPLTLFLLSVFLLLGYTISLFSFRNSQIPSTFISAFILIFSLLESGLNTYYQLQGINKEWGFPSRQIYNSQLKDINNLVNSVSKNSQPFFRMERLLPQTGNDSMKFNYYGISQFSSVRNRLSSSLLDRLGFQSKGTNLNLRYQNNTIIMDSLLGIKYNLSEGPPNKFGFTKLKTSGNTTLYQNHYSSPLAILTRNVYKDVNLNVNTLDNQTKLLNQLSGKSLTYFNLQPAQLISGANQFNGQISAQASDYQNSVTLNYQINIPKHSQLYVSIPNIIFSNPDAKEMRIQTDNHNFIYTTDNAYSFFDLGYFADAKVATFSFVFPKNKQISFKEPHFYSLSIESYLEAMNSIKQKNVHTYAKSNTVITDYNSKTKGSLIFTLPYDKGWSAQKDGKNLPVKKAQGGFLSVTIPKGKGRVILTFIPNGFKLGLSLSCVGIIAYMLLYKYIDIKSKLL

SEQ ID NO: 5095 - DNA, 477 bp, Streptococcus agalactiae
atgaaattaaaaataattacagttggaaaattgaaagagaaataccttaaagaaggtgttgcagagtatcagaaacgtctgaatcgcttttctaaaattgagacaattgagctagctgatgaaaagacacctgataaagctagtatatctgaaaatcaaagaattttagatatagaaggggaacgtattttgagtaaaataggtgagagggattatgtcattggtttagctatagaagggaaacaattgccatctgaatcatttagccatctaatcgatcaaaaaatgatatccggctactctactattacttttgttattggtggtagtttgggtttatctcaaaaagtgaaaaaacgtgctgattatttaatgagttttggactgttaaccttacctcatcaacttatgaaattagtcttgatggaacaaatttatcgtgcttttatgattcgtcaaggcactccttaccacaaa

SEQ ID NO: 5096 - protein, 159 aa, Streptococcus agalactiae
MKLKIITVGKLKEKYLKEGVAEYQKRLNRFSKIETIELADEKTPDKASISENQRILDIEGERILSKIGERDYVIGLAIEGKQLPSESFSHLIDQKMISGYSTITFVIGGSLGLSQKVKKRADYLMSFGLLTLPHQLMKLVLMEQIYRAFMIRQGTPYHK

SEQ ID NO: 5097 - DNA, 477 bp, Streptococcus pyogenes
atgaaagtgaaactaatttgtgttggaaaactaaaagaaagatacctcaaagatggtatttcagaatatcaaaaaagactttcccgtttttgtcaattcgaaatgattgagttaactgatgaaagaacaccagataaagcaagttttgctgataatcaattgattatgagtaaagaagctcagcgaatccataaaaaaattggggaacgtgattttgtaattgcattagctattgaaggaaaacagtttccttcagagacatttagtgaattaatatcaggggttactgttaagggatattcaactatcacgtttattattggtgggagtcttggattagattcaattattaaaaaaagagctaatatgctaatgagttttggattgttaaccttacctcatcagttaatgcgtctagtccttactgagcaaatttatcgtgcttttatgattacacaaggcagtccttatcataag

SEQ ID NO: 5098 - protein, 159 aa, Streptococcus pyogenes
MKVKLICVGKLKERYLKDGISEYQKRLSRFCQFEMIELTDERTPDKASFADNQLIMSKEAQRIHKKIGERDFVIALAIEGKQFPSETFSELISGVTVKGYSTITFIIGGSLGLDSIIKKRANMLMSFGLLTLPHQLMRLVLTEQIYRAFMITQGSPYHK

SEQ ID NO: 5099 - DNA, 117 bp, Streptococcus agalactiae
atgacaaaactagcaaatgctccaccagcaaagctaacaataatgattagagaacactttagaagtgatgagactaatttttttttcacaaatagctacctccgtaaatttttatac

SEQ ID NO: 5100 - protein, 39 aa, Streptococcus agalactiae
MTKLANAPPAKLTIMIREHFRSDETNFFFTNSYLRKFLY

SEQ ID NO: 5101 - DNA, 1140 bp, Streptococcus agalactiae
atgaatcataatgacaatattccaaatggtggtgtcactaaaactagtaaagtaaattataataacataacgcctacaacaaaagctgttaaaaaggtacaaaatagtgttgtttctgttatcaattataaacaacaagagagtcgttctgacctatcagacttctatagtcatttttttggtaatcaggggggcaacactgataagggcttacaagtttacggtgaaggctctggagtcatctataaaaaagatggtaaaaatgcctatgttgtcactaataaccacgtcattgatggggctaaacaaattgaaattcaactagctgatggctcaaaagcagttgggaaacttgttgggtcagatacctactctgatttagccgtcgtcaaaattccatcagataaggtttcaaatattgcagaatttgctgattcatcaaaactcaacattggtgaaactgctatagcgatcggaagccctcttggaactgagtatgcaaattctgtaactcaaggtattgtatctagtttaaaaagaactgtaacaatgactaatgaagaaggacaaacagtttctacaaatgctatccagactgatgctgctatcaatcctggtaattcaggtggagcacttatcaatattgaaggacaggttattggaattaattctagtaaaatttcttctacatcaaatcaaacctcaggacaatcgtcaggaaatagcgttgaaggtatgggatttgccattccttcaaatgatgttgttaagattatcaatcaacttgagagtaacggacaagtagagagacctgctctaggtatttctatggctggattaagtaatttaccatccgatgttattagtaaactgaaaatcccaagtaatgttactaatggtattgtagtagcatctatccaatctggcatgccagctcaaggcaaactaaagaaatacgatgtcattactaaagttgacgataaagaagtagtatctccaagtgatttacaaagtttactctatggccaccaggtaggggattccataacagtaaccttttatcgtggtgaaaataaacaaacagtcactataaaacttactaaaactagtaaagatttagctaaacaacgagcaaataac

SEQ ID NO: 5102 - protein, 380 aa, Streptococcus agalactiae
MNHNDNIPNGGVTKTSKVNYNNITPTTKAVKKVQNSVVSVINYKQQESRSDLSDFYSHFFGNQGGNTDKGLQVYGEGSGVIYKKDGKNAYVVTNNHVIDGAKQIEIQLADGSKAVGKLVGSDTYSDLAVVKIPSDKVSNIAEFADSSKLNIGETAIAIGSPLGTEYANSVTQGIVSSLKRTVTMTNEEGQTVSTNAIQTDAAINPGNSGGALINIEGQVIGINSSKISSTSNQTSGQSSGNSVEGMGFAIPSNDVVKIINQLESNGQVERPALGISMAGLSNLPSDVISKLKIPSNVTNGIVVASIQSGMPAQGKLKKYDVITKVDDKEVVSPSDLQSLLYGHQVGDSITVTFYRGENKQTVTIKLTKTSKDLAKQRANN

SEQ ID NO: 5103 - DNA, 1221 bp, Streptococcus pyogenes
atgccaagtatgaaacatatcttaaaatccttaagtattttactaattggatttttaggaggattaatagcaattattacattcaataatctctacccacattctccatcaaaaataaattcaggtaaggcaacaactagtaatatggtttttaacaacacaaccaatactactaaagctgtcaaagctgttcaaaatgcagttgtatcagttattaattatcaagataacccttcttcatccctttctaacccttatacaaaactctttggagaagggcgttcaaaagagaataaggatgctgaattatctatttttagtgaaggatctggggtcatttatcgaaaagatggcaactccgcttacgttgttactaataaccatgttatcgacggagctaaacgaattgaaattcttatggcagacggatctaaagttgttggtgaattagttggagctgatacttattcggatttagctgttgttaagatctcttcagataagataaaaacagtagctgaatttgcagattctacaaaactaaatgttggagaagttgctattgctatcggcagcccactaggaacacaatacgctaattctgttactcaaggaatcgtctctagtttaagtcgtactgtaactttaaaaaacgagaatggtgagactgtctcaacaaatgctattcagacagatgctgctattaaccctggaaactctggtggaccactaattaatattgaggggcaagtaatcggaattaattcaagtaaaatttcttctaccccaactggtagcaacggtaatagtggtgctgttgaaggaattggttttgctatcccatctactgatgttattaaaattattaaacaactagaaactaatggtgaagttatcagacctgctcttggaatatccatggtcaatttaaatgacttatccacaaatgctcttagtcaaattaatattccaactagtgtaactggtggtattgtagtagcagaagttaaggaaggaatgccggcatctggcaaacttgctcagtacgatgtgattacagaaattgatggcaaaacagttaattcaattagtgatttacaaagtagtctatacggacacgatattaatgatactattaaagtaactttttatagaggaactacaaagaaaaaagcagatatcaaattaacaaaaactactcaagatttgactaaaacgcag

SEQ ID NO: 5104 - protein, 407 aa, Streptococcus pyogenes
MPSMKHILKSLSILLIGFLGGLIAIITFNNLYPHSPSKINSGKATTSNMVFNNTTNTTKAVKAVQNAVVSVINYQDNPSSSLSNPYTKLFGEGRSKENKDAELSIFSEGSGVIYRKDGNSAYVVTNNHVIDGAKRIEILMADGSKVVGELVGADTYSDLAVVKISSDKIKTVAEFADSTKLNVGEVAIAIGSPLGTQYANSVTQGIVSSLSRTVTLKNENGETVSTNAIQTDAAINPGNSGGPLINIEGQVIGINSSKISSTPTGSNGNSGAVEGIGFAIPSTDVIKIIKQLETNGEVIRPALGISMVNLNDLSTNALSQINIPTSVTGGIVVAEVKEGMPASGKLAQYDVITEIDGKTVNSISDLQSSLYGHDINDTIKVTFYRGTTKKKADIKLTKTTQDLTKTQ

SEQ ID NO: 5105 - DNA, 771 bp, Streptococcus agalactiae
atggaatatttagaaacgatcaacatcaatcatattgctccaaatccgtatcaacctcgcctagaatttaatacaaaagaactagaagaattagccaactctattaaaattaatggccttatccaacccattattgtaagaccgtcagcagtctttggttacgaactggtagccggagaacgacggctaagagccgcaaagttagctaaattggaaagtatacctgcaattataaaatcctataataatgatgatagtatgcaattagctattgtcgaaaatttacaacgatctaatttgtcacctattgaagaggctaaagcctactctcaacttctacaaaagaaaagtatgacacatgaagagttagcaaaatatatgggaaaatctcgtccctatatatcaaatacgatacgactactaaatttaccgccactaattacttcagctattgaagaaggaaaactttcctctggtcatgcgcgtgcactactcagtctaccagatgctagtcaacagaaagattggtatcagagaatcctcactgaagatattagtgtaagacgactagagaagttattaaaacaagaaaagaaaacaaatcataagtcacttcaaaataaagatgtctttctaaaacatcaagaaaatgagttagctcaatttctaggtagcaaagtgaaacttactattaataaagatggtgctggcaatataaagattgctttcgctaaccaagaagaattaaacagaattatcaacactctaaaa

SEQ ID NO: 5106 - protein, 257 aa, Streptococcus agalactiae
MEYLETININHIAPNPYQPRLEFNTKELEELANSIKINGLIQPIIVRPSAVFGYELVAGERRLRAAKLAKLESIPAIIKSYNNDDSMQLAIVENLQRSNLSPIEEAKAYSQLLQKKSMTHEELAKYMGKSRPYISNTIRLLNLPPLITSAIEEGKLSSGHARALLSLPDASQQKDWYQRILTEDISVRRLEKLLKQEKKTNHKSLQNKDVFLKHQENELAQFLGSKVKLTINKDGAGNIKIAFANQEELNRIINTLK

SEQ ID NO: 5107 - DNA, 804 bp, Streptococcus pyogenes
atgtttcttattctatccaggaactcccttatgacaaaagaattattgatagacctaccaattgaagatattgttacaaatccctatcagccaaggatacaatttaatcaaagagaactccaagacctagcaacttctattaaatcaaacggcctcattcaacctattattgttcgaaaatctgacatttttggctatgagttagttgctggagaacgacgacttaaagcttcaaaaatggctggtctaaaaaaagttccagctatcatcaagaagatctccacactcgagagcatgcaacaagctatagttgaaaatttacaacgttctaaccttaacgctatcgaagaagctaaagcctatcagttattggttgaaaaaaaacacatgactcacgatgagattgctaaatatatgggaaaatcaagaccttatattagcaataccttacgtctgttacaactcccagcacctatcattaaagcaattgaagaaggaaaaattagtgcgggacacgcgcgtgctcttttaactttgagtgatgataagcaacaactgtacctcactcataaaatacaaaatgaaggcctaagtgttaggcaaattgagcaactggttacttctactccaagttcgaagctatctaaaaaaactaaaaatatttttgccacttctttagagaaacaattggctaaatcattgggactctctgtcaatatgaagctgacagcaaaccatagtgggtaccttcagatatctttttccaatgatgatgaattaaacagaattatcaacaagctaaag

SEQ ID NO: 5108 - protein, 268 aa, Streptococcus pyogenes
MFLILSRNSLMTKELLIDLPIEDIVTNPYQPRIQFNQRELQDLATSIKSNGLIQPIIVRKSDIFGYELVAGERRLKASKMAGLKKVPAIIKKISTLESMQQAIVENLQRSNLNAIEEAKAYQLLVEKKHMTHDEIAKYMGKSRPYISNTLRLLQLPAPIIKAIEEGKISAGHARALLTLSDDKQQLYLTHKIQNEGLSVRQIEQLVTSTPSSKLSKKTKNIFATSLEKQLAKSLGLSVNMKLTANHSGYLQISFSNDDELNRIINKLK

SEQ ID NO: 5109 - DNA, 1452 bp, Streptococcus agalactiae
ttgttgattttattcttcaacatctgtggaaaactttatttttttatggtacaatataacaataattatccacaagacaataaggaagaagctatgacggaaaacgaacaactattttggaatagagtactagagctatctcgttctcaaatagcaccagcagcttatgaattttttgttctagaggctagactcctcaaaattgaacatcaaactgcagttattactttagataacattgaaatgaaaaagctattctgggaacaaaatttggggcctgttatcctaacagctggttttgaaattttcaatgctgaaattacagctaactatgtctcaaacgatttacatttacaagaaactagtttttctaactaccagcaatctagcaatgaagtaaatactttaccaattagaaaaatcgactctaaccttaaagagaaatatacttttgctaattttgttcaaggagatgaaaatagatgggctgtttcagcatcaattgctgtagctgatagtcctggcacgacttataatcctctatttatctgggggggacctggtctaggaaagacgcatctactaaatgctattggaaatcaagtcttaagagataatccaaacgcgagggttttatacatcactgctgagaattttattaatgaatttgtcagtcatattcgtttagattcgatggaagaattaaaagaaaagtttcgcaacttagacttactcctgattgatgatattcagtcgcttgctaagaaaaccttaggggggacccaagaggagttcttcaatactttcaatgctttacatacaaacgataaacaaatcgtattgaccagtgaccgaaatccaaatcaattaaatgatctagaagaacgtctagtcacgcgctttagttggggactcccagtaaatatcacaccacctgattttgaaacacgagttgctattttaaccaataaaattcaagaatatccttatgattttcctcaagataccattgaatacttagcaggagaatttgattccaacgtacgtgaattagaaggagccttgaaaaatattagtctagttgctgactttaagcatgctaaaactattacagtagatatagctgcagaagctatcagagcacgtaaaaatgatggtcctattgttactgtcattcctatagaagaaattcaaatacaagttggtaaattctatggcgtaactgtaaaagagataaaagcaactaaaagaacacaagatattgtccttgcaagacaggtagccatgtacttagctcgtgagatgacagataacagtctcccaaaaataggtaaagaatttgggggacgagatcactcaactgttctccacgcttataataaaataaaaaatatggttgctcaagatgacaacttacgaattgagatagaaactatcaaaaataaaatcaga

SEQ ID NO: 5110 - protein, 484 aa, Streptococcus agalactiae
MLILFFNICGKLYFFMVQYNNNYPQDNKEEAMTENEQLFWNRVLELSRSQIAPAAYEFFVLEARLLKIEHQTAVITLDNIEMKKLFWEQNLGPVILTAGFEIFNAEITANYVSNDLHLQETSFSNYQQSSNEVNTLPIRKIDSNLKEKYTFANFVQGDENRWAVSASIAVADSPGTTYNPLFIWGGPGLGKTHLLNAIGNQVLRDNPNARVLYITAENFINEFVSHIRLDSMEELKEKFRNLDLLLIDDIQSLAKKTLGGTQEEFFNTFNALHTNDKQIVLTSDRNPNQLNDLEERLVTRFSWGLPVNITPPDFETRVAILTNKIQEYPYDFPQDTIEYLAGEFDSNVRELEGALKNISLVADFKHAKTITVDIAAEAIRARKNDGPIVTVIPIEEIQIQVGKFYGVTVKEIKATKRTQDIVLARQVAMYLAREMTDNSLPKIGKEFGGRDHSTVLHAYNKIKNMVAQDDNLRIEIETIKNKIR

SEQ ID NO: 5111 - DNA, 1353 bp, Streptococcus pyogenes
atgactgaaaatgaacaaattttttggaacagggtcttggaattagctcagagtcaattaaaacaggcaacttatgaattttttgttcatgatgcccgtctattaaaggtcgataagcatattgcaactatttacttagatcaaatgaaagagctcttttgggaaaaaaatcttaaagatgttattcttactgctggttttgaagtttataacgctcaaatttctgttgactatgttttcgaagaagacctaatgattgagcaaaatcagaccaaaatcaaccaaaaacctaagcagcaagccttaaattctttgcctactgttacttcagatttaaactcgaaatatagttttgaaaactttattcaaggagatgaaaatcgttgggctgttgctgcttcaatagcagtagctaatactcctggaactacctataatcctttgtttatttggggtggccctgggcttggaaaaacccatttattaaatgctattggtaattctgtactattagaaaatccaaatgctcgaattaaatatatcacagctgaaaactttattaatgagtttgttatccatattcgccttgataccatggatgaattgaaagaaaaatttcgtaatttagatttactccttattgatgatatccaatctttagctaaaaaaacgctctctggaacacaagaagagttctttaatacttttaatgcacttcataataataacaaacaaattgtcctaacaagcgaccgtacaccagatcatctcaatgatttagaagatcgattagttactcgttttaaatggggattaacagtcaatatcacacctcctgattttgaaacacgagtggctattttgacaaataaaattcaagaatataactttatttttcctcaagataccattgagtatttggctggtcaatttgattctaatgtcagagatttagaaggtgccttaaaagatattagtctggttgctaatttcaaacaaattgacacgattactgttgacattgctgccgaagctattcgcgccagaaagcaagatggacctaaaatgacagttattcccatcgaagaaattcaagcgcaagttggaaaattttacggtgttaccgtcaaagaaattaaagctactaaacgaacacaaaatattgttttagcaagacaagtagctatgtttttagcacgtgaaatgacagataacagtcttcctaaaattggaaaagaatttggtggcagagaccattcaacagtactccatgcctataataaaatcaaaaacatgatcagccaggacgaaagccttaggatcgaaattgaaaccataaaaaacaaaattaaa

SEQ ID NO: 5112 - protein, 451 aa, Streptococcus pyogenes
MTENEQIFWNRVLELAQSQLKQATYEFFVHDARLLKVDKHIATIYLDQMKELFWEKNLKDVILTAGFEVYNAQISVDYVFEEDLMIEQNQTKINQKPKQQALNSLPTVTSDLNSKYSFENFIQGDENRWAVAASIAVANTPGTTYNPLFIWGGPGLGKTHLLNAIGNSVLLENPNARIKYITAENFINEFVIHIRLDTMDELKEKFRNLDLLLIDDIQSLAKKTLSGTQEEFFNTFNALHNNNKQIVLTSDRTPDHLNDLEDRLVTRFKWGLTVNITPPDFETRVAILTNKIQEYNFIFPQDTIEYLAGQFDSNVRDLEGALKDISLVANFKQIDTITVDIAAEAIRARKQDGPKMTVIPIEEIQAQVGKFYGVTVKEIKATKRTQNIVLARQVAMFLAREMTDNSLPKIGKEFGGRDHSTVLHAYNKIKNMISQDESLRIEIETIKNKIK

SEQ ID NO: 5113 - DNA, 1134 bp, Streptococcus agalactiae
atgattcatttttcaataaataaaaatttcttcttgcatgctctaacggtaaccaaacgagctattagtcataaaaatgcgattccaatcctttcaactgttaaaatagaagtgactagggatgctatcattttaacggggtcaaatggacaaatttcaattgaaaatactattcctgcttcaaatgaaaatgcaggtttactagtaacgaatccaggctctattttgttagaagctggtttctttattaatattatttcaagtttaccagatgtaactttagaatttacagagattgaacaacatcaaattgttcttactagtggaaaatcagagattactttgaaaggtaaggatgtcgatcaataccctcgtctgcaggaaatgacaacagatactccattaacattagaaactaaactgttaaaatcaattattaatgaaactgcttttgctgctagccaacaagaaagccgtccaatcttaacaggtgttcatttggttatcagtcaaaataaatactttaaggctgttgcgacagattcacaccgtatgagtcaacgcactttccaattagagaaatcggctaataattttgatttggttgttccaagtaaatcccttcgagaattttcggctgtttttacagatgatattgaaactgtagaggttttcttctcagatagtcaaatgttatttagaagtgaaaatatcagcttctatacacgtttgcttgaaggaaactaccctgatactgatcgcctcctaactaatcagtttgaaaccgaaattatctttaatacaaatgctttacgccatgctatggaacgtgcttatttaatttcgaatgcaactcagaacggtactgttcgtttagaaattcaaaatgagacagtctcagctcatgtaaactctccagaagttggtaaagttaatgaggaattggatactgttagtcttaaaggtgatagtttaaatattagctttaatccaacttacctaattgaatctttaaaagcagtaaaaagcgaaacagttacgattcgatttatttctccagtacgtccatttactttgacacctggtgaagatactgaagatttcatccaattaataactcctgttcgtactaac

SEQ ID NO: 5114 - protein, 378 aa, Streptococcus agalactiae
MIHFSINKNFFLHALTVTKRAISHKNAIPILSTVKIEVTRDAIILTGSNGQISIENTIPASNENAGLLVTNPGSILLEAGFFINIISSLPDVTLEFTEIEQHQIVLTSGKSEITLKGKDVDQYPRLQEMTTDTPLTLETKLLKSIINETAFAASQQESRPILTGVHLVISQNKYFKAVATDSHRMSQRTFQLEKSANNFDLVVPSKSLREFSAVFTDDIETVEVFFSDSQMLFRSENISFYTRLLEGNYPDTDRLLTNQFETEIIFNTNALRHAMERAYLISNATQNGTVRLEIQNETVSAHVNSPEVGKVNEELDTVSLKGDSLNISFNPTYLIESLKAVKSETVTIRFISPVRPFTLTPGEDTEDFIQLITPVRTN

SEQ ID NO: 5115 - DNA, 1134 bp, Streptococcus pyogenes
atgattcaattttcaattaatcgcacattatttattcatgctttaaatacaactaaacgtgctattagcactaaaaatgccattcctattctttcatcaataaaaattgaagtcacttctacaggagtaactttaacagggtctaacggtcaaatatcaattgaaaacactattcctgtaagtaatgaaaatgctggtttgctaattacctctccaggagctattttattagaagctagtttttttattaatattatttcaagtttgccagatattagtataaatgttaaagaaattgaacaacaccaagttgttttaaccagtggtaaatcagagattaccttaaaaggaaaagatgttgaccagtatcctcgtctacaagaagtatcaacagaaaatcctttgattttaaaaacaaaattattgaagtctattattgctgaaacagcttttgcagccagtttacaagaaagtcgtcctattttaacaggagttcatattgtattaagtaatcataaagattttaaagcagtagcgactgactctcatcgtatgagccaacgtttaatcactttggacaatacttcagcagattttgatgtagttattccaagtaaatctttgagagaattttcagcagtatttacagatgatattgagaccgttgaggtatttttctcaccaagccaaatcttgttcagaagtgaacacatttctttttatacacgcctcttagaaggaaattatcccgatacagaccgtttattaatgacagaatttgagacggaggttgttttcaatacccaatcccttcgccacgctatggaacgtgccttcttgatttctaatgctactcaaaatggtactgttaagcttgagattactcaaaatcatatttcagctcatgttaactcacctgaggttggtaaggtaaacgaggatttagatattgttagtcagtctggtagtgatttaactatcagcttcaatccaacttaccttattgagtctttaaaagctattaaaagtgaaacagtaaaaattcatttcttatcaccagttcgaccattcaccctaacaccaggcgatgaggaagaaagttttatccaattaattacaccagtacgaacaaac

SEQ ID NO: 5116 - protein, 378 aa, Streptococcus pyogenes
MIQFSINRTLFIHALNTTKRAISTKNAIPILSSIKIEVTSTGVTLTGSNGQISIENTIPVSNENAGLLITSPGAILLEASFFINIISSLPDISINVKEIEQHQVVLTSGKSEITLKGKDVDQYPRLQEVSTENPLILKTKLLKSIIAETAFAASLQESRPILTGVHIVLSNHKDFKAVATDSHRMSQRLITLDNTSADFDVVIPSKSLREFSAVFTDDIETVEVFFSPSQILFRSEHISFYTRLLEGNYPDTDRLLMTEFETEVVFNTQSLRHAMERAFLISNATQNGTVKLEITQNHISAHVNSPEVGKVNEDLDIVSQSGSDLTISFNPTYLIESLKAIKSETVKIHFLSPVRPFTLTPGDEEESFIQLITPVRTN

SEQ ID NO: 5117 - DNA, 924 bp, Streptococcus agalactiae
ttgggtagttttcttattctaagatatgctataatgatgagtaatatgactctatatataatagctaacccccatgctggtaataaaaatgcctccactattgttggtaaaattcaggagctttatcatactgaagatatttctgtgttctatacagaacagaaagatgatgaaaaaaaacaagtcattaatatactaaggtcttttaaagaaagtgatcatctaatgattataggaggagatggtaccttatcaaaagtaatgacttatctcccccaacatattccgtgcacttattatcctgttggttcgggaaatgattttgccagagctttgaaaattcctaacctcaaagaaacccttaccgctattcagacagaaagattaaaggaaattaattgctttatttatgataaagggctgattttgaatagtttagatttaggttttgcagcctatgtcgtttggaaagcatctaactctaaaataaaaaatattttgaatagatatcgtctaggaaaaataacttacattgttatagctatcaaatcattattacattcttctaaagtacaagtattagtggaaggagagacaggacagcagataaaactaaatgacctttattttttcgcattagcaaataacacttattttggaggtggcattactatttggcctaaagcaagtgctttaactgcagagttagatatggtttacgctaaagggcatacttttctaaaacgattaagtattttattatctttggtttttaaaaggcatactacctctaaaagtataaaacaccagactttcaaagctatgaccgtatattttcctaaaaatagtttgattgaaatagatggcgaaatagttgagttagatcagattagtttaaaatgtcaaaaaaggtatttatatatg

SEQ ID NO: 5118 - protein, 308 aa, Streptococcus agalactiae
MGSFLILRYAIMMSNMTLYIIANPHAGNKNASTIVGKIQELYHTEDISVFYTEQKDDEKKQVINILRSFKESDHLMIIGGDGTLSKVMTYLPQHIPCTYYPVGSGNDFARALKIPNLKETLTAIQTERLKEINCFIYDKGLILNSLDLGFAAYVVWKASNSKIKNILNRYRLGKITYIVIAIKSLLHSSKVQVLVEGETGQQIKLNDLYFFALANNTYFGGGITIWPKASALTAELDMVYAKGHTFLKRLSILLSLVFKRHTTSKSIKHQTFKAMTVYFPKNSLIEIDGEIVELDQISLKCQKRYLYM

SEQ ID NO: 5119 - DNA, 909 bp, Streptococcus pyogenes
atgaaaaccgttcggattttttacaatcctaattctggaaagaaagaaagccaacttgctaggcaagtcaaagactatttttgccaacatggtttttccgaagattctgtaaaagttattacccctaaagatgctgaccaggcttttcaattagcaaaacaagctgctaaggacaagattgacttggttatccctcttggtggcgatgggacactaaataaaatcatcggtggcatctatgaaggaggagctcattgtttaataggcttagtgccctcagggacagtcaataattttgccaaggctatgcatatccctttacaaattactgaggcgttggatactatcttgactggacaaatcaagcaagttgatatttgcaaagctaaccagcaatacatgatttccagtttaactttaggattactggctgatattgctgccgacgtaacggctgaggaaaaacgacgctttggtcctctagcatttttaaaagatagtattcgaatactgaaacgaaatcgcagctatgccatctctttaattagccacaaccatcgtattcacctgaaaacgaagtttctcttaatcacgatgacaaataccattgctggttttccttctttttctcctggtgctcaagctgacgatggctatttccaagtttataccatgaaaaaagtctctttctttaaatttttatggcatattaatgattttaaacagggtgatttttccaaagcagaggaaatcagtcattttcaagccaatacgcttagcttactaccacaagctaaaaaacaagcgatattaccacgtaccaggattgatggggataaaagtgactatctgcccattcaattagatatcattccaaaagccgtttcgattattgttccaacagaagat

SEQ ID NO: 5120 - protein, 303 aa, Streptococcus pyogenes
MKTVRIFYNPNSGKKESQLARQVKDYFCQHGFSEDSVKVITPKDADQAFQLAKQAAKDKIDLVIPLGGDGTLNKIIGGIYEGGAHCLIGLVPSGTVNNFAKAMHIPLQITEALDTILTGQIKQVDICKANQQYMISSLTLGLLADIAADVTAEEKRRFGPLAFLKDSIRILKRNRSYAISLISHNHRIHLKTKFLLITMTNTIAGFPSFSPGAQADDGYFQVYTMKKVSFFKFLWHINDFKQGDFSKAEEISHFQANTLSLLPQAKKQAILPRTRIDGDKSDYLPIQLDIIPKAVSIIVPTED

SEQ ID NO: 5121 - DNA, 195 bp, Streptococcus agalactiae
atgtatcaagttggatcacttgttgaaatgaaaaaacctcatgcttgtgtaattaaagaaactggtaaaaaggctaatcaatggaaggtactgagagtaggagctgatattaaaattcagtgtactaactgtcagcatgtgattatgatgagtcgttatgattttgagcgaaaattaaaaaaagtactgcaacca

SEQ ID NO: 5122 - protein, 65 aa, Streptococcus agalactiae
MYQVGSLVEMKKPHACVIKETGKKANQWKVLRVGADIKIQCTNCQHVIMMSRYDFERKLKKVLQP

SEQ ID NO: 5123 - DNA, 195 bp, Streptococcus pyogenes
atgtatcaaattggatcatttgttgaaatgaaaaaacctcatgcttgtgtaattaaagaaactggtaaaaaggctaatcaatggaaggtactgagagtaggagctgatattaaaattcagtgtactaactgtcagcatgtgattatgatgagtcgttatgattttgagcgaaaattaaaaaaagtactgcaacca

SEQ ID NO: 5124 - protein, 65 aa, Streptococcus pyogenes
MYQIGSFVEMKKPHACVIKETGKKANQWKVLRVGADIKIQCTNCQHVIMMSRYDFERKLKKVLQP

SEQ ID NO: 5125 - DNA, 201 bp, Streptococcus agalactiae
ttggataatttaatcaggttagctgagatttttgacgtgagcttagatgaacatgttttagctaaaacaaatgaagttaaagttgaacgtatttatgaaaataaaccccttgatctacgaaaatacaataaaatttattggtttatttttcgaaatattattcgatctctactaattattttagctatattaactttctta

SEQ ID NO: 5126 - protein, 67 aa, Streptococcus agalactiae
MDNLIRLAEIFDVSLDEHVLAKTNEVKVERIYENKPLDLRKYNKIYWFIFRNIIRSLLIILAILTFL

SEQ ID NO: 5127 - DNA, 99 bp, Streptococcus agalactiae
ttggtaagcctacaatacctgctgttaaagccatttagtgagtctccattcaaatttcaatcaagactattatatcaaaaaatagaagaaaaagcggta

SEQ ID NO: 5128 - protein, 33 aa, Streptococcus agalactiae
MVSLQYLLLKPFSESPFKFQSRLLYQKIEEKAV

SEQ ID NO: 5129 - DNA, 987 bp, Streptococcus agalactiae
atggtagaagtaccagatgagcgtctacaaaaattgacagaattgattacgcctaaaaaaacagttccgacaacctttgaatttactgatattgcaggtattgttaaaggtgcttcgaagggggaaggtctaggtaataaatttttagctaatattcgtgaagtggatgctattgttcatgtggtacgtgcgtttgatgatgaaaatgttatgcgtgaacaaggtcgtgaggatgctttcgttgatcctatagcagatattgatactattaatcttgaattaatcttagctgatttagagtcaatcaataaacgttatgcgcgtgttgaaaaaatggcacgaactcaaaaagataaagaatcagtagcagagttcaatgttttacaaaagattaaacctgttttggaagatgggaaatcagctcgtaccattgagtttacagaagaggaagcaaaagttgttaaaggtctttttttattaacaactaaacctgttttatatgttgctaatgttgatgaggacaaagtagctgatcctgatgatatcgactatgttaatcaaattcgtgcatttgcagaaacagagaatgcagaagtagtcgtgatttctgctcgagctgaagaagaaatatctgaacttgatgatgaagataagttagaatttttagaagctattggattaacagaatctggtgttgataaattaacacgagctgcttatcatcttttaggccttggaacttactttactgctggtgaaaaagaggttcgcgcttggacgtttaagcgtggtataaaagctccacaagctgctagtattatccattcagattttgaaagaggttttattcgtgcagtaacgatgtcatatgatgaccttattcaatatggatctgaaaaagcagtaaaagaagctggccggttacgtgaagaaggaaaagagtatattgttcaagatggcgatatcatggaattccgtttcaatgtc

SEQ ID NO: 5130 - protein, 329 aa, Streptococcus agalactiae
MVEVPDERLQKLTELITPKKTVPTTFEFTDIAGIVKGASKGEGLGNKFLANIREVDAIVHVVRAFDDENVMREQGREDAFVDPIADIDTINLELILADLESINKRYARVEKMARTQKDKESVAEFNVLQKIKPVLEDGKSARTIEFTEEEAKVVKGLFLLTTKPVLYVANVDEDKVADPDDIDYVNQIRAFAETENAEVVVISARAEEEISELDDEDKLEFLEAIGLTESGVDKLTRAAYHLLGLGTYFTAGEKEVRAWTFKRGIKAPQAASIIHSDFERGFIRAVTMSYDDLIQYGSEKAVKEAGRLREEGKEYIVQDGDIMEFRFNV

SEQ ID NO: 5131 - DNA, 1113 bp, Streptococcus pyogenes
atggctttaacagcaggtattgtaggcttaccaaatgttggtaaatcaaccttatttaacgcaattacaaaagcaggagcagaagctgctaattatccttttgcgactattgatcccaatgttggtatggtagaggttccagatgagcgtctgcaaaaattgacagaattgattacacctaaaaaaacagttccgacaacctttgaatttactgatattgcaggtatcgttaaaggtgcttctagaggggaaggtctaggaaataaatttttagctaatattcgtgaaatcgatgctattgttcatgtggtacgtgcttttgatgatgaaaatgtcatgcgtgaacaaggtcgtgaggatgctttcgttgatcctatagcagatattgacactattaatcttgaattaatcttagctgatttagagtcaatcaataaacgttatgcgcgtgttgaaaaaatggcacgaactcaaaaagataaagaatcagtagcagagtttaatgttttgcaaaagattaaacctgttttggaagatgggaaatcagctaggacaattgagtttacagaagatgaagcaaaagttgttaaaggtctctttttattaacaactaaacctgttttatatgtagctaatgtcgatgaagataaagttgctaatccagatggtattgattatgtcaaacaaattcgtgactttgcagctactgaaaatgctgaagtagttgttatctcagcgcgtgcagaagaagaaatttcagagcttgacgatgaggataaagaagaatttttggaagctatcggtcttactgaatcaggcgttgataaattaaccagagcagcttatcatctcttaggccttggaacctattttacagcaggtgaaaaagaggttcgtgcttggacgtttaagcgtggtataaaagctccacaagctgctggtattatccattcagattttgaaagaggttttattcgtgcagtaaccatgtcttatgatgatctaatgacctacggttcagaaaaagccgtcaaagaagctggacgcttgcgtgaagaaggaaaagaatatgttgtccaagatggggacatcatggaattcagatttaatgtg

SEQ ID NO: 5132 - protein, 371 aa, Streptococcus pyogenes
MALTAGIVGLPNVGKSTLFNAITKAGAEAANYPFATIDPNVGMVEVPDERLQKLTELITPKKTVPTTFEFTDIAGIVKGASRGEGLGNKFLANIREIDAIVHVVRAFDDENVMREQGREDAFVDPIADIDTINLELILADLESINKRYARVEKMARTQKDKESVAEFNVLQKIKPVLEDGKSARTIEFTEDEAKVVKGLFLLTTKPVLYVANVDEDKVANPDGIDYVKQIRDFAATENAEVVVISARAEEEISELDDEDKEEFLEAIGLTESGVDKLTRAAYHLLGLGTYFTAGEKEVRAWTFKRGIKAPQAAGIIHSDFERGFIRAVTMSYDDLMTYGSEKAVKEAGRLREEGKEYVVQDGDIMEFRFNV

SEQ ID NO: 5133 - DNA, 585 bp, Streptococcus agalactiae
atggagaagataatggtaaaaatgattgttggattaggaaatccaggaagtaaatataatgatacaaaacataatattggatttatggctgttgacagaattgtaaaagaccttgacgtcaactttacagaagataaaaattttaaagcagagataggtagtgattttatcaacggtgaaaaaatttattttatcaaaccgactacttttatgaataacagtggtattgctgtaaaagccctgcttacttactacaacatttctattaaggatatgattatcatatatgatgatttagacatggaagtcggtaaaatacgttttcgtcaaaaaggatctgctgggggacataatggtatcaagtctattattgctcatttaggtactcaagaatttgatcgtattaaagtaggtataggacgtccgaatggacgtatgacagttattaatcatgttctagggaaatttgataaaaatgatgaaattatgatattaaatacccttgataaggttgacaatgctgtcaattattatttacagacgaatgattttcaaaaaacaatgcagaaatacaacggtttaaaa

SEQ ID NO: 5134 - protein, 195 aa, Streptococcus agalactiae
MEKIMVKMIVGLGNPGSKYNDTKHNIGFMAVDRIVKDLDVNFTEDKNFKAEIGSDFINGEKIYFIKPTTFMNNSGIAVKALLTYYNISIKDMIIIYDDLDMEVGKIRFRQKGSAGGHNGIKSIIAHLGTQEFDRIKVGIGRPNGRMTVINHVLGKFDKNDEIMILNTLDKVDNAVNYYLQTNDFQKTMQKYNGLK

SEQ ID NO: 5135 - DNA, 612 bp, Streptococcus pyogenes
ttggaagaacattccagcccttttggcattttagaaagagaaaatatggtaaaaatgattgttggtctgggaaatccaggctctaaatatgaaaaaacaaagcacaatattggttttatggctattgacaatattgtcaagaaccttgacgttacctttacagatgataaaaattttaaagcacagataggaagtacttttattaatcatgaaaaagtttactttgtgaaacctactacttttatgaataatagcggcatagcagtaaaagcattactaacctactataatattgacataacagatttaattgttatctatgatgatttagacatggaagtcagtaaattacgtttacgtagtaagggttcagcaggaggacataatggcattaagtcaatcattgcccacattggaactcaggaatttaaccgaatcaaagttggtattggacgacctttaaaaggtatgactgttattaaccatgtgatgggccaattcaataccgaagataatattgctatttcgttaactcttgacagagttgtcaatgctgtcaagttttatttacaagaaaatgattttgaaaaaacaatgcagaaatttaatgga

SEQ ID NO: 5136 - protein, 204 aa, Streptococcus pyogenes
LEEHSSPFGILERENMVKMIVGLGNPGSKYEKTKHNIGFMAIDNIVKNLDVTFTDDKNFKAQIGSTFINHEKVYFVKPTTFMNNSGIAVKALLTYYNIDITDLIVIYDDLDMEVSKLRLRSKGSAGGHNGIKSIIAHIGTQEFNRIKVGIGRPLKGMTVINHVMGQFNTEDNIAISLTLDRVVNAVKFYLQENDFEKTMQKFNG

SEQ ID NO: 5137 - DNA, 3495 bp, Streptococcus agalactiae
atgaatattatagaattatttagccaaaataaagtggtgcggacatggcactctggattagtaactaatagtcgccaattagttatggggttttcaggagcaagtaaagctattgccatagcatcagcctacgagaagttatctaaaaaaattatggtagtcactgccactcaaaccgattctgataaattatcaagtgatatatcaagtttaattggagaagataacgtttatcaattttttgctgatgacgttcctgcagcagagtttattttctcttcattagataaatcaatttcacgactcagtgccctgaggtttctaaaagatccagaaaaaaacggtgttttgattactagtatcagtggtttaaggttactattaccaaatccggaagttttctcgaaaagtcaatataagtttgaaatcggtcaagaatgttatttagataaattgtgtaagaacctagtcaatttaggttatcagaaagtttctcaagtatttagtcctggtgaatttagccaaagaggagatattttagatatttttgagatgacacaagaatatccttatcgcttggaattcttcggagatgaaatagatggcatcaggcagtttgatattgacactcaaaagtctcttaaacaattagagtcagtacagatttcgccagcagatgatattattttacaagatgcagatttcgagcgtgcaaagaaaaaacttgagggctatctagtaacagctagtgaggtacaacgcacctatttgagcgaggttttatctacaactgagaatcattttaagcactcagatattcgtcgttttctaagtatcttttatgaaaaagaatggggaatattagactatattcctgagggaactccactttttgttgatgattttcaaaaaattgtagatcgaaatgctaagttagatttagaaatagctagccttctgacggaagatttacaacaaggcaagtctcattctagtttgaactatttttcagatccttataagcaattaagacaataccaaccagcaaccttcttttcaaatttccacaaaggattaggaaatctgaaatttgataaacttcatcattttactcaatatggaatgcaagaattttttaatcaatttccattgttggtcgatgaaatcaatcgttataagaaatctggagcgacagtactgttgcaagtagattctcaaaaaggtttaaatctccttcaagaaaatttaaaagaatatgggttagatttaatcatttcagataaaaacgatatcgttcaaaaggagtcacaacttattgttgggcatctttcaaatggtttttattttgcagatgagaaaattgttctgattactgaacgtgagatttatcataggcgtgttaaaaggaaaattagacgcagtaatattagtaatgcagaacgtctaaaagattataatgaactttcagttggcgattatgttgttcataatgttcatggcgtaggaaaatttttaggtattgaaacaattgagatacaaggtattcatcgtgattatctgactattcaatatcaaaatgctgatcgtatctctatccccgtagaacaaattgaacttctaacaaaatatgtctctgcagatggcaaagagcctaaaattaatacgttaaatgatggtcgcttcaaaaaagcaaaacagagagttgcaaagcaagtagaagatattgctgatgatttgttgaaactttatgcagagcgtagtcaattacaaggatttgcattttctcctgacgataatatgcaaaatgactttgataatgattttgcatatgtagagacagaggatcaattgcggtctataaaagaaattaaacaggatatggaaggtaatcgtccgatggatcgattattggttggagacgttggttttggtaagacagaggttgctatgcgtgcggctttcaaagctgtcaatgaccataaacaagttgttgttttagtcccaacaacagttctagcccagcagcattttgaaaattttaaagaacgttttagcaattatcctgttacagttgatgtacttagtcgttttcgtagcaaaaaagaacaaacagatacactaaaaagattatctaagggccaagttgatattattattggaacacatcgacttctctctcaagatgttgtattttcggatttagggttaatagttattgatgaggaacagcgatttggtgtaaagcataaagaaaagttaaaagaattaaaaacaaaagttgatgtattaactttgacagcgaccccaatacctagaacattacatatgtcaatgcttggcattagagacttatcagtcattgaaacacctccaactaatcgttatcctgtgcagacttacgttttggagacaaatcctggtttagttagagaagctattattcgtgagatagacagaggaggacaggttttttatgtttacaataaagttgacactattgatcagaaagtttcagaacttcaggagttagtaccagaagctagtattggttttgttcatggtcaaatgtctgaaattcaattagaaaatacattaatagactttatcaatggagattacgatgttttagttgcaacgacaataattgagacaggagtcgatatttcaaatgttaataccctctttgttgaaaatgcagatcatatgggcttgtcaaccctttatcaattaagaggccgtgtgggtagaagtaatcgcattgcttatgcttaccttatgtacagacctgataaagttttaacagaaatttctgagaaaagactagatgcaatcaaagggtttacagaattgggatctggttttaaaatagcgatgcgtgatttatctatacgtggtgcaggaaatattttaggagcttcacaaagtggttttattgattcggttggattcgagatgtattcacagcttctagagcaagcgattgccaccaaacaagggaaatcattaattcgtcaaaaaggtaatgctgaattagccttacaaattgacgcctatttaccagcagaatatatatcagatgagcgccaaaaaatagaaatatataagcgtattcgtgaattagaaactagggctgattatgaagccttacaagatgagttaatagatcgttttggagaatatcctgatcaagttgcataccttttagaaataggacttttaaaagcttatctggaccttgcctttactgaattagtagaaagaaaaggtaatgaaataagcatcctatttgaaaaagcatctttgaagtattttttaactcaagattattttgaagcactatcaaaaactcaacttaaggctagaattagcgaaacaaatggtaagatggaagttgtttttaatatcaaacataagaaaaattatgaaattattgaagaacttctaaaatttgccgaatgttttatcgagattaagtcacgtaaaccagtagaagaa

SEQ ID NO: 5138 - protein, 1165 aa, Streptococcus agalactiae
MNIIELFSQNKVVRTWHSGLVTNSRQLVMGFSGASKAIAIASAYEKLSKKIMVVTATQTDSDKLSSDISSLIGEDNVYQFFADDVPAAEFIFSSLDKSISRLSALRFLKDPEKNGVLITSISGLRLLLPNPEVFSKSQYKFEIGQECYLDKLCKNLVNLGYQKVSQVFSPGEFSQRGDILDIFEMTQEYPYRLEFFGDEIDGIRQFDIDTQKSLKQLESVQISPADDIILQDADFERAKKKLEGYLVTASEVQRTYLSEVLSTTENHFKHSDIRRFLSIFYEKEWGILDYIPEGTPLFVDDFQKIVDRNAKLDLEIASLLTEDLQQGKSHSSLNYFSDPYKQLRQYQPATFFSNFHKGLGNLKFDKLHHFTQYGMQEFFNQFPLLVDEINRYKKSGATVLLQVDSQKGLNLLQENLKEYGLDLIISDKNDIVQKESQLIVGHLSNGFYFADEKIVLITEREIYHRRVKRKIRRSNISNAERLKDYNELSVGDYVVHNVHGVGKFLGIETIEIQGIHRDYLTIQYQNADRISIPVEQIELLTKYVSADGKEPKINTLNDGRFKKAKQRVAKQVEDIADDLLKLYAERSQLQGFAFSPDDNMQNDFDNDFAYVETEDQLRSIKEIKQDMEGNRPMDRLLVGDVGFGKTEVAMRAAFKAVNDHKQVVVLVPTTVLAQQHFENFKERFSNYPVTVDVLSRFRSKKEQTDTLKRLSKGQVDIIIGTHRLLSQDVVFSDLGLIVIDEEQRFGVKHKEKLKELKTKVDVLTLTATPIPRTLHMSMLGIRDLSVIETPPTNRYPVQTYVLETNPGLVREAIIREIDRGGQVFYVYNKVDTIDQKVSELQELVPEASIGFVHGQMSEIQLENTLIDFINGDYDVLVATTIIETGVDISNVNTLFVENADHMGLSTLYQLRGRVGRSNRIAYAYLMYRPDKVLTEISEKRLDAIKGFTELGSGFKIAMRDLSIRGAGNILGASQSGFIDSVGFEMYSQLLEQAIATKQGKSLIRQKGNAELALQIDAYLPAEYISDERQKIEIYKRIRELETRADYEALQDELIDRFGEYPDQVAYLLEIGLLKAYLDLAFTELVERKGNEISILFEKASLKYFLTQDYFEALSKTQLKARISETNGKMEVVFNIKHKKNYEIIEELLKFAECFIEIKSRKPVEE

SEQ ID NO: 5139 - DNA, 3501 bp, Streptococcus pyogenes
atggatattttagaattatttagtcagaataagaaagtccaatcctggcactctggattaaccaccttaggaagacaactggtaatggggttatcgggttcaagtaaaacattggctatagcttccgcttatttagatgatcaaaaaaaaatagttgtggttacatcaactcaaaatgaggttgaaaaattagccagcgatttatctagtttacttgatgaagaacttgttttccaattttttgcagacgatgtggctgcagcggaatttatctttgcgtcaatggataaagctctatcaagaatagaaaccctgcaatttttaaggaatcctaaatctcagggcgttttaattgttagtttatcaggcttaagaattttattgccaaacccagatgtttttacaaagagtcagattcaactaacagttggagaagattatgatagtgatactcttactaaacaactgatgacaattggctatcagaaggtctcacaggttattagtccaggagaatttagccgtcgaggggatattttagatatctatgagattacacaagaattgccttatcgattggaattttttggcgatgatattgatagtattaggcaatttcatccagaaactcaaaaatcttttgaacaactagaaggtatttttattaatccagcaagtgatcttatttttgaggttagtgattttcaacgtggcattgagcaattagaaaaggctctacaaacagcacaagatgataaaaaatcttatttagaagatgtattagctgtttcaaaaaacggttttaaacataaggatatccgtaaatttcaatcattattttatgaaaaagagtggtcattattagattatattcctaagggaacgccaatcttttttgatgattttcaaaaactagttgataaaaatgcaagatttgatttagagattgctaatctcttgacagaagatttacagcaaggaaaggctctttccaatcttaactactttacagataattatcgagagcttaggcactataagccagcgaccttcttttcaaattttcataagggacttggaaatatcaaatttgatcagatgcatcagctaactcagtatgccatgcaggaattttttaatcaatttcctttgttgattgatgagattaaacggtatcaaaaaaatcaaacaacggttattgtacaggtagagtctcagtatgcttacgaacgacttgaaaaatcttttcaagattaccaatttcgccttcctttagtgagtgctaatcaaattgtttcacgtgaatcacaaattgtaattggagctatctccagtggtttttattttgctgatgaaaagttagcgttaatcacagagcatgaaatttatcataaaaagatcaaacgacgcgctagacgatctaatattagcaatgctgagcgtttgaaagattacaatgagttagcagtaggtgattacgtggttcataatgtccatggtatcggtcgctttcttggaattgaaacgattcagattcagggaatccatcgagattatgttactattcaatatcaaaattcagaccgtatttctcttccaattgaccaaattagtagcttatcaaagtacgtttctgctgatggaaaagaacctaaaattaataaactcaatgatggtcgttttcaaaagacaaagcaaaaggtcgctagacaagtagaggatattgctgatgaccttctaaaattatatgctgaaagaagtcagcaaaaaggattttcattttcaccagatgatgacttgcagcgcgcttttgatgatgattttgcttttgtagaaacagaagatcaacttaggtctataaaggaaattaaagctgatatggagagcatgcagcctatggatcgtcttttagtaggcgatgtaggatttggtaagacagaagtagctatgagggcagcctttaaagcggtgaatgatcacaaacaagtagctgtcttagttccaaccacagtcttggcccagcagcattatgaaaacttcaaagcacgctttgaaaattaccctgttgaggttgacgtcttaagtcgtttccgtagtaaaaaagagcaagctgaaacactagaacgtgtacgaaaaggtcaaattgacattattatcggaacccatcgactcctatcaaaagatgtggtcttttctgatttaggattgattgtgattgatgaggaacaacggtttggtgttaagcataaagaaactttaaaggaattaaaaactaaggttgacgtcttaaccttaacagctactccgattcctagaaccttacacatgtctatgttaggtatccgagatttatcggttattgagaccccaccaaccaatcgttatcctgttcaaacctatgttttggaaaataatccaggtctcgttagagaagctatcattcgtgaaatggatcgcggaggacaaattttttacgtttacaataaagttgacactattgaaaagaaagttgcagagctacaagaattagtcccagaagcttctataggttttgttcatgggcaaatgagtgaaattcaacttgaaaataccttgattgactttataaatggtgattatgatgtccttgtggctacaacaatcatcgaaacaggagttgacatttctaatgtaaacactttgtttattgagaatgctgatcatatgggattgtcaactttatatcaactacgagggcgcgtcggaagaagtaatcgtattgcttatgcttacctgatgtatcgtcctgataaggtcctaacagaggtttctgaaaagcgtttagaggctattaaaggctttactgaattaggttcaggcttcaagattgctatgcgagatttgtctatacgaggagcaggtaatattttaggggcttctcagagtggctttattgattcggtcggttttgaaatgtattctcagttattggaacaggctattgctagcaagcagggaaaaacgactgttcgtcaaaaaggcaatactgaaatcaatcttcagattgatgcctatttaccagatgattatattgcagatgagcgccaaaaaattgacatttacaagcgtattcgagaaattcaatcaagagaagattatctcaatttgcaagatgagcttatggatcgttttggagagtatcctgatcaagttgcctatttgttagagatagctctgctaaaacattatatggacaatgcctttgcggaattagttgaacgcaaaaataatcaggtcattgttcgatttgaagtaacttctttaacttatttcttgactcaggattatttcgaagccttatcgaaaacccatcttaaagctaaaattagtgaacatcaggggaaaatcgatatcgtctttgacgttcgccatcaaaaagattatagaattttagaagaattgatgttatttggagaaaggcttagtgagataaaaatcagaaaaaacaattcagtttttaaa

SEQ ID NO: 5140 - protein, 1167 aa, Streptococcus pyogenes
MDILELFSQNKKVQSWHSGLTTLGRQLVMGLSGSSKTLAIASAYLDDQKKIVVVTSTQNEVEKLASDLSSLLDEELVFQFFADDVAAAEFIFASMDKALSRIETLQFLRNPKSQGVLIVSLSGLRILLPNPDVFTKSQIQLTVGEDYDSDTLTKQLMTIGYQKVSQVISPGEFSRRGDILDIYEITQELPYRLEFFGDDIDSIRQFHPETQKSFEQLEGIFINPASDLIFEVSDFQRGIEQLEKALQTAQDDKKSYLEDVLAVSKNGFKHKDIRKFQSLFYEKEWSLLDYIPKGTPIFFDDFQKLVDKNARFDLEIANLLTEDLQQGKALSNLNYFTDNYRELRHYKPATFFSNFHKGLGNIKFDQMHQLTQYAMQEFFNQFPLLIDEIKRYQKNQTTVIVQVESQYAYERLEKSFQDYQFRLPLVSANQIVSRESQIVIGAISSGFYFADEKLALITEHEIYHKKIKRRARRSNISNAERLKDYNELAVGDYVVHNVHGIGRFLGIETIQIQGIHRDYVTIQYQNSDRISLPIDQISSLSKYVSADGKEPKINKLNDGRFQKTKQKVARQVEDIADDLLKLYAERSQQKGFSFSPDDDLQRAFDDDFAFVETEDQLRSIKEIKADMESMQPMDRLLVGDVGFGKTEVAMRAAFKAVNDHKQVAVLVPTTVLAQQHYENFKARFENYPVEVDVLSRFRSKKEQAETLERVRKGQIDIIIGTHRLLSKDVVFSDLGLIVIDEEQRFGVKHKETLKELKTKVDVLTLTATPIPRTLHMSMLGIRDLSVIETPPTNRYPVQTYVLENNPGLVREAIIREMDRGGQIFYVYNKVDTIEKKVAELQELVPEASIGFVHGQMSEIQLENTLIDFINGDYDVLVATTIIETGVDISNVNTLFIENADHMGLSTLYQLRGRVGRSNRIAYAYLMYRPDKVLTEVSEKRLEAIKGFTELGSGFKIAMRDLSIRGAGNILGASQSGFIDSVGFEMYSQLLEQAIASKQGKTTVRQKGNTEINLQIDAYLPDDYIADERQKIDIYKRIREIQSREDYLNLQDELMDRFGEYPDQVAYLLEIALLKHYMDNAFAELVERKNNQVIVRFEVTSLTYFLTQDYFEALSKTHLKAKISEHQGKIDIVFDVRHQKDYRILEELMLFGERLSEIKIRKNNSVFK

SEQ ID NO: 5141 - DNA, 270 bp, Streptococcus agalactiae
gtgagattagacaagtatctaaaagtgtcgcgtatcattaagcgtcgtcccgttgctaaagaagttgcagacaaaggacgtgtcaaggtgaatggcgtattagcaaagtcatcaactgacctaaagcttaatgaccaagttgaaattcgttttggtaataaattgttgaccgttaaagtattagaaatgaaagatagcactaagaaagaagatgctatcaaaatgtatgaaattattaatgaaacaaggatagaaacagatgagcaagcc

SEQ ID NO: 5142 - protein, 90 aa, Streptococcus agalactiae
MRLDKYLKVSRIIKRRPVAKEVADKGRVKVNGVLAKSSTDLKLNDQVEIRFGNKLLTVKVLEMKDSTKKEDAIKMYEIINETRIETDEQA

SEQ ID NO: 5143 - DNA, 294 bp, Streptococcus pyogenes
atgaagaggattgtaggagaaattatgagactagataaatatctaaaggtatcgcgccttattaaacgtcgttcagtagcaaaagaagttgcggataagggacgaattaaagttaatgggatacttgctaaaagttcaacgaatataaaactaaatgatcacattgaaattagttttggaaataaattactgacagtaagagtcattgaaataaaagatagtacaaaaaaagaagatgctcttaagatgtatgagataatcagtgaaacaaggataacattaaatgaagaagcc

SEQ ID NO: 5144 - protein, 98 aa, Streptococcus pyogenes
MKRIVGEIMRLDKYLKVSRLIKRRSVAKEVADKGRIKVNGILAKSSTNIKLNDHIEISFGNKLLTVRVIEIKDSTKKEDALKMYEIISETRITLNEEA

SEQ ID NO: 5145 - DNA, 369 bp, Streptococcus agalactiae
atgagcaagcctaatgttgttcagttaaataatcaatatattaacgatgagaatctaaaaaaacgttacgaagctgaggagttacgccgaaaaaatcgtttaatgggttgggttcttatttttgtcatgcttttatttattttacccacttataatttagttaagagttacagaactttacaagaacgtcgtcaagaagttgtaaaattaacgaaagactatcagacattaactaatagaactgagaaccagaagttgctagcaaaacaactaaaaaatccagattacgttcaaaaatatgctcgagctaagtattatttctctaagaccggcgaaatgatttacccattaccagaccttttaccaaaa

SEQ ID NO: 5146 - protein, 123 aa, Streptococcus agalactiae
MSKPNVVQLNNQYINDENLKKRYEAEELRRKNRLMGWVLIFVMLLFILPTYNLVKSYRTLQERRQEVVKLTKDYQTLTNRTENQKLLAKQLKNPDYVQKYARAKYYFSKTGEMIYPLPDLLPK

SEQ ID NO: 5147 - DNA, 369 bp, Streptococcus pyogenes
atgaagaagcctagtattgttcaattaaataatcattatattaagaaagagaatctcaaaaaaaaatttgaagaagaagaatctcaaaaaagaaatcgttttatgggatggatccttgtaagtatgatgtttttatttattttgccaacttataatcttgtcaaaagttatgttgattttgaaaagcaaaatcaacaggtggttaaattaaaaaaagagtataatgaattgtcagagagtacaaaaaaagaaaaacaattagcagaacgactaaaagatgataattttgtcaaaaaatatgctagggcaaaatactatttatcgcgtgaaggagaaatgatttatcctattccaggactattaccaaaa

SEQ ID NO: 5148 - protein, 123 aa, Streptococcus pyogenes
MKKPSIVQLNNHYIKKENLKKKFEEEESQKRNRFMGWILVSMMFLFILPTYNLVKSYVDFEKQNQQVVKLKKEYNELSESTKKEKQLAERLKDDNFVKKYARAKYYLSREGEMIYPIPGLLPK

SEQ ID NO: 5149 - DNA, 132 bp, Streptococcus agalactiae
atgaataatttaattgaaacaatagaacattttctagcctactcggatgacaaactagaagaattagctgataagaactatcaacttaggcaaacaattgtagaaaaagaaaagattgagagcagagaaaag

SEQ ID NO: 5150 - protein, 44 aa, Streptococcus agalactiae
MNNLIETIEHFLAYSDDKLEELADKNYQLRQTIVEKEKIESREK

SEQ ID NO: 5151 - DNA, 1284 bp, Streptococcus agalactiae
atgaagaaagttttaaccttcttattatgtagcttatattttgtatcaatcccagctataagtaccgaggagccattaacgctttctcaaaatagacgatacgccttaactcagacagttgtggataaggaaatgtattttgatgctattccagagagaccaactacaaaaattgaaataagcagttttcaagatgaagctttaaccataacaggagagactttagttccaaatactttattgtcgattgtttctcttacaattaattcaaatggaattccagtatttactttgtccaatggacagttcataaaggctagtcgtgaagctatttttaatgatttagtttctaagcagcaatctgtctcattggattattggttaaaaccttcttttgtgacttatgaagcaccttacacaaatggtgttagtgaagttaaaaataatttaaaaccttattccagagtgcatttagtagaacaagcagaaacagaacatggtatttattataaaacggacagtggtttttggatatcagtagaagatctatcggttgctgataatcgtatggctaaggttcaagaagtattattggaaaaatataataaagataaatatggtatatacatcaaacaattaaatacacagacagtagctggtattaatattgataggtcaatgtactctgcaagtattgcaaaattagcaacactttatgctagccaagagcaagtaaaattaggaaaactgtcattggacagcaaatttgaatacaaagataatgttaatcaatttcctaatagctatgatccaagtggtagtgggaaattagagaaaaaagctgatcataaattatataccgttaaggagttacttgaagcaactgccaaggaatcagataatgttgcaacaaatatgctaggttattatgtcaataatcaatatgattcaatgtttcaaacacaagtagacacaatttctggtatgcactgggatatgaaaaaacgccagatttctccacaagctgcgggtaaaatgatggaagcaatttattatcaaaatggagatattgttaattacctatcaaagactgattttgataatacaagaatccctaaaaatataccagttaaagtagcacataaaattggagatgcttatgactacaaacatgatgcggctattgtttatgcagaacaaccttttattatgattatctttacggataaatcatcttacgatgatatcactaagattgctgacgacgtttaccaggttttaaaa

SEQ ID NO: 5152 - protein, 428 aa, Streptococcus agalactiae
MKKVLTFLLCSLYFVSIPAISTEEPLTLSQNRRYALTQTVVDKEMYFDAIPERPTTKIEISSFQDEALTITGETLVPNTLLSIVSLTINSNGIPVFTLSNGQFIKASREAIFNDLVSKQQSVSLDYWLKPSFVTYEAPYTNGVSEVKNNLKPYSRVHLVEQAETEHGIYYKTDSGFWISVEDLSVADNRMAKVQEVLLEKYNKDKYGIYIKQLNTQTVAGINIDRSMYSASIAKLATLYASQEQVKLGKLSLDSKFEYKDNVNQFPNSYDPSGSGKLEKKADHKLYTVKELLEATAKESDNVATNMLGYYVNNQYDSMFQTQVDTISGMHWDMKKRQISPQAAGKMMEAIYYQNGDIVNYLSKTDFDNTRIPKNIPVKVAHKIGDAYDYKHDAAIVYAEQPFIMIIFTDKSSYDDITKIADDVYQVLK

SEQ ID NO: 5153 - DNA, 1284 bp, Streptococcus pyogenes
atgagaaaattattagcggctatgttaatgactttttttctgactcctttaccagtgattagtacagaaaaaaaacttatattttcaaaaaatgctgtttatcaattgaaacaagatgtcgttcaatcaacacaattctataatcaaataccctctaatccaaatctttatcaagaaacgtgtgcctataaagacagtgatttaactctaccagcaggaagattaggtgtaaatcaaccattacttattaaatcgcttgtgcttaacaaagaatctttaccggtttttgagttagctgatggtacctatgttgaggctaatcgacaattgatttatgacgatattgtacttaatcaagtagatatagatagctatttttggacacaaaagaaacttaggctttattcagccccttatgttttaggtacgcaaacaattccttcttcttttttatttgctcaaaaagttcatgccactcaaatggcacaaacaaaccatggaacttattatcttattgatgataagggctgggcatcacaagaagatctagttcaatttgataaccgcatgttaaaagtccaggaaatgctcttacaaaaatataataacccaaattattcaatttttgtaaagcaactcaacacacaaacaagtgctggtattaatgctgataaaaaaatgtatgctgcaagtatctcgaagttagcaccactttatattgttcaaaaacaattacaaaaaaagaaattagcagagaataaaactttgacttatactaaagatgttaatcatttttatggagactatgatccattgggaagtggtaaaattagtaaaatagctgataataaagattatcgtgttgaagacctactgaaagctgtagcacaacaatcggataatgtagcaactaatattttaggttattatctatgtcatcagtatgataaagctttccgctcagagataaaagctttatcaggtatcgattgggatatggagcagcgcttattaacttctcgttcagctgcaaatatgatggaagctatttatcatcaaaaaggccaaattatttcttacctttcaaataccgaatttgatcaacaacgtatcacaaaaaatattactgttccagttgcacataaaattggtgatgcttatgattataaacatgacgttgctattgtttacggtaatactccatttattttgtctatttttacaaataaatcaacctatgaagatattacggctattgcagatgacgtttatggtattttaaaa

SEQ ID NO: 5154 - protein, 428 aa, Streptococcus pyogenes
MRKLLAAMLMTFFLTPLPVISTEKKLIFSKNAVYQLKQDVVQSTQFYNQIPSNPNLYQETCAYKDSDLTLPAGRLGVNQPLLIKSLVLNKESLPVFELADGTYVEANRQLIYDDIVLNQVDIDSYFWTQKKLRLYSAPYVLGTQTIPSSFLFAQKVHATQMAQTNHGTYYLIDDKGWASQEDLVQFDNRMLKVQEMLLQKYNNPNYSIFVKQLNTQTSAGINADKKMYAASISKLAPLYIVQKQLQKKKLAENKTLTYTKDVNHFYGDYDPLGSGKISKIADNKDYRVEDLLKAVAQQSDNVATNILGYYLCHQYDKAFRSEIKALSGIDWDMEQRLLTSRSAANMMEAIYHQKGQIISYLSNTEFDQQRITKNITVPVAHKIGDAYDYKHDVAIVYGNTPFILSIFTNKSTYEDITAIADDVYGILK

SEQ ID NO: 5155 - DNA, 1272 bp, Streptococcus agalactiae
atgtataacactattttgaaagataccttatccaaagggttatttaccgctcatcagaaagttctaattgctgtttctggtggcattgattcaataaatttgttgcaatttttataccagtatcaaaaagagttatcgattagtattggtattgcacacataaatcatggacagcgaaaagaatcagaaaaagaagaagaatatatcagacagtggggacagatacatgatgtccctgtctttatctcttattttcaaggaatattttcagaagatagagcacgtaaccatcgctacaattttttttcaaaagttatgcgtgaagaaggttacacggctttagtaacagctcaccatgctgatgatcaagctgaaactgtatttatgagaattttaagaggaagcaggctacgctatttatcagggattaagcaagtgagtgcttttgcaaacggtcaattgattagaccatttcttccatataaaaaggagttattaccaaatatttttcattttgaagatgctagcaacgcttcgtctgattatttaagaaatcgaataagaaacgtctactttcctgctttggaaagagaaaataatcaattgaaagattctctcataactctctctgaggaaacagagtgtttattcacggctttaacagacctaacaaggagcatcgaagtaacaaactgctatgattttttaaggcaaactcattctgtccaagaatttttattgcaagattacattagcaaatttccagatttacaagtgagtaaagaacagttcagagtaatattaaaattgattagaactaaagccaatattgactatactattaaatcgggctattttcttcataaggattacgagagttttcatattacaaaaatccatcctaagacggatagttttaaggttgaaaaaagattagaattgcataatatacaaatattctcacaatatttattttcctatggaaaattcatttctcaagcagacattactattcctatttatgatacttctccgattattttaagaagaagaaaagaaggggataggatatttttaggaaatcacactaaaaaaattcgccgtctatttattgatgagaaaataactctaaaagagagagaagaagctgttattggggagcaaaataaagagttgatatttgtgattgttgcaggtagaacatatttgagaaaaccttctgaacatgatataatgaagggcaaactttatattgaaaatttagaaaaaagg

SEQ ID NO: 5156 - protein, 424 aa, Streptococcus agalactiae
MYNTILKDTLSKGLFTAHQKVLIAVSGGIDSINLLQFLYQYQKELSISIGIAHINHGQRKESEKEEEYIRQWGQIHDVPVFISYFQGIFSEDRARNHRYNFFSKVMREEGYTALVTAHHADDQAETVFMRILRGSRLRYLSGIKQVSAFANGQLIRPFLPYKKELLPNIFHFEDASNASSDYLRNRIRNVYFPALERENNQLKDSLITLSEETECLFTALTDLTRSIEVTNCYDFLRQTHSVQEFLLQDYISKFPDLQVSKEQFRVILKLIRTKANIDYTIKSGYFLHKDYESFHITKIHPKTDSFKVEKRLELHNIQIFSQYLFSYGKFISQADITIPIYDTSPIILRRRKEGDRIFLGNHTKKIRRLFIDEKITLKEREEAVIGEQNKELIFVIVAGRTYLRKPSEHDIMKGKLYIENLEKR

SEQ ID NO: 5157 - DNA, 1284 bp, Streptococcus pyogenes
atgatgacctatcaagaaatttttaatgaaataaaaaataaagcctactttaaaaatcatagacatgtgttaatagccgtatctggtggagtagattcaatgaatttattgcactttttatacctgtttcaagacaaattgaaaattcgtattggtattgctcatgttaatcacaaacaaagatcagaatcagattcagaagaagcttatttaaagtgttgggctaaaaaacatgacatacctatttatgtttctaattttgaaggaatattttcagaaaaagcagcacgtgattggcgctatgctttttttaagagtattatgttaaaaaataactattcagctttagtaacagctcaccattcagatgatcaagcagaaactattttgatgaggctaattagaggaagccgattgaggcacttgtcgggtataaaaagcgtgcaaccatttgccaatggtcaacttataagaccttttttaactttctcaaaaaaggacttgccagaaatttttcattttgaagattcttcaaatagagaattatcatttttaagaaatagagttagaaataattatttaccactgttaaagcaggaaaatcctaggttcattcagggattaaatcaattagcacttgaaaatagcttactttttcaagcttttaaggagctaacaaatcatattactaccactgatttaacagaatttaatgagcaatctaagtcaattcaatactttttgttacaagattatttagaaggttttccagatttagatttaaaaaaatctcaatttactcaattattgcaaattatccaaactgctaaacaaggctattattatctcaaaaaagactattatatattcattgataaattctcttttaaaattacaaaaatcgttcctaagactgagttagttaaagaagaaaaaatgttagaatacgatagtaacttatgctacagagattattatttttcatttatgccaaaaagtaacgaagatcaaggacaggtaagtatacctttatttagtttatcgtctattaaattaagaagtcgccaatctggagattatatttcttttggtcacttttcaaaaaaaataagacgtttatttatagatgaaaaattcacaatagctgaacgtcaaaatgctattattggagagcaagatgagcagattatatttgtattgataggtaataaaacttatttgagaaaagcttgtaaacatgatataatgttggctaaactgtatattgataaattagaaaaaggg

SEQ ID NO: 5158 - protein, 428 aa, Streptococcus pyogenes
MMTYQEIFNEIKNKAYFKNHRHVLIAVSGGVDSMNLLHFLYLFQDKLKIRIGIAHVNHKQRSESDSEEAYLKCWAKKHDIPIYVSNFEGIFSEKAARDWRYAFFKSIMLKNNYSALVTAHHSDDQAETILMRLIRGSRLRHLSGIKSVQPFANGQLIRPFLTFSKKDLPEIFHFEDSSNRELSFLRNRVRNNYLPLLKQENPRFIQGLNQLALENSLLFQAFKELTNHITTTDLTEFNEQSKSIQYFLLQDYLEGFPDLDLKKSQFTQLLQIIQTAKQGYYYLKKDYYIFIDKFSFKITKIVPKTELVKEEKMLEYDSNLCYRDYYFSFMPKSNEDQGQVSIPLFSLSSIKLRSRQSGDYISFGHFSKKIRRLFIDEKFTIAERQNAIIGEQDEQIIFVLIGNKTYLRKACKHDIMLAKLYIDKLEKG

SEQ ID NO: 5159 - DNA, 540 bp, Streptococcus agalactiae
atgcttgaaaatgatataaaaaaagttttatattcagaagaagatattattctgaaaacgaaagaattaggagctaaattaactgcagattatgcaggtaagaatccattattagtaggtgtattaaaggggtcagtgccttttatggctgagctattaaagcatattgatacacatgttgaaattgattttatggttgtttcaagctatcatggtggtacaactagtagtggagaagttaaaattttaaaagatgttgatactaacattgaaggaagagatgtaatctttattgaagacatcattgatactggacgtacattaaaataccttcgagatatgtttaagtatcgccaagctaactctgtcaaagttgcaaccctttttgataagccagaagggcgattggtagatattgatgctgattacgtttgttacgatatcccaaatgaatttattgtgggattcggtttagactatgctgaaaactatcgtaacttaccttatgttggtgtgttaaaagaagaaatttactcaaaa

SEQ ID NO: 5160 - protein, 180 aa, Streptococcus agalactiae
MLENDIKKVLYSEEDIILKTKELGAKLTADYAGKNPLLVGVLKGSVPFMAELLKHIDTHVEIDFMVVSSYHGGTTSSGEVKILKDVDTNIEGRDVIFIEDIIDTGRTLKYLRDMFKYRQANSVKVATLFDKPEGRLVDIDADYVCYDIPNEFIVGFGLDYAENYRNLPYVGVLKEEIYSK

SEQ ID NO: 5161 - DNA, 540 bp, Streptococcus pyogenes
atgctcgagcaagatattcaaaaaattctttactctgaaaatgatattattcggaaaactaaaaaattaggagaacaattaacaaaagattatcaagaaaaaaatccgcttatgattggtgtattaaaaggatcagttccttttatggcagaactaatgaaacacatcgatactcatgttgaaattgattttatggtagtatcaagttatcatggcggtacatctagcagtggtgaagttaaaattttaaaagatgtagataccaatattgaaggaagagatatcataattgttgaagatattattgacaccggtcgcaccttaaaatatttacgagatatgtttaagtaccgtaaagctaatactatcaaaattgcaacactgtttgataaacctgaaggtcgtgttgttaaaattgaagcagattatgtttgttacaatattccaaatgaatttatcgtaggctttggtttagattacgcagaaaattatcgcaatcttccttacgtaggtgtattaaaagaagaagtctattcaaaa

SEQ ID NO: 5162 - protein, 180 aa, Streptococcus pyogenes
MLEQDIQKILYSENDIIRKTKKLGEQLTKDYQEKNPLMIGVLKGSVPFMAELMKHIDTHVEIDFMVVSSYHGGTSSSGEVKILKDVDTNIEGRDIIIVEDIIDTGRTLKYLRDMFKYRKANTIKIATLFDKPEGRVVKIEADYVCYNIPNEFIVGFGLDYAENYRNLPYVGVLKEEVYSK

SEQ ID NO: 5163 - DNA, 1974 bp, Streptococcus agalactiae
atgaaaaataataaaaataatggttttctgaaaaattcctttatttacatattattgattattgcggttattacaacctttcaatactatttaaaaggaactagctctcaaaaccagcaaatttcttatacaaaacttgttaaacaattaaaagctggagaaattaagtctatctcataccagccaagtggtggtgttgttgaagttagtgggacatataagaaagccaaaacaattaaatcagctaatagttttacttttttaggtggtagtgttgctactaaagttacaggatttaattctgttatactaccaaatgactcttcaataaaatctcttgttagcgctgctgaagaaaataacactaatattcaggtcaaacatgaaagttcaagtgggacatggatttcttatattgccagttttttacctttagttatcatgattggtttcttcatgatgatgatgaaccaaggcggtggcggtggcgctcgtggtgccatgagctttggtaaaaataaagcaagatcatctagtaaagatgaggttaaagttcgattttcggatgttgctggagcagaggaagaaaagcaagaattaatagaagtcgttgacttccttaaagatcctaaacgatataaatctctaggtgcccgaattccagcaggggttctattagaaggacctccagggacaggtaaaaccctattagcaaaagctgttgccggtgaagcaggggttccattctttagtatttccggttcagattttgttgaaatgtttgtcggtgttggagctagtcgagtacgctctttgtttgaagatgctaaaaaagctgaacgtgctattattttcattgatgaaattgatgctgttggacgtcgacgtggagctggtatgggtggcggaaacgatgaacgtgaacaaacgctcaaccaacttttaattgaaatggatggttttgaaggaaacgaaagtattatcgttatcgctgctaccaaccgtagtgatgtgttagatcccgcattactgcgtccaggacgttttgatagaaaagttctagttggacaacctgatgtaaaaggtcgtgaagcaattctgagagtacatgctaaaaataaaccattagcagataatgttgacttaaaagtagtagctcaacaaaccccaggatttgttggtgctgatttggagaatgttctcaatgaagctgctttagttgctgcgcgacgaaataaaaaagttattgatgcttcagatattgatgaagcagaagaccgtgtaattgctggtccttctaaaaaagatcgtactatttctgaaagagaaagagctatggttgcttaccatgaagctgggcacacaattgtcggtttgattctttcaaatgcgcgagttgttcataaagttactatcgtaccacgtggtcgtgcaggtggatatatgattgctttacctaaagaagatcaaatgcttctttcaaaagatgatatgaaagagcaattagcaggtcttatgggaggacgtgtagcggaagaaattattttcaacgctcagacaacaggtgcctcaaatgacttcgaacaagccactgctatggcccgcgctatggtaactgaatatggtatgagcgagaaacttggaccagttcaatacgaaggcaaccacgcaatgatggctggtcaaatgtcacctgaaaaatcatattctgctcaaactgcacaacttattgatgatgaagttcgtcaccttcttaatgaagcacgtaataaggcagctgatattatcaacgaaaaccgtgatactcataaattaattgcagaagccctcttaaaatatgagactcttgatgctgctcagattaaatcgatttttgagacaggtaaaatgcctgagacagaaaatgatgaagataaagcaagagcgttatcatacgatgaaatcaaagaaaaaatgcaagaagaagataaaaaa

SEQ ID NO: 5164 - protein, 658 aa, Streptococcus agalactiae
MKNNKNNGFLKNSFIYILLIIAVITTFQYYLKGTSSQNQQISYTKLVKQLKAGEIKSISYQPSGGVVEVSGTYKKAKTIKSANSFTFLGGSVATKVTGFNSVILPNDSSIKSLVSAAEENNTNIQVKHESSSGTWISYIASFLPLVIMIGFFMMMMNQGGGGGARGAMSFGKNKARSSSKDEVKVRFSDVAGAEEEKQELIEVVDFLKDPKRYKSLGARIPAGVLLEGPPGTGKTLLAKAVAGEAGVPFFSISGSDFVEMFVGVGASRVRSLFEDAKKAERAIIFIDEIDAVGRRRGAGMGGGNDEREQTLNQLLIEMDGFEGNESIIVIAATNRSDVLDPALLRPGRFDRKVLVGQPDVKGREAILRVHAKNKPLADNVDLKVVAQQTPGFVGADLENVLNEAALVAARRNKKVIDASDIDEAEDRVIAGPSKKDRTISERERAMVAYHEAGHTIVGLILSNARVVHKVTIVPRGRAGGYMIALPKEDQMLLSKDDMKEQLAGLMGGRVAEEIIFNAQTTGASNDFEQATAMARAMVTEYGMSEKLGPVQYEGNHAMMAGQMSPEKSYSAQTAQLIDDEVRHLLNEARNKAADIINENRDTHKLIAEALLKYETLDAAQIKSIFETGKMPETENDEDKARALSYDEIKEKMQEEDKK

SEQ ID NO: 5165 - DNA, 1977 bp, Streptococcus pyogenes
atgaaaaataataaaaataatggttttgttaaaaattcttttatatatatattgatgattattgttgtcatcacaggatttcaattttatcttaagggaaccagcacacaaagccaacagattagttattccaaattaattaaacatcttaaggctggagatataaaatctttaagttatcagcctagcggtagtattattgaagttaaagggaaatatgagaaacctcaaaaagtgacagttaattcaggactatcatttttaggtggaagagcttcaacacaggtaacagagttctcatctttagtattacctagtgataccatcttgaaagaaatgacagcagcagctgataaaaatggaacagagcttacagttaagcaggaaagttcaagtggtacttggattaccttcttaatgagctttttacctattgttatttttgctgctttcatgatgatgatgatgaatcaaggtggtggaggagctcgtggtgctatgagtttcggcaaaaataaggcaaaatctcaatcaaaaggtaatgttaaagtgagatttacagacgttgctggtgccgaagaagaaaaacaagaattagtagaagttgttgattttttgaaaaatcctaaaaaatataaatcactaggagcacggattccagcgggagttcttctagaggggcctccaggtactggtaaaacattactagctaaagctgtagcaggtgaagctggagtgccatttttcagtatttcaggttcggattttgtcgaaatgtttgtcggtgtaggtgctagtcgtgttcgttctttatttgaggatgctaaaaaagctgagcgtgcgatcatctttatcgatgaaattgacgctgtaggtcgtcgtcgtggtgctggcatgggaggcggtaacgatgaacgagaacagacccttaaccaattactcattgaaatggatggttttgagggtaatgagaacattatcgttattgctgcaactaaccgtagtgatgttttagatccagctttactaagaccaggtcgttttgatcgtaaggttttagttggtcgccctgatgttaaaggacgtgaagccattttacgtgttcatgctaaaaataaaccacttgcaaatgacgttaatttgaaagtagtagcccaacagactccaggttttgtaggtgctgatcttgaaaatgttttaaatgaagctgcgttggttgctgctcgcagaaataaaattaaaattgatgctagtgatattgatgaagctgaagatcgtgttattgctggaccatcaaagaaagatcgcactatttcgcaaaaagagcgagaaatggttgcttatcacgaagctggtcatactattgttggtttagttttatctaatgcgcgtgtagttcacaaggtaactattgtacctcgtggacgagcaggtggttatatgatcgctcttccaaaagaagatcaaatgcttctttctaaagaagatctgaaagagcaattagcaggattgatgggtggtcgtgttgctgaagaaattgtttttaatgctcaaacatcaggtgcgtcaaatgactttgagcaagctactcagatagcaagggccatggttacggaatatggtatgagtgaaaagcttggaccagttcaatatgaaggtaaccatgcgatgatgccaggacagatctctcctgaaaaagcttactctgcccaaacagctcaaatgattgatgatgaggttcgtgaactcttaaatcaagctcgtaatcaagcagctgatatcatcaatgagaatcgagatactcataaattgattgctgaagctcttctcaaatatgaaactctagacgctgcacaaattaaatcaatttatgaaactggtaaaatgccagttgatttagaaactgatgataatgaagctcatgcgttatcttatgacgaaattaaaaataaaatgacagaatctgaatctgcagaa

SEQ ID NO: 5166 - protein, 659 aa, Streptococcus pyogenes
MKNNKNNGFVKNSFIYILMIIVVITGFQFYLKGTSTQSQQISYSKLIKHLKAGDIKSLSYQPSGSIIEVKGKYEKPQKVTVNSGLSFLGGRASTQVTEFSSLVLPSDTILKEMTAAADKNGTELTVKQESSSGTWITFLMSFLPIVIFAAFMMMMMNQGGGGARGAMSFGKNKAKSQSKGNVKVRFTDVAGAEEEKQELVEVVDFLKNPKKYKSLGARIPAGVLLEGPPGTGKTLLAKAVAGEAGVPFFSISGSDFVEMFVGVGASRVRSLFEDAKKAERAIIFIDEIDAVGRRRGAGMGGGNDEREQTLNQLLIEMDGFEGNENIIVIAATNRSDVLDPALLRPGRFDRKVLVGRPDVKGREAILRVHAKNKPLANDVNLKVVAQQTPGFVGADLENVLNEAALVAARRNKIKIDASDIDEAEDRVIAGPSKKDRTISQKEREMVAYHEAGHTIVGLVLSNARVVHKVTIVPRGRAGGYMIALPKEDQMLLSKEDLKEQLAGLMGGRVAEEIVFNAQTSGASNDFEQATQIARAMVTEYGMSEKLGPVQYEGNHAMMPGQISPEKAYSAQTAQMIDDEVRELLNQARNQAADIINENRDTHKLIAEALLKYETLDAAQIKSIYETGKMPVDLETDDNEAHALSYDEIKNKMTESESAE

SEQ ID NO: 5167 - DNA, 138 bp, Streptococcus agalactiae
atgcctgctgcaattagggatccagtaatgtcagatccccctcttgaaaaggtacaaatttggttatcttctgtgactccaaaaaatccagggataacaagaacctcattgtatagacataagttctcaatcttatca

SEQ ID NO: 5168 - protein, 46 aa, Streptococcus agalactiae
MPAAIRDPVMSDPPLEKVQIWLSSVTPKNPGITRTSLYRHKFSILS

SEQ ID NO: 5169 - DNA, 1350 bp, Streptococcus agalactiae
atgaaagtagtcaaatttggaggaagttctttagcatcttcccaacaattatacaaagtactaaatattatcaaatcagactacactagacggtttgttgtcgtttcagctccagggaaacgctacgaagaagacttaaaaatgacagatgctttgatacaatattatcaaaattatattaacggtaaagatattgttaaagaccaaacttggattatcaatcgttatcaagaaattattagtgatttgtctttaggaagcactattgcagaagaaattactcgctctatagagcagctagcttcacttcccatagaaaataatcagtttttatatgattgttttttagcagccggtgaagataacaacgcaaagttagttgcaacgttttttaatcaaaatgacattcctgcaagatatgttcatccaaacgaagcaggaattattgtaactaaagaaccatgtaatgcacgaattattccaggaagttatgataagattgagaacttatgtctatacaatgaggttcttgttatccctggattttttggagtcacagaagataaccaaatttgtaccttttcaagagggggatctgacattactggatccctaattgcagcaggcataaaagcagacctttatgagaacttcacagatgttgatggtatatttgcagcacatccaggtgtagttaagaaccctcacgctatccctgagcttacttataaagaaatgcgtgaattagcctatgcgggtttttcggttttacatgatgaagctttacttcctgcctatcgtggcagaatccctcttgttattaaaaatacaaataatccccaacagcctggtacaaaaatagttttaaagcatactcgtagtaacatagcagtaactgggatcgcttctgatagccgttttgctagcataaacgtatctaaatacttaatgaatagagaagtaggtttcggccgaaaagtactacaaattttagaggatttaaatattagttttgaacatatgccaactggcatagatgatctatccattgtcttacgtgaaaaagaattgacaccaatcaaagaacaagaaatcttaaattacctaactcgtaaactagaagtagattacgttgacatccaacacaatctatctacaatcgtaattgtaggtgaaaatatgaaaagtcagattggagtcactgcaacagcgacacaagccttatcaagagaaaaaatcaatatcaccatgatatcacaaggttcaagcgaagtctccattatgttcgttataaacagtaaggatgaaaaaagagctattaaagcactatatgaaacattcttccaaaaa

SEQ ID NO: 5170 - protein, 450 aa, Streptococcus agalactiae
MKVVKFGGSSLASSQQLYKVLNIIKSDYTRRFVVVSAPGKRYEEDLKMTDALIQYYQNYINGKDIVKDQTWIINRYQEIISDLSLGSTIAEEITRSIEQLASLPIENNQFLYDCFLAAGEDNNAKLVATFFNQNDIPARYVHPNEAGIIVTKEPCNARIIPGSYDKIENLCLYNEVLVIPGFFGVTEDNQICTFSRGGSDITGSLIAAGIKADLYENFTDVDGIFAAHPGVVKNPHAIPELTYKEMRELAYAGFSVLHDEALLPAYRGRIPLVIKNTNNPQQPGTKIVLKHTRSNIAVTGIASDSRFASINVSKYLMNREVGFGRKVLQILEDLNISFEHMPTGIDDLSIVLREKELTPIKEQEILNYLTRKLEVDYVDIQHNLSTIVIVGENMKSQIGVTATATQALSREKINITMISQGSSEVSIMFVINSKDEKRAIKALYETFFQK

SEQ ID NO: 5171 - DNA, 648 bp, Streptococcus agalactiae
atgtgtaaatataaagcaataatatttgatatggatggtgttctatttgacactgaattattttattataaaaggcgagagcgttttttaaaacaacatggaattacaattgaccatttaccaatgaatttttttattggaggaaatatgaagcaggtttggaaatctgttttaggtgatcaatatgatacctgggatattgataagctccaacaagattatagtcgctataaagaggataatcccttgccatacaaagatttaatttttcaggattgtaaaagagtcattgaaaagcttcatcacaaaggctatcttttgggtctagcttcaagttctactagacatgatatcatgttagcattagaaagttttaatctggatacatattttaaggtaattctgtctggtgaggaattttcagaaagtaaacctaatccagctatttataatagagcagcagaacttttagatattcctaaacagcaaattcttattgtagaagacagtgagaaggggattacagctggtattgcagccggtattgatgtgtgggctattgaagataaatactttggaatgaatcagtcgcaggctaatgtattagtgagcgatctgagtcaattttttgtgaaattagataactat

SEQ ID NO: 5172 - protein, 216 aa, Streptococcus agalactiae
MCKYKAIIFDMDGVLFDTELFYYKRRERFLKQHGITIDHLPMNFFIGGNMKQVWKSVLGDQYDTWDIDKLQQDYSRYKEDNPLPYKDLIFQDCKRVIEKLHHKGYLLGLASSSTRHDIMLALESFNLDTYFKVILSGEEFSESKPNPAIYNRAAELLDIPKQQILIVEDSEKGITAGIAAGIDVWAIEDKYFGMNQSQANVLVSDLSQFFVKLDNY

SEQ ID NO: 5173 - DNA, 843 bp, Streptococcus agalactiae
ttgataatcaaattattttttatttttctttcactcttaaagagaggagacattttgaagttcgaaaatataatatatggtattgatggcaacgtggccactattatgcttaatcgaccagatatttcaaatggttttaacatcccaatgtgtcaagaaattattgatgcaataaggcttgtgtctgaaaataaagatgtcatgtttttagtgattgaagcacaaggaccaatcttttcaatcggaggagatttaaaagtgatgaaagctgctgttgagagcgatgatattagctcattaactaaaattgctgagttagttaatcagatatcgtatgatttactacagctagagaaacctgttgttatgtgtgtagatggggctgtagctggtgccgcagctaatattgcattagcagctgattttgttatcgcaagcaagaagagtaaatttatccaggcttttgtgggtgtcggtttagctccagatgcaggaggtttattgttacttagtaaatcaatcggtataactcgtgcagtgcaactagctttaactggagaaagcttatctgctgaaaaagctgaagctttgggaattgtttataaactttgtgaatcagataaaataggtaaaattaaggatcaactattaaagcgtttaagtagacattctataaactcatatcaagccataaaatcattagcttgggaagctgcttttaaagattgggaacaatataaaaagcttgaattacaactgcaagaatcattagcctttaagcaagattttaaagaaggtgttcgggcacacgctgatagaaggcgtcctaattttttaggcaaa

SEQ ID NO: 5174 - protein, 281 aa, Streptococcus agalactiae
MIIKLFFIFLSLLKRGDILKFENIIYGIDGNVATIMLNRPDISNGFNIPMCQEIIDAIRLVSENKDVMFLVIEAQGPIFSIGGDLKVMKAAVESDDISSLTKIAELVNQISYDLLQLEKPVVMCVDGAVAGAAANIALAADFVIASKKSKFIQAFVGVGLAPDAGGLLLLSKSIGITRAVQLALTGESLSAEKAEALGIVYKLCESDKIGKIKDQLLKRLSRHSINSYQAIKSLAWEAAFKDWEQYKKLELQLQESLAFKQDFKEGVRAHADRRRPNFLGK

SEQ ID NO: 5175 - DNA, 789 bp, Streptococcus pyogenes
atgcagtttaaacacatcatctttgatgttgtagatgatcttgcgacattgactttaaaccgtccagaggtttcaaacggttttaatattccaatttgtcaagagattctggtagcattagcagaagttaaacgcgatacatctgtgcgttttttattaattaaagccgttggaaaagtgttttcagttggtggtgacctagttgaaatgcaagaagctgttgcaaaagataatgtgcagtcgctagtcaagattgctgaactggtacaagaaatttcttttgcaataaagcatttgccaaaaccagtcatcctttgcgccgatggagctgtagctggagcggcttttaatatagctttagctgttgacttttgtatcgctagtactcaaacaaaatttatccaagcttttgtaaatgttggactagcaccggatgccggtggtttatttctattgactcgtgcagtaggacttaatcgtgcaactcaccttgtgatgacaggtgaaggaattactgctgataaaggtctcgattatgggtttgtctaccgtacggcagaatctgataaactagacaaagtttgtcttcaacttttaaagcgattgagacgtggctcttcaaattcttatgctggaatgaaatcattggtctggcaaagttttttcacaggatgggaagattatgctaaggcagagcttgctattcaagaggagctagctttcaaggaagattttaaagaaggtgtcatagcttttggagaaaggcgccgaccaaattttcaaggtaag

SEQ ID NO: 5176 - protein, 263 aa, Streptococcus pyogenes
MQFKHIIFDVVDDLATLTLNRPEVSNGFNIPICQEILVALAEVKRDTSVRFLLIKAVGKVFSVGGDLVEMQEAVAKDNVQSLVKIAELVQEISFAIKHLPKPVILCADGAVAGAAFNIALAVDFCIASTQTKFIQAFVNVGLAPDAGGLFLLTRAVGLNRATHLVMTGEGITADKGLDYGFVYRTAESDKLDKVCLQLLKRLRRGSSNSYAGMKSLVWQSFFTGWEDYAKAELAIQEELAFKEDFKEGVIAFGERRRPNFQGK

SEQ ID NO: 5177 - DNA, 432 bp, Streptococcus agalactiae
ttggaatacgatcagattaatagttatttagttgacatttttaatagaatcatgattattgaggaaatgagtttaaagactagccaatttagcgatgtatctttaaaagaaatgcatactattgaaattattgggaaacattctgaggtaactcctagcgatgtcgctcgagaattaatgttaactttgggaactgtaacaaccagccttaataagttagaaaaaaaaggctacattgagcgtaaacggtcaagtattgatcgtcgagttgttcacttgagtcttactaagagaggtaggttattagatcgattgcatagtaaatttcataaatctatggtatctcatattattgaagacctaggtgaagaagacataaaaatgttgacgagcgctttagggaatcttcataaatttttggaggacttagtc

SEQ ID NO: 5178 - protein, 144 aa, Streptococcus agalactiae
MEYDQINSYLVDIFNRIMIIEEMSLKTSQFSDVSLKEMHTIEIIGKHSEVTPSDVARELMLTLGTVTTSLNKLEKKGYIERKRSSIDRRVVHLSLTKRGRLLDRLHSKFHKSMVSHIIEDLGEEDIKMLTSALGNLHKFLEDLV

SEQ ID NO: 5179 - DNA, 450 bp, Streptococcus pyogenes
ttgctaggaggtgtttacttggaatatgacaaaatttacccatacttagttgatattttcaaccggattttggttattgaagaaatgagcttaaagacgagtcagtttagtgatgtctctttaaaagagatgcacactattgaaattatcggcaaatatgatcaggtgactccaagtgatatcgccagagaattaatggtaacgttagggacagtaaccactagcttaaataaattagaagcaaaaggttatatcgcaagaacgcgatcacgctcagataggcgagttgtttacctgtcattaacaaaaaggggtcgacttttggaccgcctccatgcaaagttccataaaaatatggttggacatgtcattgctgatatgagtgatgaagagatgcaggcattggtgcgtggactagggaatctacatcaatttttggaggatttggtt

SEQ ID NO: 5180 - protein, 150 aa, Streptococcus pyogenes
LLGGVYLEYDKIYPYLVDIFNRILVIEEMSLKTSQFSDVSLKEMHTIEIIGKYDQVTPSDIARELMVTLGTVTTSLNKLEAKGYIARTRSRSDRRVVYLSLTKRGRLLDRLHAKFHKNMVGHVIADMSDEEMQALVRGLGNLHQFLEDLV

SEQ ID NO: 5181 - DNA, 969 bp, Streptococcus agalactiae
gtggtttttgctaaaattagtcaacttgcacattatgcaccttctcaaattattaaaaatgaggatttatcattaatcatggataccagtgatgactggatttcgtcacgtactggtataaaacaacgtcatattagtaaaaatgaaacaacagctgatttggcaaataaggtcgcagaacaacttattgaaaaatccggttattccgctagtcaaattgactttattattgttgcaacgatgacaccagactctatgatgccttctactgctgcaagagtgcaagctcatattggagcgagtaatgcttttgcctttgacttgagtgcagcatgtagtggttttgtttttgccttgtctaccgccgaaaaattgatatcatcaggtagctatcaaaaaggtttagtaataggagcagaaactgtttctaaagtattagactggactgatagagggacagcagttttatttggagatggagctggaggtgtcttgctagaagcttctaaggaaaaacattttcttgcagagtctctcaatacagatggtagtcgtcagggacttcaatccagtcaagtcgggttaaattcacctttctcagatgaagtacttgatgataaatttttgaaaatggatggtagagcaatctttgattttgctatcaaagaagtttcaaaaagtatcaatcatcttatagaaacatcttatttggaaaaagaagatattgattatcttttcttacaccaagcgaatcgaaggattttagataagatgtctcgaaaaattgatatagcacgtgataaatttccagagaatatgatggattatggtaatactagtgcagctagtatccctattttactttcagaatcttatgagaacggtttgttgaaactagatggtaaccaaacaatcctcttatcgggtttcggtggaggtttgacatggggaagtctaattgttaaaatt

SEQ ID NO: 5182 - protein, 323 aa, Streptococcus agalactiae
MVFAKISQLAHYAPSQIIKNEDLSLIMDTSDDWISSRTGIKQRHISKNETTADLANKVAEQLIEKSGYSASQIDFIIVATMTPDSMMPSTAARVQAHIGASNAFAFDLSAACSGFVFALSTAEKLISSGSYQKGLVIGAETVSKVLDWTDRGTAVLFGDGAGGVLLEASKEKHFLAESLNTDGSRQGLQSSQVGLNSPFSDEVLDDKFLKMDGRAIFDFAIKEVSKSINHLIETSYLEKEDIDYLFLHQANRRILDKMSRKIDIARDKFPENMMDYGNTSAASIPILLSESYENGLLKLDGNQTILLSGFGGGLTWGSLIVKI

SEQ ID NO: 5183 - DNA, 972 bp, Streptococcus pyogenes
atgattttttctaaaatcagtcaggtagcccactatgttccacagcagttagtgactaataatgatttagctagcataatggacactagtcatgagtggatcttttctcgaacaggaatagcagaacgccatatttctagagatgaaatgactagtgacctagctattcaggttgctgatcagcttttaactcagtctgggttaaaagctgatgctattgattttattattgttgcaactatcagccctgatgccactatgccatcaacagctgcgaaagttcaagcagctattgcggctacaagtgcttttgcttttgatatgactgctgcttgtagtggctttgtctttgccttggctatggcagataagcttattgcatcaggtgcctaccaaaacggaatggtaataggtgcagagactttatctaagttagtaaactggcaggatcgagcgacagccgttctttttggagacggagctggtggcgtgctactggaagccagtaaagataagcatgttttagcggaaacattacacacagatggtgcgagatgtcagagtttgatttcaggagaaactagtctttcatctccttactcaattggcaaaaaagccatagcgactattcagatggatggacgtgccatatttgattttgcgattagggatgtgtcaaaaagcatcctcacactaatggcgcaatcagatattacaaaagatgacatagactattgtttattgcatcaagctaatcgtcgtatacttgataaaatagcacgcaagattgatgttcctcgggaaaaattccttgaaaacatgatgcgttatggtaatactagtgctgctagtatcccaatcctcttgtcagaggctgttcaaaagggacagattaggttagatggtacccaaaaaatcttactttccggttttggtggaggtttgacatggggaagtctaattgttagaatc

SEQ ID NO: 5184 - protein, 324 aa, Streptococcus pyogenes
MIFSKISQVAHYVPQQLVTNNDLASIMDTSHEWIFSRTGIAERHISRDEMTSDLAIQVADQLLTQSGLKADAIDFIIVATISPDATMPSTAAKVQAAIAATSAFAFDMTAACSGFVFALAMADKLIASGAYQNGMVIGAETLSKLVNWQDRATAVLFGDGAGGVLLEASKDKHVLAETLHTDGARCQSLISGETSLSSPYSIGKKAIATIQMDGRAIFDFAIRDVSKSILTLMAQSDITKDDIDYCLLHQANRRILDKIARKIDVPREKFLENMMRYGNTSAASIPILLSEAVQKGQIRLDGTQKILLSGFGGGLTWGSLIVRI

SEQ ID NO: 5185 - DNA, 270 bp, Streptococcus agalactiae
gtgcatagcacatttataaaagattatttaaaatttaaggagctaaaaatggcagtatttgaaaaagtacaagaaattattgttgaagaacttggtaaagatgcagaagaagtaacgttgaacactacttttgacgatcttgatgctgattcgcttgatgttttccaagtgatttcagaaattgaagatgcatttgatatccaaattgagacagaagaaggactaaatactgttggtgatttagttgcttatgttgaagaaaaagtaaaa

SEQ ID NO: 5186 - protein, 90 aa, Streptococcus agalactiae
MHSTFIKDYLKFKELKMAVFEKVQEIIVEELGKDAEEVTLNTTFDDLDADSLDVFQVISEIEDAFDIQIETEEGLNTVGDLVAYVEEKVK

SEQ ID NO: 5187 - DNA, 222 bp, Streptococcus pyogenes
atggcagtatttgaaaaagtacaagaaattattgttgaagaacttggtaaggagacagaagaagtaacactagaaactacatttgatgatttagatgcagattcacttgatgttttccaagttatttcagaaattgaagatgcttttgatattcaaattgaaacagaagaaggattaaatactgttggtgaccttgttgcttacgttgaagaaaagtcaaaa

SEQ ID NO: 5188 - protein, 74 aa, Streptococcus pyogenes
MAVFEKVQEIIVEELGKETEEVTLETTFDDLDADSLDVFQVISEIEDAFDIQIETEEGLNTVGDLVAYVEEKSK

SEQ ID NO: 5189 - DNA, 957 bp, Streptococcus agalactiae
atgaaaacacgtataacagaattactaaatataaaatatccaatttttcaagggggtatggcgtgggtcgctgatggagatcttgcaggagcagtttctaaggcaggtggtctaggtattattggtggaggaaatgcccctaaagaggttgtcaaagcaaatattgataaaataaaatctatgactgataaaccctttggtgtgaatattatgcttttatcaccttttgtagatgatattgttgatttggttattgaagaaggtgtaaaagttgtaacgacgggtgcaggtaatcctggtaagtacatggagcgctttcatgaagcaggtataacagtaatccctgttgttcctagtgttgcattagcaaaacgtatggagaaattaggggctgatgctatcattacagaaggaatggaagcgggtggtcacatcggaaaactgaccacgatgacattagtacgacaggttgttgatgctgttacaattccagtcattgccgcaggtggtatagcagatgggcgtggggctgctgcgggtttcatgttaggagctgatgctgttcaggtaggaactcgttttgttgttgctaaagaatctaatgctcaccctaattacaaagcaaaaatcttaaaagcaaaagatatcgacactgctgtttctgctcaggtagtaggtcatccagttcgtgccttaaaaaataaactagtaacaacctatagccaagcagaaaaagattatttagctggccgtatttcaatcaatgagattgaagaattaggagcgggagctcttcgcaatgcagttgttgatggggatgttattaatggttcagttatggcaggacaaattgcaggattaattaaatcagaagagacttgtcaagagattcttgaagatatttattcaggagcgcgtcaagttattctttctgaggcaagccgctggtcagattta

SEQ ID NO: 5190 - protein, 319 aa, Streptococcus agalactiae
MKTRITELLNIKYPIFQGGMAWVADGDLAGAVSKAGGLGIIGGGNAPKEVVKANIDKIKSMTDKPFGVNIMLLSPFVDDIVDLVIEEGVKVVTTGAGNPGKYMERFHEAGITVIPVVPSVALAKRMEKLGADAIITEGMEAGGHIGKLTTMTLVRQVVDAVTIPVIAAGGIADGRGAAAGFMLGADAVQVGTRFVVAKESNAHPNYKAKILKAKDIDTAVSAQVVGHPVRALKNKLVTTYSQAEKDYLAGRISINEIEELGAGALRNAVVDGDVINGSVMAGQIAGLIKSEETCQEILEDIYSGARQVILSEASRWSDL

SEQ ID NO: 5191 - DNA, 969 bp, Streptococcus pyogenes
atgaaaacacgtattacagaattacttaatattgattaccccatttttcaaggaggaatggcttgggttgctgatggtgatttagcaggtgcagtttctaatgctggtggtttaggcattataggtggtggcaatgctcccaaagaagtcgttaaagctaatattgatcgtgtcaaagctattactgatagaccttttggggttaatatcatgcttttatctccttttgctgatgatatcgttgatctggtcattgaagaaggtgttaaagtagtaacaacaggcgcaggaaatccaggaaagtatatggaaagactgcaccaggcgggtataatcgttgttcctgttgtcccaagcgttgcgctagccaaacgtatggaaaagcttggggtagatgctgttattgctgagggtatggaagctggaggacatattggcaagttaacgactatgtctttagtaagacaagttgttgaagcggtttcgattcctgtcattgcggcaggtggtatagctgatggtcatggtgcagcagcagcatttatgttaggagcagaggctgttcaaattggaactcgctttgttgttgctaaagaatccaatgctcaccaaaattttaaagataaaatcttagcagcaaaagatattgatacggtgatttctgcgcaggttgtgggccaccctgtccgttctattaaaaataaattgacctcagcttacgctaaagcagaaaaagcatttttaattggtcaaaaaacagctactgatattgaagaaatgggagcaggatcgcttcgacacgctgttattgaaggcgatgtagtcaatggatctgttatggctggccaaattgcagggcttgtgagaaaagaagaaagctgtgaaacgattttaaaagatatttattatggtgcagctcgtgttattcaaaatgaagctaagcgctggcaatctgtttcaatagaaaag

SEQ ID NO: 5192 - protein, 323 aa, Streptococcus pyogenes
MKTRITELLNIDYPIFQGGMAWVADGDLAGAVSNAGGLGIIGGGNAPKEVVKANIDRVKAITDRPFGVNIMLLSPFADDIVDLVIEEGVKVVTTGAGNPGKYMERLHQAGIIVVPVVPSVALAKRMEKLGVDAVIAEGMEAGGHIGKLTTMSLVRQVVEAVSIPVIAAGGIADGHGAAAAFMLGAEAVQIGTRFVVAKESNAHQNFKDKILAAKDIDTVISAQVVGHPVRSIKNKLTSAYAKAEKAFLIGQKTATDIEEMGAGSLRHAVIEGDVVNGSVMAGQIAGLVRKEESCETILKDIYYGAARVIQNEAKRWQSVSIEK

SEQ ID NO: 5193 - DNA, 924 bp, Streptococcus agalactiae
atgaataaagtttcatttctatttgctggtcaaggtgctcaaaagttaggaatggctagagatttatatgaaactttcccgattgttaaagaaacttttgataaggcaagtcatgttttaggatatgatttgagagaattgattgataaagacttagacaaattaaatcagacgaaatatacgcaaccagctattctaacgacttcgactgctatttatcgtttaattcttaaagaaattgaacttagaccagatatggttgcaggactttctttgggagaatacagtgctttagttgcttcaggtgctataagatttgaagatgctgtagtacttgttgctagacgaggccaactaatggaagcagcagcacctgctggtagtggcaaaatggtagcagttttaaatgctgatcgtcaaataattgaagatgcttgtaagaaggcttctcagtttggtattgttagtcctgcaaattataatactccaaagcaaattgttatagggggagagtcaatcgctgtaaatgcagctgtagaagaattaaaacaacaaggagtaaaacgtttaattcctctgaatgtttcaggtccttttcacactgctttattgaaacctgcaagtcagaaattgagcgatgttttagataaagttcatttttcagtttctgaaatccctgtaattggaaatacagaggcgcagataatgaaaaaagacgatatcaaatctttattggcacgccaagttatggaacctgtacgctttgatgagtctattgaaaccatgaaaaaaatgggaatgacacaggttgttgaaattggtccagggaaggtactctcaggtttcttgaaaaaaatagatagctcattatcagtacattctgttgaagataaaattggatttaataatcttaaggaattaaac

SEQ ID NO: 5194 - protein, 308 aa, Streptococcus agalactiae
MNKVSFLFAGQGAQKLGMARDLYETFPIVKETFDKASHVLGYDLRELIDKDLDKLNQTKYTQPAILTTSTAIYRLILKEIELRPDMVAGLSLGEYSALVASGAIRFEDAVVLVARRGQLMEAAAPAGSGKMVAVLNADRQIIEDACKKASQFGIVSPANYNTPKQIVIGGESIAVNAAVEELKQQGVKRLIPLNVSGPFHTALLKPASQKLSDVLDKVHFSVSEIPVIGNTEAQIMKKDDIKSLLARQVMEPVRFDESIETMKKMGMTQVVEIGPGKVLSGFLKKIDSSLSVHSVEDKIGFNNLKELN

SEQ ID NO: 5195 - DNA, 942 bp, Streptococcus pyogenes
atgataatgacaaagacagcctttttatttgccggtcaaggtgctcaaaaattagggatggcaagggatttttatgataactttgctattgtaagaaaaacctttgatcaagctagtcaagtattgggatacgatttgcgccgtttgattgatagtgacgagttaaaacttaatcaaactagctatacgcaaccagctattttgacatcatcaattgctatttaccgtgttttgggcttacatcacgttaaaccggatatggtagctggtctttccttaggagaatactcagctttggtagcatcaggggcactctcttttgaagataccctatccttagtagctaagagaggccgcttgatggaggaagcagcaccacaaggatctggaaagatggttgccgttatgaatacagacgtgcaagtcatcgaagaagtctgtcaaatagctgctaaacatggagtggttgctccagcaaactataatactcctagtcaaattgtaattggtggtcagacagatgctgtgaacgtggcagttgaacttttaaaggaaaggggagttaagcgtttaatccctttaaacgtgtcaggtcctttccacactgctttgttagaaccagctagccgcttgttggctaaagagttggaaagatacaacttcagtgacttcaagattcctttggttggtaataccgaagctaatattatggaaaaagaccgtatcccagaactattagcccgtcaagtcatggagcctgttcgtttttatgacagtgttgcgactttagtagaaagtggcataacacaattcattgaggtaggaccaggtaaggttttgacaggttttgtgaagaaaattgataaaaatttactatgtactagtgttgaaaacatggtaagcttacgtttatttttagatagagaggacattcatggaaat

SEQ ID NO: 5196 - protein, 314 aa, Streptococcus pyogenes
MIMTKTAFLFAGQGAQKLGMARDFYDNFAIVRKTFDQASQVLGYDLRRLIDSDELKLNQTSYTQPAILTSSIAIYRVLGLHHVKPDMVAGLSLGEYSALVASGALSFEDTLSLVAKRGRLMEEAAPQGSGKMVAVMNTDVQVIEEVCQIAAKHGVVAPANYNTPSQIVIGGQTDAVNVAVELLKERGVKRLIPLNVSGPFHTALLEPASRLLAKELERYNFSDFKIPLVGNTEANIMEKDRIPELLARQVMEPVRFYDSVATLVESGITQFIEVGPGKVLTGFVKKIDKNLLCTSVENMVSLRLFLDREDIHGN

SEQ ID NO: 5197 - DNA, 732 bp, Streptococcus agalactiae
atgcaattaaaagataagaacatttttattacgggttcaagtagaggaatcggccttgcaattgcccatcaatttgcacaattaggtgctaatattgttttaaatggacgttctgaaatatcagaagacttaatagctgaatttgctgattatggtgtaaaagttattgctatttcaggagatgtttcttcttttgaagatgctaatcgcatgattaaagaagctattgcaagtctaggtagcgtggatgtgctcgttaacaacgctggtattactaatgataaattgatgcttaaaatgactgttgaagattttgagagcgttcttaaaattaatttaacaggtgcatttaatatgacacaatcagtcttgaaaccgatgacaaaagcgcgtcaaggtgctattattaatatctctagcgtcgttggattaactggaaatgtagggcaagctaattacgcagcctctaaagcaggtttaattggctttacaaaatcagttgccagagaagtagcagcacgaggcattcgtgtcaatgccattgctccaggctttatcgaatctgatatgacagatgttatcccagaaaaaatgcaagaagctattttagctcaaattccaatgaaacgtattggaaaaggtaaagaagtagcgcaggtagcgtctttcttagcagaacaagaataccttacaggacaagttattgccattgatggcggtatgacgatgcaa

SEQ ID NO: 5198 - protein, 244 aa, Streptococcus agalactiae
MQLKDKNIFITGSSRGIGLAIAHQFAQLGANIVLNGRSEISEDLIAEFADYGVKVIAISGDVSSFEDANRMIKEAIASLGSVDVLVNNAGITNDKLMLKMTVEDFESVLKINLTGAFNMTQSVLKPMTKARQGAIINISSVVGLTGNVGQANYAASKAGLIGFTKSVAREVAARGIRVNAIAPGFIESDMTDVIPEKMQEAILAQIPMKRIGKGKEVAQVASFLAEQEYLTGQVIAIDGGMTMQ

SEQ ID NO: 5199 - DNA, 1230 bp, Streptococcus agalactiae
atgacattacagcgagtagtagtaacaggttacggtgtaacctcacctattggaaacacaccagaagaattttggaatagtcttaaagaaggaaatgttggtattggacctatcactaaatttgattcaagtgatttcatggtcaaaaatgctgctgaaattcatgattttccatttgataaatattttgtcaaaaaagatctgaacagatttgatatgtattccctttatgccttatatgcttcaagtgaagctattcaacatgctaatttaaatttagatgaaattgatgcagatcgatttggtgtcatcgttgcatcaggtattggagggattcaagagattgaagaacaagtgattcgtcttcatgaaaaagggccaaaacgcgtaaaaccaatgacgcttccaaaagctctaccaaatatggcagctggaaatgttgcgatgaggttaggcgctcatggtgtatgtaaatcaattaatacagcttgtgcttcttctaatgatgctattggagatgctttccgtaatataaaatttggtattcaagatattatggtagtcggtggtgcagaagctgctattacaaaatttgccattgctggattccaaagtcttacagcattatcaacaactgaagatccatcaagagcatctattccatttgataaagatcgcaatggatttatcatgggagaaggttctggaatgttggtcttagaaagtttagaacacgctgaaaaacgaggagctactattcttgcagaagttgttggttatggtaacacttgtgacgcatatcatatgacttcaccacatccagaaggtttaggagccactaaagctattcaacttgcactggttgaagctaatattaaacctgaagaagttaactatgtaaatgctcatggaacttcaacacctgctaacgaaaaaggagagagtcaagctattgttgctgcacttgggacagacgttccagtttcttcgactaaatcttttactggtcatcttttgggtgccgcgggagctgttgaggcaattgcaactattgaagcgatacgtcatagttatgttccaatgactgctggaacgacagaattatcagaagatattacagcgaatgttatttttggtcaagggcaagacgctgatattcgttatgccatttcaaatacatttggttttggaggacacaatgcagttctggccttcaaacgctgggaggat

SEQ ID NO: 5200 - protein, 410 aa, Streptococcus agalactiae
MTLQRVVVTGYGVTSPIGNTPEEFWNSLKEGNVGIGPITKFDSSDFMVKNAAEIHDFPFDKYFVKKDLNRFDMYSLYALYASSEAIQHANLNLDEIDADRFGVIVASGIGGIQEIEEQVIRLHEKGPKRVKPMTLPKALPNMAAGNVAMRLGAHGVCKSINTACASSNDAIGDAFRNIKFGIQDIMVVGGAEAAITKFAIAGFQSLTALSTTEDPSRASIPFDKDRNGFIMGEGSGMLVLESLEHAEKRGATILAEVVGYGNTCDAYHMTSPHPEGLGATKAIQLALVEANIKPEEVNYVNAHGTSTPANEKGESQAIVAALGTDVPVSSTKSFTGHLLGAAGAVEAIATIEAIRHSYVPMTAGTTELSEDITANVIFGQGQDADIRYAISNTFGFGGHNAVLAFKRWED

SEQ ID NO: 5201 - DNA, 552 bp, Streptococcus agalactiae
ttggttttggaggacacaatgcagttctggccttcaaacgctgggaggattaaattggatattcaagagattaaggatttaatgactcaatttgatgagtcaagtctgagagaattttcattcaaaacaagtgacggtgagctgtcttttagtaaaaatgagggaaaagctccacttgtcccaactatgtctcctatgagtcatcaacctgaagcgactccaactatagcaactcctgtctctaatgaagcaggtgagcaaacgaaacaagctactgaagtagtttcagaaatcccagagtcgactgtgactgttgcagaaggtgacgttgtcgaaagtcctttagttggggttgcttatttagcttctggaccagataaacctaactttgtttcagtaggtgatagcgtgaagaagggacaaactttgatgattattgaggcaatgaaggtgatgaatgaagtgcctgccccccatgatggtgtagttactgaaattcttgtagccaatgaagaagttattgaatttggtaaaggattggtacgaatcaaa

SEQ ID NO: 5202 - protein, 184 aa, Streptococcus agalactiae
MVLEDTMQFWPSNAGRIKLDIQEIKDLMTQFDESSLREFSFKTSDGELSFSKNEGKAPLVPTMSPMSHQPEATPTIATPVSNEAGEQTKQATEVVSEIPESTVTVAEGDVVESPLVGVAYLASGPDKPNFVSVGDSVKKGQTLMIIEAMKVMNEVPAPHDGVVTEILVANEEVIEFGKGLVRIK

SEQ ID NO: 5203 - DNA, 498 bp, Streptococcus pyogenes
ttgaatattcaagaaatcaaagatttgatggctcagtttgatacctcaagcctacgtgaatttttattcaaaacaaatgaaggtgagctaatctttagtaaaaacgaacaacacctcaatgcatcgacatcaaatcaagaacatgctgtgcctgtaccacaggtacaacttgttccgaatccaactgcttcggaagcgtccagtccagcatcagttaaggatgttcctgtagaggagcaaccacaagcagaatcttttgtagcagaaggtgatattgttgaaagtcctttagtcggtgtagcctatcttgcagctagccctgacaagccaccatttgtggcagtcggagatactgtaaaaaaaggacaaacccttgtgattatcgaagccatgaaggtgatgaacgaagtgccagcgccatgtgatggtgtgattacagaaattttggtatcaaatgaagatgtcattgaatttggacaaggattggtgcggatcaaa

SEQ ID NO: 5204 - protein, 166 aa, Streptococcus pyogenes
LNIQEIKDLMAQFDTSSLREFLFKTNEGELIFSKNEQHLNASTSNQEHAVPVPQVQLVPNPTASEASSPASVKDVPVEEQPQAESFVAEGDIVESPLVGVAYLAASPDKPPFVAVGDTVKKGQTLVIIEAMKVMNEVPAPCDGVITEILVSNEDVIEFGQGLVRIK

SEQ ID NO: 5205 - DNA, 420 bp, Streptococcus agalactiae
atgattgatataaaagaaattcgtgaggctttacctcaccgctatccaatgttattagtggatcgtgttttagaggtatcagaagatgagatagtcgctatcaaaaatgttagtatcaatgagccttttttcaatggtcattttccagaatatcctgtaatgccaggcgttttaattatggaagctttggctcaaactgcaggtgttttagaattatctaaagaagaaaacaaaggaaagcttgttttttatgcaggtatggataaagtgaaatttaaaaagcaagttgttccaggagatcaattagttatgactgctaagtttgtcaaacgtagaggaactatagccgttgttgaagcaatagcagaagttgatgggaaattagctgccagtggaacgttaacatttgcaataggcaat

SEQ ID NO: 5206 - protein, 140 aa, Streptococcus agalactiae
MIDIKEIREALPHRYPMLLVDRVLEVSEDEIVAIKNVSINEPFFNGHFPEYPVMPGVLIMEALAQTAGVLELSKEENKGKLVFYAGMDKVKFKKQVVPGDQLVMTAKFVKRRGTIAVVEAIAEVDGKLAASGTLTFAIGN

SEQ ID NO: 5207 - DNA, 420 bp, Streptococcus pyogenes
atgatggatattagagaaattcaagcggctttgcctcatcgctacccaatgttattggttgatcgtgtgttagaagtgtcagacgaccatatcgttgccattaaaaatgtgactattaatgagcctttctttaacgggcattttcctcactatcctgtgatgccaggtgttctgattatggaagctttggctcaaacagctggtgtcttagaattgtcaaaagaagaaaataaaggcaagttggtcttttacgctggaatggataaagtgaagttcaaaaaacaagtcgtccctggtgatcaacttgtgatgacagcaacctttatcaagcgtcgcggtaccattgctgtcgttgaagccagggcagaagttgatggcaagctagcagcaagtggaacattaacctttgcctgtgggcaa

SEQ ID NO: 5208 - protein, 140 aa, Streptococcus pyogenes
MMDIREIQAALPHRYPMLLVDRVLEVSDDHIVAIKNVTINEPFFNGHFPHYPVMPGVLIMEALAQTAGVLELSKEENKGKLVFYAGMDKVKFKKQVVPGDQLVMTATFIKRRGTIAVVEARAEVDGKLAASGTLTFACGQ

SEQ ID NO: 5209 - DNA, 1368 bp, Streptococcus agalactiae
atgtttaagaaaatattgattgctaatcgcggagaaattgcagtacgtatcattcgtgcagcccgtgaaatgggaatttcgacagttgctatctattcggaggctgacaaggaatcattgcacacaattttagcagatgaagctatttgtgttggaccagccaaatcagcagaatcttatttaaacgttaatgctatattatctgctgctattgtgactggagcggaagctgttcatccaggttttgggtttttgagtgaaaattctaaatttgctactatgtgtgaagagatgaacttaaaattcattggtccatctggagaagttatggataaaatgggtgataaaatcaatgctcgtacagagatgataaaagctgatgttccggttatcccaggatcagatggtcaagttacaagtgtagaagaagctgtatcaattgctgaggaaatcggctatccattgatgttaaaagcctcagccggtggcggtggaaaaggaattaggaaggtcaaatcagcagatgaattgaagcctgcttttgagtctgcttcacaggaggctttggctgcgttcggtaatggtgctatgtatattgaaaaagttatatacccagctagacatattgaagtacaaatacttggagatagctttggtaagatagttcacctaggagaacgtgattgttctctgcagcgtaacaatcagaaggtattggaagaaagtccgtctgtggcaataggtaacactctgcgtcaacaaattggtgaagcagctgttcgtgcagctgaggctgtatcttatgaaaatgcaggaacaattgagtttttgttagatgagaatagcggacagttctatttcatggaaatgaatactcgtgttcaagtagaacaccctgttacagaatttgtaacgggtgttgacatcgttaaagagcagattcgtatcgctgctggaattcctttatcagtttctcaaaatgatattaagttaactggtcatgcgattgaatgtcgtattaacgcagagaatccacaatttaattttgcgccatgtccaggtaccattaatgggttacatctacctgctggcggtatgggcttacgtgtcgattcagcggtttacacaggctacactattcctccttattacgatagtatgattgcgaaagtaattgttcacggagaaaatcgttttgatgcacttatgaaaatgcaacgtgccttatatgagcttgaaattgatggtattgtaacaaatacagaatttcaaatggatctcatttctgataaaaaagtcttggctggggattatgatacttcattcctgatggaagactttttaccaaggtattatggtaacaatcaa

SEQ ID NO: 5210 - protein, 456 aa, Streptococcus agalactiae
MFKKILIANRGEIAVRIIRAAREMGISTVAIYSEADKESLHTILADEAICVGPAKSAESYLNVNAILSAAIVTGAEAVHPGFGFLSENSKFATMCEEMNLKFIGPSGEVMDKMGDKINARTEMIKADVPVIPGSDGQVTSVEEAVSIAEEIGYPLMLKASAGGGGKGIRKVKSADELKPAFESASQEALAAFGNGAMYIEKVIYPARHIEVQILGDSFGKIVHLGERDCSLQRNNQKVLEESPSVAIGNTLRQQIGEAAVRAAEAVSYENAGTIEFLLDENSGQFYFMEMNTRVQVEHPVTEFVTGVDIVKEQIRIAAGIPLSVSQNDIKLTGHAIECRINAENPQFNFAPCPGTINGLHLPAGGMGLRVDSAVYTGYTIPPYYDSMIAKVIVHGENRFDALMKMQRALYELEIDGIVTNTEFQMDLISDKKVLAGDYDTSFLMEDFLPRYYGNNQ

SEQ ID NO: 5211 - DNA, 1410 bp, Streptococcus pyogenes
ttgcctgtgggcaatgagaatgattgttctgcggaggaagaaacccttatgtttaaaaaaatcttaattgctaatcgtggtgaaattgcagtgcgtatcattcgtgctgcacgagaattagggatttccacagttgcagtttattcggaagcggataaggaagctctgcacacgatcttggcggacgaggctatctgtattggtcctgcccgttccaaggaatcctatcttaatatgaattccgtcttgtcagcagctattgtgacaggagcccaagcgattcacccagggtttggctttttaagtgaaaactcaaagtttgcgaccatgtgtgaagagatgaatattaaatttatcggtccatccgcatcggttatggataaaatgggtgataaaatcaatgctcgttctgaaatgattaaggcaggagtgcccgttattccagggtcagatggtgaagtttataacgctcaagaagccttagctattgccaataagattggttatcctgtcatgctaaaagcatcggcaggtggtggaggtaaagggattcgtaaagtggagacagaagcagatttggaggcggctttcaatgctgccagtcaagaagctttgggagctttcggaaatggcgccatgtatttggaaaaagtaatttatccagctagacatattgaggtgcaaattttaggagacgcttacggtaacatcattcacttgggagaacgggattgctccttgcaacggaataatcaaaaagtcttggaagaaagtccatccattgctattggcaataccctcagacacgaaatggggcaagcagcggttagagcagctgaagctgtagcctatgaaaatgcgggaaccattgagtttttgttggacgaagacagcgagaaattctatttcatggaaatgaatacccgtatccaagttgagcatcctgtcaccgaatttgtgacaggagtggatattgtcaaagagcaaatcaaaattgcagcaggtcagcctttggcgattaatcaagaagacatcactatcacgggacatgctattgaatgtcgtatcaatgctgaaaatactgcttttaactttgcaccgagtccaggaaagattacagacttgtatatgccaagtggtggtgtaggactacgagttgattcagcagtttacaatggctatgccattcctccttattatgacagcatgattgctaaaatcatcgttcatggaagcaatcgatttgacgctttgatgaaaatgcaacgtgccttagttgaattggaaattgaaggcattatcaccaatacagacttccagctcgatttgatttcagataagcgagtgattgcaggagattatgatacctctttcttgatggaaacgttcctgccacattacaataaagat

SEQ ID NO: 5212 - protein, 470 aa, Streptococcus pyogenes
LPVGNENDCSAEEETLMFKKILIANRGEIAVRIIRAARELGISTVAVYSEADKEALHTILADEAICIGPARSKESYLNMNSVLSAAIVTGAQAIHPGFGFLSENSKFATMCEEMNIKFIGPSASVMDKMGDKINARSEMIKAGVPVIPGSDGEVYNAQEALAIANKIGYPVMLKASAGGGGKGIRKVETEADLEAAFNAASQEALGAFGNGAMYLEKVIYPARHIEVQILGDAYGNIIHLGERDCSLQRNNQKVLEESPSIAIGNTLRHEMGQAAVRAAEAVAYENAGTIEFLLDEDSEKFYFMEMNTRIQVEHPVTEFVTGVDIVKEQIKIAAGQPLAINQEDITITGHAIECRINAENTAFNFAPSPGKITDLYMPSGGVGLRVDSAVYNGYAIPPYYDSMIAKIIVHGSNRFDALMKMQRALVELEIEGIITNTDFQLDLISDKRVIAGDYDTSFLMETFLPHYNKD

SEQ ID NO: 5213 - DNA, 873 bp, Streptococcus agalactiae
atggctttatttagtaaaaaggataaatatatccgtattagtccaaacaaagcattagggtcttctgataaacgtagtcttcctgaggttcctgatgaactctttgctaagtgtccttcttgtaaacatatgatttatcagaaagatttaggattagcaaagatttgtccagcttgttcttacaactttagaatttcagcgcaagaacgtctgttgctaacagttgacgaagatagttttgaggaattatttacaggaattgaaactaaggatcctttgaattttccaaactaccgtgaaaaactggctgctacacgtcaaaagactaacttagatgaagcggtggtgacaggtttagctaaaataaaaggacaaactacggccttagctattatggattctcattttataatggcgtctatgggaacggtcgtaggcgaaaagttgacaagattatttgagctagcaactgaaaagaaattacctattgttatttttacagcgtcagggggcgccagaatgcaagaaggtattatgagtttgatgcaaatggcaaaagtatcggcagcagttaaacgccattctaaccagggattgttttatttaacaattttaacagacccaacaaccggcggcgttactgcgagttttgctatggaaggtgatattattctggctgagccacaagcgttggttggttttgctggtcgtcgtgttatcgaaacaacagtgagagaagatttacctgaaggctttcaaaaggcagagtttttgttagaacatggttttgtcgatgctattataaatcgaacagaattacgcgactgcattgctcaactaattgctttccatggaaatgaggttggtcatgaa

SEQ ID NO: 5214 - protein, 291 aa, Streptococcus agalactiae
MALFSKKDKYIRISPNKALGSSDKRSLPEVPDELFAKCPSCKHMIYQKDLGLAKICPACSYNFRISAQERLLLTVDEDSFEELFTGIETKDPLNFPNYREKLAATRQKTNLDEAVVTGLAKIKGQTTALAIMDSHFIMASMGTVVGEKLTRLFELATEKKLPIVIFTASGGARMQEGIMSLMQMAKVSAAVKRHSNQGLFYLTILTDPTTGGVTASFAMEGDIILAEPQALVGFAGRRVIETTVREDLPEGFQKAEFLLEHGFVDAIINRTELRDCIAQLIAFHGNEVGHE

SEQ ID NO: 5215 - DNA, 864 bp, Streptococcus pyogenes
atggctttatttcgtaaaaaagataaatacatccgtattactcccaataattccctcaaaggatctgtcagccataatgtcccagaagttccagatgaactctttgcgaaatgcccagcttgtaagcacatgatttataagaaagatttgggattggcaaagatttgcccaacctgttcttacaattttaggatttctgcccaagagcggctgaccttaacagttgatgaaggctctttccaagaattatttacaagtattgaaaccaaggatccgttacgttttccaggttatcaggaaaaattacaaaaagccaaggaaacgacaggtctgcatgaagctgttttgacagggaaagctatggttaaggagcaaaagattgctcttgctattatggattctcactttattatggctagtatgggaactgttgttggggaaaaaattacccgattgtttgaattggctatcgaagaaaacctgccggtggtgatttttacggcttcaggaggcgcccgtatgcaagagggtatcatgagcctcatgcaaatggccaaggtctctgcagctgtgaaaagacattctaatgcaggcctcttttacctcactattttgacagatccaactactggtggggtaacagctagttttgccatggaaggggatattattttggcagaacctcaatccttggttggctttgcaggtcgtcgtgtcattgagaccacagttcgtgaaaacttgccagatgatttccaaaaagcagaatttttacaagaccatggttttgtggatgctattgtgaaacgaacagagttgcgagacaagattgcccacttagtagcatttcatggaggtggccaa

SEQ ID NO: 5216 - protein, 288 aa, Streptococcus pyogenes
MALFRKKDKYIRITPNNSLKGSVSHNVPEVPDELFAKCPACKHMIYKKDLGLAKICPTCSYNFRISAQERLTLTVDEGSFQELFTSIETKDPLRFPGYQEKLQKAKETTGLHEAVLTGKAMVKEQKIALAIMDSHFIMASMGTVVGEKITRLFELAIEENLPVVIFTASGGARMQEGIMSLMQMAKVSAAVKRHSNAGLFYLTILTDPTTGGVTASFAMEGDIILAEPQSLVGFAGRRVIETTVRENLPDDFQKAEFLQDHGFVDAIVKRTELRDKIAHLVAFHGGGQ

SEQ ID NO: 5217 - DNA, 798 bp, Streptococcus agalactiae
ttgctttccatggaaatgaggttggtcatgaataatgatgtgacaagaattttaaaagatgcgcgtgatcaagggaggctaactgctcttgactacgctgaattgatttttgataattttatggaacttcatggtgatcgccagttcgcagatgacaaatcaattataggaggtttggggtacttggcagggcgtcctgtgacgattgtcggtattcaaaaaggtaagaaccttcaagataatttagaccgtcattttggtcaaccacatcctgaaggttatcgtaaggctttacgtttaatgaaacaagctgagaagtttggaagacctgttataaccttcatcaatactgctggagcatatcctggggtaggtgctgaggagcgaggtcagggtgaagcaattgctagaaacctcttagaaatgagtgatttaaaagtccctattatagctattattattggtgaagggggttctggaggagcattagctttagctgttgccgataaggtttggatgttggaacatactgtttattctattttaagtcctgagggctttgcctctattttatggaaagatggtacaagaacaacagaagcagcacaattaatgaagatgactgctggagaactttaccatatggaagttgtagacaaagtaatccctgaacatggttatttttcaagtgagattgtcgatatgattaagacaagtttaatttcagagttagaagtgctctcacaattatctcttgaggatttattggaacaacgttaccaacgttttagaaaatat

SEQ ID NO: 5218 - protein, 266 aa, Streptococcus agalactiae
MLSMEMRLVMNNDVTRILKDARDQGRLTALDYAELIFDNFMELHGDRQFADDKSIIGGLGYLAGRPVTIVGIQKGKNLQDNLDRHFGQPHPEGYRKALRLMKQAEKFGRPVITFINTAGAYPGVGAEERGQGEAIARNLLEMSDLKVPIIAIIIGEGGSGGALALAVADKVWMLEHTVYSILSPEGFASILWKDGTRTTEAAQLMKMTAGELYHMEVVDKVIPEHGYFSSEIVDMIKTSLISELEVLSQLSLEDLLEQRYQRFRKY

SEQ ID NO: 5219 - DNA, 768 bp, Streptococcus pyogenes
atgacagatgtatcaagaattttaaaagaagcgcgtgatcaagggcgtttaacaactttggattacgccaaccttattttcgatgactttatggaactgcatggcgatcgccatttttcagatgatggtgccattgtaggtggcctagcttatttggcgggacaacctgttacggtcattggtattcaaaaaggtaagaatttacaggataatttggcaaggaattttggccagcccaatccagaaggttatcgtaaagctttgcgccttatgaaacaggcagaaaaatttggacgaccagttgttacgtttatcaatactgcaggagcctatccaggtgtcggtgcggaagaacgaggacagggtgaggccattgctaaaaatttgatggaaatgagtgatctcaaggttcccattatcgccatcattattggtgaaggaggctctggtggtgcattagccttagcggttgccgatcaggtctggatgcttgaaaatactatgtatgcggttcttagcccagaaggctttgcttctattttatggaaggatggttcaagggcgaccgaggccgctgaattgatgaaaatcacagcgggtgaactctacaaaatgggaatagtagaccgtattattccagaacatggttatttttcaagtgaaatcgttgacatcatcaaagctaacctcatcgaacaaataaccagtttgcaagctaagccattagaccaattattagatgagcgctaccaacgctttcgtaaatat

SEQ ID NO: 5220 - protein, 256 aa, Streptococcus pyogenes
MTDVSRILKEARDQGRLTTLDYANLIFDDFMELHGDRHFSDDGAIVGGLAYLAGQPVTVIGIQKGKNLQDNLARNFGQPNPEGYRKALRLMKQAEKFGRPVVTFINTAGAYPGVGAEERGQGEAIAKNLMEMSDLKVPIIAIIIGEGGSGGALALAVADQVWMLENTMYAVLSPEGFASILWKDGSRATEAAELMKITAGELYKMGIVDRIIPEHGYFSSEIVDIIKANLIEQITSLQAKPLDQLLDERYQRFRKY

SEQ ID NO: 5221 - DNA, 651 bp, Streptococcus agalactiae
ttgtttacatggagaaaaagaatgtatcaagaattaaatgattatttagaattccaatcaatgaagtatattatgcctgagaaggcaggcgctttaaaggacgatatgcaaacttttaaggcaaagggccaacttgctaggaatagctttacagagttatcaagagccttagaacaacgtatggatggctttaaaatgcaaagagtgagtaattgggctaatcaagctcaagtagggcgtccacatttttgggtttattatcgaaaggatacagaccaattagatgatgtggctgttgcgctaagggtttatggtgtaaaagatagttttggggttagccttgaggtaagctttgtagagaggcaaaaatctgataagacactcgagaagcaggctagagtgttatcgattccgattgcctctccattgtattttatggtccaaaggcaaggtgaaactcatcgagaagaaggcaatgaggaaaatcgtcaacgtttaatgcaagaaattaagtcagggaaggtaaggaaagtattggtaaaatatgacgttcttttgactgaaaaccagagcttagaaaatattctgcaacgattgttagaaggctttgagaaagtgttaccttactatcaagtttgtcaaactattagc

SEQ ID NO: 5222 - protein, 217 aa, Streptococcus agalactiae
MFTWRKRMYQELNDYLEFQSMKYIMPEKAGALKDDMQTFKAKGQLARNSFTELSRALEQRMDGFKMQRVSNWANQAQVGRPHFWVYYRKDTDQLDDVAVALRVYGVKDSFGVSLEVSFVERQKSDKTLEKQARVLSIPIASPLYFMVQRQGETHREEGNEENRQRLMQEIKSGKVRKVLVKYDVLLTENQSLENILQRLLEGFEKVLPYYQVCQTIS

SEQ ID NO: 5223 - DNA, 1275 bp, Streptococcus agalactiae
atgttagacttaaaacgtattcgtacagattttgatgttgtcgctaaaaaattggccacgcgtggtgttgaccaagaaacattaacaacccttaaagaacttgatataaaacgccgtgaactacttatcaaagctgaagaggcgaaagcgcaacgtaatgttgcttctgctgccattgctcaagcaaaacgaaataaagagaatgcagacgagcaaatcgcagctatgcaaacactttccgctgatatcaaagcaattgatgcggaattggcagatgtggatgctaatttacaatcaatggtgaccgtacttcctaatacaccagctgatgatgtgccgcttggagcagacgaggatgaaaatgttgaagttcgtcgctggggaactcctcgtgaatttgattttgagaccaaagctcactgggatttaggtgaaagccttggaattctcgattgggaacgtggtgcaaaagttactggctctcgcttcctcttctacaaaggtctaggtgctcgtttagagcgtgctatctacagcttcatgctggatgaacacgctaaggaggggtacactgaagtgatccctccttatatggttaaccacgattcaatgttcggtacgggacaatatccaaagttcaaggaagatactttcgaattagcagatagcccattcgtacttatcccaacagctgaagttcctttaacaaactattatcgtgatgaaattatcgatgggaaagaattacctatatactttactgccatgagtccatcattccgttcagaagcaggctctgcaggacgtgacacacgtggattaattcgccttcatcaattccataaagtagaaatggtgaaatttgccaagcctgaggaatcataccaagaattagaaaaaatgacagcaaatgctgaaaatattcttcaaaaacttaatctcccataccgtgtcattaccttgtgtacaggagatatgggattctcagcagctaaaacgtatgacttagaggtatggattcccgctcaaaatacttatcgagaaatttcttcatgttctaatactgaagatttccaagcacgtcgtgctcaaattcgttaccgtgacgaagttgatggcaaagttaggttgcttcatactttaaatggttcaggacttgcagttggacgtactgtagcagcaatcctcgaaaattatcaaaatgaagatggttctgtgactatcccagaagttcttcgtccatatatgggtaatatcgatattattaaaccaaat

SEQ ID NO: 5224 - protein, 425 aa, Streptococcus agalactiae
MLDLKRIRTDFDVVAKKLATRGVDQETLTTLKELDIKRRELLIKAEEAKAQRNVASAAIAQAKRNKENADEQIAAMQTLSADIKAIDAELADVDANLQSMVTVLPNTPADDVPLGADEDENVEVRRWGTPREFDFETKAHWDLGESLGILDWERGAKVTGSRFLFYKGLGARLERAIYSFMLDEHAKEGYTEVIPPYMVNHDSMFGTGQYPKFKEDTFELADSPFVLIPTAEVPLTNYYRDEIIDGKELPIYFTAMSPSFRSEAGSAGRDTRGLIRLHQFHKVEMVKFAKPEESYQELEKMTANAENILQKLNLPYRVITLCTGDMGFSAAKTYDLEVWIPAQNTYREISSCSNTEDFQARRAQIRYRDEVDGKVRLLHTLNGSGLAVGRTVAAILENYQNEDGSVTIPEVLRPYMGNIDIIKPN

SEQ ID NO: 5225 - DNA, 1275 bp, Streptococcus pyogenes
atgctagatcttaaacgtatccgtaccgattttgacactgtcgctgccaaattaaaaaaccgcggtgtttctgaagacaccctgacccatcttaaagaacttgatgaaaaacgtcgtgctctattagtgcaatcagaagaattaaaagcagagcgtaatattgcttctgcagccatcgcccaagcaaaacgtcaaaaagaagatgccactcaacaaattgccgatatgcaaaaagtctctgcagatatcaaaactattgacaatcaactagtagctatcgaccagcaagttactgacatcatcactgttttacctaatactcctcacgattctgtccctgttggagctgacgaagaagacaatgtcgaaattcgccgttggggaacgcctcgtgactttgacttcgaagttaaggctcattgggatctaggcgaagatcttgatattttagactgggaacgtggggcaaaggtaactggtgctcgtttcttattctataaaaatcttggtgctcgtttggagcgtgctctttataacttcatgctggatgaacatatcaaagaaggttatcaagaaatcatcacaccttacatggttaaccacgattccatgtttggtacaggacaatatccaaaattcaaagaggacacctttgaattagctgataccaactttgtcctgattccaactgctgaagtgcctttgaccaattattaccgtggggaaatcctagacggcaaagaattgccaatttactttactgcaatgagcccatcttttcgttctgaagcgggttctgcgggtcgtgacacacgtggccttatccgcctacaccaattccacaaagttgaaatggttaaatttgctaaaccagaagaatcttaccaagaactagaaaaaatgactgctaatgctgaaaatattcttcaaaaacttggtttgccatatcgcgtcatttccctttgtactggagacatgggcttctcagctgctaaaacctatgaccttgaagtctggattccagctcaaaatacctatcgtgaaatttcatcatgttcaaatacagaagatttccaagcacgtcgtgctcaaatccgttaccgtgatgaggctgacggtaaggtcaaacttctccacacccttaatgggtcaggacttgctgtcggtcgtaccgtagcagccattttagaaaactaccaaaatgaagatggttctgttaccatccctgaagtactccgcccttacatgggtggcgaaaccgtcatttcacctaaa

SEQ ID NO: 5226 - protein, 425 aa, Streptococcus pyogenes
MLDLKRIRTDFDTVAAKLKNRGVSEDTLTHLKELDEKRRALLVQSEELKAERNIASAAIAQAKRQKEDATQQIADMQKVSADIKTIDNQLVAIDQQVTDIITVLPNTPHDSVPVGADEEDNVEIRRWGTPRDFDFEVKAHWDLGEDLDILDWERGAKVTGARFLFYKNLGARLERALYNFMLDEHIKEGYQEIITPYMVNHDSMFGTGQYPKFKEDTFELADTNFVLIPTAEVPLTNYYRGEILDGKELPIYFTAMSPSFRSEAGSAGRDTRGLIRLHQFHKVEMVKFAKPEESYQELEKMTANAENILQKLGLPYRVISLCTGDMGFSAAKTYDLEVWIPAQNTYREISSCSNTEDFQARRAQIRYRDEADGKVKLLHTLNGSGLAVGRTVAAILENYQNEDGSVTIPEVLRPYMGGETVISPK

SEQ ID NO: 5227 - DNA, 1065 bp, Streptococcus agalactiae
atgattatggaaaagtatacaagtattaaacaatcaggtcgtcattacggcttagaccttttaaggattatttccatgttcatgattgttattacgcatgttcttggaaaaggtggtctgagatcttcggttgagggacacgcagactcctattttatagtaacgtggattatccaagtcttagtttatggggccgttaactgttacgcactaataagtggttatgtgggaattaattcgcgttatcgttactcaaaattactgtctatctgggcacaggtttttttctacacctttacaataacagcactttttgcaatcacaggtcatgaagtgaccttgcttaattggagagatgcttttttccctattgtcagtgggcagtattggtacattactgcttactttggtctattggtttttatgcctgttattaataatggattaaatgccttgactgataaacaattaaaacaattggttttgttaatgtttattattttttcaattttaccagctgttttaaataatcgtgttccagaattttcattgagcaagggttttgaaatgacttggctactgattttatatattattggtgcctatttgaaacgtattgatttaaatatatttaaaacgtcatatttacttataatttatctattatcattggttgctacttatgccatgaagtttagcgttggtgatatttggtattggtatgtttcgcctactttaactttaggggcggtaagtttgtttatattatttgctagagcaagcattaagccctcgggattcttaaagaaaataattgttgtattagccccttcaaccttgggagtttatctctgtcatctccacccactaatagtaaaatattttgtaagagattttgcagagacgtttgtttatgagtccatttatctttacccatttttaattttaggagcagggattttaatttatttgttggcttttattgtagaacgtattagattacgaatatttaaagcaatccatttttctaactttttgagatggtttgatgacaagttcccatat

SEQ ID NO: 5228 - protein, 355 aa, Streptococcus agalactiae
MIMEKYTSIKQSGRHYGLDLLRIISMFMIVITHVLGKGGLRSSVEGHADSYFIVTWIIQVLVYGAVNCYALISGYVGINSRYRYSKLLSIWAQVFFYTFTITALFAITGHEVTLLNWRDAFFPIVSGQYWYITAYFGLLVFMPVINNGLNALTDKQLKQLVLLMFIIFSILPAVLNNRVPEFSLSKGFEMTWLLILYIIGAYLKRIDLNIFKTSYLLIIYLLSLVATYAMKFSVGDIWYWYVSPTLTLGAVSLFILFARASIKPSGFLKKIIVVLAPSTLGVYLCHLHPLIVKYFVRDFAETFVYESIYLYPFLILGAGILIYLLAFIVERIRLRIFKAIHFSNFLRWFDDKFPY

SEQ ID NO: 5229 - DNA, 360 bp, Streptococcus agalactiae
atggcacaatcattaaacaaaactgttgaatttcaaacaacaggagtttcgtatttaggtatggggaataaagttggaaaatttttagttggtgaccaggcattagaattctataacgataaaaatgtcaacgactatattcaaattccatggacatcaatcaatcaaattggagctaatgttagtcgaaaaaaaattagtcgtcactttgaggtctttacagaccaaggaaaatttttattcgcctctaaagactctggaacgatattaaagcatgcgagacgacatattggagacgataaagttgttaagcttcctaccctcatccagaccattttaaaaatattcaagtttaaaaaa

SEQ ID NO: 5230 - protein, 120 aa, Streptococcus agalactiae
MAQSLNKTVEFQTTGVSYLGMGNKVGKFLVGDQALEFYNDKNVNDYIQIPWTSINQIGANVSRKKISRHFEVFTDQGKFLFASKDSGTILKHARRHIGDDKVVKLPTLIQTILKIFKFKK

SEQ ID NO: 5231 - DNA, 357 bp, Streptococcus pyogenes
atggctcaatctttaaacactagtgtcgaatacaagacaaaagctgtctcctaccttggaatgggaggcaaagttggtcatattttactcggtgacaaggcccttgaattttacaacgataaaaatgtgaatgattatattcaaattccttggacagctatcaatcacatcggggctaatgtttcaagaaaaaaagttagccgccactttgaaatttttacggaccaaggcaagtttttatttgcttctggagactctggaaaaatcttaaaaatcactcgtcaacatattggtaatgagaaagtgattacattaccaaccttgatgcaaacctttattaacaaattttttcgacat

SEQ ID NO: 5232 - protein, 119 aa, Streptococcus pyogenes
MAQSLNTSVEYKTKAVSYLGMGGKVGHILLGDKALEFYNDKNVNDYIQIPWTAINHIGANVSRKKVSRHFEIFTDQGKFLFASGDSGKILKITRQHIGNEKVITLPTLMQTFINKFFRH

SEQ ID NO: 5233 - DNA, 909 bp, Streptococcus agalactiae
atgactgaacaaattaaattatcaaaatcagatcgtcaaaaagtttggtggcgttcacaattccttcaaggttcttggaactatgagcgtatgcaaaatatggggtgggcctatgctcttatcccagcattgaaaaaactttacactactaaagaagatcgtgctgctgcgcttgagcgccatatggaattctttaacacacatccatacgttgctgctccaattatcggtgtaacccttgctcttgaggaagaaaaagcaagcggtacacctgtcgaagacaaagcaattcaaggggttaaaatcggtatgatgggacctcttgctggtattggtgatccagtattctggtttactgtacgtcctatcttaggtgctcttggtgcttcacttgcctctgctggtaatatcctcggaccaatcatcttctttgttggttggaacctcattcgtatgtcattcttatggtacacacaagagttaggttacaaatcaggtaaagaaattactaaagatatgtctggtggtatcctccaagatattactaaaggtgcttcaatccttggtatgttcatccttgctgtccttgttaagcgttgggtagcaattaactttactgtagaccttcctaaaaagacattgtcagaaggggcatacatcaatttccctaaagaccatgttagtggacaacaattgcatgatatcctaggacaagttcagagtggcttaagccttgataaaatgcaaccacaaacacttcaaggacaacttgactcacttattcctggtttagctggattacttcttacattcttctgtatgtggttacttaagaagaaagtatcaccaattacaattatcatcggtttgtttatcgttggtattctagctcgccttgcaggtgtgatg

SEQ ID NO: 5234 - protein, 303 aa, Streptococcus agalactiae
MTEQIKLSKSDRQKVWWRSQFLQGSWNYERMQNMGWAYALIPALKKLYTTKEDRAAALERHMEFFNTHPYVAAPIIGVTLALEEEKASGTPVEDKAIQGVKIGMMGPLAGIGDPVFWFTVRPILGALGASLASAGNILGPIIFFVGWNLIRMSFLWYTQELGYKSGKEITKDMSGGILQDITKGASILGMFILAVLVKRWVAINFTVDLPKKTLSEGAYINFPKDHVSGQQLHDILGQVQSGLSLDKMQPQTLQGQLDSLIPGLAGLLLTFFCMWLLKKKVSPITIIIGLFIVGILARLAGVM

SEQ ID NO: 5235 - DNA, 909 bp, Streptococcus pyogenes
atgactgaacaaattaaattaactaaatcagaccgtcaacgtgtttggtggcgttcacaattcttacaaggttcttggaactacgaacgtatgcaaaacatgggctgggcttatgcacttatccctgctcttaaaaaattgtatacgtctcctgaagaccgtgcagctgctcttgagcgccacatggaattctttaacactcacccatacgttgcagctccaatcattggtgtaacacttgcccttgaagaagaacgcgcaaatggtacgccaattgatgacaaggctatccaaggggttaaaatcggtatgatgggacctcttgctggtatcggtgacccagtattctggtttacgattcgtcctatccttggggcacttggtgcttctttggcttcaacaggtaacatcgttggtccacttctgttcttctttggatggaaccttatccgtatggccttcttatggtatactcaagaatttggttacaaagctggttctgaaattactaaagacatgtcaggcggtatcctccaagacattactaaaggtgcttcaatccttggaatgtttatccttgcagtgcttgttcaacgttgggtatctatcaactttactatcgaccttcctggaaaacaattgtcagatggtgcctatgtggtcttcccagatggcgctgttaaaggtgctgaattgaaaactatccttgccaacgctattggtggtatgagccttgataaagtccaagctcaaacccttcaaggacaattggactctcttatcccaggtttagctggattactccttacattcctttgcatgtggttattgaagaaaaaagtttctccaatcgcaatcatcatcggcttgtttgcatttggtatccttgctcaccttgcaggtattatg

SEQ ID NO: 5236 - protein, 303 aa, Streptococcus pyogenes
MTEQIKLTKSDRQRVWWRSQFLQGSWNYERMQNMGWAYALIPALKKLYTSPEDRAAALERHMEFFNTHPYVAAPIIGVTLALEEERANGTPIDDKAIQGVKIGMMGPLAGIGDPVFWFTIRPILGALGASLASTGNIVGPLLFFFGWNLIRMAFLWYTQEFGYKAGSEITKDMSGGILQDITKGASILGMFILAVLVQRWVSINFTIDLPGKQLSDGAYVVFPDGAVKGAELKTILANAIGGMSLDKVQAQTLQGQLDSLIPGLAGLLLTFLCMWLLKKKVSPIAIIIGLFAFGILAHLAGIM

SEQ ID NO: 5237 - DNA, 141 bp, Streptococcus agalactiae
atggcaccaccaacttgcataccaccatttaaccaatcaggcattgcttcaagaatactttgtactgaagaagatggaatagctaaaagaagcgcagctgggaatgcaatacgtaatccttggagaaggagggcgataaag

SEQ ID NO: 5238 - protein, 47 aa, Streptococcus agalactiae
MAPPTCIPPFNQSGIASRILCTEEDGIAKRSAAGNAIRNPWRRRAIK

SEQ ID NO: 5239 - DNA, 555 bp, Streptococcus agalactiae
ttggttaaaagtggtgacttcactcaaaaaggtatcaactttgccttctctactgctgtacctctagctattgctggacttttccttacaatgattgttcgtacaatctcaactgcacttgttcacgctggtgacaaagctgcttctgaaggaaacttcgcagcaattgaacgttttcactttatcgccctccttctccaaggattacgtattgcattcccagctgcgcttcttttagctattccatcttcttcagtacaaagtattcttgaagcaatgcctgattggttaaatggtggtatgcaagttggtggtgccatggttgttgccgttggttacgctatggttatcaatatgatggctactcgcgaagtttggcctttctttgctcttggatttgctctagcagctttgaaccagttaactcttattgcaatgggtactattggtgttgctatcgccctcatctacatcagtttatcaaaaatgggtggaagcaaaggtacttctaacgcaggttctaacgatcctatcggcgatatcttagaggactac

SEQ ID NO: 5240 - protein, 185 aa, Streptococcus agalactiae
MVKSGDFTQKGINFAFSTAVPLAIAGLFLTMIVRTISTALVHAGDKAASEGNFAAIERFHFIALLLQGLRIAFPAALLLAIPSSSVQSILEAMPDWLNGGMQVGGAMVVAVGYAMVINMMATREVWPFFALGFALAALNQLTLIAMGTIGVAIALIYISLSKMGGSKGTSNAGSNDPIGDILEDY

SEQ ID NO: 5241 - DNA, 807 bp, Streptococcus pyogenes
atgtcagatatttcgattatttctgcaattttggtcgttatcattgccttcttcgctggtcttgaaggtatcctcgaccaatttcaaatgcaccaaccacttgttgcctgtactttgattggacttgtaactggacaccttgaagctggtgtcatccttggtggtacacttcaaatgcttgctcttggttgggcaaacatcggtgctgccgttgcccctgatgctgcccttgcctctgttgcagctgctatcatcatggtcaaaagtggcgactttactcaaaaaggaattacctttgcttactcaacagctatcccacttgctgttgctggtcttttccttacaatgatcgttcgtactttgtcaactgcccttgtacacgctggtgacaaagctgccgctgaaggtaatttcgcaggtattgaacgcttccactttattgcccttcttcttcaaggattgcgtatcgctgtccctgcagctcttcttgttgctgttcctacttcagccgtacaatctgttttgaatgctatgccaaactggttgaacgaaggtatgcaaatcggtggtgcgatggttgttgctgtaggttatgctatggttatcaacatgatggctactcgtgaagtatggccattcttcgccctaggttttgctcttgcagctatcagccaattaacccttatcgctatgggtgttatcggtgtagcaattgccttcatctaccttaatctttctaaaaaaggtggtaacggtggtaatgcagcaggttcagctgatccaatcggcgacatcttagaagactac

SEQ ID NO: 5242 - protein, 269 aa, Streptococcus pyogenes
MSDISIISAILVVIIAFFAGLEGILDQFQMHQPLVACTLIGLVTGHLEAGVILGGTLQMLALGWANIGAAVAPDAALASVAAAIIMVKSGDFTQKGITFAYSTAIPLAVAGLFLTMIVRTLSTALVHAGDKAAAEGNFAGIERFHFIALLLQGLRIAVPAALLVAVPTSAVQSVLNAMPNWLNEGMQIGGAMVVAVGYAMVINMMATREVWPFFALGFALAAISQLTLIAMGVIGVAIAFIYLNLSKKGGNGGNAAGSADPIGDILEDY

SEQ ID NO: 5243 - DNA, 120 bp, Streptococcus agalactiae
ttgacagcgttatcatggaattacattaatttagaaatagaaggttttatatatatgcgttccttatttggtggtttaagagaaaaagttgcaagtgattatgttaagattgtttttccc

SEQ ID NO: 5244 - protein, 40 aa, Streptococcus agalactiae
MTALSWNYINLEIEGFIYMRSLFGGLREKVASDYVKIVFP

SEQ ID NO: 5245 - DNA, 882 bp, Streptococcus agalactiae
ttgaaatttgaatacgtagcaaaagaaaggtgcaaagttaaaacacttttgaaaagtcatgatgtttcaagggggttattagcaaagattaagtacagaggtggtaagatttttgttaatggtgaagagcagaacgctattttcttattagagattggcgatgttgttacaatagatattcctgacgagccttctcacgaaactttggaaccagtgcctcacgatttagatattatttatgaggatgatcattttttgattttaaataaaccttttggtttcgctagtattcctagctctattcattcaaatacaattgctaattttataaaacactattatgtgtctaataactatgccaatcagcaggtccatattgtgacccggttggatcgagatacaagtggattaatgttattcgccaagcatggttatgcccatgctcgtctagataaacaacttcaggctaaagcaattgaaaaaaggtattatgcattagtatcagggagtggtgatttagcagatagtggtgatattatagctcctattgcacgagatgttgatagtattattacgaggcgcgtccatgaatcaggcaaatatgcacatactagttatcaagtagttgctcgttatggtgatgttagattagtggatatcaaattacatacagggcgtactcatcaaattagagttcactttgctcatatcggctttcctcttttgggagatgatttgtacggaggacgtatggatctaggaataaacaggcaagcattgcattgtcattctttgtctttttacgacccttttatgggaaaaataaataaacagacgctagacttgacagatgactttgacagcgttatcatggaattacat

SEQ ID NO: 5246 - protein, 294 aa, Streptococcus agalactiae
MKFEYVAKERCKVKTLLKSHDVSRGLLAKIKYRGGKIFVNGEEQNAIFLLEIGDVVTIDIPDEPSHETLEPVPHDLDIIYEDDHFLILNKPFGFASIPSSIHSNTIANFIKHYYVSNNYANQQVHIVTRLDRDTSGLMLFAKHGYAHARLDKQLQAKAIEKRYYALVSGSGDLADSGDIIAPIARDVDSIITRRVHESGKYAHTSYQVVARYGDVRLVDIKLHTGRTHQIRVHFAHIGFPLLGDDLYGGRMDLGINRQALHCHSLSFYDPFMGKINKQTLDLTDDFDSVIMELH

SEQ ID NO: 5247 - DNA, 903 bp, Streptococcus pyogenes
atgagatttgaatttgtagcagacaaacgaataaaagtaaaaacccttttaaaaagttatgatgtctctaaaggactattggctaaaatcaaatataagggcggtaatatattagtgaatggtattgaacaaaatgccatttatttattgcaagtgggagatgttgtcaccattgacattccaaacgaagagccctttgaaaagcttgaagccatcccttttgatttggatattgttcacgaggatgatcattttttggtgattaataaacccattggctttgccagtattccaagtgccatccactccaataccattgctaactttatcaaggcatattatgtggacaatcattacctagaccaacaagtgcatatcgtgactcgtttagacagagatacgagtggcttgatgttatttgctaagcatggttatgctcatgcaaggttggacaagcaactccaaactcgctcaatagagaaacgttattttgctctggtttctggaaatgggatgttgccagatgaaggagatattattgctccaattgggcgttcaaaagatagtattattaccagggcagttgaccctatgggcaaatatgccaagactagctataaggttgtggcgcgctattcagaaaatgtgcatttagtggatatcaaattgcatacaggacgtacccatcaaatcagagttcattttgcccatattggttttccacttttaggggatgacctttacggaggtcgtttggacttaggaataacaaggcaagctttacattgtcattatttgaatttcaaagatccatttacagaaagtgattgtagctatgcaatacacttgacagatgactttgatagcgttatcataggtttacagaaaaaagatagaggttat

SEQ ID NO: 5248 - protein, 301 aa, Streptococcus pyogenes
MRFEFVADKRIKVKTLLKSYDVSKGLLAKIKYKGGNILVNGIEQNAIYLLQVGDVVTIDIPNEEPFEKLEAIPFDLDIVHEDDHFLVINKPIGFASIPSAIHSNTIANFIKAYYVDNHYLDQQVHIVTRLDRDTSGLMLFAKHGYAHARLDKQLQTRSIEKRYFALVSGNGMLPDEGDIIAPIGRSKDSIITRAVDPMGKYAKTSYKVVARYSENVHLVDIKLHTGRTHQIRVHFAHIGFPLLGDDLYGGRLDLGITRQALHCHYLNFKDPFTESDCSYAIHLTDDFDSVIIGLQKKDRGY

SEQ ID NO: 5249 - DNA, 837 bp, Streptococcus agalactiae
gtgatgacacagatgaattttacagatagagcaacacgtgttgctataattgctaacgggaaatatcaaagcaagcgtgtagcctcaaagctctttgctgcttttaaacatgatcctgatttttatttatcaaaaaaggatcctgatattgtcatttctattggtggagatggtatgcttttgtcagccttccacatgtacgaaaaacaactggataaagtaaggtttgtcggtgttcatacaggacatttagggttttatacagactatcgagattttgaagttgacacattaattaataatttgaaaaatgataaaggtgaacaaatctcctatcccattttgaaagtaactattacccttgaagatggtcgagttattcgtgcgcgtgctttaaatgagtctactattaagcgtattgaaaaaacaatggtagcggatgttgttattaatcaagtggtatttgaaaggtttaggggagatggcattttagtttctacaccaaccggtagtactgcttacaataaatcactagggggggcagtactccacccaacgatagaagccttgcaactaacagaaatttctagtcttaataatcgcgtctatcgtaccttggggtcatcggttatcatccccaaaaaagatgctatagagatagttcctaaacgagttggtgtctatacaatttctatagataacaaaacagtccattacaagaatgttaccaaaatagaatatagtattgacgaaaaaagtattaactttgtttcaactccaagtcacactagtttttgggaacgtgttaacgatgcttttatcggagaacctgaacat

SEQ ID NO: 5250 - protein, 279 aa, Streptococcus agalactiae
MMTQMNFTDRATRVAIIANGKYQSKRVASKLFAAFKHDPDFYLSKKDPDIVISIGGDGMLLSAFHMYEKQLDKVRFVGVHTGHLGFYTDYRDFEVDTLINNLKNDKGEQISYPILKVTITLEDGRVIRARALNESTIKRIEKTMVADVVINQVVFERFRGDGILVSTPTGSTAYNKSLGGAVLHPTIEALQLTEISSLNNRVYRTLGSSVIIPKKDAIEIVPKRVGVYTISIDNKTVHYKNVTKIEYSIDEKSINFVSTPSHTSFWERVNDAFIGEPEH

SEQ ID NO: 5251 - DNA, 837 bp, Streptococcus pyogenes
gtgatgacacagatgaattatacaggtaaggtaaaacgagttgctattattgcaaatggtaagtaccaaagtaaacgcgtcgcctccaaacttttctccgtatttaaagatgatcctgatttctatctttcaaagaaaaatccggatattgtgatttctattggcggagatgggatgctcttatctgcctttcacatgtatgaaaaagaattagataaggtacgttttgtaggaatccacaccggtcatcttggcttttataccgattatagggattttgaagttgataaattaattgataatttaagaaaagacaagggagaacaaatctcttatccgattttaaaagttgctattactttagatgatggtcgtgtggttaaagcgcgtgctttgaatgaagcgacggttaagcgtattgaaaaaacgatggtagcagatgttattattaaccatgtcaaatttgaaagcttccgaggtgatgggatttcagtatcgaccccgacagggagcacagcctacaataaatctttaggtggtgctgtcttgcatccgacgattgaagcgctgcaattgacggaaatttccagtcttaataaccgtgtctttagaaccttgggctcatcaatcattattcccaaaaaagataagattgagttagtgccaaaacgattaggaatttataccatttccattgataataaaacctatcagttaaaaaatgtgacgaaggtggagtattttatcgacgatgagaaaattcattttgtttcctctccgagtcatacgagcttttgggaaagggtcaaggatgcctttattggagagattgactca

SEQ ID NO: 5252 - protein, 279 aa, Streptococcus pyogenes
VMTQMNYTGKVKRVAIIANGKYQSKRVASKLFSVFKDDPDFYLSKKNPDIVISIGGDGMLLSAFHMYEKELDKVRFVGIHTGHLGFYTDYRDFEVDKLIDNLRKDKGEQISYPILKVAITLDDGRVVKARALNEATVKRIEKTMVADVIINHVKFESFRGDGISVSTPTGSTAYNKSLGGAVLHPTIEALQLTEISSLNNRVFRTLGSSIIIPKKDKIELVPKRLGIYTISIDNKTYQLKNVTKVEYFIDDEKIHFVSSPSHTSFWERVKDAFIGEIDS

SEQ ID NO: 5253 - DNA, 669 bp, Streptococcus agalactiae
atgtcaatggattgggaaacatttctagacccttatattcaaacggttggtgaattaaaaataaagcttcgtggtattcgtaaacaatttagaaagcaaaatcgtcactctccaatagaatttgttactggacgcgtaaagtcggttgaaagtattcaagaaaagatggttttacgtggtatttcagaagaaaatcttgctcaggacttgcaagatattgcagggcttcgtatcatggtacaatttgtagatgacgttgatgaagtccttgctttattgagaaaacgtcatgacatgacagtggttcaggagcgagattatattacccatatgaaatctagtggatatcgttcatatcatgtcgttgtagagtatcctgtagacacaatagatggacaaaagaaagttttagcagaaatacaaatcagaactctggctatgaatttttgggcaaccatcgaacattcattaaattacaagtatcagggggacttccctgaagaaattaaacaaagactggagaaaacagcaaaaatcgctttagaattggatgaagaaatgcgtaagattcgcgaagatattcgtgaagcacagcttttatttgatcctttaaatcgaaaattgagcgatggtgtaggaaatagtgatgacacagatgaattttacaga

SEQ ID NO: 5254 - protein, 223 aa, Streptococcus agalactiae
MSMDWETFLDPYIQTVGELKIKLRGIRKQFRKQNRHSPIEFVTGRVKSVESIQEKMVLRGISEENLAQDLQDIAGLRIMVQFVDDVDEVLALLRKRHDMTVVQERDYITHMKSSGYRSYHVVVEYPVDTIDGQKKVLAEIQIRTLAMNFWATIEHSLNYKYQGDFPEEIKQRLEKTAKIALELDEEMRKIREDIREAQLLFDPLNRKLSDGVGNSDDTDEFYR

SEQ ID NO: 5255 - DNA, 669 bp, Streptococcus pyogenes
atgaccttagattgggaagaatttttagatccttatatccaaacagttggtgaattaaaaataaaactacggggtattcgcaagcaatatcgtaagcaaaatcgttattctccgattgaatttgttacgggacgtgttaagtcaattgaaagtattaaagaaaaaatgattttacgtggtgttattgaagaaaatatagcacaagatattcaagatattgctggactacgtattatggttcagtttgttgatgatgtggaagaagtcttagctctattgcgtcaacgacaagacatgacaattgtttatgaacgagattatattcgcaatatgaagtccagtggctacaggtcttatcatgtggtggttgagtaccctgttgacaccattgaaggtcaaaaaaaggtcttagcggagattcagattcgtactttggcaatgaacttttgggcgaccattgagcattctttaaattataaatatggtggagacttcccagaagaaattaaaaagcgtcttgaagtgactgctaaaattgctttagaattagacgaagaaatgcgtaagattcgagaagatattcgggaggctcaattattgtttgaccccgtgacacgaaatttaagtgatggtgtaggaaatagtgatgacacagatgaattatacagg

SEQ ID NO: 5256 - protein, 223 aa, Streptococcus pyogenes
MTLDWEEFLDPYIQTVGELKIKLRGIRKQYRKQNRYSPIEFVTGRVKSIESIKEKMILRGVIEENIAQDIQDIAGLRIMVQFVDDVEEVLALLRQRQDMTIVYERDYIRNMKSSGYRSYHVVVEYPVDTIEGQKKVLAEIQIRTLAMNFWATIEHSLNYKYGGDFPEEIKKRLEVTAKIALELDEEMRKIREDIREAQLLFDPVTRNLSDGVGNSDDTDELYR

SEQ ID NO: 5257 - DNA, 570 bp, Streptococcus agalactiae
atgacacacctagaaattgaatacaaaactctattgaataaagacgaatttaatcgtctaacaagcttattttctcatgttcaacctattactcaaaccaattactattttgacacagaaacatttgaaatgaaagcacaccgaatgtcacttcgtattagaacgttacctaaccgtgccgaactaacactaaaaatccctagagaagtgggaaatttagaacacaatcatgaccttactttagaagaagctaaatatatcgttaaaaatggccaattccctgaagatactgagattgcttctttaatccttgaaaagggagttgatccaaccaaattagctgtctttggacaacttacaacaacaagacgagagatggaaacttcaatcggcttaatggctctagacagcaatatatatgctgatattaaagattatgaacttgagttagaagtcaaacaacctaaacaagggaaaagagatttcgaccagtttttaaaagaaaataatattaattttaaatacgccaaaagtaaggtggctagattctctgctactttaaaaaataac

SEQ ID NO: 5258 - protein, 190 aa, Streptococcus agalactiae
MTHLEIEYKTLLNKDEFNRLTSLFSHVQPITQTNYYFDTETFEMKAHRMSLRIRTLPNRAELTLKIPREVGNLEHNHDLTLEEAKYIVKNGQFPEDTEIASLILEKGVDPTKLAVFGQLTTTRREMETSIGLMALDSNIYADIKDYELELEVKQPKQGKRDFDQFLKENNINFKYAKSKVARFSATLKNN

SEQ ID NO: 5259 - DNA, 576 bp, Streptococcus pyogenes
atgactaacctagaaatcgaatataaaactctacttacaaaaaatgagtataaccgtcttttatctcaaatgaaacatgtgacgcctgttacacaaactaattactatattgatacaaaagcatttgatttaaaagctaacaaaatgtcattacgtattcgaacatttgtaaatagcgccgaattaaccctaaaagtgccagaaaaagtggggaatcgtgagtacaatgtccctctttttcttgaacaagcaaaagatatgattaaacatgggaatcttcctgaatcaactgctcttgatattattatttcaaaaggtatcaaaccatctgcactggtaacttttggcaatttaactaccgttcgtcgcgagacagtgataccgataggtaaattggccttagactataacctatatgccaataccaaagactatgaattagaattagaagtaagtgacgctcttcaaggaaagattgattttgattcttttttatctgaatatcacattactttcaaatatgctaaaagcaaagtagctcggtgtattaataccttaaaaaagttcaacgataaa

SEQ ID NO: 5260 - protein, 192 aa, Streptococcus pyogenes
MTNLEIEYKTLLTKNEYNRLLSQMKHVTPVTQTNYYIDTKAFDLKANKMSLRIRTFVNSAELTLKVPEKVGNREYNVPLFLEQAKDMIKHGNLPESTALDIIISKGIKPSALVTFGNLTTVRRETVIPIGKLALDYNLYANTKDYELELEVSDALQGKIDFDSFLSEYHITFKYAKSKVARCINTLKKFNDK

SEQ ID NO: 5261 - DNA, 105 bp, Streptococcus agalactiae
atgatagcaattggagagtcaaggtattctgccaaactacgagcacgcttgattccagaatttttaggactaacaacgacgacatcttcaccagagagaccgagt

SEQ ID NO: 5262 - protein, 35 aa, Streptococcus agalactiae
MIAIGESRYSAKLRARLIPEFLGLTTTTSSPERPS

SEQ ID NO: 5263 - DNA, 132 bp, Streptococcus agalactiae
atgagatggctagctgtcagatatttaatattgctaggaatacgctctttagataaaacagagtctgttacgataatttctctaattggtgcagactctaaaatatcagctgcgccgccagcaaaaagccca

SEQ ID NO: 5264 - protein, 44 aa, Streptococcus agalactiae
MRWLAVRYLILLGIRSLDKTESVTIISLIGADSKISAAPPAKSP

SEQ ID NO: 5265 - DNA, 972 bp, Streptococcus agalactiae
atggcagaacaatacgccgataaacaaatcaaacttttctcattaaccgctaatagagaaattgctgaaaaaatttcccaagcttcaggaattcctttgggtaagatgtcatcacgtcaattctctgatggcgaaattatgattaatattgaggaaacggtgcgcggtgacgatatctatatcatccaatctacaagcttcccagtcaatgataatctctgggaattactcattatgattgacgcttgcaaacgtgcaagtgctaatactgttaacatcgtagtcccttattttggatactctcgtcaggaccgcatcgctgcatctcgtgaacctattactgcaaaattggtcgctaatatgttagttaaagctggagttgatcgagttcttaccctcgacttacatgcagtgcaagtacaagggttcttcgatatcccagttgacaatctttttactgtcccactatttgctgaacactataatcaactcggtctctctggtgaagatgtcgtcgttgttagtcctaaaaattctggaatcaagcgtgctcgtagtttggcagaataccttgactctccaattgctatcattgattatgcacaagatgattctgaacgtgaagaaggctatattattggtgaggtagaaggtaagaaagctattattattgatgatattttaaatacaggaaaaacctttgccgaagctgcaaaaattttagaacgtggtggagcaactgagatttatgctgttgctagtcatgggctttttgctggcggcgcagctgatattttagagtctgcaccaattagagaaattatcgtaacagactctgttttatctaaagagcgtattcctagcaatattaaatatctgacagctagccatctcattgcagatgctattatccgtatccatgaaagaaaacctctaagtccattattttcatatcgttcagataagaaggat

SEQ ID NO: 5266 - protein, 324 aa, Streptococcus agalactiae
MAEQYADKQIKLFSLTANREIAEKISQASGIPLGKMSSRQFSDGEIMINIEETVRGDDIYIIQSTSFPVNDNLWELLIMIDACKRASANTVNIVVPYFGYSRQDRIAASREPITAKLVANMLVKAGVDRVLTLDLHAVQVQGFFDIPVDNLFTVPLFAEHYNQLGLSGEDVVVVSPKNSGIKRARSLAEYLDSPIAIIDYAQDDSEREEGYIIGEVEGKKAIIIDDILNTGKTFAEAAKILERGGATEIYAVASHGLFAGGAADILESAPIREIIVTDSVLSKERIPSNIKYLTASHLIADAIIRIHERKPLSPLFSYRSDKKD

SEQ ID NO: 5267 - DNA, 978 bp, Streptococcus pyogenes
atgactgaacgatatgctgacaagcaaatcaaactgttctcactcacatcaaatcttccaattgctgaaaaaattgctaaagctgctggaatccctcttggaaaaatgtcttcacgtcaattttccaatggagaaattatgatcaatattgaagaaacagtgcgtggagatgatatctatattattcaatccactagttttcctgtcaatgataatctttgggaattactcatcatgattgatgcttgtaaacgtgcaagtgctaataccgtcaatattgtattgccatactttggttactctcgtcaagaccgtgtcgctaagccccgcgaaccgattactgctaaactagtagctaatatgctgactaaagctggtattgatcgtgtagtgacgcttgacttacatgctgttcaggtacaaggtttttttgatattccagtggataacctctttacagtccctctttttgcagaacgttacagtaaattaggcttatcaggttctgatgttgttgtcgttagccctaaaaattctggaattaaacgtgctagaagcttggctgaatatcttgattccccgattgctattatcgactatgcacaagatgattctgaacgtgaacaaggttatattattggtgatgtttctggtaaaaaagccattttaattgatgatattttaaatactgggaaaacctttgcagaagctgctaaaattcttgaacgctcaggcgctactgatacttacgcggtcgctagccatggcttatttgctggtggagctgctgatgtattagaaacagctccaatcaaagaaattatcgttacagattctgttaaaactaaaaatcgtgtgccagaaaacgttacttatcttagcgccagtgatttaatcgcagaagctattattcgtatccatgaaagaagacccttaagtccgcttttttcttatcaacctaaaggcaaaaataacgca

SEQ ID NO: 5268 - protein, 326 aa, Streptococcus pyogenes
MTERYADKQIKLFSLTSNLPIAEKIAKAAGIPLGKMSSRQFSNGEIMINIEETVRGDDIYIIQSTSFPVNDNLWELLIMIDACKRASANTVNIVLPYFGYSRQDRVAKPREPITAKLVANMLTKAGIDRVVTLDLHAVQVQGFFDIPVDNLFTVPLFAERYSKLGLSGSDVVVVSPKNSGIKRARSLAEYLDSPIAIIDYAQDDSEREQGYIIGDVSGKKAILIDDILNTGKTFAEAAKILERSGATDTYAVASHGLFAGGAADVLETAPIKEIIVTDSVKTKNRVPENVTYLSASDLIAEAIIRIHERRPLSPLFSYQPKGKNNA

SEQ ID NO: 5269 - DNA, 1116 bp, Streptococcus agalactiae
ttgatgatttatttagacaatgctgctactaccgctctaaccccatctgttattgagaaaatgaccaatgtcatgacaagtaactatggtaatccatctagtatacatacctttgggcgtcaagcaaatcaacttttacgtgaatgtcgacaaattattgctgaatatctaaatgttaattcacgtgaaattattttcacttctgggggaactgagagcaacaatacagctatcaaagggtatgctcttgcaaatcagctaaaaggtaaacatattattacctctgaaattgaacatcattcagtcctacatactatgacttacttatcagagcgatttggttttgatattacttacttaaaaccaaatcatggacaaataactgcaaaagacgtgcaagaagctttacgagatgatactattatggtatctctcatgtttgttaataatgaaaccggggactttttaccaattcaagagattggtcagcttctcaggaaccaccaagctgtttttcacgttgatgccgttcaagtctttagcaaaatggaacttgatcctcattctttaggaattgactttttagctgcttctgcccataaatttcacggtccaaaaggtgttgggatactttactgtgctccccatcactttgatagtctacttcatggtggagaccaagaggaaaaaagacgtgcttcaactgaaaatataattggtattgctggaatgtctcaagctcttactgatgctacgactaacacccttaaaaattggactcacattagtcagctgagaacgacctttttagatgctatttcagaccttgacttctatcttaataacggtcaagactgcttacctcatgtacttaatataggttttcctggacagaataatggcttgttattgacacaattagatttagctggattcgcagtttcaacaggttctgcatgtactgcaggaacagtcgaacctagccatgtcttaacaagcttgtacggagccaactcaccacgtctaaatgaatcaatacgtattagtttttcagaactaaatacccaagaagaaattcttgaattagctaaaaccttaagaaaaattataggagat

SEQ ID NO: 5270 - protein, 372 aa, Streptococcus agalactiae
MMIYLDNAATTALTPSVIEKMTNVMTSNYGNPSSIHTFGRQANQLLRECRQIIAEYLNVNSREIIFTSGGTESNNTAIKGYALANQLKGKHIITSEIEHHSVLHTMTYLSERFGFDITYLKPNHGQITAKDVQEALRDDTIMVSLMFVNNETGDFLPIQEIGQLLRNHQAVFHVDAVQVFSKMELDPHSLGIDFLAASAHKFHGPKGVGILYCAPHHFDSLLHGGDQEEKRRASTENIIGIAGMSQALTDATTNTLKNWTHISQLRTTFLDAISDLDFYLNNGQDCLPHVLNIGFPGQNNGLLLTQLDLAGFAVSTGSACTAGTVEPSHVLTSLYGANSPRLNESIRISFSELNTQEEILELAKTLRKIIGD

SEQ ID NO: 5271 - DNA, 1125 bp, Streptococcus pyogenes
atgacttactttgataacgccgccaccacaccacttagtcctaatgtgattagggcgatgacagcagctatgcaagataactttggtaacccctctagtattcatttctacggtcgccgagccaataaaatccttcgtgaatgccgacaagctatcgctagaaacttgggggcaagtgaacagcaaattatagtaacgtccggtggaactgaaagcaataatatggccataaaaggctatgctttagctcatcaagcaaagggcaaacatctcatcacaactactattgagcaccactctgtgcttcataccatggcctatctcgaagagcgatttggttttgaggtcacttatttgccttgtcaaaatggacaaataaatttatctgacttaaaacaagccttgagagatgacaccattttggtaagcataatgtatgccaataacgaaacaggtgacctgttacctattaaggacattgggaatctgctcaaagaccatcaagctgcttttcatgttgatgccgttcaagctgttggcaaactcaagattattcctagcgaacttgggattgactttttatctgcttctgctcacaaatttcatggtcctaaaggatgcggctttttatacagtaacggacaaccaatcgaccctcttcttcacgggggtgatcaagaaggaaagcgacgcgcaagtactgaaaatatgttaggtattattggtatggcacaagctttgactgatgctatgacttgtcttgaccaatcaactgatcacattattagtttacgtcatcacttgattagcctcctagaaggactaccctactatattaatcaaggtactcattatcttcctcatgttctcaatattggatttttaggctaccaaaatactattttactaacacaacttgacttagcaggcattgcagtatcaactggttctgcttgtactgctggagctgttaatccaagtcatgttttagctgcgtactatggggatgactcttctcgtttaaaagaatcaattcgtatcagtttttcagatcaaaatagcattgaagatgttaatcaattagctcaaacattaaaaaatattttaggaggaacagatggcttt

SEQ ID NO: 5272 - protein, 375 aa, Streptococcus pyogenes
MTYFDNAATTPLSPNVIRAMTAAMQDNFGNPSSIHFYGRRANKILRECRQAIARNLGASEQQIIVTSGGTESNNMAIKGYALAHQAKGKHLITTTIEHHSVLHTMAYLEERFGFEVTYLPCQNGQINLSDLKQALRDDTILVSIMYANNETGDLLPIKDIGNLLKDHQAAFHVDAVQAVGKLKIIPSELGIDFLSASAHKFHGPKGCGFLYSNGQPIDPLLHGGDQEGKRRASTENMLGIIGMAQALTDAMTCLDQSTDHIISLRHHLISLLEGLPYYINQGTHYLPHVLNIGFLGYQNTILLTQLDLAGIAVSTGSACTAGAVNPSHVLAAYYGDDSSRLKESIRISFSDQNSIEDVNQLAQTLKNILGGTDGF

SEQ ID NO: 5273 - DNA, 636 bp, Streptococcus agalactiae
gtgattatggataagtctattcctaaagcaactgctaaacgtttatcactgtactaccgtatttttaaacgttttaatactgatggcatcgaaaaagctagttccaaacaaattgcagatgccctaggtatcgattctgctactgttcgacgtgatttttcttattttggtgaactaggacgccgtggttttggttatgatgtcaaaaaacttatgaacttctttgcagaaatattgaacgatcattctacaacaaatgttatgttggtggggtgtggaaatatcggtagagctctcttgcattatcgtttccacgatcgcaataaaatgcaaatttcaatggcttttgatttagatagcaatgatttagttggtaaaacaaccgaagatggcattcctgtctacggtatttcgactatcaatgaccatttaatagatagtgatattgaaactgctatcctaacagtacctagtacagaagcccaagaagttgctgacatcttagtcaaagcaggtataaaaggcatcttgagtttttctccagttcatttaacattaccaaaagatatcattgttcagtatgtagatttaacaagcgaattacaaactttactttatttcatgaaccagcagcaa

SEQ ID NO: 5274 - protein, 212 aa, Streptococcus agalactiae
MIMDKSIPKATAKRLSLYYRIFKRFNTDGIEKASSKQIADALGIDSATVRRDFSYFGELGRRGFGYDVKKLMNFFAEILNDHSTTNVMLVGCGNIGRALLHYRFHDRNKMQISMAFDLDSNDLVGKTTEDGIPVYGISTINDHLIDSDIETAILTVPSTEAQEVADILVKAGIKGILSFSPVHLTLPKDIIVQYVDLTSELQTLLYFMNQQQ

SEQ ID NO: 5275 - DNA, 642 bp, Streptococcus pyogenes
gtggttattgacaaatctattccaaaagcgactgcaaagcgcttatcactttattaccgtatttttaaacgattccatgctgaccaagttgaaaaagccagttctaaacaaattgcagatgcaatgggaattgactctgctactgtacgccgtgacttttcttattttggagaattggggcgtcgtgggtttggctatgatgttaccaaattgatgaatttttttgctgacttgcttaatgatcactctacaacaaacgttatcttagttggatgcggtaatatagggcgtgctctattacattaccgcttccatgatcgtaataagatgcaaattgccatgggttttgataccgatgataacgctcttgttggtactaaaacagctgataatattccagtccatggtatctcatctgtcaaagaacggattgcgaacactgacattgaaacggctatcttaacggttcccagcattcatgctcaagaagttactgatcaacttattgaagcaggaatcaaaggaatcttgagttttgctcctgttcacctacaagttcctaaaggagttattgttcaatctgtcgatttgaccagtgagctccagacactactctattttatgaatcaaaatcatctagat

SEQ ID NO: 5276 - protein, 214 aa, Streptococcus pyogenes
VVIDKSIPKATAKRLSLYYRIFKRFHADQVEKASSKQIADAMGIDSATVRRDFSYFGELGRRGFGYDVTKLMNFFADLLNDHSTTNVILVGCGNIGRALLHYRFHDRNKMQIAMGFDTDDNALVGTKTADNIPVHGISSVKERIANTDIETAILTVPSIHAQEVTDQLIEAGIKGILSFAPVHLQVPKGVIVQSVDLTSELQTLLYFMNQNHLD

SEQ ID NO: 5277 - DNA, 711 bp, Streptococcus agalactiae
ttggtttacgaatattatgactggaggtgttttatgtaccatattgaattaaaaaaggaagctttattaccaagagaacgcctagttgatttaggcgcagatagattgagtaatcaggagttattagccattctcttacgtacaggtattaaagaaaaacctgttctggaaatttcaacgcaaattttagaaaacataagcagtttagcagattttggtcaattatccttacaggagttgcaatccattaaaggaatcggtcaggttaaatccgtcgaaataaaagctatgctagaactagcaaaacggattcacaaagctgaatatgatcgtaaagagcaaattttaagtagtgaacaattagcgaggaaaatgatgctcgaattaggggataaaaaacaagaacatttagtagctatttatatggatacacaaaatcgtattatcgaacagagaactatttttattggtactgtacgtcgttcagtagcagagccaagagaaattctacattatgcttgtaaaaacatggcaacttctttgattatcatacataatcatccctcaggttctccaaagcccagtgaaagtgatttaagtttcactaaaaaaataaaacgatcatgtgatcatctgggaattgtctgcctagatcacatcatcgttggaaaaaataaatattatagttttcgagaagaagcagatatttta

SEQ ID NO: 5278 - protein, 237 aa, Streptococcus agalactiae
MVYEYYDWRCFMYHIELKKEALLPRERLVDLGADRLSNQELLAILLRTGIKEKPVLEISTQILENISSLADFGQLSLQELQSIKGIGQVKSVEIKAMLELAKRIHKAEYDRKEQILSSEQLARKMMLELGDKKQEHLVAIYMDTQNRIIEQRTIFIGTVRRSVAEPREILHYACKNMATSLIIIHNHPSGSPKPSESDLSFTKKIKRSCDHLGIVCLDHIIVGKNKYYSFREEADIL

SEQ ID NO: 5279 - DNA, 678 bp, Streptococcus pyogenes
atgtattctataaaatgtgatgataataaagccatgccaagagaacgtttgatgcgactaggagcagagtctctaagtaatcaagaattattagcaattttattacgaacaggtaataaagaaaagcatgtcttagagctgtcatcctatcttttatcgcatttagacagtctggcagattttaaaaagatgtctttgcaagaattacaacatttggcaggtataggaaaagttaaagcgattgaaattaaagctatgattgagttggtttcccgaattttagcgacagataagacattaactgatagcgtattaaccagtgttcaggtcgctgaaaaaatgatggcagctttaggagataaaaaacaagagcatttagtcgtattgtatttagataatcaaaatcgtattattgaagaaaaaactatttttattgggactgtccgacgttcacttgcagaaccaagagaaattttatactatgcctgtaaaaatatggcgactagtctcattgttattcataatcatccttcaggaaatattgaacctagttctaacgattattgctttactgaaaaaataaaacgatcatgtgaagatttaggcattatctgtctagatcacattatcgttagctataaagattattatagttttcgagaaaaatcaacccttttt

SEQ ID NO: 5280 - protein, 226 aa, Streptococcus pyogenes
MYSIKCDDNKAMPRERLMRLGAESLSNQELLAILLRTGNKEKHVLELSSYLLSHLDSLADFKKMSLQELQHLAGIGKVKAIEIKAMIELVSRILATDKTLTDSVLTSVQVAEKMMAALGDKKQEHLVVLYLDNQNRIIEEKTIFIGTVRRSLAEPREILYYACKNMATSLIVIHNHPSGNIEPSSNDYCFTEKIKRSCEDLGIICLDHIIVSYKDYYSFREKSTLF

SEQ ID NO: 5281 - DNA, 1131 bp, Streptococcus agalactiae
atgaaatttgaaaaacggcaggtctattatgttgtcataacatttgctatttgctatgctatacaggcttattggggagctgtttctaatattttaactacgcttcataaggcaatatttccttttttgatgggagctggaattgcctatattattaatattgtaatgtcagtctatgagcgattatatataaagctttttaaaggatctagactattaatggcaatcaagcgtagtgtttctatgattttatcctatgcaacttttattggtttaattgtctggctattttcaattgtcattccagatttgatttctagtttgagttctttattggttattgataccggagcacttgctaaattggttaataatctcaatgagaataaacaaatttctgaggttttaaattatatgggaacagataaagacttagtttctactttaagtggttatagccagcagattttgaagcaagttttatctgttttaacaaatttactaacctcagtttcctctattgcggcaacactcctgaatgtttttgttagttttattttttcaatttacgttttggcaaacaaggagcagttgggacgtcagtttaatttgttaattgatacctatttaggttcaacaggcaaaacattccattacgttcgtcatatccttcatcaacgtttccatggtttttttgtaagccaaactttagaagctatgattttaggaagtttgacggttattggtatgttgatcttccaatttccttatgctttaacagttggggttttagttgcttttacagctctaataccggttgtgggagcctacattggtgttacaatcggtttcatcttaattgctactgaatcgcttactgaagcattcttgtttgttcttttcttgatccttttacaacaatttgagggaaatgtcatttatccgaaagttgtcggtggatcgattggactgccttctatgtgggttttaatggctattactatcggaggtgctttatgggggattttaggcatgttacttgctgttcctgttgcagctactatctatcagattgtaaaagatcatattatcaagcgacaaacgcttagaaattgtgcacgaacctatcgt

SEQ ID NO: 5282 - protein, 377 aa, Streptococcus agalactiae
MKFEKRQVYYVVITFAICYAIQAYWGAVSNILTTLHKAIFPFLMGAGIAYIINIVMSVYERLYIKLFKGSRLLMAIKRSVSMILSYATFIGLIVWLFSIVIPDLISSLSSLLVIDTGALAKLVNNLNENKQISEVLNYMGTDKDLVSTLSGYSQQILKQVLSVLTNLLTSVSSIAATLLNVFVSFIFSIYVLANKEQLGRQFNLLIDTYLGSTGKTFHYVRHILHQRFHGFFVSQTLEAMILGSLTVIGMLIFQFPYALTVGVLVAFTALIPVVGAYIGVTIGFILIATESLTEAFLFVLFLILLQQFEGNVIYPKVVGGSIGLPSMWVLMAITIGGALWGILGMLLAVPVAATIYQIVKDHIIKRQTLRNCARTYR

SEQ ID NO: 5283 - DNA, 1146 bp, Streptococcus pyogenes
atgataattaaaggagttaccatgaaatttgaaaaaaaacaagtcttctatttagtccttacgtttatcttatgctatgggatcctagcaaactggcgaaatggaacggctatcgtcacgactatttacaaaacaagccttccttttttttatggagcagcaggtgcctatattgttaatattgtaatgagcgcttacgaaaaggtatatgtttatatctttaaagactggtcacatgtcttaaaagtaaaacggggtatttgtttactgttagcgtatttgacattttttattttaattacttggattatttccattgtcattccagacttaattacaagtattagtactctaacaaaatttgatactataacgatacaagaagttgttaacaatcttgagcacaataaactgttagcacgtactattcagtatattggtggcgatggcaaacttacagagacgattgctaactatagtcaacagttattaaagcaatttcttactgttttgacaaatattttaacatctgtcacggttattgcttctgcaattattaatctttttattagttttgttttttcgttatacgttttagcaagtaaagaagatctttgtcgtcagggaaatactttagtagatacttatactggtaagtacgctaaacgcattcattacttgttagagttgttgcatcagcgttttcacggattttttgttagtcagaccttagaagctatgattttaggttcgctgactgctagtggcatgtttatattaagattaccatttgcagggactattggcgttttagtagcttttacagcattgattccagttataggtgcttcaattggagcagctattggatttattttaattatgactcagtccatgtcacaggccattatttttatcatttttttaattattttgcagcagattgaaggcaattttatttatccgaaagtagttggtggatcgattggattaccggctatgtgggtattaatggcaattacaataggcgcttctttaaagggaatagttggtatgattattgcagttcctttagcagcgacactttatcaagtgattaaagataatattcaaaaaagacaagctattcaaaaaaaacaagtttcc

SEQ ID NO: 5284 - protein, 382 aa, Streptococcus pyogenes
MIIKGVTMKFEKKQVFYLVLTFILCYGILANWRNGTAIVTTIYKTSLPFFYGAAGAYIVNIVMSAYEKVYVYIFKDWSHVLKVKRGICLLLAYLTFFILITWIISIVIPDLITSISTLTKFDTITIQEVVNNLEHNKLLARTIQYIGGDGKLTETIANYSQQLLKQFLTVLTNILTSVTVIASAIINLFISFVFSLYVLASKEDLCRQGNTLVDTYTGKYAKRIHYLLELLHQRFHGFFVSQTLEAMILGSLTASGMFILRLPFAGTIGVLVAFTALIPVIGASIGAAIGFILIMTQSMSQAIIFIIFLIILQQIEGNFIYPKVVGGSIGLPAMWVLMAITIGASLKGIVGMIIAVPLAATLYQVIKDNIQKRQAIQKKQVS

SEQ ID NO: 5285 - DNA, 1437 bp, Streptococcus agalactiae
atgatggtaaaacaagtatttccaaaaggttttttatggggcggggcaactgctgccaatcaatgcgaaggagcttacaatgttgatggacgtggcctagcaaatgtagatgttgttcctactggagaagatcgatttgcaattatttcaggacaaaagaaaatgtttgattttgaggaaggatacttttatccagcaaaagaatcaatagatttttatcaccattataaagaggaccttgcattacttgcagaaatgggtttcaaaacctatcgtatgtcaatagcatggacgcgtatttttccaaagggtgatgagctatatccaaatgaagctggtcttcagttttatgaaaatatttttaaagagtgtcgtaagtatggtattgaacctttggtaaccattacacattttgactgtcctatctaccttattaaacattacggtgggtggcggagccgtaaaatgattggtttttatgagcgccttgtacgagctttatttactcgttttaaggggttagttaaatattggttgacctttaacgaaatcaatatgattttacacgctccttttatgggcgctggcttatattttgaagatggtgaaaatcaagagcaaattaaatatcaagcagctcaccatgagttagtggcttcggctattgcagtaaaaattgctcatgaagttgatccaaataatcaaatcggatgtatgctagctgcaggtcaatactatccaaatacgtgtcatccacaagattattgggcttcgatgcaaaaaaatagagaaaattatttttttattgatgtgcaagctcgtggcaaataccctaattatgctaaaaaacattttgagcatttaggtatttcaattcaaatgacagcagaagatcttgctttgttaagagactatacggttgattttatttcattttcttactattcaagccgagtagcttcaggtaatccaactgtcagtgaacaggttcaagaaaatattttcgcatctcttaagaatccttacttgaaatcttctgaatggggatggcaaattgatccgcttggattacgtattaccttaaatgctatctgggatcgttatcaaaaaccgatgtttattgttgaaaatggacttggagcagtagatattcctgatgagaatggttacgtagaagatgattatcgtattgattacctccgtcagcacattgctgcaatgagagatgctatatatgtagatggtgttaatctaattggctatactacatggggatgtattgatttagtatctgcaggaactggtgaaatggaaaaacgctatggtttcatttatgttgatcgcaataataaaggagaggggacactcaagcgttacaagaaaaaatcgttttattggtacaagaaggttattgcaagtaatggcagtcaaatagaa

SEQ ID NO: 5286 - protein, 479 aa, Streptococcus agalactiae
MMVKQVFPKGFLWGGATAANQCEGAYNVDGRGLANVDVVPTGEDRFAIISGQKKMFDFEEGYFYPAKESIDFYHHYKEDLALLAEMGFKTYRMSIAWTRIFPKGDELYPNEAGLQFYENIFKECRKYGIEPLVTITHFDCPIYLIKHYGGWRSRKMIGFYERLVRALFTRFKGLVKYWLTFNEINMILHAPFMGAGLYFEDGENQEQIKYQAAHHELVASAIAVKIAHEVDPNNQIGCMLAAGQYYPNTCHPQDYWASMQKNRENYFFIDVQARGKYPNYAKKHFEHLGISIQMTAEDLALLRDYTVDFISFSYYSSRVASGNPTVSEQVQENIFASLKNPYLKSSEWGWQIDPLGLRITLNAIWDRYQKPMFIVENGLGAVDIPDENGYVEDDYRIDYLRQHIAAMRDAIYVDGVNLIGYTTWGCIDLVSAGTGEMEKRYGFIYVDRNNKGEGTLKRYKKKSFYWYKKVIASNGSQIE

SEQ ID NO: 5287 - DNA, 1422 bp, Streptococcus pyogenes
atgggaatttttccaaaagatttcttatggggcggcgcagtagctgccaaccaagtggaaggagcatttgaggcagacgcaaaaggtttgtccgtacaagatgttctaccaaatggtggactaggagaatggacagatagtcctaccagcgataatttaactttagaggcgattgatttttaccaccgctacaaagaagacattgctctttttgccgagatgggctttaaagtctttcgaacgtctattgcttggtctcgtatttttccaaatggtgacgatgaccagcccaatgaagcaggtttgcaattttatgatgacttattcgatgaattgttgaactatggcatcgaacccttagtgaccttgtcgcattatgagacacctctgcatttggccaaagcctataatggttggacagatagacgtctgattggcttttttgagcgctttgctcagacagtcatggaacgctataaggacaaagtcaaatactggttgacctttaacgaagtcaactcgattttacacatgccctttaccagtggtggcatcatgacagaaaaagaaaagctgagcctgcaagatttataccaagctattcatcatgaattggtagcatctgctagtgtcacaaagctagcgcatgaaatcaatcctgatgttaaagttgggtgtatgattttggcgatgcctgcttacccaatgacctctgatcctcgtgatatacttgctgcgcatgcatttgaaaatcttaatctcttattttcagatattcatgtgagaggcaagtatccttcatatattaagtcgtattttaaagaaaatgggattgagattgtttttgaagacggagacaaggaattattagcggaacatacggttgattttctatcctttagctattacatgagtgtcacacaagcccacaatcctgaagcttacacatctggtcagggaaatattctaggtggtttgtccaatccatatttagaatcttcggagtggggttggcagatagacccaattggtctgcgattggtcttgaatcagtactatgaccgctaccagattcctttgtttattgttgaaaatggcttaggtgcaaaggatcagctggtgcaaaccgcagatggcagcatgacggttcacgatgattatcgcattgactacatgagtcagcatctcgtacaagttgccaaagcgattgaagatggcgttgaggtcatgggttacacttcttggggctgtattgattgtgtctctatgtcaacagcccaattaagtaaacgctacggttttatttatgttgaccgaaatgatgatggtactggtcaactcacacgctataagaaaaaatcatttgattggtaccgacaagtcattcaaaccaatggacgttaccttgaggataatttttcc

SEQ ID NO: 5288 - protein, 474 aa, Streptococcus pyogenes
MGIFPKDFLWGGAVAANQVEGAFEADAKGLSVQDVLPNGGLGEWTDSPTSDNLTLEAIDFYHRYKEDIALFAEMGFKVFRTSIAWSRIFPNGDDDQPNEAGLQFYDDLFDELLNYGIEPLVTLSHYETPLHLAKAYNGWTDRRLIGFFERFAQTVMERYKDKVKYWLTFNEVNSILHMPFTSGGIMTEKEKLSLQDLYQAIHHELVASASVTKLAHEINPDVKVGCMILAMPAYPMTSDPRDILAAHAFENLNLLFSDIHVRGKYPSYIKSYFKENGIEIVFEDGDKELLAEHTVDFLSFSYYMSVTQAHNPEAYTSGQGNILGGLSNPYLESSEWGWQIDPIGLRLVLNQYYDRYQIPLFIVENGLGAKDQLVQTADGSMTVHDDYRIDYMSQHLVQVAKAIEDGVEVMGYTSWGCIDCVSMSTAQLSKRYGFIYVDRNDDGTGQLTRYKKKSFDWYRQVIQTNGRYLEDNFS

SEQ ID NO: 5289 - DNA, 612 bp, Streptococcus agalactiae
atgttagaagttattgacaaagctttaagagattatcaaatgaaacgagaacagttttttgagattaacaatcagacagtacaagaaggtgccattgttttcacaggagattctatcgttgagttttttcctttaaaaaaacatttaggacgtgactatcctttagttaatagaggagtagcaggatcagatacttattggcttttagaaaacttgagaacccaagtatgggaactattaccatccaaagtatttattttaattggaacaaatgatattggtttagggcattcacagtcagaaatcatagctaatatcacggatataattgcagaaattcgtgcggaatcttatatgacagagattaatatactgagtgttttacctgttagtgaagaagatgactatatagagcgtgtcaaggtaagaaataatcaaacaataaaagctttaaacaaaaccttatcagtaatttctggcattaattatattgaattgtatgatttattagttgacgaaaaaggtcagcttgctagcagttttacaaaagatggtttgcacctaacagatcaagcctatgctaaaatttctgaaacgataaaactctacctt

SEQ ID NO: 5290 - protein, 204 aa, Streptococcus agalactiae
MLEVIDKALRDYQMKREQFFEINNQTVQEGAIVFTGDSIVEFFPLKKHLGRDYPLVNRGVAGSDTYWLLENLRTQVWELLPSKVFILIGTNDIGLGHSQSEIIANITDIIAEIRAESYMTEINILSVLPVSEEDDYIERVKVRNNQTIKALNKTLSVISGINYIELYDLLVDEKGQLASSFTKDGLHLTDQAYAKISETIKLYL

SEQ ID NO: 5291 - DNA, 612 bp, Streptococcus pyogenes
atgttagaaattgtttcagaagagctacgtcactatcaagaacaaaaattgattgagtaccgtaacaaaaatcagttagccccaaaaggaggcattgtatttgcaggtgattctctcattgaattttttcctttaaaaaaagcttttggttcatgtttgcctattattaatcgaggtattgctgggatagatagtcagtggttattgcgccatttttctgtccaaattactgatttagagcctaaacatatttttttattaattggttgtaatgatatcgggcttggatatgataaatgtcatattgtcaagactattgtagagcttattagccagattcgtagtcattgtgtctatagtcagatttatctcttatctttattaccagtttccaacaatccccgatatcagaagactgtcaaaataagaacaaatgctatgattgatgctattaataaagatttagcaatgattccaactgtagaatttattaatcttaatacttgtcttaaagacgaaaaaggtggtttatcagatgagaatactctagatggtttacatcttaattttccagcttatgctaaactagctgaaattattaaatcttatatc

SEQ ID NO: 5292 - protein, 204 aa, Streptococcus pyogenes
MLEIVSEELRHYQEQKLIEYRNKNQLAPKGGIVFAGDSLIEFFPLKKAFGSCLPIINRGIAGIDSQWLLRHFSVQITDLEPKHIFLLIGCNDIGLGYDKCHIVKTIVELISQIRSHCVYSQIYLLSLLPVSNNPRYQKTVKIRTNAMIDAINKDLAMIPTVEFINLNTCLKDEKGGLSDENTLDGLHLNFPAYAKLAEIIKSYI

SEQ ID NO: 5293 - DNA, 819 bp, Streptococcus agalactiae
atgattaaactaatagcaacagatatggatggaacttttctacgctcagataaaacttatgataaagcacggttttcttctttattaacgttgatggagaagtatgatattaaatttgtagctgctagtggtaatttatacgatcaattgttgttaaactttttggaataccctaatcgtatcgcctacgtcgctgaaaatggtggtcgtgtcattgaccaagatggcacattactaaaagaaacttatttatctaatgatacagttgcagctgttttatcctatttatatcagaactatcctgagacactcatcagcttatctggtgaaaaacgttcataccttgagcgaagaactcctattaataggcggactgaattagaatactatatgcctaattttatctataaagaccatttgctgcccttagatgatgaccgctattttcaaatgacactttgggtaaatgaaaatcttgtttctgagatgttgttagatattagtgaacactttaaaaatcatcatatcagattgacctctagtggttttggttgtatcgatgtcttaccagctgatgtcaataaagcggatggtatcgctattctccttgaaaagtggggattgaaacaggatcaagtgatggtttttggtgatgggggcaatgatgtggaaatgttgagagcagcaaatatttcttacgctatgtcaaatgcgccagaagaaattaaagctattgctaaatatcaaacagttagtaacgatcaagatggtgtgttagaaacgatagagaactttcttcacaagatgagtgataatgaa

SEQ ID NO: 5294 - protein, 273 aa, Streptococcus agalactiae
MIKLIATDMDGTFLRSDKTYDKARFSSLLTLMEKYDIKFVAASGNLYDQLLLNFLEYPNRIAYVAENGGRVIDQDGTLLKETYLSNDTVAAVLSYLYQNYPETLISLSGEKRSYLERRTPINRRTELEYYMPNFIYKDHLLPLDDDRYFQMTLWVNENLVSEMLLDISEHFKNHHIRLTSSGFGCIDVLPADVNKADGIAILLEKWGLKQDQVMVFGDGGNDVEMLRAANISYAMSNAPEEIKAIAKYQTVSNDQDGVLETIENFLHKMSDNE

SEQ ID NO: 5295 - DNA, 927 bp, Streptococcus agalactiae
atgaactcacttgataatttactatcacataatttagaagataaccggcatttattaccctatgaacacatgcatactgaggttagaaatggttaccctgacattttatttcactggcatccggaacttgaaatttcatatgtccacgaggggaccgcacgttatcacatcgattatgatttttttaatagccaatctggtgatattatcttgatccgtccaaatggtatgcattctattcatccgattgaaaataaagagcatatcacagatagcattaaatttcacttagatttaataggatattctattgtagaccaagttagccttcgttatttacaaccgttgcagactagctcttttaagtttatccaatgtatcaaacctagtatgacaggatataatgatatcaaaaattgtttgtttgatatttttaatatttcaaaagaagaaaatcgacattttgagctactcctaaaagctaaattaaacgaactcttgtatttactctattatcatcaatatgtcattaaaaaacatactgatgatacctacagaaaaaacgagagaattcgtgatctgattgattatattaataataattaccagcaaaatcttaccattgaatttttagctgattatatggggtatagtaagacacattttatgaccgtatttaaacagcatactggaacatcctgtacagaatttatcatacaagttcgtcttaataaagctagtgaacatcttattaactccactacggccattattgatattgccaacagcgttggttttaataatctatcaaattttaatcgccaatttaaacgctattatcatacaactcctcgccagtaccgcaaacaatttaccaacaaaaaagacggtagtacgcttgtctatagaaatataaatacaaaaaaa

SEQ ID NO: 5296 - protein, 309 aa, Streptococcus agalactiae
MNSLDNLLSHNLEDNRHLLPYEHMHTEVRNGYPDILFHWHPELEISYVHEGTARYHIDYDFFNSQSGDIILIRPNGMHSIHPIENKEHITDSIKFHLDLIGYSIVDQVSLRYLQPLQTSSFKFIQCIKPSMTGYNDIKNCLFDIFNISKEENRHFELLLKAKLNELLYLLYYHQYVIKKHTDDTYRKNERIRDLIDYINNNYQQNLTIEFLADYMGYSKTHFMTVFKQHTGTSCTEFIIQVRLNKASEHLINSTTAIIDIANSVGFNNLSNFNRQFKRYYHTTPRQYRKQFTNKKDGSTLVYRNINTKK

SEQ ID NO: 5297 - DNA, 1485 bp, Streptococcus pyogenes
ttgatgtataaggtactattagttgacgatgaatacatgattttacaagggctcaccatgattattgattggcaggcacttggatttgaagtggttcaaacagcaagatcaggcaaggaagccttagcctatttgactcagtacccagtggatgtcatgatttcagatgttaccatgcctggaatgacaggactggatttaatagaagcagctaaaacctatcatcctcagctacaaaccttgattttatctggttatcaagaattctcctatgtgcaaaaggctatggaattagaaaccaaggggtatttgttaaaacctgttgataaggcagaattacaggctaaaatgaaacaatttaaagactggttggatgcccagcaggcagaatcaatccggcaagaagcctatcatgacagccttttgaccctttggcttacagatgaattgagtgagaaagaatttcagcagttaagtcaaggcttgccagcggctgctttaactggttttacagtgctgtatttggactgtcaagagtggcaagcagccatcgatgcttattttgaacgagaaggtcagcctttttatctcaaaaaagaagaagataagaaggtttatctggctgtcctacttggtaaaactgatcaagccaaggcgtttacctatgatctacaaaagcgattctcaagaaacatgcatcaacttattttgggagaaacagttgatgactgggaaaatgtttatgaaagctacaatcaggtgcttaagagcctcttttacaattgtgaagtgtcaccaattagagcaaaagataagtccaaaattgaactaccagagtcccgtttgcagttctttgcttttaacaaggcgttgatgattggggacgaacctacaatcttgtctaaattagaagctatttttgacgagatgaagaccttgaacttttcaccagaggatgtgaagcatgtttcgttcttgttgttttctgacatttatcgtcaatttcccattttagataaaatgacttatctgtccatggtaaaaactattcatgacagccaatccattgattgcattttgagggaactaaaaaaagtgttggatgtcaccaatcagaacaattcccctgaaaaacgctattcagatttagttagtgaaaccattgattgcattcgcaaggaataccatcaagaattaactcttaaagctatcgctgataggttacatgtcaatggggtttatttagggcaatgctttaaaaatgaaaccgagcgtagttttacccagtacttaaatcatgttaggattcaaaaagcgcaacagttattgctttacaccaaccaatccatcaatgaaattgcttatgaaacaggttacaataccaatcattattttatcaagatgtttaaaaagttgaatggtttatcgccaaaagagttcagagatcgttacaaggacaattaccaagccatcaagggcgaccag

SEQ ID NO: 5298 - protein, 495 aa, Streptococcus pyogenes
LMYKVLLVDDEYMILQGLTMIIDWQALGFEVVQTARSGKEALAYLTQYPVDVMISDVTMPGMTGLDLIEAAKTYHPQLQTLILSGYQEFSYVQKAMELETKGYLLKPVDKAELQAKMKQFKDWLDAQQAESIRQEAYHDSLLTLWLTDELSEKEFQQLSQGLPAAALTGFTVLYLDCQEWQAAIDAYFEREGQPFYLKKEEDKKVYLAVLLGKTDQAKAFTYDLQKRFSRNMHQLILGETVDDWENVYESYNQVLKSLFYNCEVSPIRAKDKSKIELPESRLQFFAFNKALMIGDEPTILSKLEAIFDEMKTLNFSPEDVKHVSFLLFSDIYRQFPILDKMTYLSMVKTIHDSQSIDCILRELKKVLDVTNQNNSPEKRYSDLVSETIDCIRKEYHQELTLKAIADRLHVNGVYLGQCFKNETERSFTQYLNHVRIQKAQQLLLYTNQSINEIAYETGYNTNHYFIKMFKKLNGLSPKEFRDRYKDNYQAIKGDQ

SEQ ID NO: 5299 - DNA, 126 bp, Streptococcus agalactiae
ttgagatttaaagatggtaattctgatggtaaagctaaaactggggttaaaccaaagatattaagtgagacaaagtttgccactaaacttgctaccaaagctgttatccaaactaagcgagaaaaa

SEQ ID NO: 5300 - protein, 42 aa, Streptococcus agalactiae
MRFKDGNSDGKAKTGVKPKILSETKFATKLATKAVIQTKREK

SEQ ID NO: 5301 - DNA, 1530 bp, Streptococcus agalactiae
atggaaaatcataaaaatgaatttcagttttcacttgaatcaattctgggatttgtttggagaggaatagtagtaggcttaatagcaggatttgttgtcagcatatttcgattagcgattgaaaaaatttttttagttgttatggaactttataaaagtgcccattatcaaccaattattttattgagcattacggttactagtattatcgctgcagtgataataggtttttttatcaaatctgatcctgatattaaaggttcaggtatcccgcatgttgaaggtgaacttaaaggaatgctatcgccagactggtttagtattgtatggaagaaattcattgcgggtattttagctatttcttcgggacttatgcttggtcgcgaaggtcccagtattcagttaggagctatgacaggcaagggaattgcacagtatctcaatgctagtcgaatggaaaaacgtgttttaattgctagtggtgcggcagcaggtctttcagcagctttcaacgctcctattgcaggccttttatttgtagttgaagaaatttaccatcatttttctcgcttagtttggataacagctttggtagcaagtttagtggcaaactttgtctcacttaatatctttggtttaaccccagttttagctttaccatcagaattaccatctttaaatctcaacttttattggatttttttactcatgggtctctttttgggtatcttaggttttatctatgagtgggtaattttaagatttcatgtgatctatgattatttgggcaaactatttcatctaccatctcacctatatggtatattagcggtaatttttattcttcctattggttactatttcccacaattattggggggtggaaatggcttaattgtatcactgcctaggagtaatcttagtctgatgatgttaggattatttttcctcattcgttttttatggagtatgttgagttacagtagtggcttgccaggaggaatttttttaccaattctagctttaggatctttagcaggtgctttttttgcagtaggtatgcagtactttggtataatatctcatcagcagatatctttatttgttgttctaggaatggcgggctattttggtgcaatctcaaaagcaccactaacagctatgattttggttacagaaatggttggcgatttaaaacaattaatggctattggaattgtaacgatggtatcttatattgtcatggatttattaaagggagaacctatttatgaagcgatgttggctaaaatgaccttcaatccaaaagataaagtaatgacacctacattgattgaattaactgtttcagataaaatatcaggaaagtatgtccgagatttagaattaccagaaaatgtgttaataacgactcaaattcatcataagacatcggctgtagtatcaggaaatactatcttgaatgctggcgacaccatttttttagttgtgaatgaatcggaaattaaagaagtacgtgaacagctgatg

SEQ ID NO: 5302 - protein, 510 aa, Streptococcus agalactiae
MENHKNEFQFSLESILGFVWRGIVVGLIAGFVVSIFRLAIEKIFLVVMELYKSAHYQPIILLSITVTSIIAAVIIGFFIKSDPDIKGSGIPHVEGELKGMLSPDWFSIVWKKFIAGILAISSGLMLGREGPSIQLGAMTGKGIAQYLNASRMEKRVLIASGAAAGLSAAFNAPIAGLLFVVEEIYHHFSRLVWITALVASLVANFVSLNIFGLTPVLALPSELPSLNLNFYWIFLLMGLFLGILGFIYEWVILRFHVIYDYLGKLFHLPSHLYGILAVIFILPIGYYFPQLLGGGNGLIVSLPRSNLSLMMLGLFFLIRFLWSMLSYSSGLPGGIFLPILALGSLAGAFFAVGMQYFGIISHQQISLFVVLGMAGYFGAISKAPLTAMILVTEMVGDLKQLMAIGIVTMVSYIVMDLLKGEPIYEAMLAKMTFNPKDKVMTPTLIELTVSDKISGKYVRDLELPENVLITTQIHHKTSAVVSGNTILNAGDTIFLVVNESEIKEVREQLM

SEQ ID NO: 5303 - DNA, 1566 bp, Streptococcus pyogenes
atggtaacagtgtatttaaaagaaagagaggacaacatggaaaaccataaaaatgaattcaccttttccaacaaatcaattattgcctatgtttggcgtggtgttgtggttggtattattgctggtgttattgttagtttattccggttgttaattgaagtgacagctgactgggtgattgaatggtaccgatacgctcatatcaattcgctgttgctacttcctatactaagtgtcagtttgttagctgttctttttgtaggttttttagtaaagtctgattctgatataaaaggatcagggatcccccatgtcgaaggagaactaaaggggctaatgtccccagattggtggagtgtcctttggaaaaaatttttaggaggaatcatggctatttctatgggatttatgctcggtcgtgagggtccttcgattcagttaggtgctatgtcagccaaaggattagctaagtttttaaaatcgagtcgtttggaaaagcgagtgctaattgccagcggagcagcagcagggctatcagcagcttttaatgctccaatagcaggcctcttgtttgttgttgaagaaatttaccatcatttttcgcgtttaatttggattacagcgctagtggctagcttagtggctaattttatttctctgaatatttttggattgaaaccagtcttagcaatgtcagaggcgatgccttttttaggactcaatcaatattggttgttgcttttacttggattatttctaggctgcttaggctatttatatgagatagttatccttaattttaataaactttatgttattttagggagttggttacatctgccagattatttttacggtattattatggtttttctaattttaccgattggctattatttaccacagttacttggaggaggacatggtttaatactttctttatccaatcaacaattgcctttgatgactatcttcttttattttattattcgatttattgttagtatgtttagttatggaagtggcttacctggaggtatttttttacctattttaactttaggtgctttggcaggcctattatttgggcaaatagcttctcaattaggtttattgaaccaatcttttctttctctttttttgatattagggatggcagggtattttgcggcaatttcaaaagcaccactgacaggcatgattttggtaactgaaatggtaggtgatttgaaacccttaatggccatagctgtagttacttttgtctcctatttagtgatggatttgttaaatggacagccaatttacgaagctatgctagataagatggcaatgaagcatccaactaatcttgttgaaccaacattaattgaattgactgttggtgataagattgcagggaaatatgttaaagagttaaagcttccagaaaatgtcttaattacaacccaaattcaccatcaaaaatctcaagttgtgtcaggtaacacgcgccttttatcaggagcaactatctttttggtcgttaatgaagctgatacaggttttgtccgtgaggtattgatg

SEQ ID NO: 5304 - protein, 522 aa, Streptococcus pyogenes
MVTVYLKEREDNMENHKNEFTFSNKSIIAYVWRGVVVGIIAGVIVSLFRLLIEVTADWVIEWYRYAHINSLLLLPILSVSLLAVLFVGFLVKSDSDIKGSGIPHVEGELKGLMSPDWWSVLWKKFLGGIMAISMGFMLGREGPSIQLGAMSAKGLAKFLKSSRLEKRVLIASGAAAGLSAAFNAPIAGLLFVVEEIYHHFSRLIWITALVASLVANFISLNIFGLKPVLAMSEAMPFLGLNQYWLLLLLGLFLGCLGYLYEIVILNFNKLYVILGSWLHLPDYFYGIIMVFLILPIGYYLPQLLGGGHGLILSLSNQQLPLMTIFFYFIIRFIVSMFSYGSGLPGGIFLPILTLGALAGLLFGQIASQLGLLNQSFLSLFLILGMAGYFAAISKAPLTGMILVTEMVGDLKPLMAIAVVTFVSYLVMDLLNGQPIYEAMLDKMAMKHPTNLVEPTLIELTVGDKIAGKYVKELKLPENVLITTQIHHQKSQVVSGNTRLLSGATIFLVVNEADTGFVREVLM

SEQ ID NO: 5305 - DNA, 1110 bp, Streptococcus agalactiae
ttggttattactatatttcgaaagagaagggagaaaagaatgcgtagagtttattcctttttaggcggtattgttcttgttatcctgatcctctttggtttaaccacttacttagaaaaaaagagtagttcaacacctaactcagataagttagttatttataactggggagactatattgatccagccttattaaaaaaatttacaaaagaaactggaattgaagtacaatacgaaacgtttgactctaatgaggctatgcacaccaaaattaagcagggtgggacgacatatgatattgctgtacctagtgattatatgattgacaaaatgataaaagaaaaccttctggttaaacttgatcattcaaagatagctaattgggatgctattggagccaggtttaaaaatttgagtttcgatcctaaaaataaatattcgattccttatttctggggaactgttgggattgtttataatgatcaattagttaaaactcctcctaaacattgggatgatttatggcgtccagagtttcgaaataaaatcatgctagttgatagtgcacgtgaggttattggagttggtttaaattccttgggatatggattgaatacaaagaacatatcagaattaaaagccgcttctaaaaagttagatgctctaacaccaaacgttaaggctattgttgctgatgagatgaaaggctatatgattcagggagatgcagcgattggtgttacattctctggagaagcacgagaaatgcttgatgggaacaagcatttgcattacgttgttcctagtgaaggatcgaacctttggtttgataatattgtaatccccaaaacagtaaagcatcgcaaagaagcctatgcctttattaatttcatgatggaacctaaaaatgcggcacaaaatgcagaatatattggttatgcgacccctaatctcaaagcaaaagcgctgttaccagcagatatcaaaaatgataaagcattttatcctcctgataaaacaattgatcatttagaagtttataataacttgggtcaaaaatggcttggtatttacaatgatttgtacttacaatttaaaatgtatcgtaag

SEQ ID NO: 5306 - protein, 370 aa, Streptococcus agalactiae
MVITIFRKRREKRMRRVYSFLGGIVLVILILFGLTTYLEKKSSSTPNSDKLVIYNWGDYIDPALLKKFTKETGIEVQYETFDSNEAMHTKIKQGGTTYDIAVPSDYMIDKMIKENLLVKLDHSKIANWDAIGARFKNLSFDPKNKYSIPYFWGTVGIVYNDQLVKTPPKHWDDLWRPEFRNKIMLVDSAREVIGVGLNSLGYGLNTKNISELKAASKKLDALTPNVKAIVADEMKGYMIQGDAAIGVTFSGEAREMLDGNKHLHYVVPSEGSNLWFDNIVIPKTVKHRKEAYAFINFMMEPKNAAQNAEYIGYATPNLKAKALLPADIKNDKAFYPPDKTIDHLEVYNNLGQKWLGIYNDLYLQFKMYRK

SEQ ID NO: 5307 - DNA, 1071 bp, Streptococcus pyogenes
atgcgtaaactttattcctttctagcaggagttttgggtgttattgttattttaacaagtctttctttcatcttgcagaaaaaatcgggttctggtagtcaatcggataaattagttatttataactggggagattacattgatccagctttgctcaaaaaattcaccaaagaaacgggcattgaagtgcagtatgaaactttcgattccaatgaagccatgtacactaaaatcaagcagggcggaaccacttacgacattgctgttcctagtgattacaccattgataaaatgatcaaagaaaacctactcaataagcttgataagtcaaaattagttggcatggataatatcgggaaagaatttttagggaaaagctttgacccacaaaacgactattctttgccttatttctggggaaccgttgggattgtttataatgatcaattagttgataaggcgcctatgcactgggaagatctgtggcgtccagaatataaaaatagtattatgctgattgatggagcgcgtgaaatgctaggggttggtttaacaacttttggttatagtgtgaattctaaaaatctagagcagttgcaggcagccgagagaaaactgcagcagttgacgccgaatgttaaagccattgtagcagatgagatgaaaggctacatgattcaaggtgacgctgctattggaattaccttttctggtgaagccagtgagatgttagatagtaacgaacaccttcactacatcgtgccttcagaagggtctaacctttggtttgataatttggtactaccaaaaaccatgaaacacgaaaaagaagcttatgcttttttgaactttatcaatcgtcctgaaaatgctgcgcaaaatgctgcatatattggttatgcgacaccaaataaaaaagccaaggccttacttccagatgagataaaaaatgatcctgctttttatccaacagatgacattatcaaaaaattggaagtttatgacaatttagggtcaagatggttggggatttataatgatttatacctccaatttaaaatgtatcgcaaa

SEQ ID NO: 5308 - protein, 357 aa, Streptococcus pyogenes
MRKLYSFLAGVLGVIVILTSLSFILQKKSGSGSQSDKLVIYNWGDYIDPALLKKFTKETGIEVQYETFDSNEAMYTKIKQGGTTYDIAVPSDYTIDKMIKENLLNKLDKSKLVGMDNIGKEFLGKSFDPQNDYSLPYFWGTVGIVYNDQLVDKAPMHWEDLWRPEYKNSIMLIDGAREMLGVGLTTFGYSVNSKNLEQLQAAERKLQQLTPNVKAIVADEMKGYMIQGDAAIGITFSGEASEMLDSNEHLHYIVPSEGSNLWFDNLVLPKTMKHEKEAYAFLNFINRPENAAQNAAYIGYATPNKKAKALLPDEIKNDPAFYPTDDIIKKLEVYDNLGSRWLGIYNDLYLQFKMYRK

SEQ ID NO: 5309 - DNA, 798 bp, Streptococcus agalactiae
gtggttaacaaaggagaggaaagcatgaaaaaattcgcaaatatctatttagcacttgtttttattatcctttatattcctattatttatttgattttttattctttcaataaaggtggggatatgaattcttttactggattcacctttagtcactatggagaactgtttcaggatagccgcttaatgctaattttagtgcaaacattctttttggcttttcttagcgccttattagctacaattattggtacctttggagctatttggatttatcaggtaagacgtagacatcaaacctctattttatcgcttaataatatccttttagtagcaccagatgttatgattggtgcaagttttctcttagtatttactgttattggtttacagttaggtttcacttctgtattattgagccatgttgcattctctattcctattgttgttttaatggtcttacctcgtttaaaagaaatgaatgatgatatgattaatgcttcctatgatttaggagcttcaacttggcaaatgcttaaagaagttatgttaccctatttgtcgtcgggtattatttcaggtttctttatggctttcacttactcgctagatgattttgcggttactttctttgttacaggtaatggcttttcaacgctttcagtagaaatctattcacgcgcacgtcgcggtatatcattggaaattaacgccttgtcaactattgtctttttatttagtattttattggtaattggttattactatatttcgaaagagaagggagaaaagaatgcg

SEQ ID NO: 5310 - protein, 266 aa, Streptococcus agalactiae
MVNKGEESMKKFANIYLALVFIILYIPIIYLIFYSFNKGGDMNSFTGFTFSHYGELFQDSRLMLILVQTFFLAFLSALLATIIGTFGAIWIYQVRRRHQTSILSLNNILLVAPDVMIGASFLLVFTVIGLQLGFTSVLLSHVAFSIPIVVLMVLPRLKEMNDDMINASYDLGASTWQMLKEVMLPYLSSGIISGFFMAFTYSLDDFAVTFFVTGNGFSTLSVEIYSRARRGISLEINALSTIVFLFSILLVIGYYYISKEKGEKNA

SEQ ID NO: 5311 - DNA, 774 bp, Streptococcus pyogenes
atgaaaaaatttgccaatctttatttagcgagtgtctttgttttactctacattcctattttttatttgattttctattctttcaacaaaggtggggatatgaatggttttacaggatttacccttgagcattaccaaaccatgtttgaggatagtcgtctcatgacaatcttactgcaaacctttgttcttgcttttagtagcgctctactagcaacgattattgggatctttggagctatctttatccaccatgttagaggtaagtaccaaaatgccatgctatcagccaataatgtcttgatggtatcaccagatgtcatgattggggcttcctttttaattctttttacatcattgaagtttcagctgggcatgtcttcagttttattaagtcatattgctttttcgattcctattgtggttttgatggtattgccgcgcttgaaagagatgaatcaggacatggtcaacgccgcttatgatttgggagctaattatttccaaatgctcaaagaagtcatgctgccatactttacaccagggattattgcaggttattttatggcctttacctattccttagatgattttgcagtgactttctttttgactggaaatagtgttactacattatctgttgagatttattcgcgggctcgtcagggaatttccttggatatcaatgctttgtcaaccatcgttttctttttctccatcctcttagtgatcggttattattatatgtcacaggacaaggaggaaaaacatgcg

SEQ ID NO: 5312 - protein, 258 aa, Streptococcus pyogenes
MKKFANLYLASVFVLLYIPIFYLIFYSFNKGGDMNGFTGFTLEHYQTMFEDSRLMTILLQTFVLAFSSALLATIIGIFGAIFIHHVRGKYQNAMLSANNVLMVSPDVMIGASFLILFTSLKFQLGMSSVLLSHIAFSIPIVVLMVLPRLKEMNQDMVNAAYDLGANYFQMLKEVMLPYFTPGIIAGYFMAFTYSLDDFAVTFFLTGNSVTTLSVEIYSRARQGISLDINALSTIVFFFSILLVIGYYYMSQDKEEKHA

SEQ ID NO: 5313 - DNA, 813 bp, Streptococcus agalactiae
atgctatcgaggaggagagaaatgaagaaaacctctagtctattttcaattccttatatggcttggttattcttatttgtattagcacctgttgctttgattgcttggaactcgttctttgatattaatgggcactttactttagctaattaccagacgttttttagctcaggaacctatcttaaaatgagctttaactcggtcctatatgcaggcatcgttagtttcataacgcttttgattagctatccagctgcttatttgcttacaaaattaaaacacaagcaattatggctaatgctagttattttgccaacatggattaatcttttgttaaaagcctatgcttttatggggatatttggtcaacaagggggaattaacgccttcttaacctttataggtatcggcccaaaacagattctatttacagacttttcatttctttttgtagcagcttacattgaattaccgtttatgttattacccatttttaatgccttggatgatattgatcaaaatctcatttatgcaagtgatgacttgggtgcaaatgcatggcaaacttttcagaaggttatatttcctttatctctgaatggtgtaagagcaggtgtacagtctgtctttatccctagtttgagtctctttatgcttacgcgtcttattggtggtaatcgagttatcactttagggacagccatagaacaacattttttaatcacacaaaataaaggtatgggctcaaccataggggttattttaattttagtgatggttgctattatgtggttaacaaaggagaggaaagca

SEQ ID NO: 5314 - protein, 271 aa, Streptococcus agalactiae
MLSRRREMKKTSSLFSIPYMAWLFLFVLAPVALIAWNSFFDINGHFTLANYQTFFSSGTYLKMSFNSVLYAGIVSFITLLISYPAAYLLTKLKHKQLWLMLVILPTWINLLLKAYAFMGIFGQQGGINAFLTFIGIGPKQILFTDFSFLFVAAYIELPFMLLPIFNALDDIDQNLIYASDDLGANAWQTFQKVIFPLSLNGVRAGVQSVFIPSLSLFMLTRLIGGNRVITLGTAIEQHFLITQNKGMGSTIGVILILVMVAIMWLTKERKA

SEQ ID NO: 5315 - DNA, 813 bp, Streptococcus pyogenes
atgccattgaggaggagcgtaatgaagaaaacctctagtcttttttcgattccttacttcttatggattctcttttttgttgtggcaccagtcactctcttgttttacaagtccttttttgacatagaagggcgcgtgaccttagccaattatgaaaccttttttagctcttggacttatttgaggatgagtgtgaattctattttatacgctggtattatcacactcgtcacgctcttgatttcatatcctacggctctctttttaacgcgcctaaagcacaagcagttgtggcttatgctcattatcttgccaacctgggtaaatttattgctaaaggcctatgcctttatgggaatctttggtcaacaaggagggattaacagctttttaacctttatggggattggcccgcagcaaatccttttcacagatttctccttcatttttgtagcctcttacattgagctcccttttatgatgttaccgatttttaacgctttggatgatattgaccataatgtcatcaatgccagtcgcgacctaggagctagtgaatttcaggccttctcaaaagttatttttcccctttctttaaatggggttagggcaggtgttcagtctgtctttatcccaagtttgagtctctttatgttaacccgtttgattggtggaaaccgggtgattacacttggtacagccattgaacaacattttttgaccacccaaaactggggaatgggatcaaccattggtgtcgtcttgattttgaccatggttgctattatgtggctcacaaaggagaaaagtaaa

SEQ ID NO: 5316 - protein, 271 aa, Streptococcus pyogenes
MPLRRSVMKKTSSLFSIPYFLWILFFVVAPVTLLFYKSFFDIEGRVTLANYETFFSSWTYLRMSVNSILYAGIITLVTLLISYPTALFLTRLKHKQLWLMLIILPTWVNLLLKAYAFMGIFGQQGGINSFLTFMGIGPQQILFTDFSFIFVASYIELPFMMLPIFNALDDIDHNVINASRDLGASEFQAFSKVIFPLSLNGVRAGVQSVFIPSLSLFMLTRLIGGNRVITLGTAIEQHFLTTQNWGMGSTIGVVLILTMVAIMWLTKEKSK

SEQ ID NO: 5317 - DNA, 1152 bp, Streptococcus agalactiae
ttgactaacccaatcattgcatttaaaaatgtatcaaaggtatttgaagacagcaacaccgttgtcttaaaagatattaattttgaacttgaagaaggtaaattttacaccttattaggggcctcaggaagtggtaaatcaactatcttaaatattattgcaggtttgctagaggcgagtacaggcgatatttacttagatgggaaacgcatcaatgatgttcccactaataaacgggatgttcataccgttttccaaaactatgctttgtttccacatatgacggtttttgaaaacgttgcttttccattaaagttgaaaaaaatggataagaaagaaattcaaaaacgtgttcaagaaactctaaaaatggttcgtttagaagggtttgaaaaacgagccattcaaaaattatcaggaggacaacgccagcgtgttgcgatagcgcgtgctatcatcaatcaacctaaagtagtcttactagatgaacccttatcagcattggatttgaaattgcgtacagagatgcaatatgaattgcgcgaactgcaacaacgtttaggaattacctttgtttttgtcacacatgatcaagaagaagcgttggcaatgagtgattggattttcgtcatgaatgaaggtgaaattgttcaatcaggaacaccagtagatatctacgatgaacctatcaatcattttgtagcaacttttataggtgaatcaaatatcttatctggcaagatgattgaggattatttggttgaatttaacggtaagcgctttgaggctgttgatggcggtatgcgccctaatgaatcagtccaagtagttattcgtccagaagatcttcaaattaccctacccgatgaaggaaaacttcaagttaaagtggacacacaactttttcgaggtgtccactatgaaattattgcttatgatgatttaggtaatgaatggatgattcattcaactcgtaaagctattgagggtgaagttattggtttagatttcactccagaagatatacatattatgcgtcttaatgaaacagaagaagaatttgatgcgcgcattgaagaatatgtagacactgacgatcatgaggatggtttaatcaatgctatcgaggaggagagaaatgaagaaaacctc

SEQ ID NO: 5318 - protein, 384 aa, Streptococcus agalactiae
MTNPIIAFKNVSKVFEDSNTVVLKDINFELEEGKFYTLLGASGSGKSTILNIIAGLLEASTGDIYLDGKRINDVPTNKRDVHTVFQNYALFPHMTVFENVAFPLKLKKMDKKEIQKRVQETLKMVRLEGFEKRAIQKLSGGQRQRVAIARAIINQPKVVLLDEPLSALDLKLRTEMQYELRELQQRLGITFVFVTHDQEEALAMSDWIFVMNEGEIVQSGTPVDIYDEPINHFVATFIGESNILSGKMIEDYLVEFNGKRFEAVDGGMRPNESVQVVIRPEDLQITLPDEGKLQVKVDTQLFRGVHYEIIAYDDLGNEWMIHSTRKAIEGEVIGLDFTPEDIHIMRLNETEEEFDARIEEYVDTDDHEDGLINAIEEERNEENL

SEQ ID NO: 5319 - DNA, 900 bp, Streptococcus agalactiae
atgattaaaacaatacaaaaagaattagaaggtctcgatattcgctttgatgagcctttaaagaaatatacttatactaaagtaggaggacctgctgattatcttgcattcccaaggaatcgccttgaactatcgcgtattgttaagtttgctaacagtcaaaatattccttggatggttttaggaaatgcgagtaatattatcgttagagatggtggtatccgtggttttgttatcatgtttgataaactgtcaactgtgacagtcaacggttatgttattgaagcagaagcaggagctaatctcattgaaacaactcgtattgcacgttatcatagcttaactggctttgagtttgcttgcggaattcctggaagtgtaggtggagcggtctttatgaatgctggcgcttacggtggtgaaattgctcatattttattgtctgcacaggttttgacaccacagggtgaactcaaaacgattgaagctaggaatatgcaatttggttatcgtcattctgtcattcaagagagtggagatattgttatatcagctaagtttgccttaaaaccaggagatcatctcatgattactcaggaaatggatcgtttaacctatctccgtgagctgaaacaacctttagaatacccttcttgtggttctgtgttcaaacgtcctccaggacattttgcagggcaactcattagcgaagcacatcttaaaggtcaacgtattggtggagtagaggttagtcaaaaacatgctggttttatggttaacattgcagaaggttcagctcaagattatgaaaatcttattgaacatgttattaacaccgttgaatcaacttcaggtgtccatttggaaccagaagttcgtattatcggtgagtcgctatta

SEQ ID NO: 5320 - protein, 300 aa, Streptococcus agalactiae
MIKTIQKELEGLDIRFDEPLKKYTYTKVGGPADYLAFPRNRLELSRIVKFANSQNIPWMVLGNASNIIVRDGGIRGFVIMFDKLSTVTVNGYVIEAEAGANLIETTRIARYHSLTGFEFACGIPGSVGGAVFMNAGAYGGEIAHILLSAQVLTPQGELKTIEARNMQFGYRHSVIQESGDIVISAKFALKPGDHLMITQEMDRLTYLRELKQPLEYPSCGSVFKRPPGHFAGQLISEAHLKGQRIGGVEVSQKHAGFMVNIAEGSAQDYENLIEHVINTVESTSGVHLEPEVRIIGESLL

SEQ ID NO: 5321 - DNA, 885 bp, Streptococcus pyogenes
atgataactgaacttcatgggattgatattcgagagaatgaacccctaaaacattacacttacactaaggtaggtggcccagcagatttcttggcttttcctagaaatcactacgagctatcacgcatcgttgcttatgccaacaaagaaaatatgccttggcttgttttgggaaatgccagcaatctcattgtgcgagatggtggtattcgtggctttgtcatcatgtttgataagctaaatgcagtgcacttaaatggttataccttagaagccgaagctggtgccaatctgattgaaacaacgaagattgccaaattccatagtttaacagggtttgaatttgcatgtggcattcctggaagcattgggggtgctgtttttatgaatgcgggtgcttatggtggggaaatatcacatattttcttatccgctaaggtgcttaccccaagtggagagatcaaaaccatttcagctagggatatggcttttggttaccgtcactctgccattcaagaaacaggtgacattgtcatttctgctaagtttgctcttaaaccgggtaattatgatacgatcagccaagaaatgaatcggttaaatcaccttcgccaactaaaacaacctttagaatttccatcttgtggatctgtgtttaagcgcccgccaggacactttgcaggtcaattaatcatggaagcaaatcttaaagggcatcggattggtggtgtggaagtttccgaaaaacacactggttttatgattaatgtggcagatggcacagctaaagattatgaagatttgattgcttatgtcattgagacagttgaaaaccattctggtgtcaggcttgaaccagaagttcggattattggggaaaacctg

SEQ ID NO: 5322 - protein, 295 aa, Streptococcus pyogenes
MITELHGIDIRENEPLKHYTYTKVGGPADFLAFPRNHYELSRIVAYANKENMPWLVLGNASNLIVRDGGIRGFVIMFDKLNAVHLNGYTLEAEAGANLIETTKIAKFHSLTGFEFACGIPGSIGGAVFMNAGAYGGEISHIFLSAKVLTPSGEIKTISARDMAFGYRHSAIQETGDIVISAKFALKPGNYDTISQEMNRLNHLRQLKQPLEFPSCGSVFKRPPGHFAGQLIMEANLKGHRIGGVEVSEKHTGFMINVADGTAKDYEDLIAYVIETVENHSGVRLEPEVRIIGENL

SEQ ID NO: 5323 - DNA, 486 bp, Streptococcus agalactiae
atgacaaccgtttacttgagtttaggtagtaatattggtgatagagaaacttttctgaagcaggctctcttttcaattgatcatttgcaaaagacaaaagtcgcgcaaatttccgctatttatgaaacagctgcttgggggaatactaaccaagaagatttttttaatatatgttgtcaggtagagacagacttagcaccttttgaattattggattattgtcaagaaattgaaaaatgcttaaagcgcgtgagacatgagcactggggtccaaggacaatagatattgatatcttactttttggtaatcaagtgattaaccaagaagatttagtagtaccccatccgtatatgacgaagcgagcatttgttctagttccgttactcgaaatagcacctcaactaagtttacctaatggttctaagctagaagactatctcgaaaaattgaatttaggagaagttcattatttaaaaccagtcgaa

SEQ ID NO: 5324 - protein, 162 aa, Streptococcus agalactiae
MTTVYLSLGSNIGDRETFLKQALFSIDHLQKTKVAQISAIYETAAWGNTNQEDFFNICCQVETDLAPFELLDYCQEIEKCLKRVRHEHWGPRTIDIDILLFGNQVINQEDLVVPHPYMTKRAFVLVPLLEIAPQLSLPNGSKLEDYLEKLNLGEVHYLKPVE

SEQ ID NO: 5325 - DNA, 498 bp, Streptococcus pyogenes
atgaccattgtttatttaagtttaggcaccaatatgggggaccgagcagcttacttgcaaaaagctcttgaggctttagctgacttacctcaaacacggttgcttgctcaatcatccatttatgaaacgactgcttggggcaagacaggccaggctgattttctcaatatggcctgtcaattagatacacaattaaccgcggctgatttcttaaaagaaacacaagctattgagcaatctcttggtcgtgtgaggcatgaaaaatggggatcaagaactattgacattgatatcttgctatttggagaagaggtttatgacacaaaggaattgaaagtgccacacccttatatgactgagcgtgcttttgttttaatccccttattggaattgcagccagatttaaaattgcctcctaatcataagtttttaagggattatcttgcagctttagatcaatcagatatcacactcttttcagctcaacagacagagttc

SEQ ID NO: 5326 - protein, 166 aa, Streptococcus pyogenes
MTIVYLSLGTNMGDRAAYLQKALEALADLPQTRLLAQSSIYETTAWGKTGQADFLNMACQLDTQLTAADFLKETQAIEQSLGRVRHEKWGSRTIDIDILLFGEEVYDTKELKVPHPYMTERAFVLIPLLELQPDLKLPPNHKFLRDYLAALDQSDITLFSAQQTEF

SEQ ID NO: 5327 - DNA, 360 bp, Streptococcus agalactiae
atggataagatttatttaaataaatgtcggttttatggttatcatggtgctttttcggaagaacaaacattggggcaagtttttcaagttgatgctgttctatcacttgatttggcaaaagcatcacaaactgatgatttaattgatacggttcattatggtgaagtttttgactgtattaaaaatcatgttgaaaacgaacagtatcaattaatagagaaattagcaggtgttattgttgaagatattttcttacagtttcatccagtacaagctattacattaaagattacaaaagacaatccaccaattaatgggcactatgaatcagttggaattgaattggagcgcaggcgagca

SEQ ID NO: 5328 - protein, 120 aa, Streptococcus agalactiae
MDKIYLNKCRFYGYHGAFSEEQTLGQVFQVDAVLSLDLAKASQTDDLIDTVHYGEVFDCIKNHVENEQYQLIEKLAGVIVEDIFLQFHPVQAITLKITKDNPPINGHYESVGIELERRRA

SEQ ID NO: 5329 - DNA, 357 bp, Streptococcus pyogenes
atggataaaatcgtattagaaggttgccgtttttatggctaccatggagcctttaaagaagaacagacccttgggcaaatttttctggttgatttagaattgtcagtcgatttgcaagcagcttctttgtcagaccaattaacagatacggtccattacgggatggtgtttgatagtgtccgtcagttagtggaaggggaaaagtttattttgattgaacgtttagcaggtgcgatttgtgaacagctttttaacgaatttccgcctattgaagccatcaaagtggccattaaaaaggaaaacccaccgattgcaggccactataaggcagttggtattgaattggagagacagaga

SEQ ID NO: 5330 - protein, 119 aa, Streptococcus pyogenes
MDKIVLEGCRFYGYHGAFKEEQTLGQIFLVDLELSVDLQAASLSDQLTDTVHYGMVFDSVRQLVEGEKFILIERLAGAICEQLFNEFPPIEAIKVAIKKENPPIAGHYKAVGIELERQR

SEQ ID NO: 5331 - DNA, 801 bp, Streptococcus agalactiae
atgaaaataggacaatatgatattacaggtaaagcttgtatcatggggattttaaatgtaacgcctgattccttctcagatggtggttcttataccacaattgattcagctttaaatcaagttggtgagatgcttgaacaaggggtggcaattgtagatattgggggagaatcaacgcggccaggtgcagtatttgtgactgctgaagaagaaattaaacgtgtagttccaatgattaaagctattagagaggtctaccctgatcttttgttatcaatagatacttataaaacagaggtagctcaagcagcccttgatgcaggtgtacatattttaaatgacgtttggtcaggtttatatgatggtaaaatgctatctttagcagcagaacgaaatgttccaattattttgatgcataaccaggaagaagctgtttatcaagatatcaaaaaagaagtttgtgaattcttacttgaaagagcagagcgtgctttagaagcaggtgtttcaaaggataatatttggatagatcctggctttggttttgctaaaacagaggagcaaaatttagaactattaaaaggtttggaacaagtgtgtgatttaggttatcctgtgttatttgggatctctcgaaaacgtactgttaattatcttctaggtggtaatagggaagtaactgaacgtgatatggggacggctgctttatcggcatgggcaatagcaaaggggtgtcagattgtacgtgttcacaatgttgaagtaaataaggacattgtgacagtaattagtcagttggtg

SEQ ID NO: 5332 - protein, 267 aa, Streptococcus agalactiae
MKIGQYDITGKACIMGILNVTPDSFSDGGSYTTIDSALNQVGEMLEQGVAIVDIGGESTRPGAVFVTAEEEIKRVVPMIKAIREVYPDLLLSIDTYKTEVAQAALDAGVHILNDVWSGLYDGKMLSLAAERNVPIILMHNQEEAVYQDIKKEVCEFLLERAERALEAGVSKDNIWIDPGFGFAKTEEQNLELLKGLEQVCDLGYPVLFGISRKRTVNYLLGGNREVTERDMGTAALSAWAIAKGCQIVRVHNVEVNKDIVTVISQLV

SEQ ID NO: 5333 - DNA, 798 bp, Streptococcus pyogenes
atgaaaattggaaagtttgtgattgagggcaatgcggctatcatggggattttaaatgtgactccagattctttttcagatggggggtcttacactactgtgcaaaaagcattagatcacgttgagcaaatgattgctgatggggctaaaatcatcgacgttggtggagaatcaacacgtccaggttgccaatttgtaagcgctaccgatgaaattgaccgggtggttcctgtgatcaaggccatcaaagaaaactatgatattctaatcagcattgatacctataaaaccgaaacagctagagcagctttagaggcgggtgccgatattctcaatgatgtttgggcaggtttgtacgacggtcaaatgtttgccttagcagccgagtacgatgcgcctatcatcttgatgcataaccaagacgaagaagtttatcaagaggtaacacaagacgtttgtgattttctaggcaatagagcacaagcagctcttgatgctggcgtgccaaaaaacaatatttgggttgatccaggatttggatttgccaaatctgttcaacagaatacggagttattaaaaggattggaccgcgtctgtcagttgggctatcctgtcttgtttggtatttcgagaaagcgtgtcgtagatgccttgttaggcggcaacaccaaagctaaagagcgagacggagcgacagcagccttgtctgcttatgcccttggaaaaggctgtcagattgtacgcgtacacgatgtcaaggctaatcaagacattgtggctgtgttgagccagttgatg

SEQ ID NO: 5334 - protein, 266 aa, Streptococcus pyogenes
MKIGKFVIEGNAAIMGILNVTPDSFSDGGSYTTVQKALDHVEQMIADGAKIIDVGGESTRPGCQFVSATDEIDRVVPVIKAIKENYDILISIDTYKTETARAALEAGADILNDVWAGLYDGQMFALAAEYDAPIILMHNQDEEVYQEVTQDVCDFLGNRAQAALDAGVPKNNIWVDPGFGFAKSVQQNTELLKGLDRVCQLGYPVLFGISRKRVVDALLGGNTKAKERDGATAALSAYALGKGCQIVRVHDVKANQDIVAVLSQLM

SEQ ID NO: 5335 - DNA, 561 bp, Streptococcus agalactiae
atgcccaatcaagaaaaaatggaaaaagctatttatcaatttttagaggctttaggagaaaatcctaatcgagaaggattgaaagatacaccgaagcgtgtggcaaaaatgtatatagaaatgttctcaggacttaatcaagatccaaaggagcaattcactgcagtcttttctgaaaatcatgaagaggttgtgattgtcaaggatattccattctattccatgtgtgaacatcatttggttcctttttatggtaaagctcatattgcttatttaccaaacgatggacgtgttactggacttagtaagcttgcacgtgcagttgaagtggcgagtaagcgtcctcaacttcaggaacgtttaacagcacaagttgcacaagctttagaggatgctttggcgcctaaaggtatttttgttatgatagaagcagagcatatgtgcatgacaatgcgtggcattaaaaaaccaggaagtaagacgattacaacggtagctcgtggtttatacaaggacgatcgatatgaaagacaagaaattctatcgctaatacaaaaagga

SEQ ID NO: 5336 - protein, 187 aa, Streptococcus agalactiae
MPNQEKMEKAIYQFLEALGENPNREGLKDTPKRVAKMYIEMFSGLNQDPKEQFTAVFSENHEEVVIVKDIPFYSMCEHHLVPFYGKAHIAYLPNDGRVTGLSKLARAVEVASKRPQLQERLTAQVAQALEDALAPKGIFVMIEAEHMCMTMRGIKKPGSKTITTVARGLYKDDRYERQEILSLIQKG

SEQ ID NO: 5337 - DNA, 600 bp, Streptococcus pyogenes
atgaaaaggaaaaaactaatgaaaagggaaagactaatgtctattaataaggaaaaagcagaagcagccatttatcagtttttagaggctattggtgaaaatccaaatcgggaaggtcttcttgacacgcctaaacgggttgctaaaatgtatgcggagatgtttttgggactgggaaaagatcctaaagaggagtttacggctgtctttaaagaacaacatgaggatgtggtgattgtcaaagacattagtttttattctatatgtgaacaccacttagttcctttttatggcaaggctcatatcgcttacttgccaagtgatggtcgagtaacaggtttgagtaaattagcgcgagcagttgaagtagctagtaaacgacctcaactccaagagcgtttgacctctcaaatagcggatgctttagttgaagccctcaatcctaaagggactttagttatggtagaagcagagcacatgtgcatgaccatgcgaggcatcaaaaagccaggtagtaaaaccattaccaccactgccagaggcttatataaggaaagtcgtgctgagaggcaagaagttatttctctaatgacaaaagat

SEQ ID NO: 5338 - protein, 200 aa, Streptococcus pyogenes
MKRKKLMKRERLMSINKEKAEAAIYQFLEAIGENPNREGLLDTPKRVAKMYAEMFLGLGKDPKEEFTAVFKEQHEDVVIVKDISFYSICEHHLVPFYGKAHIAYLPSDGRVTGLSKLARAVEVASKRPQLQERLTSQIADALVEALNPKGTLVMVEAEHMCMTMRGIKKPGSKTITTTARGLYKESRAERQEVISLMTKD

SEQ ID NO: 5339 - DNA, 1260 bp, Streptococcus agalactiae
atgacttatcaagaagcgctagaatggattcatagtaaattagcttttggtattaaaccaggtttggaacgtatgagatggatgctagagcagctgggaaaccctcaaaacaacctatctgccattcatgttgttggaacgaatggtaaaggatcaacaactagttatttacaacatatttttaccaattctggttatcaagttggaacatttacatcaccatatattgttgactttagagagcgtattagcattgatggtcaaatgattccagagtctgattttatcaaacttgttgaaactgttcgtccagttgttgaacggttgcaccttgagaccaacctagaaccagctacagaatttgaagttataacagttttgatgttctattattttggcaatagctgtccggttgatatcgtcattattgaggctggaatgggcggttattatgattctaccaacatgttcaaggctttagcggttacttgtccgtcaattggattagatcatcaggaggttttaggacgaacttatgtagatatagctgagcaaaaagtaggtgttttaaaaaaaggagttccattcgtatatgctaatgatcgtcaggatgttgaagaagtctttcaaataaaagccaaggaaacccacagccagacttatcgtttacacaatgacttttatataaaagaagaggaaaattattttaactatataggtcctcaagcaaatattgatcatattcagttgcaaatgccgggacatcaccaagtttccaatgctagcatagctataactaccagtttattattaagagacaaatatccaaagttaaccctacagaccattaaagatgggcttgaaatgacaaaatgggtaggccgtacagaattaatctttccgaatgtaatgattgatggcgctcataataatgaaagtgtcgatgctctcgttcaagttataaaaaaatatcagcagaaaaacgtgcatattctatttgctgcaattaatactaaaccgatagagagtatgttagaatcattgtctagtatcgctccggtttcggttactagctttgattaccctaaatcaataaacttagacaaatatcctaaagcgtacactagagttagtgattggaagaaatggctacatgatataaatctgacatcagataaagatttctatgtgattactggctccctttattttatttctcaagttcgtcaggagctactattaatcaaaactacaacaact

SEQ ID NO: 5340 - protein, 420 aa, Streptococcus agalactiae
MTYQEALEWIHSKLAFGIKPGLERMRWMLEQLGNPQNNLSAIHVVGTNGKGSTTSYLQHIFTNSGYQVGTFTSPYIVDFRERISIDGQMIPESDFIKLVETVRPVVERLHLETNLEPATEFEVITVLMFYYFGNSCPVDIVIIEAGMGGYYDSTNMFKALAVTCPSIGLDHQEVLGRTYVDIAEQKVGVLKKGVPFVYANDRQDVEEVFQIKAKETHSQTYRLHNDFYIKEEENYFNYIGPQANIDHIQLQMPGHHQVSNASIAITTSLLLRDKYPKLTLQTIKDGLEMTKWVGRTELIFPNVMIDGAHNNESVDALVQVIKKYQQKNVHILFAAINTKPIESMLESLSSIAPVSVTSFDYPKSINLDKYPKAYTRVSDWKKWLHDINLTSDKDFYVITGSLYFISQVRQELLLIKTTTT

SEQ ID NO: 5341 - DNA, 1374 bp, Streptococcus pyogenes
gtgtttggtgaggataataaaaaaaagggtactactctaggttatctgctgtcacttttttttatatatggtatactaaagatagatgtgaggtatgaaatgacttatgaagagactctagaatggattcatgatcacttagttttcggcatcaagccaggcttaaaacgtatgctttgggttcttggacagttaggaaatccccaaaaaaatgtcaagggagtgcatatcgttggaactaacggaaaaggttccacggtcaatcatttacaacacatctttacgacagctggttatgaagtggggacctttacctctccttatattatggatttcaaagaacgtattagcataaatggtcgaatgatttcagaaaaagatttggttattgctgctaatcgtattcgtcctttgacagagcgtctagttcaagagactgattttggagaggtaactgaatttgaagtgattactttgatcatgttcctctattttggtgacatgcatcctgtagatattgctattattgaagcaggccttggcggtctttatgattcgaccaatgtttttcaagcaatggttgtggtctgtccctcaattggtttagatcaccaagctattttgggcgagacttacgctaatattgccgcccaaaaagctggtgttttagaagggggcgagacccttgtttttgccgttgaaaacccgtcagctcgagaggtttttttaacaaaagctgagcaggttggtgcttcaatctgggaatggcaagagcagtttcaaatggctgagaacgcatctggctatcgttttactagtcctttaggagttatttcagatattcacatcgctatgccaggacaccaccaagtgtctaatgcagctttagctattatgacttgcttaaccttgcaagaccgctatcctaggctaactccagatcatataagggaaggtctagcaaatagtttgtggctaggccgtaccgaattattagcaccaaatctaatgattgatggggctcataacaatgaaagcgttgctgctttggtagccgtcttaaaaaataactacaatgataaaaagcttcatattttgtttggtgcgatcgacaccaagcctattgcagatatgttggttgctcttgagcaaataggtgacttgcaggttactagctttcattaccctaacgcctatccattggaaaaatacccagaacgttttggtagggttgctgatttcaaagatttcttggccttgcgtaagcatgctaaagcagatgactttttcgtgattacagggtcactatattttatttcagaaattagacagtattgggaaaaacatattgaaaaaagcgttcttttaacccat

SEQ ID NO: 5342 - protein, 458 aa, Streptococcus pyogenes
VFGEDNKKKGTTLGYLLSLFFIYGILKIDVRYEMTYEETLEWIHDHLVFGIKPGLKRMLWVLGQLGNPQKNVKGVHIVGTNGKGSTVNHLQHIFTTAGYEVGTFTSPYIMDFKERISINGRMISEKDLVIAANRIRPLTERLVQETDFGEVTEFEVITLIMFLYFGDMHPVDIAIIEAGLGGLYDSTNVFQAMVVVCPSIGLDHQAILGETYANIAAQKAGVLEGGETLVFAVENPSAREVFLTKAEQVGASIWEWQEQFQMAENASGYRFTSPLGVISDIHIAMPGHHQVSNAALAIMTCLTLQDRYPRLTPDHIREGLANSLWLGRTELLAPNLMIDGAHNNESVAALVAVLKNNYNDKKLHILFGAIDTKPIADMLVALEQIGDLQVTSFHYPNAYPLEKYPERFGRVADFKDFLALRKHAKADDFFVITGSLYFISEIRQYWEKHIEKSVLLTH

SEQ ID NO: 5343 - DNA, 885 bp, Streptococcus agalactiae
ttgagaaaagataatttaggaattatccttggcttgtcagcctatgttttatgggggctgttatctctttattggaaattattatctggaattgaagcatatagtacgtttgcttataggattatattcactgttttaactatgcttatttatatgctcgtttcgggtagaaaaacagtctatttaaaagacttaaaaggcttagttaataataaaaagtcattttggacaatgtttgtagccagtattttaatttcaattaattggttggtctatatttttgcagtcacgcatggtcacgctactgaggcaagtcttggttattatatgatgccgattatttcaattttgttgtcggtccttgttttacgtgaacacctggcaagagtagttagccttgcaattttgattgcaatcatgggagttggaattttagtttatcaaactggtcattttcctttaatttcactaactctagcgctttcttttggtttttatgggttattaaaaaaatcaatttctttatctagtgatttttcgatgctggtagaaagtagttttattgctccgtttgcactcatttatatagtgtttttcgccaaagattttctaactgattataatatattacaattagttttactctcactttcaggaatcattacagcagttcctcttttattatttgcagaagccattaagagggctcctctaaatattatcggctttatccaatacatcaatccaaccatccaattattgctagcattgtttatttttaaagaaactatcgttagtggggaggtaataggttttatttttatctggcttgctattttagtttttagtattggacaagtacatacgatgttaaagaaaggtaaa

SEQ ID NO: 5344 - protein, 295 aa, Streptococcus agalactiae
MRKDNLGIILGLSAYVLWGLLSLYWKLLSGIEAYSTFAYRIIFTVLTMLIYMLVSGRKTVYLKDLKGLVNNKKSFWTMFVASILISINWLVYIFAVTHGHATEASLGYYMMPIISILLSVLVLREHLARVVSLAILIAIMGVGILVYQTGHFPLISLTLALSFGFYGLLKKSISLSSDFSMLVESSFIAPFALIYIVFFAKDFLTDYNILQLVLLSLSGIITAVPLLLFAEAIKRAPLNIIGFIQYINPTIQLLLALFIFKETIVSGEVIGFIFIWLAILVFSIGQVHTMLKKGK

SEQ ID NO: 5345 - DNA, 123 bp, Streptococcus agalactiae
ttggctaattctattcctgcaacaattacagaggaagaagagcctaaacctctggccaaaggaatatctgaaaacatttttaagcggtgtggtgccaaatccgacttaacatgcaaagctgtt

SEQ ID NO: 5346 - protein, 41 aa, Streptococcus agalactiae
MANSIPATITEEEEPKPLAKGISENIFKRCGAKSDLTCKAV

SEQ ID NO: 5347 - DNA, 864 bp, Streptococcus agalactiae
atgaggataattgtacctgcaactagtgcgaatattggtccaggctttgattcaataggagttgcgttatcaaagtatttaatcattgaagtattagaagaaagtacagagtggttagttgaacacaatttagtaaatattccaaaagatcatactaacctccttattcaaacagctttgcatgttaagtcggatttggcaccacaccgcttaaaaatgttttcagatattcctttggccagaggtttaggctcttcttcctctgtaattgttgcaggaatagaattagccaatcaattaggaaatttggctctttctcaaaaagaaaaattagagatagctacccgattagaaggacatcctgataatgtagcaccggccatttttggtgatttagttatttcatcaatagtgaaaaatgatattaaaagtttggaagtgatgtttccagatagttcctttatcgcttttattccaaattatgaattaaaaacaagtgatagtcgaaatgtactacctcaaaaattgagttatgaggatgcagttgcttcaagcagcgtcgctaatgtgatggttgcgtcgttgttgaaaggtgatttggtaactgctggatgggctatagaaagggacctctttcatgaaagatatcgtcaacctttggtgaaggaatttgaagtgataaaacaaatcagcactcaaaatggtgcgtatgctacttatttgtctggagcaggaccgacggtaatggttctgtgttcgaaagaaaaagaacaagcaattgtcacagagttaagtaaattatgtttaggtggacagattcaagtgcttaatattgagcgaaaaggagtgagagttgagaaaaga

SEQ ID NO: 5348 - protein, 288 aa, Streptococcus agalactiae
MRIIVPATSANIGPGFDSIGVALSKYLIIEVLEESTEWLVEHNLVNIPKDHTNLLIQTALHVKSDLAPHRLKMFSDIPLARGLGSSSSVIVAGIELANQLGNLALSQKEKLEIATRLEGHPDNVAPAIFGDLVISSIVKNDIKSLEVMFPDSSFIAFIPNYELKTSDSRNVLPQKLSYEDAVASSSVANVMVASLLKGDLVTAGWAIERDLFHERYRQPLVKEFEVIKQISTQNGAYATYLSGAGPTVMVLCSKEKEQAIVTELSKLCLGGQIQVLNIERKGVRVEKR

SEQ ID NO: 5349 - DNA, 1323 bp, Streptococcus agalactiae
atgtttgtcttgaagttagagacaatttctaaggagaaattcatgactattaaaatagctttattaggttttggaacggttgctaagggtattccatatttgctaaaagaaaatcaacataagctactttctttagaaggcgaagatattgtgattgataaagtattagtaagagataatgaaagccgccagcgtttcatcaatcagggatttacttataactttgtgacagagataaatactattcttcaagattcacaaattgatattgtagtggaattaatgggggggattgagccagctaaaacttatttgagtcaagcattaggatttggtaaacatattgtgacagccaataaagatctcattgctttacacggaaaagagttgatggatttagcagacgctagaggtctagctttattctatgagggagcagttgctggaggcattcctattttaaggaccctatcgcattcgtttgcctcagataaaatgacacgtttattaggaattctcaacggtacctccaacttcatgttaacaaaaatgtttgaagagggatggtcttatgaacaagctctaaaaaaggcacaagagttaggttatgctgaaagtgatcccacaaatgatgttgaaggtattgatactgcctacaaagccactatcttaagtcaatttggatttggtatgcctattgattttgatgatgttaattataaggggatttctagtattcgctcagaggatgttgaagtagctcaggagatgggctttgccattaagttggtagctgatcttcgtgaaactccaactggtataagtgtagacgtttctccgacactaatttctcaaaagcatcccttagctgcagttaatcatgtgatgaatgcagtattcattgaatcaatagggattggtcagtctcttttttatggaccaggtgcgggacaaaatccaacagcaacctctgttttagcggatatcatcgatattagtcgtagtattcgatcacagataaaaattaagcctatgaatacttatcattgtccgtgtaggttgtcaatgcagtctgatattttcaatgagtactatctagctatttctttgagaaatgctgaagatagtgatacacttggaaggtactttgagcaagaaaatataggtttgaaaaatgttatcgaaaaagcattgggtgataaacaacaagaaatctatgtattaacagatgaagttagccaagagaaaataactcaatttattgaggagtttcctgagagtggtgtcattcagttaatcaatgttttcaaagtaataggaggg

SEQ ID NO: 5350 - protein, 441 aa, Streptococcus agalactiae
MFVLKLETISKEKFMTIKIALLGFGTVAKGIPYLLKENQHKLLSLEGEDIVIDKVLVRDNESRQRFINQGFTYNFVTEINTILQDSQIDIVVELMGGIEPAKTYLSQALGFGKHIVTANKDLIALHGKELMDLADARGLALFYEGAVAGGIPILRTLSHSFASDKMTRLLGILNGTSNFMLTKMFEEGWSYEQALKKAQELGYAESDPTNDVEGIDTAYKATILSQFGFGMPIDFDDVNYKGISSIRSEDVEVAQEMGFAIKLVADLRETPTGISVDVSPTLISQKHPLAAVNHVMNAVFIESIGIGQSLFYGPGAGQNPTATSVLADIIDISRSIRSQIKIKPMNTYHCPCRLSMQSDIFNEYYLAISLRNAEDSDTLGRYFEQENIGLKNVIEKALGDKQQEIYVLTDEVSQEKITQFIEEFPESGVIQLINVFKVIGG

SEQ ID NO: 5351 - DNA, 93 bp, Streptococcus agalactiae
ttgttgaagaatagaaatatgccgattaaagctattaacaaaaaaaagacagaagcaatagctaaccatggggaacgttttcgtggtttacga

SEQ ID NO: 5352 - protein, 31 aa, Streptococcus agalactiae
MLKNRNMPIKAINKKKTEAIANHGERFRGLR

SEQ ID NO: 5353 - DNA, 885 bp, Streptococcus agalactiae
atggcacacacacctactagtcatcgtaaaccacgaaaacgttccccatggttagctattgcttctgtcttttttttgttaatagctttaatcggcatatttctattcttcaacaatcgttcaaagcaagaaataaaaacaaaaacgaacgcctctagtcatcgaaaaattgtcacatctatcaaaaaaaagaaatggattaagcaaaagactcctgtcaaaatacccattttaatgtaccatgctgttcatgttatggacccttctgaagccgccagtgctaacttaattgtggcacctgacatttttgaaagtcatataaaacgtctcaaaaaggaaggatattacttcttagcccctaacgaggcatatcgtgcactaaacgaaaatgccttacctgaaaaaaaagtcatttggattacttttgatgatggaaatgctgatttctacactaaggcataccctatactcaaaaagtacaaggttaaagccactaataatatcatcactggctttgttcaagaaggacgagaatctaacctcaacgttcaacaaatgctagaaatgaagcaaaacggcatgtcattccaaggacatacggttactcaccccaatctttctctcttaactccagaactacaaacccaagaaatgacactatcaaaacagtttttagatcaaaaactctctcaagatactcttgcgattgcttatccatcagggcgctacaatcctacaaccttggatattgctagtcaatattataaactagggcttacaacaaacgaaggagttgcaacaaaagataacggtttgctttctcttaatcgaattcgtatcttaccaactactagcgatgatgatctgatcaagacgattaaccaa

SEQ ID NO: 5354 - protein, 295 aa, Streptococcus agalactiae
MAHTPTSHRKPRKRSPWLAIASVFFLLIALIGIFLFFNNRSKQEIKTKTNASSHRKIVTSIKKKKWIKQKTPVKIPILMYHAVHVMDPSEAASANLIVAPDIFESHIKRLKKEGYYFLAPNEAYRALNENALPEKKVIWITFDDGNADFYTKAYPILKKYKVKATNNIITGFVQEGRESNLNVQQMLEMKQNGMSFQGHTVTHPNLSLLTPELQTQEMTLSKQFLDQKLSQDTLAIAYPSGRYNPTTLDIASQYYKLGLTTNEGVATKDNGLLSLNRIRILPTTSDDDLIKTINQ

SEQ ID NO: 5355 - DNA, 960 bp, Streptococcus pyogenes
atgaacaatagacataaacggcgccaaaaaagaaaagccttcactctcattaaccttatactattatttgcctgcattcttggtttgaccctcattttctatttatatcaagggtctaacaaattcggcttgtcagatgtctctcgatttgtacctaaaataagtctttttcatcacaaaaagacggcaaaaaaagaaacgacaaaacttaagaagactcatttcgattcctcaaaatctcaaaaaaaggcccattctaaattgacttggaccaagcaagaaacacctgtcaagatcccaattttaatgtatcatgctattcatgtaatgtcccctgaagagacggctaatgctaatttgattgtcaacccagatctctttgatcaacaacttcaaaaaatgaaagacgagggctactattttttgagtcctgaagaggtctaccgcgctctttcaaataatgaattgcctgctaaaaaagttgtatggctaacatttgatgacagtatgattgatttctacaatgttgcttacccaatcttaaaaaaatatgatgctaaagccaccaataatgttattacaggactaaccgaaatgggaagcgctgccaatctgactcttaagcagatgaaagaaatgaaacaagtcggtatgtctttccaagatcatacagtgaatcatcctgatctagagcaggctagtcctgatgttcaaacaactgaaatgaaagattcaaaggactatcttgataagcaattaaaccaaaacactattgccattgcttatccatctggtagatataatgacactaccttacaaattgcagctagacttaactataaattaggtgttaccactaacgaaggaatagctagcgcggctaatggacttctttctcttaaccggattcgtatcctcccaaacatgagtcctgaaaatcttttacaaacaatggaacca

SEQ ID NO: 5356 - protein, 320 aa, Streptococcus pyogenes
MNNRHKRRQKRKAFTLINLILLFACILGLTLIFYLYQGSNKFGLSDVSRFVPKISLFHHKKTAKKETTKLKKTHFDSSKSQKKAHSKLTWTKQETPVKIPILMYHAIHVMSPEETANANLIVNPDLFDQQLQKMKDEGYYFLSPEEVYRALSNNELPAKKVVWLTFDDSMIDFYNVAYPILKKYDAKATNNVITGLTEMGSAANLTLKQMKEMKQVGMSFQDHTVNHPDLEQASPDVQTTEMKDSKDYLDKQLNQNTIAIAYPSGRYNDTTLQIAARLNYKLGVTTNEGIASAANGLLSLNRIRILPNMSPENLLQTMEP

SEQ ID NO: 5357 - DNA, 147 bp, Streptococcus agalactiae
ttgggggctggtgttggcagtgattgctattgtcttactcttgtctggtggtctgttagcgctgcagaacgttttaattattgtcgctctgccattttcattcgtaatgattttgatgatgctagcgttattagtggagcttttcca

SEQ ID NO: 5358 - protein, 49 aa, Streptococcus agalactiae
MGAGVGSDCYCLTLVWWSVSAAERFNYCRSAIFIRNDFDDASVISGAFP

SEQ ID NO: 5359 - DNA, 144 bp, Streptococcus agalactiae
gtgccaaatgctgcaaaccatacaaaactcaataatgtcggtattaaaagaactaccgttaaaaactcccgaatgctacgccctttagaaatacgagcgatgaaaactccaacaaaaggagaccaggaaatccaccacgcccaa

SEQ ID NO: 5360 - protein, 48 aa, Streptococcus agalactiae
MPNAANHTKLNNVGIKRTTVKNSRMLRPLEIRAMKTPTKGDQEIHHAQ

SEQ ID NO: 5361 - DNA, 1545 bp, Streptococcus agalactiae
ttgagtaaaaaacatattacgcctgtatttacaggttcactaattgtatcgcttattttagtcttattaggaattattgttcctcgtggttttcaatcttggacacaaatcttgcgtgaacaggtatctaccaatttcggttggttgtacttgttgttagttacttcaattcttgctttgtgtgtcttttttattatgagtcctcttggacaaatacgtttagggcaacctcattcacgtcctgaatattcaactgtatcatggatagcaatgatgttttcagcaggtatggggattggtttggtcttctacggagcagctgaacccttatcgcattttgctatttcgacacctggtgcacctaaggaatcgcaaacagcattagctgatgcatttcgttttacattttttcactgggggatacatgcttgggcagtatatgcattggttgctttagctctagcttattttggatttcgaaagcaagagaaatacctcttgtctgtcactttaaagcctcttttcggtgataagacagatggttggctaggaaaaattgttgatatcaccacagttgttgctacagttattggagttgctacgacacttggatttggagctgctcaaatcaacggagggttaagttttttattgggtgttcccaataatgcatttgttcaaattgttattatcctgattacaacagctttatttgttatgtcagctttatcaggtttaggaaaaggtgttaaaattttatcgaacttaaatttgattttagcggtagccctcttagctttagttattgtattgggaccaacggttcgtatttttgataccctaacagagtctttaggctcttatttacaaaatttctttggaatgagctttcgtgcagctgcttttgacaatactaaacgttcttggattgataattggacgattttttattgggcgtggtggatttcctggtctccttttgttggagttttcatcgctcgtatttctaaagggcgtagcattcgggagtttttaacggtagttcttttaataccgacattattgagttttgtatggtttgcagcatttggcacattatcaactcaggtacaacaactgggtactaatttgacaaagtttgcaacagaggaagtattgtttgctacttttaatcactacactttaggttggcttttatccattattgctatcattttaattttttcattttttattacatcagcagattctgcaacgtacgttttggctatgttgacagaagatggtaatttaaacccaaaaaatcgaactaaagtaatttgggggctggtgttggcagtgattgctattgtcttactcttgtctggtggtctgttagcgctgcagaacgttttaattattgtcgctctgccattttcattcgtaatgattttgatgatgctagcgttattagtggagcttttccatgagaaaaaagaaatgggcttatcgatttctccagatcgttatccacgtaaaaatgaaccatttaaatcttatgaagaa

SEQ ID NO: 5362 - protein, 515 aa, Streptococcus agalactiae
MSKKHITPVFTGSLIVSLILVLLGIIVPRGFQSWTQILREQVSTNFGWLYLLLVTSILALCVFFIMSPLGQIRLGQPHSRPEYSTVSWIAMMFSAGMGIGLVFYGAAEPLSHFAISTPGAPKESQTALADAFRFTFFHWGIHAWAVYALVALALAYFGFRKQEKYLLSVTLKPLFGDKTDGWLGKIVDITTVVATVIGVATTLGFGAAQINGGLSFLLGVPNNAFVQIVIILITTALFVMSALSGLGKGVKILSNLNLILAVALLALVIVLGPTVRIFDTLTESLGSYLQNFFGMSFRAAAFDNTKRSWIDNWTIFYWAWWISWSPFVGVFIARISKGRSIREFLTVVLLIPTLLSFVWFAAFGTLSTQVQQLGTNLTKFATEEVLFATFNHYTLGWLLSIIAIILIFSFFITSADSATYVLAMLTEDGNLNPKNRTKVIWGLVLAVIAIVLLLSGGLLALQNVLIIVALPFSFVMILMMLALLVELFHEKKEMGLSISPDRYPRKNEPFKSYEE

SEQ ID NO: 5363 - DNA, 1401 bp, Streptococcus agalactiae
atgaggatatcaaaaggagggaacattatggcatataaaacaatttatccgtacactaacgaagtattgcatgaattcgataatatcagtgacagtgatctcgaacagtcattagacatagcgcatgccctctacaagacatggcgcaaagaagataatgttgaagaacgccaaaatcaattgcataaagtagcagatttattacgtaaggatcgtgataagtacgctgaagttatgactaaagatatgggaaaacttttcactgaagcacaaggagaagtggacttgtgtgcagacatagctgactattatgctgataatgggcaaaagtttttaaaacctgttccgttagaaagtccaaatggagaggcttactatttgaagcaagctgtcggtgttttacttgctgtcgagccatggaatttcccattttatcagattatgcgtgtatttgcccctaactttatagtgggtaatactatgcttttaaaacatgcttctatttgtcctgcctcagctcaagcgtttgaggatttagtccgagaagcaggagctccagaaggagcgtttaaaaatatttttgcttcgtatgatcaagtttcaaaccttatatcagatcctcgtgttgcaggtgtgtgtttaactggttctgagcgtggtggggcatcaatagcagctgaagctggtaaaaatttgaaaaaatcgtctatggaattaggtgggaacgatgcttttcttattttagatgatgctgattttgatttacttagtaaaacaatattctttgcgcgtttatataatgcaggtcaagtatgtacatcttcaaaacgtttcattgtcatggctgataagtatgacgaatttgtaaatatggtagttgagacctttaagtctgctaaatggggcgacccaatggattcggaaacaaccttggctccactgtcatctgcaggtgcaaaggatgatgttttaaaacaaattaaattggcggtagaccacggtgctgaggtagtttttggaaatgacactatagatcatccaggaaacttcgtcatgccaactgttttaacgaatatcactaaagcaaatccaatctataatcaagaaattttcggccccgtagcctctatctataaagtggatactgaagaagaagctattgctttagctaatgattctagttatggtttaggaagcactgttttttcttctgatccagaacatgctaaaaaagtggcggctcagattgaaacagggatgacatttattaattcagggtggacatcattaccggaattaccgtttggaggtattaaaaattcaggatatggtcgtgagttgagccaacttggatttgatgcctttgtcaacgaacatttggtatttacaccaaatagtgat

SEQ ID NO: 5364 - protein, 467 aa, Streptococcus agalactiae
MRISKGGNIMAYKTIYPYTNEVLHEFDNISDSDLEQSLDIAHALYKTWRKEDNVEERQNQLHKVADLLRKDRDKYAEVMTKDMGKLFTEAQGEVDLCADIADYYADNGQKFLKPVPLESPNGEAYYLKQAVGVLLAVEPWNFPFYQIMRVFAPNFIVGNTMLLKHASICPASAQAFEDLVREAGAPEGAFKNIFASYDQVSNLISDPRVAGVCLTGSERGGASIAAEAGKNLKKSSMELGGNDAFLILDDADFDLLSKTIFFARLYNAGQVCTSSKRFIVMADKYDEFVNMVVETFKSAKWGDPMDSETTLAPLSSAGAKDDVLKQIKLAVDHGAEVVFGNDTIDHPGNFVMPTVLTNITKANPIYNQEIFGPVASIYKVDTEEEAIALANDSSYGLGSTVFSSDPEHAKKVAAQIETGMTFINSGWTSLPELPFGGIKNSGYGRELSQLGFDAFVNEHLVFTPNSD

SEQ ID NO: 5365 - DNA, 1398 bp, Streptococcus pyogenes
gtgatggcttatcaaactatttacccttatacaaatgaagtccttcatacatttgataatatgaccgatcaaggtttggcagatgtccttgaaagagctcaccttctctataaaaaatggcgcaaggaagatcatttagaagaacgtaaagcccagcttcatcaagtggctaatattcttcgtcgtgaccgcgataaatacgctgaaatcatgaccaaagacatgggaaaactgttcacagaagcccaaggtgaagtaaatctttgtgccgatattgctgattactacgctgataaggcagatgaatttttgatgtctacgccactagaaacggattcaggtcaagcttactatttgaaacaatcaactggtgttatcctagctgttgagccttggaattttccttactatcaaatcatgcgggtctttgcgccaaactttattgttggaaacccaatggttttaaaacacgcgtccatttgcccacgctctgcccaatctttcgaagaattagttcttgaagctggtgctgaagcaggtagtattaccaatttgtttatttcttatgaccaagtatcacaagtgattgctgataaacgtgtggttggtgtctgcttgacaggttccgaacgtggaggagctagcattgcagaagaagctggtaaaaacttgaaaaaaacaacccttgaattgggtggagatgatgcctttattatccttgatgacgcggattgggatcaattagagaaggtgctttacttctctcgtctctacaatgcaggtcaagtatgtacctcatcgaaacgttttatcgtgcttgacaaagactatgaccgtttcaaagagttattaacaaaagtcttcaaaacagctaaatggggtgacccaatggatcccgaaacgacgttggcgccattatcatcagctcaagctaaagcagatgttcttgaccaaattaagttggccttggatcatggtgcggagttggtttatggtggtgaagcgattgatcatccaggtcattttgtcatgccaaccattattgctggcctcacaaaagacaaccctatttactatcaagaaatctttggcccagtcggtgaaatctacaaagtgtcttctgaagaagaagcgattgaagtggcgaatgattctaactatggccttggaggtactatctttagtagcaatcaagaacatgcgaaagccgtagctgctaaaattgaaactggtatgtcttttatcaactcaggctggacaagtcttccggaactcccatttggtgggattaaacattcaggctatggtcgtgaattgagtgagcttggctttacatcttttgtgaatgaacaccttatctatattccgaataaaacgaataatggcaatactaaagtt

SEQ ID NO: 5366 - protein, 466 aa, Streptococcus pyogenes
VMAYQTIYPYTNEVLHTFDNMTDQGLADVLERAHLLYKKWRKEDHLEERKAQLHQVANILRRDRDKYAEIMTKDMGKLFTEAQGEVNLCADIADYYADKADEFLMSTPLETDSGQAYYLKQSTGVILAVEPWNFPYYQIMRVFAPNFIVGNPMVLKHASICPRSAQSFEELVLEAGAEAGSITNLFISYDQVSQVIADKRVVGVCLTGSERGGASIAEEAGKNLKKTTLELGGDDAFIILDDADWDQLEKVLYFSRLYNAGQVCTSSKRFIVLDKDYDRFKELLTKVFKTAKWGDPMDPETTLAPLSSAQAKADVLDQIKLALDHGAELVYGGEAIDHPGHFVMPTIIAGLTKDNPIYYQEIFGPVGEIYKVSSEEEAIEVANDSNYGLGGTIFSSNQEHAKAVAAKIETGMSFINSGWTSLPELPFGGIKHSGYGRELSELGFTSFVNEHLIYIPNKTNNGNTKV

SEQ ID NO: 5367 - DNA, 198 bp, Streptococcus agalactiae
atgcctaaccaacacgctgcacctaaaagaattgattttcctccagttttaattagtttgctaacattagtatttataccaattgcccccattgccataacaataaaaaatttagataaaaccttaagtggctcaaagatacgtaacgaaaaacctaatgaagcaactatcgttgttagcaaagaagctaagataaaa

SEQ ID NO: 5368 - protein, 66 aa, Streptococcus agalactiae
MPNQHAAPKRIDFPPVLISLLTLVFIPIAPIAITIKNLDKTLSGSKIRNEKPNEATIVVSKEAKIK

SEQ ID NO: 5369 - DNA, 1020 bp, Streptococcus agalactiae
gtgaggaggactatcatgttatttaaggaaaaaattcctggattaatattatgctttattattgctataccatcttggttgcttgggctttatctccctttaataggagcaccagtttttgctatcttgattggaataattgttggatccttttatcaaaatcgacaattatttaataagggtattgcttttacatctaaatatattttacaaacagcagttgtcttattaggttttggactaaacctcatgcaagtgatgaaagttggtatatcatcgttacccatcattattatgacgatttccatttcattgattattgcttatgttttgcaaaagttatttaagttagataaaacgattgctactttaataggtgttggttcatctatttgtggtgggtccgcaattgcagcgactgcaccagttattaatgctaaagatgatgaagtagcacaagctatttcggttatttttttattcaatatcttagcggctttaatttttccaacgctggggaattttattggtctctctgatcacggttttgcattatttgcagggactgctgtcaatgatacctcgtcagttacagcaactgctactgcatgggatgctatcaatcacagcaatactttgggcggagctactattgttaaattgacacgaacattagccatcattccaattacgattgtattatctatttaccatatgaaacaaacgcagaaagaacaatctgtaagtgttactaagatatttccgaagtttgtgctttattttatcttagcttctttgctaacaacgatagttgcttcattaggtttttcgttacgtatctttgagccacttaaggttttatctaaattttttattgttatggcaatgggggcaattggtataaatactaatgttagcaaactaattaaaactggaggaaaatcaattcttttaggtgcagcgtgttggttaggcattattatagttagtttaacaatgcaagctatccttggaacttgg

SEQ ID NO: 5370 - protein, 340 aa, Streptococcus agalactiae
MRRTIMLFKEKIPGLILCFIIAIPSWLLGLYLPLIGAPVFAILIGIIVGSFYQNRQLFNKGIAFTSKYILQTAVVLLGFGLNLMQVMKVGISSLPIIIMTISISLIIAYVLQKLFKLDKTIATLIGVGSSICGGSAIAATAPVINAKDDEVAQAISVIFLFNILAALIFPTLGNFIGLSDHGFALFAGTAVNDTSSVTATATAWDAINHSNTLGGATIVKLTRTLAIIPITIVLSIYHMKQTQKEQSVSVTKIFPKFVLYFILASLLTTIVASLGFSLRIFEPLKVLSKFFIVMAMGAIGINTNVSKLIKTGGKSILLGAACWLGIIIVSLTMQAILGTW

SEQ ID NO: 5371 - DNA, 1017 bp, Streptococcus pyogenes
atgtcaactcacttaagaaaacttccagggctgttactttgcttattgttagctcttccagcctggtgtttagggcgcttatttcccattattggagcacctgtttttgctattcttttaggaatgttgttagccttgttttatgaacatcgtgacaagactaaagagggaattagttttacatccaagtatattttacaaacagcagtggttttgcttggttttggattaaacctaacccaagttatggcagtgggcatgcagtctttaccgattatcatttcaactattgcgacagctcttttggtagcttatggcttacagaaatggctgcgcttagatgtcaatacagccaccttggtaggtgtaggatcttccatttgtggggggtctgctgttgcagcgacagctcctgtcattaaggcaaaggatgacgaggttgctaaggcaatttcagtcatttttctctttaatatgttagcagctttgctatttccaagtttaggacaattactaggcttatctaatgaaggttttgctatttttgccgggacagctgttaacgacacttcttccgtgactgcaacggccacggcctgggatgcccttcaccattccaatacactagatggagcaaccattgttaaattgactcgcaccttggctattctcccaattactttaggtttatccctttaccgagcgaaaaaagagcacgacatcgttacagaagaaaactttagccttaggaagtcattccctcgtttcatcctcttctttttattagcttctctcatcacaacattgatgaccagtttgggagtttctgccgatagtttccattacctaaaaaccttatcaaaattctttatcgtgatggctatggcagcgattggtttaaacacaaacctggttaaactgattaagacgggcggtcaggctatccttttaggagctatttgctgggtagctatcacccttgtcagtttagccatgcaattaagtttgggcatttgg

SEQ ID NO: 5372 - protein, 339 aa, Streptococcus pyogenes
MSTHLRKLPGLLLCLLLALPAWCLGRLFPIIGAPVFAILLGMLLALFYEHRDKTKEGISFTSKYILQTAVVLLGFGLNLTQVMAVGMQSLPIIISTIATALLVAYGLQKWLRLDVNTATLVGVGSSICGGSAVAATAPVIKAKDDEVAKAISVIFLFNMLAALLFPSLGQLLGLSNEGFAIFAGTAVNDTSSVTATATAWDALHHSNTLDGATIVKLTRTLAILPITLGLSLYRAKKEHDIVTEENFSLRKSFPRFILFFLLASLITTLMTSLGVSADSFHYLKTLSKFFIVMAMAAIGLNTNLVKLIKTGGQAILLGAICWVAITLVSLAMQLSLGIW

SEQ ID NO: 5373 - DNA, 684 bp, Streptococcus agalactiae
atgaaaaagtttttaaaagtttttttaactgtactagtacttattctaattgtaggtgcaggcggtctctatttctggaataatcatcagtcactagagggaaaatggcgtacagtttctttagagaagcaagttgagaaagaaatagaacaacaacttggaagtcaggcagcggatatggggattagtgcagctgatttggttaagggcgctaatatgcatatgaacgtcaaaaacgatgaggcaaagataacagtcactgctcaaattgatgaggtaaaattccatcaagctataaaaacttttattgataaagctcttgaaaaacaattaaaagatcaaggtttgacttacaatgatttaagtgaagcaggtaaaaagatttttgatgaaacaaaaatcactgaccaacaaattgaccaacaaattgatagaagttttcaaagtgctgcacaagctgccggaggaaaatataatactaatactggtgaaatgacattgccagttatggatggtaaagtacatcgcttaacaagtgttattaaagtatcgcatatcaataaaaaggcaaatgcgttctatggtaatattgtgaaaaatggtgaaaaaacagcctataaaaaagagggctctaaattgattttaggtaatgaaaaatcatatccatttatgaaagtaactaaa

SEQ ID NO: 5374 - protein, 228 aa, Streptococcus agalactiae
MKKFLKVFLTVLVLILIVGAGGLYFWNNHQSLEGKWRTVSLEKQVEKEIEQQLGSQAADMGISAADLVKGANMHMNVKNDEAKITVTAQIDEVKFHQAIKTFIDKALEKQLKDQGLTYNDLSEAGKKIFDETKITDQQIDQQIDRSFQSAAQAAGGKYNTNTGEMTLPVMDGKVHRLTSVIKVSHINKKANAFYGNIVKNGEKTAYKKEGSKLILGNEKSYPFMKVTK

SEQ ID NO: 5375 - DNA, 741 bp, Streptococcus pyogenes
atgacacaagtagcccaaaggcgctctaaaagaaagtcattgttatgccatcaatgcaatgccctttttgtatttattatttttcttatcttgcttgctgtactttttggtgttcgatatcgtaatagctctattgaaggtatctggcgaacaacaagcattgatcagaagttaggcgatgattttgctaaacgtcttactggtttgcatcagagccctcttattgatgatagtttattaacgtcatctcagatgatactaacagttaaaaataacaacgttgacttgagttttagtgttcaagttgaacgagacatttttgtcaaacgtttagctgcttatcaccaaaatgaattattaaagacattaaaggaaaatcatttagttgttggtgacttgagtagtaaagaacgccaaattattgagaatagtatgccagctagccatgaattagaaatgattttagatcaagcttttgagaaattagcttctcagatcggaggcaaatataatcaaaaaacaggacatttatctgctgttgttctcaaaggaaaagttaatcgtattttgcacaccattgatatcaaagaagaagtagcagcgggacatacttctttttcaaaaggattactcacacctaatggttattttgattacaccagatttggaaagaaacttgagttattaggcgatgaaaaaattatttttaaaaaagcgctaaaaaaaagtccgtcaagtgta

SEQ ID NO: 5376 - protein, 247 aa, Streptococcus pyogenes
MTQVAQRRSKRKSLLCHQCNALFVFIIFLILLAVLFGVRYRNSSIEGIWRTTSIDQKLGDDFAKRLTGLHQSPLIDDSLLTSSQMILTVKNNNVDLSFSVQVERDIFVKRLAAYHQNELLKTLKENHLVVGDLSSKERQIIENSMPASHELEMILDQAFEKLASQIGGKYNQKTGHLSAVVLKGKVNRILHTIDIKEEVAAGHTSFSKGLLTPNGYFDYTRFGKKLELLGDEKIIFKKALKKSPSSV

SEQ ID NO: 5377 - DNA, 561 bp, Streptococcus agalactiae
ttgattaactatcaaatcgaaaacaatagacccacactaaacctatctaatgaagccgagactgatatctttttcgaaagatattatgtttctagagatggagatagtttagcacgtacagaatcaacaatttcgattaaaatggttgatgccaaaactgaacaaccgctatttaaccacacattaacgggttatcaattgtcaactgtttccaatgtctataacagactctttgaagaaaatcttatcccaactacaaaatcaggagaaaaatattttattcaaaatatgaaaaaaacagctgaacaagaatatactgtttacctttcagaaacaccttattctgaagagaacgctcccgtaatttcttatgatgcaagacctgttgattgggattatcactcaggcgcttcaggatcacttgaaaatcagcctaacatctatactgaagaagattcaactgaatttttgggtaataaaccacaagcagcttgttatccaaacaaacaatttgcttgcgaaaatactgactctaaatacaactatagctatttagaaaaa

SEQ ID NO: 5378 - protein, 187 aa, Streptococcus agalactiae
MINYQIENNRPTLNLSNEAETDIFFERYYVSRDGDSLARTESTISIKMVDAKTEQPLFNHTLTGYQLSTVSNVYNRLFEENLIPTTKSGEKYFIQNMKKTAEQEYTVYLSETPYSEENAPVISYDARPVDWDYHSGASGSLENQPNIYTEEDSTEFLGNKPQAACYPNKQFACENTDSKYNYSYLEK

SEQ ID NO: 5379 - DNA, 531 bp, Streptococcus agalactiae
atgaaagaaaagaaaaatttggggataaaattaataaaatccctatatggtattaatggcccattcgatgaatacagagaacaaaaaatcaattaccttggaaatctattatttgcaaccactagcctctatcacattttatcctctatcatcgcctggttcacggtaagtaaatatcccacagagactgcatatactctcctagctttaacattctttctatatttttgtatttttctaattgttattccctcttatctcaacagtcatgatttaataacgtcactagaagtctcaaaaaatgactatccagtagcaataaagaaaaacaaacaaaaatttatcaaaatcgggatattttatactgtcatccagtggcttatcttgggtttaacaactagcaataacactccgctgattgtatcactattttctttaaaagttattttgtctagtattatgtccggtgtagcttacaatggagttatgtatctaatatttaaaaacaatgttgatattgaaaaagatgaa

SEQ ID NO: 5380 - protein, 177 aa, Streptococcus agalactiae
MKEKKNLGIKLIKSLYGINGPFDEYREQKINYLGNLLFATTSLYHILSSIIAWFTVSKYPTETAYTLLALTFFLYFCIFLIVIPSYLNSHDLITSLEVSKNDYPVAIKKNKQKFIKIGIFYTVIQWLILGLTTSNNTPLIVSLFSLKVILSSIMSGVAYNGVMYLIFKNNVDIEKDE

SEQ ID NO: 5381 - DNA, 135 bp, Streptococcus agalactiae
gtgttaacaaatgccactcattcatcaaaagagcgtactcttgaccaaacgaatgatcataaaaatctgataataaaatcacgttatcaaggccttcagcactgcaccaacgcttctgagcaaatggaaggtcca

SEQ ID NO: 5382 - protein, 45 aa, Streptococcus agalactiae
MLTNATHSSKERTLDQTNDHKNLIIKSRYQGLQHCTNASEQMEGP

SEQ ID NO: 5383 - DNA, 492 bp, Streptococcus agalactiae
atgacaacatttcttggaaatcctgttacttttacaggaaaacagctacaagttggggatattgcaaaagattttttactaatagctacagacttatctcaaaaatctttaaaagattttgaagggaaaaagaaagttattagcgttgttccttctattgatacaggtatttgttcaaaacaaacacgtacttttaatgaggaattatcagagctagataacacagtggttattactgtttctatggaccttccatttgctcagaagcgttggtgcagtgctgaaggccttgataacgtgattttattatcagatttttatgatcattcgtttggtcaagagtacgctcttttgatgaatgagtggcatttgttaacacgtgcagttcttattttggatgagcataataaggtgacttacaccgaatacgttgacaatgttaattcagatgttgactacgaagcggcgattaatgctgcaaagatattacca

SEQ ID NO: 5384 - protein, 164 aa, Streptococcus agalactiae
MTTFLGNPVTFTGKQLQVGDIAKDFLLIATDLSQKSLKDFEGKKKVISVVPSIDTGICSKQTRTFNEELSELDNTVVITVSMDLPFAQKRWCSAEGLDNVILLSDFYDHSFGQEYALLMNEWHLLTRAVLILDEHNKVTYTEYVDNVNSDVDYEAAINAAKILP

SEQ ID NO: 5385 - DNA, 657 bp, Streptococcus agalactiae
atggatttattcctaagtttagagaggaaatttaaagctgcaagtgacaaagaagtttctaagcaacaggaggcttatttacgccatcattttaagtgctatggtattaaatcacctgagcgacgtatgctctacaaagagcttataaaggctgctaaaagacaagcaaaaattgattggcaattgcttgataaatgttggcaaagtgactatcgtgaatatcatcattttgtacttgattatctattagctatgagtcaatttctcacctataatgattgctctagactagagttttacgctcgtcatcaacagtggtgggatagtattgatgttctgactaagatttttgggaacttatccttaaaagatgacaaggttatgaatttactgtcagaatggtcacttgatcaagatttttggatgaggcgactagctattgagcatcaactaggatttaaagaaaaaacaaatactgatattttgtcactttttattttaagaaatacaggaagtcaagaattttttatcaataaggcgattggctgggcgcttagggattattcaaagtataataaagtatgggtaaaggactttatcagtaatcattgtgatgagttgtcgactttgagcatacgcgaaggaagtaagtacctt

SEQ ID NO: 5386 - protein, 219 aa, Streptococcus agalactiae
MDLFLSLERKFKAASDKEVSKQQEAYLRHHFKCYGIKSPERRMLYKELIKAAKRQAKIDWQLLDKCWQSDYREYHHFVLDYLLAMSQFLTYNDCSRLEFYARHQQWWDSIDVLTKIFGNLSLKDDKVMNLLSEWSLDQDFWMRRLAIEHQLGFKEKTNTDILSLFILRNTGSQEFFINKAIGWALRDYSKYNKVWVKDFISNHCDELSTLSIREGSKYL

SEQ ID NO: 5387 - DNA, 762 bp, Streptococcus agalactiae
atggattttgtctttgatatagatggaactctttgttttgatggtatgagtctatctaaagaaatacaaggaatactagagagagcccagattgattatggtcatagagtcacttttgctacagcgcgatcttatagagacactataggtatccttggcgacaagctatctttatcaaaaattattggtttaaatggtgcgactttacatgaaaatggtcacttagtggatagttactatttacaaagtgacttttttagtactattatttcatattgtcatcgccatcagattccatattttgttgatgaggtctttaattacgctacttatcaggcttctaaaattccctttattgcttatgttgatcctcaaaaaaggggagagcttctagaagtttctaaaattgagaaaccgataaaaatggtgttgtattttggtgatcagctgggaagggcagaccaaatgttagcggaattaaatcgttttggacttagtagtcactttttccacgaatttgaaaaatgtttgtacataaatcccattgcagttgacaagggaaaagccactaagaaattatttgggaatcgttttatagcttttggcaatgataaaaatgatatttctatgtttgatgctgcgcattatagtgttcaagtaggggattttgatgaactgactccttacgctaatttacgtgtatcaagagaatctgtacatgaaggaattacaacgctttttgaaaaatacaaggggattacg

SEQ ID NO: 5388 - protein, 254 aa, Streptococcus agalactiae
MDFVFDIDGTLCFDGMSLSKEIQGILERAQIDYGHRVTFATARSYRDTIGILGDKLSLSKIIGLNGATLHENGHLVDSYYLQSDFFSTIISYCHRHQIPYFVDEVFNYATYQASKIPFIAYVDPQKRGELLEVSKIEKPIKMVLYFGDQLGRADQMLAELNRFGLSSHFFHEFEKCLYINPIAVDKGKATKKLFGNRFIAFGNDKNDISMFDAAHYSVQVGDFDELTPYANLRVSRESVHEGITTLFEKYKGIT

SEQ ID NO: 5389 - DNA, 639 bp, Streptococcus agalactiae
atggtttctgaacaatctgaaattgtaacatctaaatatcaaaaaatagcagtagcggttgcacaaagaatcgcaaatggagattatgaagttggagagaagttgaaatctagaacaactattgcttcaacattcaacgtatcaccagaaacagcacgtaagggtcttaatattttagcagatttacagattttaactttaaagcatggcagtggagccattattctctctaaagaaaaagcaattgaattcttaaaccaatatgaaacctctcattcagttgctattttgaaaggtaaaatccgtgataatatcaaggctcagcaacaagaaatggaagagttagctactttagttgatgattttttgcttcaaacacgtgcggttagtaaacaatacccactagcaccatatgaaattattgtcagtgaagattctgaacaccttggtaagtcaataggagaattaaatgtatggcatcaaactggtgcgactattgtggctattgaacacgaagggaaatttattgtttctccggggcctttctcagttatagagcaaggagatcatatcttttttgttggtgatgaagatgtttatgcacgtatgaaaacctattttaacttaaggatgggactt

SEQ ID NO: 5390 - protein, 213 aa, Streptococcus agalactiae
MVSEQSEIVTSKYQKIAVAVAQRIANGDYEVGEKLKSRTTIASTFNVSPETARKGLNILADLQILTLKHGSGAIILSKEKAIEFLNQYETSHSVAILKGKIRDNIKAQQQEMEELATLVDDFLLQTRAVSKQYPLAPYEIIVSEDSEHLGKSIGELNVWHQTGATIVAIEHEGKFIVSPGPFSVIEQGDHIFFVGDEDVYARMKTYFNLRMGL

SEQ ID NO: 5391 - DNA, 639 bp, Streptococcus pyogenes
gtgataagtcctaaaaaagagataacaagttcaaaatatcaaaaaattgctatttcagtagctcagcgtatcgcaaatggcgaatatgaagtgggcgaaaagttaaagtcaagaactactatcgcctcgacatttaatgtatcaccagaaacggctcgtaaaggcctgaatattttagctgacttgaaaattttgactttaaaacatggtagtggagctattgtgctgtcaaaagaaagagctattgagtttataaatcaatacgaatcaacccattccatcgctgttttaaaagaaaaaatacgtgagactattaatgatcagggaaaagcaatggaaaaaatggctgttttggttaatgattttttaatgcaaagtcaatctgttagtaagcaatacccattagcaccttatgagattatttgtaatcaagattcggaacattttggcaaatctattggtgtgttaaatatctggcaccagacaggagcaactatcgtcgctattgaacatgctggtcagtttatcgtttcaccaggtccttattctgttattgaaaaaggcgatcatatttatttcgttggtgatgagtcagtcatttcacgaatgaagaccttttttaatttacgaaaaggatta

SEQ ID NO: 5392 - protein, 213 aa, Streptococcus pyogenes
VISPKKEITSSKYQKIAISVAQRIANGEYEVGEKLKSRTTIASTFNVSPETARKGLNILADLKILTLKHGSGAIVLSKERAIEFINQYESTHSIAVLKEKIRETINDQGKAMEKMAVLVNDFLMQSQSVSKQYPLAPYEIICNQDSEHFGKSIGVLNIWHQTGATIVAIEHAGQFIVSPGPYSVIEKGDHIYFVGDESVISRMKTFFNLRKGL

SEQ ID NO: 5393 - DNA, 444 bp, Streptococcus agalactiae
gtgagtggaggtttcttctctaatctaaaaaatagcgttgtaaattctgactcagtaactgatggtgtaaatgttgaagttggtactaaagaagttgcagttgatttagacatcgttgttgaatacggcaaggacatcccagctatcgttgaaagcattaaagcgattgtcagtcaaaacgttgaagtgatgacccaccttaaagttgttgaattgaacgcaaatgtcgtagatattaagactaaagctgaacatgaagctgactcagtgacagtacaagatcgtgtatctgatgcagcacaagcaacaggaaactttgcttctgaacaagctggcaaagctaaagcagcaatttcctctggagcagagaaaacaaaagaagcagtatcaaatggtactgaggctgcaaaagaaaaaatctcagaagctcgtactagtgaatct

SEQ ID NO: 5394 - protein, 148 aa, Streptococcus agalactiae
MSGGFFSNLKNSVVNSDSVTDGVNVEVGTKEVAVDLDIVVEYGKDIPAIVESIKAIVSQNVEVMTHLKVVELNANVVDIKTKAEHEADSVTVQDRVSDAAQATGNFASEQAGKAKAAISSGAEKTKEAVSNGTEAAKEKISEARTSES

SEQ ID NO: 5395 - DNA, 489 bp, Streptococcus pyogenes
atgatggaaaaaactcaaattaaaagcactcttacttatgacgataaggtcatcgaaaaaattgtcggtcatgctttggaaaacgttggcggattactagctgtaacaggtggatttttctcaaatatcaaaaataatttggtgaattctgagtctgtaactgatggtgtttcagttgaagttggtagcaaggaagtagcagttgatttagcaatcattgtagaatacggtaaagatattcctgctattgcagaatctattaaagctattgtttctcaaaacgttgacagtatgacacatttgaaagttgttgaagtcaatgtgaacgttgttgatattcgtactaaggaagaacatgaagctgctagcgttactgttcaagatcgtgtcactagtgcagcttcaagtacttcacaatttgtatcagaacaaacagaaaaattaaaagatactatctctgatactgtaaatagtgatgaggcagctaaa

SEQ ID NO: 5396 - protein, 163 aa, Streptococcus pyogenes
MMEKTQIKSTLTYDDKVIEKIVGHALENVGGLLAVTGGFFSNIKNNLVNSESVTDGVSVEVGSKEVAVDLAIIVEYGKDIPAIAESIKAIVSQNVDSMTHLKVVEVNVNVVDIRTKEEHEAASVTVQDRVTSAASSTSQFVSEQTEKLKDTISDTVNSDEAAK

SEQ ID NO: 5397 - DNA, 129 bp, Streptococcus agalactiae
atgcaaaagaaaaacttgctgacattaaagataccattaagggtgcttcagagagctttaagaaaaaggactagaaggtttgaggtcatttatttatggaaaatcaaaaacaagatattaaaacttcag

SEQ ID NO: 5398 - protein, 43 aa, Streptococcus agalactiae
MQKKNLLTLKIPLRVLQRALRKRTRRFEVIYLWKIKNKILKLQ

SEQ ID NO: 5399 - DNA, 114 bp, Streptococcus agalactiae
atgtctgaagaaaaatttgatgcaaaagttgataaggtttctggttcagtaaaagaatctgttggaaacttactggcgataaagaagttgaatctgaaggtaaagttgataaat

SEQ ID NO: 5400 - protein, 38 aa, Streptococcus agalactiae
MSEEKFDAKVDKVSGSVKESVGNLLAIKKLNLKVKLIN

SEQ ID NO: 5401 - DNA, 540 bp, Streptococcus agalactiae
atgactgaaacttacatcaaaaacacaactaacaattctggcacgacagctgttcgtggagaattaactttcgaagataaagtgattgaaaaaattgttggaattgcgattgagcatgtagatggtcttttggctgtaaatggtggttttttctcaaatttaaaaaatagcgttgtaaattctgattcagttacagatggcgtaaatgtcgaagtgggtaaaaagcaagttgctgttgatttggatattgttgctgaataccaaaaacatgttccaactatctttgccgatatcaaaaaagttgttgaagctgaagtgaaacgtatgacagaccttgaagtggttgaagttaatgttaatgttgttgatattaaaactcgtgctcaacatgaagaagattcagtaactcttcaagatcgtgtaacaagtgcagcacaagcaacaggtgaatttgcttcgaatcaagtttcaaacgttaaaagtgccgtaggtagcggtgttgataaagtggaagacatgaagtctgaaccacgtgtacaa

SEQ ID NO: 5402 - protein, 180 aa, Streptococcus agalactiae
MTETYIKNTTNNSGTTAVRGELTFEDKVIEKIVGIAIEHVDGLLAVNGGFFSNLKNSVVNSDSVTDGVNVEVGKKQVAVDLDIVAEYQKHVPTIFADIKKVVEAEVKRMTDLEVVEVNVNVVDIKTRAQHEEDSVTLQDRVTSAAQATGEFASNQVSNVKSAVGSGVDKVEDMKSEPRVQ

SEQ ID NO: 5403 - DNA, 537 bp, Streptococcus pyogenes
atgactgaaacttatattaaaaacacatctaaagacttaacttcagcaattcgtggccaattaacatatgatgataaagtaattgaaaaaattgttggtttagcacttgaaaatgttgatgggttactgggtgtaaatggtggtttttttgctaacctaaaagataaattagtaaacaccgaatctgtacgtgatggcgtgaacgtggaagttggaaaaaaacaagttgccgttgatcttgatattgtcgctgaatatcaaaagcatgtgccgactatttatgactctattaaatcgatcgttgaagaagaagtgaagagaatgaccgatctggatgtgattgaagttaatgttaaagtagtcgacattaaaacaaaagaacaatttgaagctgaaaaagtaagtttacaagacaaagtttcagacatggcacgttcaacatctgaatttacgagtcatcaagttgagaatgttaaagcttcagtggataacggtgttgaaaaacttcaagatcaaaaagctgagccacgtgtaaaa

SEQ ID NO: 5404 - protein, 179 aa, Streptococcus pyogenes
MTETYIKNTSKDLTSAIRGQLTYDDKVIEKIVGLALENVDGLLGVNGGFFANLKDKLVNTESVRDGVNVEVGKKQVAVDLDIVAEYQKHVPTIYDSIKSIVEEEVKRMTDLDVIEVNVKVVDIKTKEQFEAEKVSLQDKVSDMARSTSEFTSHQVENVKASVDNGVEKLQDQKAEPRVK

SEQ ID NO: 5405 - DNA, 192 bp, Streptococcus agalactiae
atgtcagaattcgtgaggaaatacagatatccactaggaggtgcagttattgggctcgttttagctgcaatgattgtaaccattggattctttaaaacaattcttgctcttgttatcattgtgctaggtgcttatgctggactttatgtgcaaagaacaggtatgcttgaccaattctttaataagagaaaa

SEQ ID NO: 5406 - protein, 64 aa, Streptococcus agalactiae
MSEFVRKYRYPLGGAVIGLVLAAMIVTIGFFKTILALVIIVLGAYAGLYVQRTGMLDQFFNKRK

SEQ ID NO: 5407 - DNA, 186 bp, Streptococcus pyogenes
atggaattttatgaaaaattcaagtaccctattattggtggcttggtggggctaattattgccatattgctcatggcttttggtttattcaaaacgctactagcaattattttcattattttaggaatatatggtggcctgtatgccaaaaaaacaggtattattgatcaatttcttaatcgtaaa

SEQ ID NO: 5408 - protein, 62 aa, Streptococcus pyogenes
MEFYEKFKYPIIGGLVGLIIAILLMAFGLFKTLLAIIFIILGIYGGLYAKKTGIIDQFLNRK

SEQ ID NO: 5409 - DNA, 579 bp, Streptococcus agalactiae
atgtcaaaaggactaaaaagtttatatactttactaggtctaatctcccttaccctactaggatttgtagctgttatcagtaaacaacacatttatctaccatcttttaattggttagattgggattttaatttgccatcaccgattgacgttggtatgtatcattatttcttttggggagcattagtgctgtttgtgatcgttttactggctatattggtagttctgttttatccaagacgatacacagagtataaactagctgataaaactggtaaattgatgttaaaaaaatctgcaatagagggatttgttaaaacagaagtattaaaaactggtttgatgaaatctcctagtgtgacagctcatttatataagaaaaaagtgaaagttgatgttaaaggtcttttaacttctcgtacaaatgtaccggaacaacttgaacatattcaaagtgatgttgaacttggcttaaaagaattctttgggttggaaaagaaaatgaacactagagtatttgttaagcaagttgaagaagaaaatgttggaaatgctaagacgaataaaagtcgtgtagaa

SEQ ID NO: 5410 - protein, 193 aa, Streptococcus agalactiae
MSKGLKSLYTLLGLISLTLLGFVAVISKQHIYLPSFNWLDWDFNLPSPIDVGMYHYFFWGALVLFVIVLLAILVVLFYPRRYTEYKLADKTGKLMLKKSAIEGFVKTEVLKTGLMKSPSVTAHLYKKKVKVDVKGLLTSRTNVPEQLEHIQSDVELGLKEFFGLEKKMNTRVFVKQVEEENVGNAKTNKSRVE

SEQ ID NO: 5411 - DNA, 609 bp, Streptococcus pyogenes
atgttaagtagaaaagaggtctgtatgtcaaaattgttaaagattagttattgtcttgtcggacttgttctattgtctgtttttggatgggtagttggaataaccggaggctatatatatttaccttatagttatcgttggctaagttggggtatggatagttttcccaatctcttagattcagctttatcctattattacttctggacagcccttgtattatttgttataacatttcttgccttattagttattattttatacccaagaatttatactgaggtccagttacgccataaaaataaaaaaggaacacttttattaaaaaaatcggctattgaaagttatgttgcgaccgctattcaaactgcaggtttgatgccaaacccaacagtcacagctaaattatataagcggaagtttaacattatcgttaaaggacgtttagcttctcgtgtagcagtggcagatcaaattagtggcgtgaaagaagggatcgaaaaaggtttaaccgagttcttcggaattaattatcctgttaatttcaaagtttatgttaaagatattgctgattctgatcgtaaacatattaccagaaatcgtgtagaa

SEQ ID NO: 5412 - protein, 203 aa, Streptococcus pyogenes
MLSRKEVCMSKLLKISYCLVGLVLLSVFGWVVGITGGYIYLPYSYRWLSWGMDSFPNLLDSALSYYYFWTALVLFVITFLALLVIILYPRIYTEVQLRHKNKKGTLLLKKSAIESYVATAIQTAGLMPNPTVTAKLYKRKFNIIVKGRLASRVAVADQISGVKEGIEKGLTEFFGINYPVNFKVYVKDIADSDRKHITRNRVE

SEQ ID NO: 5413 - DNA, 246 bp, Streptococcus agalactiae
atgagtttaatttggtcattaatcgtaggtgctattatcggtgctattgcaggggctgttactaacaaaggtggttcaatgggttggatagctaacatcttagctggtttagttggttcatttgttggtcaaagtttactaggaacatgggggcctaagttagcaggtatggctttgattccttcaatcgtaggtgctattattgttgtcattgttacttcatttgtactaggtaaaatgaataac

SEQ ID NO: 5414 - protein, 82 aa, Streptococcus agalactiae
MSLIWSLIVGAIIGAIAGAVTNKGGSMGWIANILAGLVGSFVGQSLLGTWGPKLAGMALIPSIVGAIIVVIVTSFVLGKMNN

SEQ ID NO: 5415 - DNA, 246 bp, Streptococcus pyogenes
atgggacttatttggactttaatcgtcggtgcgcttattggtgtgattgctggagcacttactaaaaaaggtggttcaatgggctggattgcaaacatcgctgctggtctagttggttcttccgttggtcaagctttacttggttcatggggcccttctttagcaggaatgtctttgatcccgtcagttattggtgccgttatcgttgttatgatcacttcttttgtactaaacaaaactaacaac

SEQ ID NO: 5416 - protein, 82 aa, Streptococcus pyogenes
MGLIWTLIVGALIGVIAGALTKKGGSMGWIANIAAGLVGSSVGQALLGSWGPSLAGMSLIPSVIGAVIVVMITSFVLNKTNN

SEQ ID NO: 5417 - DNA, 336 bp, Streptococcus agalactiae
ttgccgagtggtcacttaagaaactcttgttatttagttaagaacaaaataagtttgtacactgagatgtacttaggaagaaaggtatttatcatgggtttaatttggtcattaatcgttggtgctattattggtgctattgcaggagcaatcactaacaagggtggttcaatgggttggatagctaacatcttagctggtttagttggttcatttgttggtcaaagtttactaggaacatgggggcctaagttagcagatatggctttgattccttcaatcgtaggtgcgattatcgttatcattgttacttcatttgtattaggcaaaaaatca

SEQ ID NO: 5418 - protein, 112 aa, Streptococcus agalactiae
MPSGHLRNSCYLVKNKISLYTEMYLGRKVFIMGLIWSLIVGAIIGAIAGAITNKGGSMGWIANILAGLVGSFVGQSLLGTWGPKLADMALIPSIVGAIIVIIVTSFVLGKKS

SEQ ID NO: 5419 - DNA, 2298 bp, Streptococcus agalactiae
ttgacaaaattaggagtagaaatgaatcctttaataattggaatgaatgataaacaagcagaagcggtacaaacgacagacggaccgcttttgattatggcaggagctggctctggaaaaacacgtgttctgactcatcgtattgcttatttaatagatgaaaaatatgttaatccttggaatattttagcgattacttttactaataaagcagcgcgtgaaatgcgtgaacgtgctatcgccttgaatccagctacccaagatactttgattgcaacttttcatagtatgtgtgttcgtattttacgtcgtgaagctgattatattggatataatcgtaactttacaatcgttgatccaggtgagcagcgtactttaatgaagcgaatcattaagcaattaaatttggacacaaaaaagtggaatgaacgttcaattttaggtacaatctctaatgctaaaaatgaccttcttgatgaaattgcatatgagaagcaagccggagatatgtatacacaggtaattgctaaatgctataaagcttatcaagaggaattacgtagaagtgaggccatggatttcgatgacttgattatgatgacacttcgattatttgatcagaataaagatgttttggcctattaccaacagaggtatcaatatatccatgtagacgagtatcaagatactaaccacgctcaataccaattagttaagttattagcttcgcgtttcaaaaatatttgtgttgttggtgatgccgatcaatccatttacggatggcgtggagctgatatgcaaaatattcttgattttgaaaaggactatccgcaagccaaagttgtattattagaagaaaattatcgatcgactaagaaaatacttcaagctgctaataatgtgattaatcataataaaaatcgccgtcccaaaaaattatggactcaaaatgatgaaggtgagcaaattgtatatcatagagctaacaacgagcaagaagaagcagtttttgtagcatcaactattgataacatcgttcgagaacaaggaaaaaatttcaaagattttgccgttctttatcgtacgaatgcgcaatctcgtactattgaggaagcacttttaaaatccaatattccatatacaatggttggtggaacaaaattctatagtcgtaaagaaattcgagatgttattgcttatctcaatatccttgcaaatacttctgataatatttcttttgagcggattgtaaatgaacctaaaagaggggtggggccaggaactttagaaaaaatacggtcatttgcctatgaacagagcatgtctcttcttgatgcctcttcaaatgtcatgatgtcgcccttaaaagggaaggctgctcaagctgtttgggatttagctaatctgattttgactctacgtagtaatctagatagtttaactgtaacggagattacagaaaacctactggataagacaggatatctagaagcacttcaagttcaaaatacattagaaagtcaagcgcgtattgaaaatattgaagaattcttgtcagtgactaaaaattttgacgataacccagagattacagtagagggtgaaactggtttagatcgtctatcgcgttttttaaatgatttagctttaatagcagatactgatgatagcgccactgaaacggctgaggtcactttaatgacattacatgctgccaagggtctagaatttccagttgttttcttaatcggtatggaagaaggagtatttcctttatcgcgtgcaatagaggatgctgatgaattagaagaagagcgtcgtttagcttatgtcgggattacgagagcagaacaaatacttttccttaccaatgctaatacccgtactttatttggtaaaactagttataatagaccaacccgttttatacgtgagattgatgatgaactgatacaataccaagggttagctcgaccagttaattcttcatttggtgtgaaatattcaaaagaacagcctacacaatttggtcaaggaatgagtcttcaacaagcgcttcaggcacgtaaaagtaattcacaatctcaagtaactgcccaactccaggctcttaacgcgaacaatagccatgagacatcatgggagattggtgatgttgcaactcataaaaaatggggggacggtacggtgcttgaagtttcaggtagcggaaagactcaagagttaaaaataaattttccaggtattgggttaaagaaattattagcgagtgtcgctcctattagcaaaaaggaaaac

SEQ ID NO: 5420 - protein, 766 aa, Streptococcus agalactiae
MTKLGVEMNPLIIGMNDKQAEAVQTTDGPLLIMAGAGSGKTRVLTHRIAYLIDEKYVNPWNILAITFTNKAAREMRERAIALNPATQDTLIATFHSMCVRILRREADYIGYNRNFTIVDPGEQRTLMKRIIKQLNLDTKKWNERSILGTISNAKNDLLDEIAYEKQAGDMYTQVIAKCYKAYQEELRRSEAMDFDDLIMMTLRLFDQNKDVLAYYQQRYQYIHVDEYQDTNHAQYQLVKLLASRFKNICVVGDADQSIYGWRGADMQNILDFEKDYPQAKVVLLEENYRSTKKILQAANNVINHNKNRRPKKLWTQNDEGEQIVYHRANNEQEEAVFVASTIDNIVREQGKNFKDFAVLYRTNAQSRTIEEALLKSNIPYTMVGGTKFYSRKEIRDVIAYLNILANTSDNISFERIVNEPKRGVGPGTLEKIRSFAYEQSMSLLDASSNVMMSPLKGKAAQAVWDLANLILTLRSNLDSLTVTEITENLLDKTGYLEALQVQNTLESQARIENIEEFLSVTKNFDDNPEITVEGETGLDRLSRFLNDLALIADTDDSATETAEVTLMTLHAAKGLEFPVVFLIGMEEGVFPLSRAIEDADELEEERRLAYVGITRAEQILFLTNANTRTLFGKTSYNRPTRFIREIDDELIQYQGLARPVNSSFGVKYSKEQPTQFGQGMSLQQALQARKSNSQSQVTAQLQALNANNSHETSWEIGDVATHKKWGDGTVLEVSGSGKTQELKINFPGIGLKKLLASVAPISKKEN

SEQ ID NO: 5421 - DNA, 2316 bp, Streptococcus pyogenes
atgaatcctttattaaatggaatgaatgatcggcaggcacaagctgttcaaacaactgaaggccccttattgattatggcgggggctggttctggtaaaacaagggtactgacccatcgtattgcctatttaattgatgaaaaatttgtcaatccttggaatattttagctattacctttactaataaggctgcgcgtgaaatgaaagaaagggccttggccttaaatccagctactaaagataccttaattgctacctttcactccatgtgtgtacggattctgcgtcgtgaggctgatcacattggttacaaccgaaacttcacaatcgtggatccaggtgagcaacgaacgttgatgaagcgcattttaaaacaattaaatatagaccctaaaaagtggaatgaacgttctattttaggaactatttcaaacgctaaaaatgatttgcttgatgaaaagggatacgaggcacaggctgctgatatgtatagtcaaatcgtagcgaggtgttacaaagcttatcaggaagaattacgacgtagcgaagcacttgactttgatgatttaatcatgatgacgctacgcctgtttgacgctaatcctgacgtgttagcttattaccagcagcgttaccaatacattcatgtggatgagtaccaagataccaaccatgctcaatatcagctaattaaattactagcttctcgctttaaaaatatttgcgttgttggagacgctgatcagtctatctatggttggcggggagctgacatgcaaaatattcttgattttgaaaaagattacccagatgctaaggtagtgcttttagaagaaaactatcgctctaccaagaaaattctgcaagcagctaacgacgtgattaacaataaccgtaatcgccgtcctaagaaactttggacacaaaatgcggatggtgaacaactggtttattaccgggcaaatgatgagcgagatgaggcagtatttgtggcctcaaccattagcaatatgagtcaagagcttggaaaaaacttcaaagatttcgctgttttataccgtaccaatgcccaatctcggaccattgaagaagcactcttaaaatccaatattccttacaccatggttggaggcaccaagttttacagccgtaaagaaattcgggatttgattgcctatttaaccattgttgctaaccctgctgataatatttcttttgagcggattgtgaatgagcctaaacgaggtgttggtccaggaacgcttgataaactgcgtcagtttgcctatgagagtgaccagtctttattagaagcagcttcaaatctattgatgtcccccttgaaaggtaaagcagcacaagctatcatggacttggccaatattctcggtcagctacgtcaagacctagatcagatgagtatcaccgacttagcagaagctttgttagaaaaaacaggttatttagatagcttacgcctgcaaaatacattggaaagccaagcccgtatcgaaaatatcgaagaattcttatctgttaccaaaaattttgacgagtcaagtgcctctcaagaagaagacgaaaccggtgttgatcgcttgggacgttttttaaacgatttagcactgattgctgatacagatgattcccaagcagaagctgctgaagtaaccttaatgaccctacatgctgccaaaggcttggagttccctgttgttttcttaattggtatggaagaaggtgtcttccccttatcacgtgcctctgaagatccagatgaattggaagaagaaagacgtttagcttatgtcggaatcacaagagctgaagaagttctctttatgaccaatgccaacaccagaaccctctttggtaaaagtagttataaccgtccaacacgcttcttgaaagaaatttcagaggaactactctcttataaaggattggcaagaccagcacaatcttcatttggtgtgcgtttttctactgaaacacacacacagtttggacaagggatgagcctatcagaagccttacaagctcgaaaggcccaggctcaagtaagacaatcagcacagccaatgcaggcacatacgataccatcagcttcaactagctcagttttaccgtttggttctaatagctctgtagaagaggtcacttggcagattggcgatatcgctcaccataaaaaatggggagacgggactgtgcttgaggtttcaggctccggaaaaacgatggaattgaaaatcaaatttccagaagttggtttaaagaaattactagcaagtgttgctcctattgagaaaaaa

SEQ ID NO: 5422 - protein, 772 aa, Streptococcus pyogenes
MNPLLNGMNDRQAQAVQTTEGPLLIMAGAGSGKTRVLTHRIAYLIDEKFVNPWNILAITFTNKAAREMKERALALNPATKDTLIATFHSMCVRILRREADHIGYNRNFTIVDPGEQRTLMKRILKQLNIDPKKWNERSILGTISNAKNDLLDEKGYEAQAADMYSQIVARCYKAYQEELRRSEALDFDDLIMMTLRLFDANPDVLAYYQQRYQYIHVDEYQDTNHAQYQLIKLLASRFKNICVVGDADQSIYGWRGADMQNILDFEKDYPDAKVVLLEENYRSTKKILQAANDVINNNRNRRPKKLWTQNADGEQLVYYRANDERDEAVFVASTISNMSQELGKNFKDFAVLYRTNAQSRTIEEALLKSNIPYTMVGGTKFYSRKEIRDLIAYLTIVANPADNISFERIVNEPKRGVGPGTLDKLRQFAYESDQSLLEAASNLLMSPLKGKAAQAIMDLANILGQLRQDLDQMSITDLAEALLEKTGYLDSLRLQNTLESQARIENIEEFLSVTKNFDESSASQEEDETGVDRLGRFLNDLALIADTDDSQAEAAEVTLMTLHAAKGLEFPVVFLIGMEEGVFPLSRASEDPDELEEERRLAYVGITRAEEVLFMTNANTRTLFGKSSYNRPTRFLKEISEELLSYKGLARPAQSSFGVRFSTETHTQFGQGMSLSEALQARKAQAQVRQSAQPMQAHTIPSASTSSVLPFGSNSSVEEVTWQIGDIAHHKKWGDGTVLEVSGSGKTMELKIKFPEVGLKKLLASVAPIEKK

SEQ ID NO: 5423 - DNA, 300 bp, Streptococcus agalactiae
atgaaattcaatttagaacaagtaaaagtatttgagaattacgaaattgaaaactgggaagaaggtcaagttaccttaacaacgaaggtcgttgactcttcgctcaactattatggtaatgctcatggtggttatttgtttacactgtgtgatcaagtcagtggtttagttgctatttcaacaggatatgaagcggtaactctacaatcaaatatcaactatttgagggcaggccgattagatgatctgcttactgtcatcggtacttgtgttcataatggtcgtactacaaaaagtcgt

SEQ ID NO: 5424 - protein, 100 aa, Streptococcus agalactiae
MKFNLEQVKVFENYEIENWEEGQVTLTTKVVDSSLNYYGNAHGGYLFTLCDQVSGLVAISTGYEAVTLQSNINYLRAGRLDDLLTVIGTCVHNGRTTKSR

SEQ ID NO: 5425 - DNA, 399 bp, Streptococcus pyogenes
atgtcagatttaacacaagagatgaccttaaatgttattagtatttttgataattaccaaattgaacttgctgaaaaaggacaccttattttaagtactgaagtgactgagacggctttgaattattatgggaatgcccatggtggttatcttttcactctatgtgatcaagtaggtggtttggttgctagaactactggcgtagaatctgtcaccttacaggccaatgctaactatttaaaagcagggcacaagggagacaagctgatggttgaaggtcgattggttcatggaggtcgaaccacgcaggtggttgatgtgacgattcataaccaaacaggagctcttctaacaaaaacaagcttgaccatgtttgtgactggccgacgtcataacggg

SEQ ID NO: 5426 - protein, 133 aa, Streptococcus pyogenes
MSDLTQEMTLNVISIFDNYQIELAEKGHLILSTEVTETALNYYGNAHGGYLFTLCDQVGGLVARTTGVESVTLQANANYLKAGHKGDKLMVEGRLVHGGRTTQVVDVTIHNQTGALLTKTSLTMFVTGRRHNG

SEQ ID NO: 5427 - DNA, 99 bp, Streptococcus agalactiae
atgagcgttccgcaaccagaagcaaataaagccactgatacaggcatccctaaaataagcggaactaatatcgtagctccaaacatggcaaaaacatgt

SEQ ID NO: 5428 - protein, 33 aa, Streptococcus agalactiae
MSVPQPEANKATDTGIPKISGTNIVAPNMAKTC

SEQ ID NO: 5429 - DNA, 1347 bp, Streptococcus agalactiae
atgcccaagaggactagtttagatatgactttaaatgctaaaggtgaaagtaatcaaattctagtagataaggaagtacattctactaacttattactagatatcgatgaaaaaccagaattatttcaaggtttgctgttaagttttcaacatgtttttgccatgtttggagctacgatattagttccgcttattttagggatgcctgtatcagtggctttatttgcttctggttgcggaacgctcatttatcaagttgcgacaaaatttaaagtccctgtttacctaggctcatcatttgcttatattacagctatggcattagccatgaaacaaatgcatggcgatatttcggctgctcaaacaggtattctttttgtaggtctaatctatgtcgttgtggcgacggttattaagttcgtaggaaattcatgggttgataagattttgccaccaataatcattggacctatgattattgttattggtttaggtttggcaaactctgctgtaactaatgcaggttttgtcgctaaaggtgattggcgtaaaatgctagttgctgttgttacattcttgattgcagcttttatcaatactaaagggaaaggttttatcaagattattccatttttatttgcaattattggaggttatattttatcaatcattcttggcttggtagatttatctccagttgaaaaagctgcctggtttgaattgccaaaattctatttaccgtttaagacaggtttatttcacagttataaactttactttggaccagaaatgcttgccattcttccaatctcaattgtaacgattgctgaaaatatcggtgatcatacagttttaggtcagatttgtgggcgtaactttctaaaaaaaccaggtttaaatcgtcttttaattggagatggtttagcaaccgcattttctgctcttataggaggaccagctgaaactacttatggtgaaaatacaggtgttattggcatgacgcgtatagcttctgtaacggttattcgtaatgcagcttttattgcaatcgctttttcattctttggtaaatttacagctttgatctctacaattcctagtgcagtacttggtggaatggctatattactttatggtgttattgcaagtaatggattaaaagtgttgattgaaaatcgtgtcaattttgctgaggttcgtaatctgattattgctagttccatgttagttttaggcctcggtggagcagtccttgatctaggtgctctaactttatcaggaacagcattaagtgctatagtgggtattatattaaatttaatattgccaaaagaaagcatgaaatca

SEQ ID NO: 5430 - protein, 449 aa, Streptococcus agalactiae
MPKRTSLDMTLNAKGESNQILVDKEVHSTNLLLDIDEKPELFQGLLLSFQHVFAMFGATILVPLILGMPVSVALFASGCGTLIYQVATKFKVPVYLGSSFAYITAMALAMKQMHGDISAAQTGILFVGLIYVVVATVIKFVGNSWVDKILPPIIIGPMIIVIGLGLANSAVTNAGFVAKGDWRKMLVAVVTFLIAAFINTKGKGFIKIIPFLFAIIGGYILSIILGLVDLSPVEKAAWFELPKFYLPFKTGLFHSYKLYFGPEMLAILPISIVTIAENIGDHTVLGQICGRNFLKKPGLNRLLIGDGLATAFSALIGGPAETTYGENTGVIGMTRIASVTVIRNAAFIAIAFSFFGKFTALISTIPSAVLGGMAILLYGVIASNGLKVLIENRVNFAEVRNLIIASSMLVLGLGGAVLDLGALTLSGTALSAIVGIILNLILPKESMKS

SEQ ID NO: 5431 - DNA, 1257 bp, Streptococcus pyogenes
gtgaaagatgtcatttatgatgtggaagaagtgccaaaggcaggtatgttagttggtttgtcctttcagcacttatttgctatgtttggtgcgactgttctggttcccattctagttggaattgacccatcagttgctttgttatctagtggtttaggaacccttgcccacttatcagtgaccaaatttaaaattccagcctacatgggctcaagttttgcttatatagcagctatgcagttactgatgaagacaaatggtattggtgctgtagctcaaggggctatgacaggaggtctcgtttacctgattgtagctttgattgttaaagctattggcaatgattggattgataacatcttaccaccgattgtggttggtccgattgttatggtcattggtctaagcctagcttctacagctgttaatgatgtcatgctaaaaaatgggaactataatctgacttatcttgttattgggttagtcaccttattatcagttatttttttcaatatttatggtaagggaattgttgctattgtaccgcttttattagggctattagttggttatgttgtagcccttttagtgggtgttctcaccggtcaagaaattgttgattttaccaatgtggctcaggccaaatggtttagtatcccatcagtggaaattcctttcttaacctacggggttaaattctacccaagtgccattttaactatggcacccattgcctttgttacaatgacagaacattttggacacattatggtcttaaatagtttgacaaaaagagattatttcaaggatccaggacttgaaaagactttaactggtgatggttttgcgcaaatcattgccggcttcttaggggcacctccggtcacttcttatggtgaaaacatcggtgtaatggctttgaataaaatattctcggtctatgttattgcaggtgccgcagtgattgccgctctcctcagttttatcggtaaggtatcagccttaattcaatctattccaacaccagttattggaggtatatcagttgccttgtttggtgtgatagcttctagcggtttgaaaatcttgattgaatccaaagttgatatggataataagaaaaacttattgattgctagtgttattttggtctctgggattggaggattgatgcttcaagtaaatggtcttcaaatttcaggtgtcgctttctcaacactccttggcatcatcttatatcaggtacttcctgaaaaa

SEQ ID NO: 5432 - protein, 419 aa, Streptococcus pyogenes
VKDVIYDVEEVPKAGMLVGLSFQHLFAMFGATVLVPILVGIDPSVALLSSGLGTLAHLSVTKFKIPAYMGSSFAYIAAMQLLMKTNGIGAVAQGAMTGGLVYLIVALIVKAIGNDWIDNILPPIVVGPIVMVIGLSLASTAVNDVMLKNGNYNLTYLVIGLVTLLSVIFFNIYGKGIVAIVPLLLGLLVGYVVALLVGVLTGQEIVDFTNVAQAKWFSIPSVEIPFLTYGVKFYPSAILTMAPIAFVTMTEHFGHIMVLNSLTKRDYFKDPGLEKTLTGDGFAQIIAGFLGAPPVTSYGENIGVMALNKIFSVYVIAGAAVIAALLSFIGKVSALIQSIPTPVIGGISVALFGVIASSGLKILIESKVDMDNKKNLLIASVILVSGIGGLMLQVNGLQISGVAFSTLLGIILYQVLPEK

SEQ ID NO: 5433 - DNA, 96 bp, Streptococcus agalactiae
atgtgctctaggcgccgaaggggcaagaagagtaaaacaactcctccaatctctcaggcaaaaggacagaagctaaaagccaatattaataatgag

SEQ ID NO: 5434 - protein, 32 aa, Streptococcus agalactiae
MCSRRRRGKKSKTTPPISQAKGQKLKANINNE

SEQ ID NO: 5435 - DNA, 1368 bp, Streptococcus agalactiae
atgtcatgtatcaaaggagaacatatgctaacactttttactcatatcaatagcttcgtttggggtccacctttacttgctttattagtcggaacaggtatttacctatcatttcgcttaggttttattcaattgagacaactttctagagctttcaaattgattttccgagaggataacgggcaaggagatatttcaagttatgctgcccttgcaactgctcttgctgcaacggtagggacaggtaatatcgttggtgtggctacggctattaaatctggaggaccaggagctttgttttggatgtgggtagctgccttttttggaatggcaacaaaatacgcagaaggattattagctatcaaatatcgcacaaaagatactaatggagaaatttctggaggaccgatgtactacattatcaatggaatgggacaaaaatggaaaccattagcagtctttttttctgcagcaggtatcttagtagctcttttaggaatagggacattcactcaagtcaatgcaattgcttcttctcttgagcatactttcaaaatatcaactagatttaccagcctcattcttgctgttatagtattatttattatatttggaggtataaaatctatttcaaaagtttcagaaaaaatagtgccttttatggctataagctatattttagcaactctgattattattgcagttaattacaataagattccacatactttccaactcatctttagcggtgctttttctgggacagcagccattggtggtttttctggagctatcgttaaagaagcaattcaaaagggaattgctagaggagttttctcaaatgaatctggattgggttctgctccaatagccgcagcagcagctaaaacaaaagaacctgttgaacaaggccttatttcaatgacaggaaccttcattgacactattgttatttgtactttgacagggattgcaattttagttacaggaaaatggctagaatttgatttacagggtgctccgttaacacaagcatcttttaataccgtatttggctcactaggtagttttgccctaaccttttgccttgtcttatttgcttttactactattttaggatggagctattacggagagcgttgctttgaatatctatttgggactaaatttattaacgcttatcgcattatttttgtcattatggtcggcttaggtggtttcttacagctcgatctcatttgggttatcgctgatatcgttaatggtttaatggctttacccaatctaatagctctcctagctttgtcaccaattattgttaaagaaacacagaaatatttttcagagactaaaaatatcactaagcct

SEQ ID NO: 5436 - protein, 456 aa, Streptococcus agalactiae
MSCIKGEHMLTLFTHINSFVWGPPLLALLVGTGIYLSFRLGFIQLRQLSRAFKLIFREDNGQGDISSYAALATALAATVGTGNIVGVATAIKSGGPGALFWMWVAAFFGMATKYAEGLLAIKYRTKDTNGEISGGPMYYIINGMGQKWKPLAVFFSAAGILVALLGIGTFTQVNAIASSLEHTFKISTRFTSLILAVIVLFIIFGGIKSISKVSEKIVPFMAISYILATLIIIAVNYNKIPHTFQLIFSGAFSGTAAIGGFSGAIVKEAIQKGIARGVFSNESGLGSAPIAAAAAKTKEPVEQGLISMTGTFIDTIVICTLTGIAILVTGKWLEFDLQGAPLTQASFNTVFGSLGSFALTFCLVLFAFTTILGWSYYGERCFEYLFGTKFINAYRIIFVIMVGLGGFLQLDLIWVIADIVNGLMALPNLIALLALSPIIVKETQKYFSETKNITKP

SEQ ID NO: 5437 - DNA, 1320 bp, Streptococcus pyogenes
atgatagcactcgttaaattaattgataaccttgtttggggaccgcccctcttaattttattggttgggacggggatttaccttaccagtcatttaggattaattcaaatcttaaaactaccaagagcctttaaactcattttttcagatgacgaaggacatggagatatttcatcctttgctgctcttgcaactgcccttgccgctactgtcggaactggtaacattgttggggttgccactgctatcaagtctggtggtcctggagcgctcttttggatgtgggttgccgctttttttggaatggccactaagtacgctgaaggggtactagcgattaaataccgtacaaaggatgccaacggtcatatttctggtggtcctatgtactatattgttaatggcatggggacaaaatggaaacccttagccgttctttttgcgggttcagggatcctagttgccctatttggaataggaacctttgctcaagtgaactcgatcacctcgtctttaggtcatagctttggcttatccccacaaatggtcagtattgttttagctatctttgtggctgccattatttttggtggcattcattccatttccaaagtggctgaaaaagtcgttccttttatggctattttttatattctatctagtttagcagttatttttagtcactaccaacagctacttcctgttattcgtttagtctttcaatcagccttcactccgacagctgctattggaggctttgctggaagtctcatgaaggatgccattcaaaaaggaattgcacgcggtgtcttctccaatgagtctggactaagatctgcacctattgctgcagcagcagctaaaaccaatgaacccgtggagcagggactgatctccatgacaggaacttttattgatacgattattatctgtaccctaaccggcctatctattttagtaacaggccaatggactgggcagctcgaaggggctcctctgacccaatctgcctttgccactgtgtttggaaatttagggacttttggcctaaccttttccctagttctcttcgcctttacaacgattttaggatggagttattatggagaacgctgctttgaattcctctttggcattacacatctcacctacttccgtattgtctttatcttaatggtaggcctaggaggcttccttaagttagaactaatttgggttttggctgatattgtcaatggtttaatggcacttcctaacctgattgccctcctagctctctcgccagttgttattttagaaaccaagcattactttattaag

SEQ ID NO: 5438 - protein, 440 aa, Streptococcus pyogenes
MIALVKLIDNLVWGPPLLILLVGTGIYLTSHLGLIQILKLPRAFKLIFSDDEGHGDISSFAALATALAATVGTGNIVGVATAIKSGGPGALFWMWVAAFFGMATKYAEGVLAIKYRTKDANGHISGGPMYYIVNGMGTKWKPLAVLFAGSGILVALFGIGTFAQVNSITSSLGHSFGLSPQMVSIVLAIFVAAIIFGGIHSISKVAEKVVPFMAIFYILSSLAVIFSHYQQLLPVIRLVFQSAFTPTAAIGGFAGSLMKDAIQKGIARGVFSNESGLRSAPIAAAAAKTNEPVEQGLISMTGTFIDTIIICTLTGLSILVTGQWTGQLEGAPLTQSAFATVFGNLGTFGLTFSLVLFAFTTILGWSYYGERCFEFLFGITHLTYFRIVFILMVGLGGFLKLELIWVLADIVNGLMALPNLIALLALSPVVILETKHYFIK

SEQ ID NO: 5439 - DNA, 1233 bp, Streptococcus agalactiae
atggcaacttctactgaaaacttacaacttgcaaaaagagggcccattattagtatcattgcctatataacactggcagtcgctaaattagctgcaggttattggtttgatgctacttcacttgtagcagatggatttaataacttatctgatatcttaggaaatgtagcactcttaattggtttacacttggctagtcaaccagccgactcaaaccatcgttttggtcactggaaaattgaagatttagcaagcctgattacctcttttatcatgtttgtcgtaggtattcaagtttttattcaaactgtcactaagattattaataatactgatactaacattgatcctctaggtgctatagtaggtgctatatctgctcttgttatgcttggcgtttatttctataataaacaattatctcaaagagtaaagtctagcgctctggttgcagcttctaaagataacctttctgatgctgtgacatctatcggcacatctattgctatcattgcggcttctctaaattttcctattattgatcgtttagctgctatcattattacttattttattcttaaaacagcttatgatatttttatagaatctgctttcagcttatcggatggtttcgatgattatcaattaaaacaatacgaaaaagctatattaacaattcctaaaatatccgctgtaaaatctcaacgtggacgtacttacggtagtaatatttaccttgatattgttctcgaaatgaaccctgatctctcagtctttgaaagtcatgccattaccgaaagagtggaaaaactactcagtgataaattttctgtatatgacatagatattcatgtagaacccgcttctatcccagaagacgaaattttcgataatgtttatcaaaaattatacaaaaacgaaaaaatcatcctagcaaaaattcccggttatgagacctttattagccctgacttttatatgattaatgaaaagggaaacattatcacttctgacatgctcactaatgctacaaatcattcattggcaagcaactttaaatatttcaatgtaaaatcaattagtcaaaaaacaaaacttgtgtcttatgaattggaaggtaaacgacatactagtatttggcgccgtaatgaaaaatggttcttaatctaccatcaaataactgccaagtcaagtccgtataaaacgagacgatatcaaatcacttcccttgat

SEQ ID NO: 5440 - protein, 411 aa, Streptococcus agalactiae
MATSTENLQLAKRGPIISIIAYITLAVAKLAAGYWFDATSLVADGFNNLSDILGNVALLIGLHLASQPADSNHRFGHWKIEDLASLITSFIMFVVGIQVFIQTVTKIINNTDTNIDPLGAIVGAISALVMLGVYFYNKQLSQRVKSSALVAASKDNLSDAVTSIGTSIAIIAASLNFPIIDRLAAIIITYFILKTAYDIFIESAFSLSDGFDDYQLKQYEKAILTIPKISAVKSQRGRTYGSNIYLDIVLEMNPDLSVFESHAITERVEKLLSDKFSVYDIDIHVEPASIPEDEIFDNVYQKLYKNEKIILAKIPGYETFISPDFYMINEKGNIITSDMLTNATNHSLASNFKYFNVKSISQKTKLVSYELEGKRHTSIWRRNEKWFLIYHQITAKSSPYKTRRYQITSLD

SEQ ID NO: 5441 - DNA, 1233 bp, Streptococcus pyogenes
atgacacaggatccgattgcaaatttaaaactagccagaaagggcccaatcgttagtattattgtctacttgtcgcttagtgttgccaaattattagctggttatttgttaaatgcaagttcccttattgctgatggatttaacaatttatcggatattgtgggaaatgtagccctgcttattggtcttcacttagctagccaaccagccgatgccaatcataaatttggtcattggaaaattgaagacttatccagccttgtcacttcttttattatgtttcttgtaggtttccaagtactgattcacacaattaaaagtatctttagtggtcagcaagttgatattgaccctcttggggctattgtcggtatcgtttcagcttttgttatgttaggggtttatgtctttaacaaacgtctttccaaacgtgtaaaatccagtgccttagtcgctgcttctaaggataatctagctgatgctgttacttctatcggaacatcaattgctattatagcagcttctttgcatttaccagttatcgatcatatagctgctatgatcattacgttctttattcttaaaacagcttttgatatctttatggaaagttcgtttagtttatctgatggatttgatagccgtcatttgaaaaaatacgaaaaagccattttagaaatccctaaaattgtcgccgttaagtctcaacgagctaggacctatggtagcaatgtctatcttgatattgtacttgaaatgaatcctgatctttcagtctatgaaagtcactctattacagagaaagtggagcagttattgagtgaccaattttctatttatgacattgacattcacgttgagcctgccatgattcccgaagaagagatttttgataatgtcgccaaaaagctctaccgctacgaaaaattaattttgagtaaggttcctgactatgaccactacattgctaagtctttccaactgattgatgcgaatggccaaacagttaactatgaacaatttttgaaccaagaaatttattatccaagtaacttcaaccattttcagattgaatccattagtcaaaaaacgatgttggtaacttaccaattaaatggcaatcaacgtaccagtatttggaggcgtcatgaatcttggtccttactcttccaccaaattacccctatcgctaagaaacaattacatcacacacactatcgtattgtaaaaatg

SEQ ID NO: 5442 - protein, 411 aa, Streptococcus pyogenes
MTQDPIANLKLARKGPIVSIIVYLSLSVAKLLAGYLLNASSLIADGFNNLSDIVGNVALLIGLHLASQPADANHKFGHWKIEDLSSLVTSFIMFLVGFQVLIHTIKSIFSGQQVDIDPLGAIVGIVSAFVMLGVYVFNKRLSKRVKSSALVAASKDNLADAVTSIGTSIAIIAASLHLPVIDHIAAMIITFFILKTAFDIFMESSFSLSDGFDSRHLKKYEKAILEIPKIVAVKSQRARTYGSNVYLDIVLEMNPDLSVYESHSITEKVEQLLSDQFSIYDIDIHVEPAMIPEEEIFDNVAKKLYRYEKLILSKVPDYDHYIAKSFQLIDANGQTVNYEQFLNQEIYYPSNFNHFQIESISQKTMLVTYQLNGNQRTSIWRRHESWSLLFHQITPIAKKQLHHTHYRIVKM

SEQ ID NO: 5443 - DNA, 759 bp, Streptococcus agalactiae
ttggactggtatcccaatggatcaaaaagagatatgaaggagattatccagaaattggaggtaaaaatggcaactttaacgaataaccctatctttggtattatgttaaccgtatgggcgtattacattggcataaggatttttagaaaatatccttcccctgcaacaactccacttcttttggcgactattttattaattgcttttttaaaattaacacatatctcctataaagattactacaatggcggttcatttctaacgatgttaattacgccttcaacggttgtattggctattcctctctatagaacctttcatttaatgaagcatcacattaaaagcattagcattagcatcatcttagcttctgttatcaacacagtttttaccgcaatagttgctaagttttttggtatgaaatatttcttagcaatctcacttttcccaaagtccgtaactacagctatggccgttggaattacaagtaaagcaggtggattagctactatcactctggtcgtagttgttattacaggcatcttaacaagcgttttgggtcctatttttctaaaattattaaggatagaagatcctgttgctatagggctcgcgctaggaggaactgggcatgctataggaactggacaagccttaaaatatggccaagttcaaggcgccatggctggactagcaattggtatcacagggatttgctatgttattgtcagtcctttagttgcaggcttaatattgaaa

SEQ ID NO: 5444 - protein, 253 aa, Streptococcus agalactiae
MDWYPNGSKRDMKEIIQKLEVKMATLTNNPIFGIMLTVWAYYIGIRIFRKYPSPATTPLLLATILLIAFLKLTHISYKDYYNGGSFLTMLITPSTVVLAIPLYRTFHLMKHHIKSISISIILASVINTVFTAIVAKFFGMKYFLAISLFPKSVTTAMAVGITSKAGGLATITLVVVVITGILTSVLGPIFLKLLRIEDPVAIGLALGGTGHAIGTGQALKYGQVQGAMAGLAIGITGICYVIVSPLVAGLILK

SEQ ID NO: 5445 - DNA, 621 bp, Streptococcus agalactiae
atgataccgttaaaaaaaataactgttggaacgattgtctgtctctcatttttgggtttaacagcatgctcttcttcaaatactcagcaaacctctacttcaaaatcaaatgtatcacaacataaaaatatcaaagctgaccacgaagaattacgtttgaaatttaataaagtaaagttaggggttaaagcaaataactttaaaggaggcactagtctcgctgaattaaaacaattatttggtggcgaaccaaatgaaaaatttgatacaccagcgggaaatgtcactcttaaaggctatcgttggaatgtcgatgatatctccatcactatacaattattaaacgatagtagcattgttcgttcaattagtaattttaagtttattcgtgatgccaacatcacaacaaaagattataatagtttaaaaaatggcatgtcatacaataaagtaaaagaacttctaggagaacctgatgatatttctcaagcagtttcttcagataaagaggaactacaggctgcatggattagtggcatccagtcgtcagacagtgatccgggaattaaccttacatttgaaaatgataaactcactaacaaacaacagcatggtttaaaa

SEQ ID NO: 5446 - protein, 207 aa, Streptococcus agalactiae
MIPLKKITVGTIVCLSFLGLTACSSSNTQQTSTSKSNVSQHKNIKADHEELRLKFNKVKLGVKANNFKGGTSLAELKQLFGGEPNEKFDTPAGNVTLKGYRWNVDDISITIQLLNDSSIVRSISNFKFIRDANITTKDYNSLKNGMSYNKVKELLGEPDDISQAVSSDKEELQAAWISGIQSSDSDPGINLTFENDKLTNKQQHGLK

SEQ ID NO: 5447 - DNA, 618 bp, Streptococcus pyogenes
atgacaaaaaaacacttactaacacttcttctcatctctttttttactagctttttggtagcttgttcaacaacgaaagataaagagcctcaaccgtctgattcagaaatcattactccccgactacaccaagccgctcatcaagataaacgcgctaactttgaaaaaattaaacttgcgactgttgattcctcatttacaggagggacaagccttgaagaacttatttcactctttggagagcctagccaacatgatccaaaaacagcaggcgaagtaacaatcgacgcttatacttggcagtttgatcaagttactctcactgttaatctttatcaaaatagtagtattgttaaaaccatctctaattttacctttgcaagagagttaggcttatcgcaaaaggaataccaacaattacaaaaaggaatgtcttatgaagacgttaaaaagatcttaacagaacctgataattatagccaagcgtcatctagtgatcatcaaactttgcaagcgatttgggttagtggcttaaagacagatacaagcggagctaatatttctctcgtttttgaaaataatcagttaacagaaatgtctcaggtaggacttgaagaa

SEQ ID NO: 5448 - protein, 206 aa, Streptococcus pyogenes
MTKKHLLTLLLISFFTSFLVACSTTKDKEPQPSDSEIITPRLHQAAHQDKRANFEKIKLATVDSSFTGGTSLEELISLFGEPSQHDPKTAGEVTIDAYTWQFDQVTLTVNLYQNSSIVKTISNFTFARELGLSQKEYQQLQKGMSYEDVKKILTEPDNYSQASSSDHQTLQAIWVSGLKTDTSGANISLVFENNQLTEMSQVGLEE

SEQ ID NO: 5449 - DNA, 924 bp, Streptococcus agalactiae
ttggaagctcgtaaagcatgggacaaacttgttggtcgtgaaggtgaagttgttactgttaaaggtacacgtgctgttaaaggcggactttcagttgaatttgaaggacttcgtggtttcatcccagcttcaatgattgatactcgttttgtacgtaatactgaaaaatttgttggacaagaatttgatgctaaaatcaaagaagttgatgcagcagaaaatcgcttcatcctttcacgtcgtgaagttgttgaagaatcagcagctgcagcacgtaaagaagttttctcaaacattgaagtaggttcagttgtaactggtaaagttgctcgtttaacaagctttggtgctttcattgaccttggtggtgttgatggacttgtacacgtaactgaattatcacatgagcgcaatgtttcacctaaatcagttgtaactgttggtgaagaagttgaagttaaagtactttcaattgatgaagaagctggtcgtgtatcactttcacttaaagcaactacacctggcccatgggatggcgttgaacaaaaacttgctgctggtgatgttattgaaggtaaagtaaaacgcttgactgactttggtgcttttgttgaagtgttacctggcattgatggacttgtacacatttcacaaatttcacacaaacgtgttgaaaatcctaaagacgtattatctgcaggacaagaagttactgttaaagttcttgaagttaattcagatgcagaacgtgtctcactttcaatgaaagctcttgaagagcgtccagcgcaagcagaaggtgaaaaagaagaaaaacgtcaatcacgtccacgtcgtccacgtcgtcaagaaaaacgcgactacgagcttccagaaacacaaactggattctctatggctgacttattcggtgatattgaatta

SEQ ID NO: 5450 - protein, 308 aa, Streptococcus agalactiae
MEARKAWDKLVGREGEVVTVKGTRAVKGGLSVEFEGLRGFIPASMIDTRFVRNTEKFVGQEFDAKIKEVDAAENRFILSRREVVEESAAAARKEVFSNIEVGSVVTGKVARLTSFGAFIDLGGVDGLVHVTELSHERNVSPKSVVTVGEEVEVKVLSIDEEAGRVSLSLKATTPGPWDGVEQKLAAGDVIEGKVKRLTDFGAFVEVLPGIDGLVHISQISHKRVENPKDVLSAGQEVTVKVLEVNSDAERVSLSMKALEERPAQAEGEKEEKRQSRPRRPRRQEKRDYELPETQTGFSMADLFGDIEL

SEQ ID NO: 5451 - DNA, 1203 bp, Streptococcus pyogenes
atgaatgaatttgaagatttgctaaacagtgttagcgaagtgaaccctggtgatgttgtcactgcggaagttttaactgttgataacggtcaagcaaacgttgttatcgaaggaacaggtgttgaaggtgtcttgacacttcgtgaattgactaacgaccgcgatgctgatattaacgactttgttaaagctggcgacacagttgaagtacttgttcttcgtcaagtagtaggtaaagatactgatacagttactttcctagtatctaaaaaacgtttggaagctcgtaaagcctgggacaaacttgttggtcgtgaaggcgaagttgttactgttaaaggtacccgtgctgttaaaggtggcctttcagttgaatttgaaggacttcgtggatttatccctgcttcaatgattgacactcgttttgttcgcaacactgaaaaatttgttggacaagagtttgatgctaaaatcaaagaagttgatgcagcagaaaaccgtttcatcctatcacgtcgtgaagttatcgaagaggccgctaaagaagctcgtgctgaagtgttctctaagatttcagaaggtgcagtcgttacaggtactgtagcgcgtttaacaagttttggtgctttcattgaccttggtggtgttgacggacttgttcacgtgactgaattgtctcacgaacgtaacgtgtcacctaaatcagttgtttcagttggtgaagaagttgaagttaaagttctttcaattgacgaagaagctggtcgtgtgtcactttcacttaaagcaacaacacctggaccatgggacggcgttgaacaaaaacttgctcaaggtgatgttgttgaaggtaaagtaaaacgcttgactgacttcggtgcttttgttgaagtattaccaggtattgatggacttgttcatatttcacaaatttcacacaaacgtgttgaaaatccaaaagatgtactttctgtaggacaagaagtaacagttaaagttcttgaagtgaatgcagctgatgagcgcgtatcattatcaatcaaagctcttgaagaacgcccagcgcaagctgaaggagacaacaaagaagaaaaacgtcaatcacgcccacgtcgtccaaaacgtgaatcaagacgtgactacgaactcccagaaacacaaactggattctcaatggctgatcttttcggtgatattgaattg

SEQ ID NO: 5452 - protein, 401 aa, Streptococcus pyogenes
MNEFEDLLNSVSEVNPGDVVTAEVLTVDNGQANVVIEGTGVEGVLTLRELTNDRDADINDFVKAGDTVEVLVLRQVVGKDTDTVTFLVSKKRLEARKAWDKLVGREGEVVTVKGTRAVKGGLSVEFEGLRGFIPASMIDTRFVRNTEKFVGQEFDAKIKEVDAAENRFILSRREVIEEAAKEARAEVFSKISEGAVVTGTVARLTSFGAFIDLGGVDGLVHVTELSHERNVSPKSVVSVGEEVEVKVLSIDEEAGRVSLSLKATTPGPWDGVEQKLAQGDVVEGKVKRLTDFGAFVEVLPGIDGLVHISQISHKRVENPKDVLSVGQEVTVKVLEVNAADERVSLSIKALEERPAQAEGDNKEEKRQSRPRRPKRESRRDYELPETQTGFSMADLFGDIEL

SEQ ID NO: 5453 - DNA, 930 bp, Streptococcus agalactiae
atggtatcgctaaaaacggaaattgctggttttagttttgacaattgtttgatgaatgcagcgggtatttattgtatgactaaggaagagttattagctattgaaaattctgaagctggttcctttgttacaaaaacaggtacccttgaagctagagagggaaaccctcaaccacgttatgcagatactgactggggatcaattaattctatgggactccctaataaaggtattgactattatcttgatttcgtgactgaattacaagatcaagacaatagcaaaaatcacgttttatcattagtaggtttatcaccagaagagacacatattattcttaaaaaggttgaaaacagtagttacaatggcctaatagagttaaatttatcgtgcccaaatgttcctggaaaacctcaaattgcttatgattttgaaatgactgacctcatcctttcagaaatctttagctattatcaaaagccattgggcatcaaattaccaccttactttgatatcgttcactttgatcaagcagctacaatttttaacaaatatcctttagcttttattaactgtgttaattctatcggaaatggacttgttattgatgatgaaactgtcgttataaagcctaaaaatggctttggaggtatcggtggggattttatcaagcctaccgccttagctaacgtccatgctttctacaaacgtttaaatccttcaattaaaattatcggaacaggtggtgttaaaaacggccgtgatgcctttgaacacattctatgtggagctagtatggtccaaatcggaaccgctttacaaaaagaaggaccagaaatttttcagcgtgtaagcagagaattaaaagaaataatggctgataaaggctatcaatcattggaggattttcgaggacaacttaattacctt

SEQ ID NO: 5454 - protein, 310 aa, Streptococcus agalactiae
MVSLKTEIAGFSFDNCLMNAAGIYCMTKEELLAIENSEAGSFVTKTGTLEAREGNPQPRYADTDWGSINSMGLPNKGIDYYLDFVTELQDQDNSKNHVLSLVGLSPEETHIILKKVENSSYNGLIELNLSCPNVPGKPQIAYDFEMTDLILSEIFSYYQKPLGIKLPPYFDIVHFDQAATIFNKYPLAFINCVNSIGNGLVIDDETVVIKPKNGFGGIGGDFIKPTALANVHAFYKRLNPSIKIIGTGGVKNGRDAFEHILCGASMVQIGTALQKEGPEIFQRVSRELKEIMADKGYQSLEDFRGQLNYL

SEQ ID NO: 5455 - DNA, 945 bp, Streptococcus pyogenes
atggaggaaataatggtttctactgctacacaaattggtcatttctcttttgataactgtttgatgaatgctgctggtgtttactgcatgacaaaagaagagcttatggaggttgaaaagtctcaagccgcttcctttgtcaccaaaacagggacgcttgaagttcgtccaggtaatccagaacctcgctacgcagatactcgtcttggttctatcaattcaatgggactccctaataatggttttcgctactacttagactttgtcagtgatcttgccaaaaccgggcaacataaacctcactttctctccgttgtcgggctatctcctactgaaaccgaaaccattttaaaagccatcatggcttcagattatgagggtctagtggaactaaacctttcttgccctaacgttccaggaaaaccacagattgcttatgattttgaaaccactgatcaacttctagagaacatctttacctattacactaaacctcttggtatcaaattacctccttattttgacattgtgcattttgatcaagcggctgcgattttcaataaataccccctttcctttgttaactgtgtcaattctatcggaaatgggctggtcattaaggatgaacaagtcctcatcaagcctaaaaatggctttggtggtataggtggagattacatcaaacctactgctctagccaatgtccatgcgttttacaaacgcttaaaaccttctatccacattattggtacagggggagttaaaacaggacgcgatgcctttgaacatattctttgtggcgccagcatggtccaaattgggacagcccttcatcaagaagggccagctatctttgaacgggtcactaaggaacttaaaacgattatggtagaaaaaggctaccaaagcttagacgattttcgtgggaacttacgttacaaagat

SEQ ID NO: 5456 - protein, 315 aa, Streptococcus pyogenes
MEEIMVSTATQIGHFSFDNCLMNAAGVYCMTKEELMEVEKSQAASFVTKTGTLEVRPGNPEPRYADTRLGSINSMGLPNNGFRYYLDFVSDLAKTGQHKPHFLSVVGLSPTETETILKAIMASDYEGLVELNLSCPNVPGKPQIAYDFETTDQLLENIFTYYTKPLGIKLPPYFDIVHFDQAAAIFNKYPLSFVNCVNSIGNGLVIKDEQVLIKPKNGFGGIGGDYIKPTALANVHAFYKRLKPSIHIIGTGGVKTGRDAFEHILCGASMVQIGTALHQEGPAIFERVTKELKTIMVEKGYQSLDDFRGNLRYKD

SEQ ID NO: 5457 - DNA, 1233 bp, Streptococcus agalactiae
atggcgcttaaagaattaacagctaaagagttcgaaagttattcaggaaattacgatttacaatcgtttatgcaaacccctgagatggcaaagcttctaaaaaaacgtgggtatgacattacctacatgggctaccaaatcgatgggaaaatggaaatcatcagtattgtttataccatcccaatgactggtggacttcatatggaagtcaattctggtccagcccattccaattctaaatatctgaaacatttttataaagaactacagaactatgccaaatctcagggcgctttagaattattaattaaaccttatgatacctaccaagagtttactggtgaaggtaagcctaaaggtgcaccgaacacctatcttattgatgacctgactagtataggttatcaccacgatgggcttcatattggttatcctggcggtgaacctgattggcattatgttaaaaatctagaaggtatcactcctcaaaatcttcttaaatctttctctaaaaaaggacgccccttggttaaaaaagccatgtcttttggtataaaaatacgtgtcctcaagcgggaagaactacatatctttaaggatattacttcttctacttctgatcgccgggactatatggataaatctctagattattatcaagatttttatgatagtttcggagataaggcggaatttgtcattgcaactctaaactttagggaatatgatcataacctacaattaaatgcaaagaaattggaagaacagattacagtccttgataatcgccatcaaaataatacagattctgccaaataccatcgtcaacgtactgagcttgtcaatcaactagctagtttagataaacgtcgcaaagaagtcgaaccttttattcaaaaatttggaaatcaagatgttgttttagctggtagcctctttatttatagcccgaaagaaactgtctatcttttctctggctcatacacagaatttaataaattttatgcgcctgcagttcttcaagaatatgttatgcaagaggctttaaagcgtcaatcaactttctataattttttaggtattcaaggaaattttgatggttcagatggcgtacttcgctttaaacagaattttaatggttacattgttcgtaaaatgggtactttccgctactatccaaatccattaaaatataagagtattcaattactaaagaaaatcttacgccgaaca

SEQ ID NO: 5458 - protein, 411 aa, Streptococcus agalactiae
MALKELTAKEFESYSGNYDLQSFMQTPEMAKLLKKRGYDITYMGYQIDGKMEIISIVYTIPMTGGLHMEVNSGPAHSNSKYLKHFYKELQNYAKSQGALELLIKPYDTYQEFTGEGKPKGAPNTYLIDDLTSIGYHHDGLHIGYPGGEPDWHYVKNLEGITPQNLLKSFSKKGRPLVKKAMSFGIKIRVLKREELHIFKDITSSTSDRRDYMDKSLDYYQDFYDSFGDKAEFVIATLNFREYDHNLQLNAKKLEEQITVLDNRHQNNTDSAKYHRQRTELVNQLASLDKRRKEVEPFIQKFGNQDVVLAGSLFIYSPKETVYLFSGSYTEFNKFYAPAVLQEYVMQEALKRQSTFYNFLGIQGNFDGSDGVLRFKQNFNGYIVRKMGTFRYYPNPLKYKSIQLLKKILRRT

SEQ ID NO: 5459 - DNA, 1233 bp, Streptococcus pyogenes
atggcactaattgaaatttcacaagaacaatttgaccattactgccacagtctcgtccatcattcctttatccaaacctcagaaatggccagcttgatggctaaaagaggggcaaaaccacaatttcttggacttgaaaaagatggtgaactaaaggttgctgctatggtctttagccaaaaagtggctggaggttggcgtatggaactcaatgcaggccctaataccaatcatcccgaagaattagaacatttttacactcaacttaaagactatgccaaacaaaaagacgttatcgaactcattttaaaaccttacgacaattatcagtcatttgatactgatggcatccctatttctcgtccaaacactgaccttattagccttttaacggcgttaggatataaacatgacggtttaaaaacaggctatcctgagggtgaacctgtttggcattacgttaaaaagttagaaggaattgattcctcacgtttaacccgttccttcagcaaaaaaggaaaagctttaataaaaaaagctaatacttttggtattaaattacgtcaactgaaacgagatgagttacaccatttcaaagaaattactgaagcaacctctgatcgtagagattaccttgacaaatcattatcttactatcaggacttttatgatagttttggagactcttgtgaatttatggttgcgactcttaattttgaagattaccttaataaccttaaacaaagacaactacaactagcaaccagcatcaacaaagttaaaggagaccttggcaaaaatcctcattctgaaaaaaagcaaaatagattaaaagaactatccagccagttcgaaacctttcaggtaagaatttctgaagctctccattttcttgaagagtatggaactaaagatgtgttccttgcgggaagtctttttatctataccgaacaagaggccgtctacctcttttcaggatcttaccccaaatttaataaattttatagcccagctctattacaagagcatgctatgctcaaggcaattcacaagggcatcaaacaatataattttcttggtattactggaaagtttgatggttcagacggtgtcttgcgctttaaacagaatttcaatggctttattttgcaaaaaccagggacatttagatgttatccatttccaatcaaatatcatttcattagattggcaaaaaagctattaaaccgctat

SEQ ID NO: 5460 - protein, 411 aa, Streptococcus pyogenes
MALIEISQEQFDHYCHSLVHHSFIQTSEMASLMAKRGAKPQFLGLEKDGELKVAAMVFSQKVAGGWRMELNAGPNTNHPEELEHFYTQLKDYAKQKDVIELILKPYDNYQSFDTDGIPISRPNTDLISLLTALGYKHDGLKTGYPEGEPVWHYVKKLEGIDSSRLTRSFSKKGKALIKKANTFGIKLRQLKRDELHHFKEITEATSDRRDYLDKSLSYYQDFYDSFGDSCEFMVATLNFEDYLNNLKQRQLQLATSINKVKGDLGKNPHSEKKQNRLKELSSQFETFQVRISEALHFLEEYGTKDVFLAGSLFIYTEQEAVYLFSGSYPKFNKFYSPALLQEHAMLKAIHKGIKQYNFLGITGKFDGSDGVLRFKQNFNGFILQKPGTFRCYPFPIKYHFIRLAKKLLNRY

SEQ ID NO: 5461 - DNA, 1209 bp, Streptococcus agalactiae
atgtatagagaaattaccgctgtcgaacacgatcgctttgtgagcgaatccaaccaaacaaacctacttcaatcttctaattggcccaaagtaaaagacaactggggtagtcaattacttggcttttttgacggtgaaacccaaattgccagcgctagtattctcatcaaatcacttcctcttggcttctccatgctatatattccgcgtggaccaatcatggattactccaatctagatattgtaactaaggtccttaaggaccttaaagcttttggcaaaaaacaaagagctctctttatcaagtgtgatcctctcatctatttaaaaatggtcaatgccaaagattttgaaaattcgcccgatgaaaaagaagggttaatcgccattgatcatttacagcgtgcaggtgctgattggactggtcggacaacagatttagctcatactatccaaccacgttttcaggcaaacctatatgctaatcaatttggacttgataaaatgtctaaaaaaactcgtcaagctattcgaacttccaaaaataagggagtagatatacaatttggtagccatgaactacttgaagattttgcagagttgatgaaaaaaacggaagaccgtaaagggataaatcttagaggaattgactactaccaaaaactccttgatacgtatcctaataactcatacatcacaatggcttcgctagatgttgcaaaacgattagaaaaaatagaaaaagaatgtcagatagcccaatctgaaagaataaaatcacttgaacttaatcgtgagaaaaaagttaaacaacaccaaggtacgattgatcgattaaataaagaaattgattttctcaaagaagctcaaaaagcctatgaccgagacattattccattggctgcaaccctcactctagaatttggtaatacatcagaaaatatttatgctggtatggacgattactttaaatcttattctgctcctatttacacttggtttgaaacagctcaaagggcttttgaacgtggaaatatttggcaaaatatgggggggattgagaatgacttatctggtggtttatatcattttaagtctaagttcgaaccaatcattgaggaatttattggagaatttaacattccagtgaacagattgctttataaagcctctaattatgtctatgccttacgcaaaaaacgtaatagc

SEQ ID NO: 5462 - protein, 403 aa, Streptococcus agalactiae
MYREITAVEHDRFVSESNQTNLLQSSNWPKVKDNWGSQLLGFFDGETQIASASILIKSLPLGFSMLYIPRGPIMDYSNLDIVTKVLKDLKAFGKKQRALFIKCDPLIYLKMVNAKDFENSPDEKEGLIAIDHLQRAGADWTGRTTDLAHTIQPRFQANLYANQFGLDKMSKKTRQAIRTSKNKGVDIQFGSHELLEDFAELMKKTEDRKGINLRGIDYYQKLLDTYPNNSYITMASLDVAKRLEKIEKECQIAQSERIKSLELNREKKVKQHQGTIDRLNKEIDFLKEAQKAYDRDIIPLAATLTLEFGNTSENIYAGMDDYFKSYSAPIYTWFETAQRAFERGNIWQNMGGIENDLSGGLYHFKSKFEPIIEEFIGEFNIPVNRLLYKASNYVYALRKKRNS

SEQ ID NO: 5463 - DNA, 1239 bp, Streptococcus pyogenes
gtgggtattaaactaatgtatacatataaaatcggaatatctcctgaagaacatgatcagtttgtcttagcacagccacaagctggcttacttcaaagttcaaagtggggaaaagtcaaagataactggaaacacgaacgcatcagcttttatgaaaatggggtacaagttgctgctgctgcttgtttaatcagaaaacttcctcttggtttcactatgatttatatcccacgtgggccaatcatggactacgccaattttgaactccttgatttcgtcattaaaacgctcaaaactttcggaaaaagcaaacgagcgctttttatcaaaattgatccaagtttagtcatcaaacaaactttagaaggaaaagagagcaaagaaaatgatgtgacactctctattattgcttttctaaaaaaactcggtgtcgaatggtctggcagaacaaaagaactcgaagacactattcaaccaagaatacaagccaacatctacgccaaggattttgactttgacagcctgcccaaaaaagccaagcaatccattcgtaccgctaccaataaaggtgttaatgtcacgattggtggcagtgaattgctagacgacttttcagccttgatgaaaaaaaccgagaatcgaaaaggcattatccttcgaggcaaatcctattatcaaaaattactaggtatttatgctggtcagtcctacattactatggctagtttagacttacctgaacaaaaaaaactcttgatccaacagttggacaaggccttagcagaacaagcacgattaacagataagagtaaacctagcaaagtagcagaaaatcaaaaaaccattgcacggctacaaaaagatttaaccattttaagcgagcagctcgctacaggccaaacccgtatcccattagccgccaccctaaccttgatttatggcgagacttctgaaaatctttatgcgggaatggacgatgattatcgcaattatcaagctcctcttttaacctggtatgaaacggctaaagaagcttttaaaagaggctgccgctggcataatttaggaggtgtggaaaatcaacaagatggtggactctatcatttcaaagctagactcaaccccactatcgaagaatttgcaggtgaattcaacattcctgtcggccttgtttcaagcttagccatcttaacctataacttaagaaaaaaattaaggagcacaactaatggcactaat

SEQ ID NO: 5464 - protein, 413 aa, Streptococcus pyogenes
VGIKLMYTYKIGISPEEHDQFVLAQPQAGLLQSSKWGKVKDNWKHERISFYENGVQVAAAACLIRKLPLGFTMIYIPRGPIMDYANFELLDFVIKTLKTFGKSKRALFIKIDPSLVIKQTLEGKESKENDVTLSIIAFLKKLGVEWSGRTKELEDTIQPRIQANIYAKDFDFDSLPKKAKQSIRTATNKGVNVTIGGSELLDDFSALMKKTENRKGIILRGKSYYQKLLGIYAGQSYITMASLDLPEQKKLLIQQLDKALAEQARLTDKSKPSKVAENQKTIARLQKDLTILSEQLATGQTRIPLAATLTLIYGETSENLYAGMDDDYRNYQAPLLTWYETAKEAFKRGCRWHNLGGVENQQDGGLYHFKARLNPTIEEFAGEFNIPVGLVSSLAILTYNLRKKLRSTTNGTN

SEQ ID NO: 5465 - DNA, 93 bp, Streptococcus agalactiae
atgttaccgttggaatatccgaaaaagaatatgatgcctttgctattgcatcgtctcaaaccaatctcctccactcttcaaagtgggcacaag

SEQ ID NO: 5466 - protein, 31 aa, Streptococcus agalactiae
MLPLEYPKKNMMPLLLHRLKPISSTLQSGHK

SEQ ID NO: 5467 - DNA, 1233 bp, Streptococcus agalactiae
atgggtaataaactgatgtatcatgttaccgttggaatatccgaaaaagaatatgatgcctttgctattgcatcgtctcaaaccaatctcctccactcttcaaagtgggcacaagtaaaatcaaattggcaaaatgaacgtttaggcttttataaagatgaccaattagttgctgtagctagcatcttaattaaatcattaccacttggttttacaatgctttatattccacgtggacctattatggactacagcaataaagaattagttaactttgtgttaaaaacactaaaaaactttggacgaaagaaacgtgctgtttttgcaaaattcgatccagcacttcttctacgtcaatatcaccttaaagaagagaatgtcgccgaagagatagatgaaagtagacaggcaattgataatcttaagtcagcaggtgcccaatggataggtccaacgaaagccatttccgaaaccatccaacctcgttttcaagcgaatatctataccaaagcaaatatagaagaaaactttccaaaacacactaaacgtctgataaaagatgcaaagcatcgcggtgttcaaatttatcgtgccaacattgatgatttacctaaattcgccacggttgtagcattaaccgagaatcgtaaaggtgtagctttacgtaatgaaaactatttccatcaactaatgacaatttatggagaagatgcctatctctatttagctaaagtcaatcttcctaaaagattagcgcaatttaaagaacaacttcttcaaatccaaaaagatttatcagaaactccatcccatcaaaaaagtcgcctgacaaggctaaatcaacaagaagcttctgttaaacaatatatccttgaatttcaggagtttagcaagaaatatccagatgagcctgtcattgcaggaattttgtccattcgttttggcaatgtcctggagatgttgtatgctggtatggatgatagcttccgtaaattttatccacagtatctcttgaatgctagggtgttcgaagatgctttcaaaaacgatattgtatctgctaatctaggcggtgtcgagggaagtcttaacgatggtttaacaaaatttaaaagtaacttcaatccaatgtttgaagaatatattggcgagtttaatctagcaatcaatccattattatataaattggccaacctagcctatactattcgaaaaaaacaaagacactctcac

SEQ ID NO: 5468 - protein, 411 aa, Streptococcus agalactiae
MGNKLMYHVTVGISEKEYDAFAIASSQTNLLHSSKWAQVKSNWQNERLGFYKDDQLVAVASILIKSLPLGFTMLYIPRGPIMDYSNKELVNFVLKTLKNFGRKKRAVFAKFDPALLLRQYHLKEENVAEEIDESRQAIDNLKSAGAQWIGPTKAISETIQPRFQANIYTKANIEENFPKHTKRLIKDAKHRGVQIYRANIDDLPKFATVVALTENRKGVALRNENYFHQLMTIYGEDAYLYLAKVNLPKRLAQFKEQLLQIQKDLSETPSHQKSRLTRLNQQEASVKQYILEFQEFSKKYPDEPVIAGILSIRFGNVLEMLYAGMDDSFRKFYPQYLLNARVFEDAFKNDIVSANLGGVEGSLNDGLTKFKSNFNPMFEEYIGEFNLAINPLLYKLANLAYTIRKKQRHSH

SEQ ID NO: 5469 - DNA, 1221 bp, Streptococcus pyogenes
atgacgaatttaacgttttatgcaaaaatcggtatttcagaagaagagcatgactcttttgttaaagaacatcagcaaattagcgttttacaaggtagtgattgggcaaaaatcaaaaatcaatggcagaatgagcgaattggtatctataaagaggaaaagcaggttgcctctttatcacttttgattaagctattgccacttggaagaagcattatttatattccaagagggccagtcatggattatcttgaccgtgatttggtggcatttaccatgaaaacactaaaggattatggtaaaactaaaaaggccctctttatcaaatatgatccagctatcctgttaaaacaatacgcactgggacaggaagaagaagaaaaacctttagctttagcagctattaagaatctccaagaagctggtgttcattggactggtttaacaatggagattgcagatagtatccaacctcgtttccaagctaatatttacactcaagaaaaccttgagatgcaatttcctaagcataccagacgtttaataaaagatgctaagcagcgtggtgtaaaaacatatcgtgtcagtcaatcagaacttcacaaattttccaagattgtctccttaacagaaaaacgtaaaaatatttctttgcgtaacgaagcttactttcaaaagttgatgactacttatggggataaggcctacttacatctagcaaaagtgaatattcctcaaaaactagatcaataccgccagcaattaattcttattaaccaagatattactcgcacccaagctcatcaaaagaagcgtttaaaaaaattagaagatcaaaaagcttctttagaacgttatataactgaatttgaaggctttacagaccaatatcctgaggaagttgttgtagcaggtatattatctatttcttatggaaatgttatggaaatgctttatgctgggatgaatgatgattttaagaagttttatcctcagtatctgctgtatcctaatgtttttcaggatgcttatcaagatggtattatttgggctaacatgggaggagtagaaggctcgcttgatgatggacttaccaaatttaaggccaactttgctccgacaatagaagaatttataggagaatttaatctccctgtcagcccactttatcatattgctaataccatgtacaaaatacgaaaacagttaaagaataaacat

SEQ ID NO: 5470 - protein, 407 aa, Streptococcus pyogenes
MTNLTFYAKIGISEEEHDSFVKEHQQISVLQGSDWAKIKNQWQNERIGIYKEEKQVASLSLLIKLLPLGRSIIYIPRGPVMDYLDRDLVAFTMKTLKDYGKTKKALFIKYDPAILLKQYALGQEEEEKPLALAAIKNLQEAGVHWTGLTMEIADSIQPRFQANIYTQENLEMQFPKHTRRLIKDAKQRGVKTYRVSQSELHKFSKIVSLTEKRKNISLRNEAYFQKLMTTYGDKAYLHLAKVNIPQKLDQYRQQLILINQDITRTQAHQKKRLKKLEDQKASLERYITEFEGFTDQYPEEVVVAGILSISYGNVMEMLYAGMNDDFKKFYPQYLLYPNVFQDAYQDGIIWANMGGVEGSLDDGLTKFKANFAPTIEEFIGEFNLPVSPLYHIANTMYKIRKQLKNKH

SEQ ID NO: 5471 - DNA, 822 bp, Streptococcus agalactiae
gtgggagataaaatgacttcaattaaacttgttgccgtagatattgacggcaccctattaaatagtaagcgtgaaattacacctgaagtggctaaagctgttcaagaagcaaaatcaaaaggcgttaaaattgttattgctacaggacgtccaatcatcggagtccaagatcttttagaagaattgaaactcaatgaagagggagattatgttatcacctttaacggcggtctagttcaagacacagccacaggagatgacatcatcaaagaaaccttaacctatgaagactatctggatttcgaactgttagcgcgtaaattaggcgtccacatgcacgccattacaaaagaaggaatttacacagcaaatcgtgatattggtaaatatacaatacacgaagtaactttagttaatatgccgctcttctatcgtactcctgaagaaatgggagacaaagaaatcattaaactaatgatgattgatcaacctgacatcttagatgcagcaattgctaaaattccaaaaaaagttctcgataactacactattgtaaaatcaactcctttttatttagaaattttacccaaaaacgttaataaaggcactgcacttctccaccttgcagagaaaatgggattaactgtagatcaaacaatggctattggtgatgaagaaaatgaccgtgctatgcttgaagttgttggaaatcctgttgttatgcaaaacggcaatcctgaactaaaaaaaatagcaaaatatatcaccaaatcaaacgaggaaagtggcgtagcctacgcactacgtgaatgggtaataaac

SEQ ID NO: 5472 - protein, 274 aa, Streptococcus agalactiae
MGDKMTSIKLVAVDIDGTLLNSKREITPEVAKAVQEAKSKGVKIVIATGRPIIGVQDLLEELKLNEEGDYVITFNGGLVQDTATGDDIIKETLTYEDYLDFELLARKLGVHMHAITKEGIYTANRDIGKYTIHEVTLVNMPLFYRTPEEMGDKEIIKLMMIDQPDILDAAIAKIPKKVLDNYTIVKSTPFYLEILPKNVNKGTALLHLAEKMGLTVDQTMAIGDEENDRAMLEVVGNPVVMQNGNPELKKIAKYITKSNEESGVAYALREWVIN

SEQ ID NO: 5473 - DNA, 1314 bp, Streptococcus agalactiae
atgaatgaaaaagtatttcgtgaccccgttcacacttatatccatgtaaataatcaagtcatatatgacttgattaacactaaagaatttcaacgtttacgacgcattaaacaaacctcaacgacttcttttaccttccatggtgcagagcatagtcgtttttcacattgtctcggagtttatgaactggctcgtaaagttacagaaatctttgatgaacattattctgatctttggaataaaaatgagtccctgctaacgatggctgccgccctactacatgatatcggacatggcgcatattctcatacatttgagcgtctcttcaatactgatcatgaagcttacactcaggaaatcatcaccaatcctaccacagagattaatgctattttacgaaaggtggctcctgattttcctgataaagtagctagtgttattaatcatagctaccccaataaacaagttgttcaattaatttctagtcaaattgattgtgatcgaatggactatcttctcagagattcttactacactgctgctagctatggacaatttgatttaacacgaattttacgcgttattagaccaaccgattctggaattgcttttgctcgtaacgggatgcacgctgtggaagattatattgttagtcgcttccaaatgtatatgcaagtttatttccatccagccagtcgtgctatggaattactcttacaaaatttactaaaacgtgctcgcttcttatttgatacccatcgcgatttttttgaacaaacttctccaaatcttattcctttcttcacggatcaatatgatttacaagattatttagccctagatgatggggtaatgaatacttacttccaatcttggatgcaagctgatgataacattttggcagatttagctaatcgttttatcaatcgaaaagtctttaaatcaattacctttgaagagtctgataaagaaaatctagttaaaatgaaagaactagtctcacaggttggttttgatcccgattattacactggtgtccatgctaattttgacttaccttacgatgtttatcggcctgaacattcaaatccacgaacagaaattcaaattatccaaaagaatggacaacttgctgaattatcaagcttatcaccgattgtaaaagcattaactggatctaattatggtgatcaacgtttttattttccaaaagaaatgttgacattagatagcctattttcaagtacaaaagaagaatttcaatcttatatcacaaatgagcatttgacactcacgaaagataatagccattca

SEQ ID NO: 5474 - protein, 438 aa, Streptococcus agalactiae
MNEKVFRDPVHTYIHVNNQVIYDLINTKEFQRLRRIKQTSTTSFTFHGAEHSRFSHCLGVYELARKVTEIFDEHYSDLWNKNESLLTMAAALLHDIGHGAYSHTFERLFNTDHEAYTQEIITNPTTEINAILRKVAPDFPDKVASVINHSYPNKQVVQLISSQIDCDRMDYLLRDSYYTAASYGQFDLTRILRVIRPTDSGIAFARNGMHAVEDYIVSRFQMYMQVYFHPASRAMELLLQNLLKRARFLFDTHRDFFEQTSPNLIPFFTDQYDLQDYLALDDGVMNTYFQSWMQADDNILADLANRFINRKVFKSITFEESDKENLVKMKELVSQVGFDPDYYTGVHANFDLPYDVYRPEHSNPRTEIQIIQKNGQLAELSSLSPIVKALTGSNYGDQRFYFPKEMLTLDSLFSSTKEEFQSYITNEHLTLTKDNSHS

SEQ ID NO: 5475 - DNA, 1299 bp, Streptococcus pyogenes
atgaatgaaaaagtatttcgtgaccctgttcacaactatatccacattgataatccattaatttatgaccttatcaataccaaagaattccaacgcttacgacgcatcaaacaagtccctacaacagctttcaccttccacggcgcagaacatagccgtttttctcactgcctaggtgtttacgaaattgcccgtcgggtgacagctatttttgaagagaaatacgctgatatctggaataaagatgaaagtctggtcactatgacggctgccctcttacatgacattggtcatggagcctattctcatacctttgaggttctttttcatacggatcacgaggcctttactcaggagataattaccaatcctgagacagaaatcaatgccattttggtgcgtcatgctcctgattttccagacaaagttgccagcgtgattaatcatacttatcctaacaagcaagttgtgcaactgatttccagccagattgactgcgaccgtatggattaccttttaagagattcttatttttctgctgccaattacggtcagtttgatttaatgcgcatcctacgtgtgattcgacctgttgaagatggcattgtctttgaacatagtggtatgcatgctgtcgaggactatattgtcagtcgttttcaaatgtacatgcaggtctattttcatcccgccagccgtgctgttgagctcatcttacaaaatctcctcaaaagagcccaacacttatatcctgagcaacaggcttatttccaaaaaacagctcctggactcatccccttctttgaaaagaaggctaatttagcagattatatagccctagatgacggagtcatgaatacttacttccaagtctggatggcaagcgaagaccatatcttatcagatttggccagtcgctttattaatcgaaaaattctgaagtctgttacctttgaccaagattcccaaggagagttagaacgcttgcgccaattggtcgaatcagttggctttgatccagattattacaccggtatccatatcaacttcgacctgccttatgatatttatcgaccagagctcgaaaatccaagaactcagattgaaatgatgcaaaaagacgggagccttgctgaattatctcagttatctcctattgtcaaagcattaacagggacaacctacggagaccgtcgcttttattttccaaaggaaatgttagagctcgatgacctctttgctcctagcaaggaaacttttatgagttatatttccaatgggcattttcactttagtcag

SEQ ID NO: 5476 - protein, 433 aa, Streptococcus pyogenes
MNEKVFRDPVHNYIHIDNPLIYDLINTKEFQRLRRIKQVPTTAFTFHGAEHSRFSHCLGVYEIARRVTAIFEEKYADIWNKDESLVTMTAALLHDIGHGAYSHTFEVLFHTDHEAFTQEIITNPETEINAILVRHAPDFPDKVASVINHTYPNKQVVQLISSQIDCDRMDYLLRDSYFSAANYGQFDLMRILRVIRPVEDGIVFEHSGMHAVEDYIVSRFQMYMQVYFHPASRAVELILQNLLKRAQHLYPEQQAYFQKTAPGLIPFFEKKANLADYIALDDGVMNTYFQVWMASEDHILSDLASRFINRKILKSVTFDQDSQGELERLRQLVESVGFDPDYYTGIHINFDLPYDIYRPELENPRTQIEMMQKDGSLAELSQLSPIVKALTGTTYGDRRFYFPKEMLELDDLFAPSKETFMSYISNGHFHFSQ

SEQ ID NO: 5477 - DNA, 396 bp, Streptococcus agalactiae
gtgagagaagtcatgaaactagaaattaacaataacattcaaattgacaacgaaaccgaaatgattcatgagattcacgattgtcaatttattgaaaaaggaagttacgtttatttgaattatattaatgctgagggcgagagggtagttattaaggcaaatcatgaggaattgcttatgacgaggttttcaaatcctaagtctgtaatgcgttttcatcgtgaaacgcctgctttggttaatatccccactccacttggtgttcaacatttgattacagagacaagtcactatcagtttgatttgtcacagcaaaggttgcatatcaattatgtccttaagcaaacggagacaggagactgttttgcaaattatgaattaaggattcaatggtat

SEQ ID NO: 5478 - protein, 132 aa, Streptococcus agalactiae
MREVMKLEINNNIQIDNETEMIHEIHDCQFIEKGSYVYLNYINAEGERVVIKANHEELLMTRFSNPKSVMRFHRETPALVNIPTPLGVQHLITETSHYQFDLSQQRLHINYVLKQTETGDCFANYELRIQWY

SEQ ID NO: 5479 - DNA, 384 bp, Streptococcus pyogenes
atgaaattacagttaaccaaccatattcgctttggagatgagacagagattattcaagaaattcatgattgtgagtggcgagaaaaagggggctatcagtacctcatctatcaaaacactgacaaggaaaaggttgtcatcaagtacaatgagacagaactgaccatgagccgtttttccaaccctcagtcaatcatgaaattttttgcgggcaagaaggtcctgattgctctacctacgccgatgggggttcaacaatttttgacagataccagtcattaccacttagattgttcttgtcaaaaattggaccttcattatcatttgcttcaagctcaaacagaaatgctatttgcaagctatcatcttgagctgagttgggat

SEQ ID NO: 5480 - protein, 128 aa, Streptococcus pyogenes
MKLQLTNHIRFGDETEIIQEIHDCEWREKGGYQYLIYQNTDKEKVVIKYNETELTMSRFSNPQSIMKFFAGKKVLIALPTPMGVQQFLTDTSHYHLDCSCQKLDLHYHLLQAQTEMLFASYHLELSWD

SEQ ID NO: 5481 - DNA, 2682 bp, Streptococcus agalactiae
ttgttaaaagaacagaaaaaatccttgttttacacacaaggtcaagaagaggttctaacgtctttagaatcttctcgtgaaggattatcaacgacagaagcgaaaaatcgcttagagatgtatggtcgcaatgagcttgaagaagggaaaaaacgtagtctaatagctaagttttttgaccaattcaaagatttaatgattattatcttactggttgctgcagctctctctgttattacggaaggtatgcatggcttaacggatgcattgattatcttggcggttgttatcttaaatgcagcttttggtgtttatcaagaggggcaagccgaagcagctattgaagccctcaaagatatgtcaagcccaattgcgcgtgttcgtcgtgatggtcatactattgaggtggattctaaagaactagttcctggtgacctcgttatgttagaagcaggagatgttgttcccgcagatttacgacttttagaagccgcgtctctaaaaattgaagaagcagctctaactggtgagtcagtacctgttgagaaagacatatctcaagtagtagcagaggatgcaggtattggtgaccgtgtgaatatggcgtatcaaaattcaaatgtcacgtatggtcgaggatatggtgttgttactaacacagggatgtatactgaagttggtaaaattgcggacatgttggcaaatgctgatgaatctgaaacaccattgaaacaaagtttagttcaactttctaaattattgacttacttaatcgtgattattgcggttattactttcttagtggggatatttgtccgtaaagaaggttggattgaaggattgatgacttcagttgctttagcagttgcagctattccagaagggcttcctgcaattgttacgattgtcttatcaatgggaacaaaaactcttgctaaacgcaattctatcgttcgtaaactccctgcagttgaaactttaggttctacagaaatcattgcatcagataagactggaactctgacaatgaatcaaatgactgtcgaaaaagtgtatactaatggtgttctccaatcatcttcggaagaaatttcagttgataataacactttacgtattatgaatttctccaacgatactaagattgatccttcaggaaaattaattggtgacccaacagagactgcactggtacaatttggtttagataagaattttgatgtccgtgaagttttgaaaaatgaaccacgtgtagctgagttaccatttgattcagatcgtaagttaatgtctacgattcataaagaatcagatggtcgctactttatcgcagtcaagggtgctcctgatcaattattaaaacgagttactaaaattgaagataatggcttggttcgtgatatcacggctgaagataaagaggctatcctaaataccaataaagaactcgcaaaacaagctcttcgtgtcttgatgatggcttataaatatgaaacacaaattccaagtttagagactgatattgttgagtcagatttagtattctcaggtttagtgggaatgattgaccctgagcgtccagaagcggcagaagctgttcgagttgctaaagaagcaggaattcgtccgattatgattaccggggaccatcaagatactgcagaagctattgcaaagcgtctaggtattattgatgcaaatgacacagaagatcatgtctttacgggtgctgaacttaatgaattaagtgatgaagagtttcaaaaagtatttaaacaatattctgtctatgcacgtgtttctcctgaacataaagtgcgtatcgtgaaagcttggcaaaacgatggcaaagtcgttgccatgactggtgatggtgttaatgatgctccatcgctaaaaacagcagatattggtattggtatgggaataactggtacggaagtttccaaaggtgcttctgatatggtccttgctgatgataattttgcaactattattgtggctgttgaggaaggacgtaaagtcttctcaaatatccaaaaatctattcagtatcttctttcagccaacatggcagaggtatttacaattttctttgcaactttattaggatgggatgtacttgcaccggttcaccttctttggattaacttggtaacagatactcttccagccatcgctcttggagttgagccagctgaaccaggagttatgacacataaacctcgtggtcgccagtcaaacttctttgatggtggtgttatgggagctattatctatcaaggtattttacaaactatcttagtacttggtgtctatggttgggcattgatgtatccagaacatgctggttatcgcatgattcacgcagatgcccttacgatggcctttgcaacgcttggtttaatccaattggtacatgcatttaacgttaagtcagtttaccaatcaatctttacagttggagcttttaaaaatagaacctttaactggtctattccagtagctttcattcttttgatggtgactattgttgttcctggatttaataaacttttccatgtaactcatttaagttcaacacaatggttaactgtagttatcggaagtttattgatggtagtgttaacggaaattgttaaatttatccaacgtaaattaggacaagacgaaaaagctatt

SEQ ID NO: 5482 - protein, 894 aa, Streptococcus agalactiae
MLKEQKKSLFYTQGQEEVLTSLESSREGLSTTEAKNRLEMYGRNELEEGKKRSLIAKFFDQFKDLMIIILLVAAALSVITEGMHGLTDALIILAVVILNAAFGVYQEGQAEAAIEALKDMSSPIARVRRDGHTIEVDSKELVPGDLVMLEAGDVVPADLRLLEAASLKIEEAALTGESVPVEKDISQVVAEDAGIGDRVNMAYQNSNVTYGRGYGVVTNTGMYTEVGKIADMLANADESETPLKQSLVQLSKLLTYLIVIIAVITFLVGIFVRKEGWIEGLMTSVALAVAAIPEGLPAIVTIVLSMGTKTLAKRNSIVRKLPAVETLGSTEIIASDKTGTLTMNQMTVEKVYTNGVLQSSSEEISVDNNTLRIMNFSNDTKIDPSGKLIGDPTETALVQFGLDKNFDVREVLKNEPRVAELPFDSDRKLMSTIHKESDGRYFIAVKGAPDQLLKRVTKIEDNGLVRDITAEDKEAILNTNKELAKQALRVLMMAYKYETQIPSLETDIVESDLVFSGLVGMIDPERPEAAEAVRVAKEAGIRPIMITGDHQDTAEAIAKRLGIIDANDTEDHVFTGAELNELSDEEFQKVFKQYSVYARVSPEHKVRIVKAWQNDGKVVAMTGDGVNDAPSLKTADIGIGMGITGTEVSKGASDMVLADDNFATIIVAVEEGRKVFSNIQKSIQYLLSANMAEVFTIFFATLLGWDVLAPVHLLWINLVTDTLPAIALGVEPAEPGVMTHKPRGRQSNFFDGGVMGAIIYQGILQTILVLGVYGWALMYPEHAGYRMIHADALTMAFATLGLIQLVHAFNVKSVYQSIFTVGAFKNRTFNWSIPVAFILLMVTIVVPGFNKLFHVTHLSSTQWLTVVIGSLLMVVLTEIVKFIQRKLGQDEKAI

SEQ ID NO: 5483 - DNA, 858 bp, Streptococcus agalactiae
atgaccaaacttgctatcatgagtgatttacatattgacctcaatcatttttctacctttgagacgaaaacgttaattaatttgcttaagaaagaaaaaattgatcacctccatatcgctggagatatatctaatcattttactaaagatacacttccctttatcaataacttaaaaaagcatattaaacttagctataatttaggaaaccatgatatgcttgatttaacagaaacagaaatccaacgtcttgactttcaaacctatcgatttgacaaaaaaatgctactagcttttcatggctggtatgattacagcttttcaaataatagagacatcaaggatgttgaaaaattaaaaaagactttttggtttgatagacgtttaaaacgtccaaataatgatgtaactatccaagcatcaattttaaaacgcttagacgaaatattagcaaaagtcgattcttcaaatatcattattgctatgcactttgttccccataaacaattcacgatgactcatcctagattctctccttttaatgcttttttggggagtcaggcttatcatgatttattccaaaaatatcatatcaaagatgttgtttttggtcatgcacaccgctcatttggcgacgttaaaattggagagactacttatcattctagaccacttggatatattagagaatggaatttaactattgactttgtcaatcagaatcccaatcataaccctaatttaacctggaatcttagcaaaaggtataatgccgttaagcatttggatagttttgaaaactatcgaaaaaaatattttgaagacgaattacgcaactctatgacaatatttgattgc

SEQ ID NO: 5484 - protein, 286 aa, Streptococcus agalactiae
MTKLAIMSDLHIDLNHFSTFETKTLINLLKKEKIDHLHIAGDISNHFTKDTLPFINNLKKHIKLSYNLGNHDMLDLTETEIQRLDFQTYRFDKKMLLAFHGWYDYSFSNNRDIKDVEKLKKTFWFDRRLKRPNNDVTIQASILKRLDEILAKVDSSNIIIAMHFVPHKQFTMTHPRFSPFNAFLGSQAYHDLFQKYHIKDVVFGHAHRSFGDVKIGETTYHSRPLGYIREWNLTIDFVNQNPNHNPNLTWNLSKRYNAVKHLDSFENYRKKYFEDELRNSMTIFDC

SEQ ID NO: 5485 - DNA, 1929 bp, Streptococcus agalactiae
atgtctaatttttataagctcttgaaagaaaaatttcctcgaaaagaagatatcgtaacagaaatgatcaatttagaagctatttgtcaattacccaaagggacggagtattttattagtgatttacacggggaatacgatgctgttgattatctcttacggacaggtgcagggtctattagagctaaattattagactgttttgattggcagaaaatagttgctgttgatttagatgatttttgtatactgctttattacccaaaggaaaaattagccttcgataaaatgaacttgtcagcaagtgcttataaaacgaagttatgggaaatgattccgttacaaatacaagttttaaaatatttttctagtaaatatacaaaatctaaagtacgtaagcaattgtcaggtaagtttgcttacattatcgaagaacttttagctgagattgaccgtaacccagagaagaaaagctattttgatactattattgaaaaattatttgaattagaccaagtagaagatttaattatagtattgtcccaaacaattcaagttttgattattgaccatttacatgttgtaggggatatttacgatcgtggtaggtatcctgatcgtatcttgaataggttaatggcttttccaaatttggatatccaatgggggaaccatgatgtcacttggatgggagcagcatctggttcttacctttgtatggtaaatgttatccgtattgctgcacgttataataatattactttaattgaagaccgatatggtatcaatttgcgtcgcttggttgattactcacgccgttactatgaacctctaccttctttcgttcctatattagatggagaggaaatgactcatccagatgaactagacttgttaaatatgatacaacaagcaacagcaattttacagtttaaattggaagcccaattgattgacaggcgtccagaatttcaaatgcataatcggcaacttattaaccaggtaaattataaagatttaagtatatctattaaggaagttgtgcatcaacttaaagattttaatagtagatgcattgattcgaaaaatcccagtcgattaacaagtgaggaagaagagcttttacaacaattgatgatagccttccagacttctgaaagtttaaagaaacatattgatttcctatttgaaaaaggaagtatgtatttaacatataatgataatcttttattccatggttgcataccaatgcatagtaatggtgattttaaaagctttaaaattgcaggaaaaacttatggtggtagggatttactggatttatttgaaagtcaaatacgtctagcatatgctagaccagagaaacatgatgatttggcgacagatatcatttggtatctttggtgtggtgaaaattcttctctttttggtaagaatgccatgactacttttgagcgctattatgtttccgacaaagtaactcatcaagaaagaaaaaatccctactttaaactgagagataaagatgatatttgcactgctcttttacaagagtttgatttgcctaagtttgggcatattgtcaatggtcatacgccagtcaaagaaaaaaatggtgagcaaccgataaaagcaaatggtaagatgttagtaattgatggtggctttgccaaaggttatcagaaaaatacaggtttagctggctacactttgatttataatagctatgggatacaattaatttcacaccttccttttacatccattgaggaagttttaagtggaaccaactatatcattgatacgaagcgattagtagaagaagccaaggataggattcttgtaaaagatacaactattggacaaaagttaaccaaagagattaaagacttagatcacctttatcgtcattttcaggaatatgatgac

SEQ ID NO: 5486 - protein, 643 aa, Streptococcus agalactiae
MSNFYKLLKEKFPRKEDIVTEMINLEAICQLPKGTEYFISDLHGEYDAVDYLLRTGAGSIRAKLLDCFDWQKIVAVDLDDFCILLYYPKEKLAFDKMNLSASAYKTKLWEMIPLQIQVLKYFSSKYTKSKVRKQLSGKFAYIIEELLAEIDRNPEKKSYFDTIIEKLFELDQVEDLIIVLSQTIQVLIIDHLHVVGDIYDRGRYPDRILNRLMAFPNLDIQWGNHDVTWMGAASGSYLCMVNVIRIAARYNNITLIEDRYGINLRRLVDYSRRYYEPLPSFVPILDGEEMTHPDELDLLNMIQQATAILQFKLEAQLIDRRPEFQMHNRQLINQVNYKDLSISIKEVVHQLKDFNSRCIDSKNPSRLTSEEEELLQQLMIAFQTSESLKKHIDFLFEKGSMYLTYNDNLLFHGCIPMHSNGDFKSFKIAGKTYGGRDLLDLFESQIRLAYARPEKHDDLATDIIWYLWCGENSSLFGKNAMTTFERYYVSDKVTHQERKNPYFKLRDKDDICTALLQEFDLPKFGHIVNGHTPVKEKNGEQPIKANGKMLVIDGGFAKGYQKNTGLAGYTLIYNSYGIQLISHLPFTSIEEVLSGTNYIIDTKRLVEEAKDRILVKDTTIGQKLTKEIKDLDHLYRHFQEYDD

SEQ ID NO: 5487 - DNA, 1122 bp, Streptococcus agalactiae
atggacataaaggcagaaattcaaaaattagcaaaagaaattggtatctctaaaattggttttacgacggcagataactttgattatttggaaaagtcattgcgtgcttctgtggaagaggggcgcaattcaggatttgaacataaagtcatagaggatcgtatctaccctgaaaggcttttagaatcggctaaaacgattatttcaattggcgttgcttatcctcacaaacttcctcagcaacctcaaaaaacatcttataaacgaggaaaaattacacctaattcgtgggggcttgattatcattatgtggtcggcgaaaagttagacagactatcaaaaggcattgaagagctctgtcgagattttcctttgcaacaaaaagcaatggtcgatactggagctttagttgatactgcagttgcccaaagagcaggtattggttttataggaaaaaatggtctagttatttctaaagaatatggctcttatatgtttttgggagaattaattaccaatttagagatcgagccagacaagcctgtcgattatgattgtggtgactgtcgtcgttgtctagatgcctgtccaacttcttgtttaattggtgatggctcaatgaatgccaagcgttgtctatcatttcaaacccaagataagggaatgatggacatagagtttcgaaaaaagattaaaacagttatctatggttgtgatatttgccaaatttgctgtccttataacaaaggtataaataatccattggcgacagagattgatcctgagttggctcaaccagaattaataccatttttgagtttatcaaatggacaatttaaagaaaaatttggtatgattgctggaagttggcgaggtaaaaatattttacagcgtaatgccattattgcgctagcaaatgctcatgataaaaccgcagtggtcaaattaatagagattattgataaaaataataaccctattcatactgcaacagctatatgggcattgggagaaattgtcaaaaaaccaaacgatgagatactggagtttatgagtaatttaaccttaaaagatgaagatagccgaaaagagttggaattaatccgtcataaatggcaattt

SEQ ID NO: 5488 - protein, 374 aa, Streptococcus agalactiae
MDIKAEIQKLAKEIGISKIGFTTADNFDYLEKSLRASVEEGRNSGFEHKVIEDRIYPERLLESAKTIISIGVAYPHKLPQQPQKTSYKRGKITPNSWGLDYHYVVGEKLDRLSKGIEELCRDFPLQQKAMVDTGALVDTAVAQRAGIGFIGKNGLVISKEYGSYMFLGELITNLEIEPDKPVDYDCGDCRRCLDACPTSCLIGDGSMNAKRCLSFQTQDKGMMDIEFRKKIKTVIYGCDICQICCPYNKGINNPLATEIDPELAQPELIPFLSLSNGQFKEKFGMIAGSWRGKNILQRNAIIALANAHDKTAVVKLIEIIDKNNNPIHTATAIWALGEIVKKPNDEILEFMSNLTLKDEDSRKELELIRHKWQF

SEQ ID NO: 5489 - DNA, 1173 bp, Streptococcus pyogenes
ttgtccttctttttccttgaagtcttaacttattttgattatgatagtagtatgactattaaggcagaaattaaggcgctcgccaaagaaattggtatctctaaaattggttttacgacggcagataactttgattatttggaaaagtcattgcgtgcttctgtggaagaggggcgcaattcaggatttgaacataaagtcatagaggatcgtatctacactgaaaggcttttagaatcggctaaaacgattatttcaattggcgttgcttatcctcacaaacttcctcagcaacctcaaaaaacaccttataaacgtggaaaaattacacctagttcgtgggggcttgattatcattatgtggtcggcgaaaagttagacagactatcaaaaggcattgaagagctgtgtcgagattttcctttgcaacaaaaagcaatggtcgatactggagctttagttgatactgcagttgcccaaagagcgggtattggttttataggaaaaaatggtctagttatttctaaagaatatggctcttatatgtttttgggagaattaattaccaatttagagatcgagccagacaagcctgtcgattatgattgtggtgactgtcgtcgttgtctagatgcctgtccaacttcttgtttaattggtgatggctcaatgaatgccaagcgttgtctatcatttcaaacccaagataagggaatgatggacatagagtttcgaaaaaagattaaaacagttatctatggttgtgatatttgccaaatttgctgtccttataacaagggtataaacaattcaccagctacagagattgatcctgagttggctcaaccagaattaataccatttttgagtttatcaaatggaaaatttaaagaaaaatttggtatgattgctggaagttggcgaggtaaaaatattttacagcgtaatgccattattgcgctagcaaatgctcatgataaaactgcagtggtcaaattaatagagattattgataaaaataataaccctattcatactgcaacagctatatgggcattgggagaaattgtcaaaaaaccaaacgatgagatactggcgtttatgagtcatttaaccttaaaagatgaagatagccgaaaagagttggaattaatccgtcataaatggcaattt

SEQ ID NO: 5490 - protein, 391 aa, Streptococcus pyogenes
LSFFFLEVLTYFDYDSSMTIKAEIKALAKEIGISKIGFTTADNFDYLEKSLRASVEEGRNSGFEHKVIEDRIYTERLLESAKTIISIGVAYPHKLPQQPQKTPYKRGKITPSSWGLDYHYVVGEKLDRLSKGIEELCRDFPLQQKAMVDTGALVDTAVAQRAGIGFIGKNGLVISKEYGSYMFLGELITNLEIEPDKPVDYDCGDCRRCLDACPTSCLIGDGSMNAKRCLSFQTQDKGMMDIEFRKKIKTVIYGCDICQICCPYNKGINNSPATEIDPELAQPELIPFLSLSNGKFKEKFGMIAGSWRGKNILQRNAIIALANAHDKTAVVKLIEIIDKNNNPIHTATAIWALGEIVKKPNDEILAFMSHLTLKDEDSRKELELIRHKWQF

SEQ ID NO: 5491 - DNA, 1011 bp, Streptococcus agalactiae
ttggaagaggagattgctcttcttgaaaatcaaatgactgagccagacttttggaatgacaatattgcagcgcaaaagacatctcaagaactgaatgagttaaaaggtaagtatgatactttccataatatgcaagaattatctgacgaaacagaactcttacttgagatgcttgacgaagatgattctttgaaagaagaattagaagaaaatctaatgcagctagataagataatgggtgcttatgaaatgacgcttctcttatctgagccttatgaccacaataatgctatcttagaaatccatcctggttcaggaggaactgaagcgcaagattggggagatttactcttacgaatgtatacccgttttggcaatgctaatggtttcaaagtagaagtattagattatcaagcaggggatgaagctggtattaaatcggttaccctctcttttgaaggccccaatgcttatggtttgttgaaatcagaaatgggagttcatcgcctcgttcgtatatcaccttttgattcggctaaacgtcgtcatacctcatttgcttcagttgaagtgatgccagagttagatgatacgattgaagtagaagtacgtgatgatgacattaaaatggatactttccgttccggaggagctggtggtcagaacgtcaataaagtatcaacaggtgttcgtttgacgcatattccaactggaattgtggtatcgtctaccgttgaccgtactcaatatgggaaccgcgatcgcgctatgaagatgttgcaggctaagctatatcagttagaacaagaaaagaaagcacaagaagtagatgctcttaagggtgataaaaaagaaatcacttggggaagtcagattcgttcttatgttttcaccccttatacgatggtgaaggatcatcgtactaactttgagcttgctcaggtagataaggttatggatggagaaatcaatggctttattgatgcctaccttaagtggcgcattgaagac

SEQ ID NO: 5492 - protein, 337 aa, Streptococcus agalactiae
MEEEIALLENQMTEPDFWNDNIAAQKTSQELNELKGKYDTFHNMQELSDETELLLEMLDEDDSLKEELEENLMQLDKIMGAYEMTLLLSEPYDHNNAILEIHPGSGGTEAQDWGDLLLRMYTRFGNANGFKVEVLDYQAGDEAGIKSVTLSFEGPNAYGLLKSEMGVHRLVRISPFDSAKRRHTSFASVEVMPELDDTIEVEVRDDDIKMDTFRSGGAGGQNVNKVSTGVRLTHIPTGIVVSSTVDRTQYGNRDRAMKMLQAKLYQLEQEKKAQEVDALKGDKKEITWGSQIRSYVFTPYTMVKDHRTNFELAQVDKVMDGEINGFIDAYLKWRIED

SEQ ID NO: 5493 - DNA, 1011 bp, Streptococcus pyogenes
ttggaagaggagattgctcttcttgaaaatcacatgactgagccagacttttggaatgacaatattgcagcgcaaaagacatctcaagaactaaatgagttaaaaggtaagtatgatactttccataatatgcaagaattatctgacgaaacagaactcttacttgagatgcttgacgaagatgattctttgaaagaagaattagaagaaaatctaatgcagctagataagataatgggtgcttatgaaatgacgcttctcttatctgaaccctatgaccacaataatgctatcttagaaatccatcctggttcaggaggaactgaagcgcaagattggggagatttactcttacgaatgtatacccgttttggcaatgctaatggtttcaaaatagaagtattggattatcaagcaggagatgaagctggtattaaatcggttaccctctcttttgaaggccccaatgcttatggtttgttgaaatcagaaatgggagttcatcgcctcgttcgtatatcaccttttgattcggctaaacgtcgtcatacctcatttgcttcagttgaagtgatgccagagttagatgatacgattgaagtagaagtacgtgatgatgacattaaaatggatactttccgttccggaggagctggtggtcagaatgtcaataaagtatcaacaggtgttcgtttgacgcatattccaactggaattgtggtatcgtctaccgttgaccgtactcaatatggaaaccgcgatcgcgctatgaagatgttgcaggctaagctatatcagttagaacaagaaaagaaagcacaagaagtagatgctctcaagggtgataaaaaagaaatcacttggggaagtcagattcgttcttatgttttcaccccttatacgatggtgaaggatcatcgtactaactttgagcttgctcaggtagataaggttatggatggagagatcaatggctttattgatgcctaccttaagtggcgcattgaagac

SEQ ID NO: 5494 - protein, 337 aa, Streptococcus pyogenes
LEEEIALLENHMTEPDFWNDNIAAQKTSQELNELKGKYDTFHNMQELSDETELLLEMLDEDDSLKEELEENLMQLDKIMGAYEMTLLLSEPYDHNNAILEIHPGSGGTEAQDWGDLLLRMYTRFGNANGFKIEVLDYQAGDEAGIKSVTLSFEGPNAYGLLKSEMGVHRLVRISPFDSAKRRHTSFASVEVMPELDDTIEVEVRDDDIKMDTFRSGGAGGQNVNKVSTGVRLTHIPTGIVVSSTVDRTQYGNRDRAMKMLQAKLYQLEQEKKAQEVDALKGDKKEITWGSQIRSYVFTPYTMVKDHRTNFELAQVDKVMDGEINGFIDAYLKWRIED

SEQ ID NO: 5495 - DNA, 690 bp, Streptococcus agalactiae
atggcactaatagaaatgtctggtgttactaaaaagtatcgccgttcaacaactgccttgagaaacttaaatttatcaattcagcaaggtgagtttgtgtatttagttggtccgtcaggtgctggtaaatctagcttgattcgcctcctataccgtgaagaaaaattaagttcaggtagattaaaggtaggggaattcaatctcaataaactcaaacgtcgtcaaattcctattttacgtcgtagtattggagttgtcttccaagattataaattactaccaacaaaaacagtttatgagaatgttgcgtttgcgatgcaagttattggagctaagcgccgtcatattaaaaaacgcgtgccagaagttctagaattagtaggtttaaaacacaagatgcgttcttttccaacacagttatctggtggagaacaacaacgtgtggcaattgcacgtgcgattgttaataatccaaaattattaattgcagatgaacctactggtaatttggatccagaaattgcttgggaaatcatgcatctattggaacgtattaaccttcaaggaacgactgttttgatggcaacacacaatagtcaaattgttaacacacttcgtcatcgtgtcattgagattgaagcaggtagcgttatccgagatgaagagaagggagaatatggttatcatgat

SEQ ID NO: 5496 - protein, 230 aa, Streptococcus agalactiae
MALIEMSGVTKKYRRSTTALRNLNLSIQQGEFVYLVGPSGAGKSSLIRLLYREEKLSSGRLKVGEFNLNKLKRRQIPILRRSIGVVFQDYKLLPTKTVYENVAFAMQVIGAKRRHIKKRVPEVLELVGLKHKMRSFPTQLSGGEQQRVAIARAIVNNPKLLIADEPTGNLDPEIAWEIMHLLERINLQGTTVLMATHNSQIVNTLRHRVIEIEAGSVIRDEEKGEYGYHD

SEQ ID NO: 5497 - DNA, 690 bp, Streptococcus pyogenes
atggcactaatagaaatgtctggtgttactaaaaaataccgccgctcaacgaccgccctcagagacgtcaatgtttctgttaaccaaggtgagtttgtttatctcgtaggcccatcaggtgctggtaaatcaacttttatcaaactcctttaccgtgaagaacaactgacaactggtaagctatatgtgggtgaattcaatttaactaagctaaaagcacgtgatgttccgattcttcgtcgtcacatcggagtagtttttcaagattacaaactgctaccaagaaaaacagtctttgaaaatgtagcttacgccatggaagttattggtgaaaagcgccgccacattaaaaaacgcgtgccagaggtactcgatttagttggcttgaaacataagatgcgttcttttccaagtcagctatcaggaggggagcagcaacgtgtggccattgcgcgtgcgattgttaacaaccctaaattattgattgcagatgaaccgacagggaatttagatcctgagatttcatgggaaattatgcagttacttgaacgtattaatgttcagggaacaactatcttaatggcgacacacaacagtcatattgtgaatacattccgtcatcgtgttgttgctattgaagatggtcgcatagtacgtgatgaagaaaaaggagattatggttacgatgat

SEQ ID NO: 5498 - protein, 230 aa, Streptococcus pyogenes
MALIEMSGVTKKYRRSTTALRDVNVSVNQGEFVYLVGPSGAGKSTFIKLLYREEQLTTGKLYVGEFNLTKLKARDVPILRRHIGVVFQDYKLLPRKTVFENVAYAMEVIGEKRRHIKKRVPEVLDLVGLKHKMRSFPSQLSGGEQQRVAIARAIVNNPKLLIADEPTGNLDPEISWEIMQLLERINVQGTTILMATHNSHIVNTFRHRVVAIEDGRIVRDEEKGDYGYDD

SEQ ID NO: 5499 - DNA, 981 bp, Streptococcus agalactiae
gtgtcattgagattgaagcaggtagcgttatccgagatgaagagaagggagaatatggttatcatgattaatttctttagacatttctgggaatcgcttaaaaacttgaaacgtaacttttggatgacttttgcttctgtaacatcagttaccataaccttacttcttgtaggcttgttttcatcagttttactgaatgttgaaaagttaacaactgatgtttcaggtaattttactatcagtgcctttttaaatgttgactcaacggatgctcaaaaacaagtcaaagataaggacggaaagctaaaagataatcctgattatcataaagtttacgacaaaattaaacgtatttctggtgtagagaaagtcacttattcaagtaaagctgaacaattaaaagaagttcaaaaagagtatggttcagatgttattgatgatacctataaagatgctttgttagatgtttacgtagttgggacaagttctgcaaaagtttctaagagtgtcagtgaagcaattggacgcattgaaggtgttgattatactaaagaacctattgattcaacaaaactatctaatctcacagataacatccgtatatggggatttggtggtgttgccttattaattgtccttgctatctttttgatttcaaatactattcgtatgtcgattatgtcacgccgtacagatattgaaatcatgagattagttggcgctaaaaattcttatattcgaggaccgttcttttttgaaggtgcttgggtagggattttaggggctatcgttccatcgctgattttctattttggttatcaatttgtgtttaacaagtttaatccaaaatttgagacaagccatgtttcattgtatcctatggatattatggttccagcaattattggtggtatggtgattattggtattattattggctcacttgggtctgtcctatcaatgagacgttaccttaagatt

SEQ ID NO: 5500 - protein, 327 aa, Streptococcus agalactiae
MSLRLKQVALSEMKRRENMVIMINFFRHFWESLKNLKRNFWMTFASVTSVTITLLLVGLFSSVLLNVEKLTTDVSGNFTISAFLNVDSTDAQKQVKDKDGKLKDNPDYHKVYDKIKRISGVEKVTYSSKAEQLKEVQKEYGSDVIDDTYKDALLDVYVVGTSSAKVSKSVSEAIGRIEGVDYTKEPIDSTKLSNLTDNIRIWGFGGVALLIVLAIFLISNTIRMSIMSRRTDIEIMRLVGAKNSYIRGPFFFEGAWVGILGAIVPSLIFYFGYQFVFNKFNPKFETSHVSLYPMDIMVPAIIGGMVIIGIIIGSLGSVLSMRRYLKI

SEQ ID NO: 5501 - DNA, 957 bp, Streptococcus pyogenes
gtgatgaagaaaaaggagattatggttacgatgattagatactttttccgtcatatttgggaatccattaaaaatcttaaacgcaacttttggatgacatttgcttcagttagtatggtggctgttacattgactttagttggtgtttttgcggcgacattgttgaatatacagcgtgttgcttcgggtgttgaaaataatgtccatatcaatacctacttacaagttgattcaactgatgctgcaaaagttattcaaaatactgccggtgaacctgttaataacgataactaccacagtgtttacgacaaaattgctcagataaaaggtgtcaaaaagattacattttctagcaaggatgaacaattgaaaaaattgcaagaaaccttaggtgatgtttggaatatgtatgaccaagacactaatccgctccaagatatctatcttattgagacccagacgcctaaacaagttaaggcgatcactaaaaagatcagaacgattgaaggcgtagaagccgcagattatggagggattaactccgataaactatttaagttttcaacattaattcaaacttgggggctgatcggaacagcaatgctattatttgtagctgtctttctcatttcaaacactattcgtatgactattatgtctcgtaaacgtgacattgaaattatgcggttagttggtgctaaaaattcttatattcgagggcctttcttttttgaaggggcttgggttggcttgttaggagctgttttaccatctcttctgatttattatggatatgatcttgtttataagcattttgcacaagaattacaacgtaataatctctcgatgtatccgcttgatccttatgtatattacctgattggtgctttgtttgtcataggtattatgattggttcgcttggttcagtgctttctatgagacgttatttaaaattc

SEQ ID NO: 5502 - protein, 319 aa, Streptococcus pyogenes
VMKKKEIMVTMIRYFFRHIWESIKNLKRNFWMTFASVSMVAVTLTLVGVFAATLLNIQRVASGVENNVHINTYLQVDSTDAAKVIQNTAGEPVNNDNYHSVYDKIAQIKGVKKITFSSKDEQLKKLQETLGDVWNMYDQDTNPLQDIYLIETQTPKQVKAITKKIRTIEGVEAADYGGINSDKLFKFSTLIQTWGLIGTAMLLFVAVFLISNTIRMTIMSRKRDIEIMRLVGAKNSYIRGPFFFEGAWVGLLGAVLPSLLIYYGYDLVYKHFAQELQRNNLSMYPLDPYVYYLIGALFVIGIMIGSLGSVLSMRRYLKF

SEQ ID NO: 5503 - DNA, 708 bp, Streptococcus agalactiae
atgaacataaaacgtcactctatttttctttggttaacaacaagtatccttgctattttaatggccgtcgggatgaccatttacttcaatacttaccaagcctccccattagctaggagaattgctaaaaccgctacaaaccataagaactaccttctttttagaagcaagggtaaggtaaaagcaaatattattttctatcaaggggctcttgtggaagaagaagcttattctcaacttgctagagatttagctgacaaaggggataatacctatattttgaagacacctttaaatttgccagttttatcgcctcataaagctaaaacaattattaatcagaaccacttaactaatgtttaccttgctggacattctttaggaggagttgttgctagccaaaatgccaaagtagcccctgttagagggctcatattattagcttcctacccttcacgtaaatccgacctatctcataaaaatttaagagtactctccattacagcaagtaatgatcatattttaaactgggaaaaatatgaggaagctaaaaaacgcctcccaaattcaagtacttttcgaactattgtcggaggaaaccatagccgatttggtaactacggacatcaaaaaggggatggtaaagctaccctttctcacaaatcatctgaaaaacaattggctacgtttatttcgaattttatccac

SEQ ID NO: 5504 - protein, 236 aa, Streptococcus agalactiae
MNIKRHSIFLWLTTSILAILMAVGMTIYFNTYQASPLARRIAKTATNHKNYLLFRSKGKVKANIIFYQGALVEEEAYSQLARDLADKGDNTYILKTPLNLPVLSPHKAKTIINQNHLTNVYLAGHSLGGVVASQNAKVAPVRGLILLASYPSRKSDLSHKNLRVLSITASNDHILNWEKYEEAKKRLPNSSTFRTIVGGNHSRFGNYGHQKGDGKATLSHKSSEKQLATFISNFIH

SEQ ID NO: 5505 - DNA, 696 bp, Streptococcus agalactiae
ttgccatttattttccgccactctttttttaacaaagtcttgattttttggtacactatcattatgaaaatctataaaacaataaaccacattgctggtgaaaatacttattacctcgttaatgatcaagctgttatcctcattgatccagggagcaatggccaagaaattattgctaaaattaaatcctttgaaaaacctttagtggctatcctcttaactcatactcactatgatcatatttttagtttagatttggtcagagatacttttgataatccacctgtttatgtttcagaaaaagaagccgcttggctatcttccccagatgataatttatctgggttaggccgtcatgatgatatcattaatgttatagcaagaccggcagagaacttttttaaattaaagcaaccctatcaactaaatggttttgaattcacagttttaccaacacctggtcattcttggggaggagtctcgtttgttttccactcagatgaattagtcgttactggcgatgctctatttcgtgaaactatcggtcgtactgacttacctaccagtaactttgaggacctcattactggtattcgtcaagaactattcaccttacctagtcattatagtgttcacccaggccatggcatgaatacaactattggccacgaaaaaaactttaatcctttcttccaa

SEQ ID NO: 5506 - protein, 232 aa, Streptococcus agalactiae
MPFIFRHSFFNKVLIFWYTIIMKIYKTINHIAGENTYYLVNDQAVILIDPGSNGQEIIAKIKSFEKPLVAILLTHTHYDHIFSLDLVRDTFDNPPVYVSEKEAAWLSSPDDNLSGLGRHDDIINVIARPAENFFKLKQPYQLNGFEFTVLPTPGHSWGGVSFVFHSDELVVTGDALFRETIGRTDLPTSNFEDLITGIRQELFTLPSHYSVHPGHGMNTTIGHEKNFNPFFQ

SEQ ID NO: 5507 - DNA, 696 bp, Streptococcus pyogenes
ttgccatttattttccgctactctttttttaacaaagtcttgattttttggtacactatccttatgaaaatctataaaacaataaaccacattgctggtgaaaatacttattacctcgttaatgatcaagctgttatcctcattgatccaggaagtaacggccaagaaatcattgctaaaattaaatcctttgaaaaacctttagtggctatcctcttaacgcatactcactatgatcatatttttagtttagatttggtcagagatgcttttgatcatccacctgtttatgtttcagaaaaagaagccgcttggctatcttccccagatgataatttatcgggcttaggccgtcatgatgatatcattactgttatagcaagaccggcagagaacttttttaaattaaagcaaccctatcaactaaatggttttgaattcacagttttaccaacatctggtcattcttggggaggagtctcatttgttttccactcagatgaattagtcgttactggcgatgctctatttcgtgaaactatcggtcgtactgacttacctaccagtaactttgaggacctcattactggtattcgccaagaactattcaccttacctaatcattaccgagtttatcctgggcatggtccttctactaccatttgtcacgaaaaaaatgctaaccccttttttcat

SEQ ID NO: 5508 - protein, 232 aa, Streptococcus pyogenes
LPFIFRYSFFNKVLIFWYTILMKIYKTINHIAGENTYYLVNDQAVILIDPGSNGQEIIAKIKSFEKPLVAILLTHTHYDHIFSLDLVRDAFDHPPVYVSEKEAAWLSSPDDNLSGLGRHDDIITVIARPAENFFKLKQPYQLNGFEFTVLPTSGHSWGGVSFVFHSDELVVTGDALFRETIGRTDLPTSNFEDLITGIRQELFTLPNHYRVYPGHGPSTTICHEKNANPFFH

SEQ ID NO: 5509 - DNA, 789 bp, Streptococcus agalactiae
ttgactaaagaatatgaggtggaagatatgtcaaaagttgctattgttactggtgctggtcaaggaattggatttgctattgcgaaacgtcttcatgcagacggctttaaaataggcgttttagactataatgaagagactgctcaggctgcggttgataaactatcacctgaggatgctgttgcagttgtagcagatgtttcaaaacgtgatcaagtttttgatgctttccaaaaagttgtagatacttttggtgatttgaatgttgttgttaacaatgcaggtgttgccccaacaactcctcttgacactattactgaagagcagtttgaaaaggcttttgcaatcaatgtcggaggaactatttggggaagccaagcagctcagaaacattttagagaattaggtcatggcggaaaaattataaatgcaacttcacaagcaggatgtgaagggaatcctaatttgactgtttatggtggtacaaaatttgcagttcgtggtattacacagactttggcaaaagatttagcatcagaaggaatcacagtcaatgcttacgcaccaggtattgttaaaacacctatgatgtttgatattgcccatgaagttggtaagaatgcaggcaaagatgatgaatggggtatggagcagtttgccaaagatatcactttgaaacgcttgtctgaaccagaagatgttgctaatgcagtaggcttcttagcgggagatgattcaaattatatcactggacaaacaatagttgtcgatgggggtatggtattccat

SEQ ID NO: 5510 - protein, 263 aa, Streptococcus agalactiae
MTKEYEVEDMSKVAIVTGAGQGIGFAIAKRLHADGFKIGVLDYNEETAQAAVDKLSPEDAVAVVADVSKRDQVFDAFQKVVDTFGDLNVVVNNAGVAPTTPLDTITEEQFEKAFAINVGGTIWGSQAAQKHFRELGHGGKIINATSQAGCEGNPNLTVYGGTKFAVRGITQTLAKDLASEGITVNAYAPGIVKTPMMFDIAHEVGKNAGKDDEWGMEQFAKDITLKRLSEPEDVANAVGFLAGDDSNYITGQTIVVDGGMVFH

SEQ ID NO: 5511 - DNA, 639 bp, Streptococcus pyogenes
ttgactaaaaaatatgaggtggaagatatgtcaaaagttgctattgttactggtgctggtcaaggaattggatttgctattgcgaaacgtcttcatgcagacggctttaaaataggcattttagactataatgaagagactgctcaggctgcggttgataaactatcacctgaggatgctgttgcagttgtagcagatgtttcaaaacgtgaccaagtttttgatgctttccaaaaagttgtagatacttttggtgatttgaatgttgttgttaacaatgcaggcgttgccccaacaacccctcttgacacgattactgaagagcagtttgaaaaggcttttgcaatcaatgtcggaggaacgatttggggaagccaagcagctcaaaaacattttagagaattaggtcatggcggaaaaattataaatgcaacatcacaagcaggatgtgaaggaaatcctaatttgactgtttatggtggtacaaaatttgcagttcgtggtattacacagactttggcaaaggatttggcatcagaaggaatcacagtcaatgcttacgcaccaggtattgttaagacacctatgatgtttgctattgcccatgaagttggtaaaaatgcaggcaaagatgatgaa

SEQ ID NO: 5512 - protein, 213 aa, Streptococcus pyogenes
LTKKYEVEDMSKVAIVTGAGQGIGFAIAKRLHADGFKIGILDYNEETAQAAVDKLSPEDAVAVVADVSKRDQVFDAFQKVVDTFGDLNVVVNNAGVAPTTPLDTITEEQFEKAFAINVGGTIWGSQAAQKHFRELGHGGKIINATSQAGCEGNPNLTVYGGTKFAVRGITQTLAKDLASEGITVNAYAPGIVKTPMMFAIAHEVGKNAGKDDE

SEQ ID NO: 5513 - DNA, 2505 bp, Streptococcus agalactiae
atgttttgttttatagatatagcgtgctataatagacttactatgacccagaaaaaacttagaaaatatgcagtagttgacttggaggctactggagcaggtcccaatgcttctattattcaggttgggattgttattatccaaggaaataaaattattgatagttatgaaacagatgttaatcctcatgaatctttggatgagcatattgttcatttgacaggtattacggataagcagttggctaaagctccggattttggtcaagtggcgcatcacatttatcaattgattgaagattgtatttttgttgcccacaatgtaaagttcgatgcaaatttattggctgagcaactatttttagaaggctgcgagttacgtacaccaaggatagatacagtagaattatcacaagtattttatccctgtttagaaaaatattctttaggggcattagcagaaagcttaaatattgaattaacagatgcgcacactgctattgcagatgcaagagctacagcacagttattcattaagttaaaagctaaaattagtagtttacctaaagaagtgttggagaccattttaacatttgctgataatcttttgttcgaatcctatttattgattgaagaagcttatcaagaagctgatttcgttaatcctaaagaatattatttctggcaaggattggtcttaaaaaaagaaaaagctgttggaaagcctaagaaattatctagtgattttcaagttaacatggctttgttaggtatggatgctcgccctaagcaagttgtttttgctgacttggttaaagcgcattttaatgatcaaacaacaacgtttttagaagctcaaccaggacttggtaaaacatatggttatctcttgcctttattggatcagtctcaaaaacaacaaataatagtatctgttccaacaaagattttgcaagatcaaataatggctaaagaaataaagcacattcaagaactttttcatattccctgtcacagtatcaaaggaccgagaaattacttgaagttagatgcgttttataagagcctccaagtgcaggatcgaaatcgattgataaatcgttttaaaatgcaactgctagtgtggttgacggaaacgactacaggtgatttggatgaaattaaacaaaaacaacgattagaatcttactttgaccagctaaaacacgatggagaagtgactcaatcatcacttttttatgatctggatttttggaaacgcagttatgataaagttgcacaaagtcaacttgttattatcaatcatgcttattttcttgagcgtgttcaggatgacaaagattttgcaaaggggaaggttttagtttttgatgaagctcagaaacttgttttgggactggaaaatttttctcgtgggcaacttgatattagtcaccaattgcaggttattcaaaaaataattgatagttctattccattattacaaaagcgccttctggaaagtatctcttatgagctaagtcatgcagtagaacttttttatcgtcataattcttttgaattttcagagacctggttgaaacgtctaaaaaatagtataaacgctttagaagtagtaggattagatgagttacaaacttttttcacagctacttatactaactattggtttgaaactgacaaagtcaatgagaagcgtttaaccattttacgtggggcgagagaagattttcttaaattttcaaagttcctcccccccacaaaaaagacctatatgatatcagcgactttacaaatcagtcccaaagtctacttgtcagatcttttaggaggattttcaagtataagtacagaaaagatagcgcatgagaaaaatgccaatcagaaagtatggattgatacctctatgcccaatatacttgatttatcaccggaacagtatgcttacgaaatagccaagcgtttacaagatataatgacgttaaagcagcctaccttagtcttattaacttctaaacagacaatgtttatggtatctgattatttggataagtgggagataaaacatcttactcaagataaaaatggcttagcttataacgttaaaaaacgttttgatcgtggagaaagcaatcttcttttaggtacaggatctttttgggaaggtgttgactttgtacatcgtgatcgtcttattgaagttatcacgcgattgccttttgatactcccaaagactattttatccagaaactatcgcagagtttaacaaaagaggggaaaaacttcttttatgactattctttaccaatgactgtcttaaaattaaaacaggccttgggacgtactacaaggagagaagaacaaaagtcagcggtaattattttggatagcagattggttattaaatcttatggacaaaccatcatgcattctcttggtagagattttgaaatttctaaggaaaaaattaacaaggtcttgactgaaatggctaaatttttgata

SEQ ID NO: 5514 - protein, 835 aa, Streptococcus agalactiae
MFCFIDIACYNRLTMTQKKLRKYAVVDLEATGAGPNASIIQVGIVIIQGNKIIDSYETDVNPHESLDEHIVHLTGITDKQLAKAPDFGQVAHHIYQLIEDCIFVAHNVKFDANLLAEQLFLEGCELRTPRIDTVELSQVFYPCLEKYSLGALAESLNIELTDAHTAIADARATAQLFIKLKAKISSLPKEVLETILTFADNLLFESYLLIEEAYQEADFVNPKEYYFWQGLVLKKEKAVGKPKKLSSDFQVNMALLGMDARPKQVVFADLVKAHFNDQTTTFLEAQPGLGKTYGYLLPLLDQSQKQQIIVSVPTKILQDQIMAKEIKHIQELFHIPCHSIKGPRNYLKLDAFYKSLQVQDRNRLINRFKMQLLVWLTETTTGDLDEIKQKQRLESYFDQLKHDGEVTQSSLFYDLDFWKRSYDKVAQSQLVIINHAYFLERVQDDKDFAKGKVLVFDEAQKLVLGLENFSRGQLDISHQLQVIQKIIDSSIPLLQKRLLESISYELSHAVELFYRHNSFEFSETWLKRLKNSINALEVVGLDELQTFFTATYTNYWFETDKVNEKRLTILRGAREDFLKFSKFLPPTKKTYMISATLQISPKVYLSDLLGGFSSISTEKIAHEKNANQKVWIDTSMPNILDLSPEQYAYEIAKRLQDIMTLKQPTLVLLTSKQTMFMVSDYLDKWEIKHLTQDKNGLAYNVKKRFDRGESNLLLGTGSFWEGVDFVHRDRLIEVITRLPFDTPKDYFIQKLSQSLTKEGKNFFYDYSLPMTVLKLKQALGRTTRREEQKSAVIILDSRLVIKSYGQTIMHSLGRDFEISKEKINKVLTEMAKFLI

SEQ ID NO: 5515 - DNA, 2499 bp, Streptococcus pyogenes
atgttttgttttatagatatagcgtgctataatagacttactatgacccagaaaaaacttagaaaatatgcagtagttgacttggaggctactggagcaggtcccaatgcttctattattcaggttgggattgttattatccaaggaaataaaattattgatagttatgaaacagatgttaatcctcatgaatctttggatgagcatattgttcatttgacaggtattacggataagcagttggctaaagctccggattttggtcaagtggcgcatcacatttatcaattgattgaagattgtatttttgttgcccacaatgtaaagttcgatgcaaatttattggcagaagctctttttttagaaggatatgagttaacaataccacgtgttgatactgttgaattagcccaactatttttccctcgctttgaaaagtataaccttagtcacctatctaggcagctcaatattgatttggcagaagctcatactgctattgcagatgcaagagctacagctatactgtttttaagacttttacaaaaaattgagagccttccaattgagtgcttagaaagcttattagtctattcagatagcctgctatttgaaacagcaatggtcattcaagaaggattagccaaagccaaaccttatgatcccaacaaatacattaaaatcagacagattctcttaccaaagggctcaaaagctctcaagccttatcaaatatcaaaaagcttccctattaatatggcactattaggtctggaagaaaggcctaaacagactcaatttgctcagttaattgacgaagattaccatcagggagtagctagttttattgaagctcagacaggtattggaaaaacctacggctacctgctaccccttttggcaaaagaagatcaaaaccaaatcattgtcagtgtgcccaccaaacttcttcaagaccaattaatggctggtgaagtagctgctattcaagaacaatttcacatcgcctgccatagtttaaaagggcccgccaattacctaaagctagatagctttgcagatagtttggaccaaaatgaccagaaccgtttggtgaatcgttataaaatgcaattattggtttggctcttagaaactaagacaggagaccttgacgaaatcaaacaaaagcagcgctttgcagcttattttgagcagcttaagcacgatggagacattaagcagtcttctgaattttacgattacgatttttggagagttagttatgaaaaagccaaaacagcccgtctcctgattaccaaccatgcttattttttacaccgtgttcaagatgacaaggactttgctagaaacaaggtcttggtctttgatgaggcccaaaagctgatgctccaattagatcaattatcacgtcatcagcttaacctgacggtttttttacaaacaatacaggccaagttaagcaaccctttacctcttttagaaaaacgcttattggaaagcttgtcgtttgaactgggacaagtgtcaagtgattactatcaaaataaagagcaccagcttgctcatgattggtctcgtatagctggctacgccaaagaattaacaggagcagattatcaagagttacaagccttttttgctacctcagatggtgactactggcttagtagcgaaaagcaagaggagaagcgagtgacttatctaaacagtgctagtaaggcatttattcatttccaacagctcttaccagaaacggtgaaaacttattttgtttctgccactttaaccatcagctcagaagtaaccttggcagacctattaggttttgaagagtatctctatcatgtcattgaaaaggataaaaagcaagaccagttggtgcttgttgatcaagaggcgcctatcgtgacagaagtcagtgaccaaatctatgtggaagcaattgcaaaacgaatcgaaagcttgaagcaagagggttatcctattttagtgctttttaattctaaaaaacacttgctgttggtttcagactatctagaccaatggcaggtgcctcacttagcgcaggaaaagaatggaacagcttataatattaaaaaacggtttgatcaaggagagcaaactattttgcttggtttaggttctttttgggaaggagttgattttattcaagcggatcgtatgattacccttatcgcacgattgccctttgataacccagaggatttctttgttaagaaaatgagtcattatctattggaaaaaggtaaaaatcctttcagagattacttcttgccaatgactattttgcgattaaaacaggctattggtcgcacgatgcgtcgacaagatcaaaagtcagtggttattattttggatcgtcgtctccttacaaagtcctatggacaagttattttggaaggtctcggtcaggaatttttgatttctcaacaaaattttcacgattgtctagtagaaacggactgttttctgata

SEQ ID NO: 5516 - protein, 833 aa, Streptococcus pyogenes
MFCFIDIACYNRLTMTQKKLRKYAVVDLEATGAGPNASIIQVGIVIIQGNKIIDSYETDVNPHESLDEHIVHLTGITDKQLAKAPDFGQVAHHIYQLIEDCIFVAHNVKFDANLLAEALFLEGYELTIPRVDTVELAQLFFPRFEKYNLSHLSRQLNIDLAEAHTAIADARATAILFLRLLQKIESLPIECLESLLVYSDSLLFETAMVIQEGLAKAKPYDPNKYIKIRQILLPKGSKALKPYQISKSFPINMALLGLEERPKQTQFAQLIDEDYHQGVASFIEAQTGIGKTYGYLLPLLAKEDQNQIIVSVPTKLLQDQLMAGEVAAIQEQFHIACHSLKGPANYLKLDSFADSLDQNDQNRLVNRYKMQLLVWLLETKTGDLDEIKQKQRFAAYFEQLKHDGDIKQSSEFYDYDFWRVSYEKAKTARLLITNHAYFLHRVQDDKDFARNKVLVFDEAQKLMLQLDQLSRHQLNLTVFLQTIQAKLSNPLPLLEKRLLESLSFELGQVSSDYYQNKEHQLAHDWSRIAGYAKELTGADYQELQAFFATSDGDYWLSSEKQEEKRVTYLNSASKAFIHFQQLLPETVKTYFVSATLTISSEVTLADLLGFEEYLYHVIEKDKKQDQLVLVDQEAPIVTEVSDQIYVEAIAKRIESLKQEGYPILVLFNSKKHLLLVSDYLDQWQVPHLAQEKNGTAYNIKKRFDQGEQTILLGLGSFWEGVDFIQADRMITLIARLPFDNPEDFFVKKMSHYLLEKGKNPFRDYFLPMTILRLKQAIGRTMRRQDQKSVVIILDRRLLTKSYGQVILEGLGQEFLISQQNFHDCLVETDCFLI

SEQ ID NO: 5517 - DNA, 1209 bp, Streptococcus agalactiae
ttgataaaaggaggagtaatgacctatttgtcagaacgtgtactcaatatggaagagagtgttactttagctgcgggagctaaagcaagagaactcagagtacaaggaagagatattcttagtttaactttaggggagcctgactttgctactcctaaaaacattcagcaagcggctattgaggctataacagatggacgtgcaagtttttacacaccatcaagtggtttgccggagttgaagtcagcaattaatgcgtattttgaacgtttttatggctactcccttaaacctaatcaggtggttgtgggaactggtgctaagtttatcctttatactttctttatgacagtactgaatcccggtgatgaagtaattattccgactccttattgggtatcttatgctgatcagattaagatggctgaaggtaagccagtttttgtcacagcaaaagaagttaatcacttcaaagtaactgtggaacagttagaagctgttaggactgataagacaaaagtcatacttcttaatagtccatcaaatcctacaggtatgatttataaagctgaggagttggaggctattggaaattgggcagtcgaacatgatatcctaattttagcagatgatatttacggtcgattggtttacaatggcaatatttttacccctatttcaagcctttcagagtctattcgaaaccaaacgatagtcataaatggagtttctaagacttatgcgatgacaggttggcgtgttggttttgcagtgggtaatcatgatattatagcggcaatgtctaaagtagtcagtcaaacaacttctaaccttacggctgtctcacagtatgctactattgaggctttaaatggttctcaagagtcatttgaaaaaatgaggctagcatttgaagaacgccttaatatcatttatccattgttgtgtcaggtccctgggtttgaggttgttaaaccacaaggtgctttttatcttttcccaaatgttacaaaagcaatggaaatgaaaggatatacggatgttacagcattcacggatgccattcttgaagaagttggacttgctttagtaacgggtgctggttttggagcgccggaaaatgttcgtctgagttatgctacagatcttgaaacccttaaagaagctgttcgtagactgcatgtctttatgggaagtaatgaaattaat

SEQ ID NO: 5518 - protein, 403 aa, Streptococcus agalactiae
MIKGGVMTYLSERVLNMEESVTLAAGAKARELRVQGRDILSLTLGEPDFATPKNIQQAAIEAITDGRASFYTPSSGLPELKSAINAYFERFYGYSLKPNQVVVGTGAKFILYTFFMTVLNPGDEVIIPTPYWVSYADQIKMAEGKPVFVTAKEVNHFKVTVEQLEAVRTDKTKVILLNSPSNPTGMIYKAEELEAIGNWAVEHDILILADDIYGRLVYNGNIFTPISSLSESIRNQTIVINGVSKTYAMTGWRVGFAVGNHDIIAAMSKVVSQTTSNLTAVSQYATIEALNGSQESFEKMRLAFEERLNIIYPLLCQVPGFEVVKPQGAFYLFPNVTKAMEMKGYTDVTAFTDAILEEVGLALVTGAGFGAPENVRLSYATDLETLKEAVRRLHVFMGSNEIN

SEQ ID NO: 5519 - DNA, 1344 bp, Streptococcus agalactiae
atgtcaaaaaaacttatttcaattgttgatgttaaagattatgttggtcaagaagttactattggtgcttgggttgctaacaaatcaggtaaaggtaagattgcgtttgtacagttgcgcgatggttctgcctttttccaaggtgtcgcttttaaaccaaacttcattgaaaaatatggtgaagaatcaggtcttgaaaaatttgacgttattaaacgtctcaaccaagaaacatctgtttatgtaacagggattgttaaagaggatgaacgttcaaaatttggctatgagcttgatattactgaccttgaagtcattggagagtcacatgaatatcctataactcctaaagagcatgggacagacttcttgatggacaaccgtcatctttggttgcgttctcgtaaacaaatggctgttatgcaaattcgtaacgctattatttattcaacttatgaattctttgaccaaaatggttttatcaaatttgatagcccaattttatcagaaaatgcagcagaagattcaacagagttatttgaaacagactattttgggaaaccagcatttcttagccaatctggtcaattataccttgaagctggagcaatggctctaggccgagttttcgactttggtccagtctttcgtgctgaaaaatctaaaacacgtcgccatttaacagaattttggatgatggatgctgagtattctttcttgtcacatgaggaatcacttgacctccaagaagcttatgttaaagcattgatccaaggcgttctagatcgtgcgcctcaagcacttgatattttagaacgtgatgttgaggctctcaaacgttatatcgcagagccattcaagcgtgtttcttatgatgatgctattacacttcttcaagagcatgaagcagatgaagatacagattatgaacatttagagcatggtgatgactttggttcaccacatgaaacttggatttctaattactttggagtgccgacatttgtagtgaattacccagcaagctttaaagcattttatatgaaaccagttcctggaaatccagaacgcgttctttgtgctgatcttctagctccagaaggttatggagagatcattggcggctcaatgcgtgaagacgactacgatgctcttgtggctaaaatggatgaactaggtatggataaatcagaatacgacttttaccttgaccttcgtaaatacggctctgttcctcatggcggttttggtataggtattgaacgtatggtaacttttgttgctggtaccaaacatattcgcgaagctattccattcccacgtatgttacatcgtatcaaacca

SEQ ID NO: 5520 - protein, 448 aa, Streptococcus agalactiae
MSKKLISIVDVKDYVGQEVTIGAWVANKSGKGKIAFVQLRDGSAFFQGVAFKPNFIEKYGEESGLEKFDVIKRLNQETSVYVTGIVKEDERSKFGYELDITDLEVIGESHEYPITPKEHGTDFLMDNRHLWLRSRKQMAVMQIRNAIIYSTYEFFDQNGFIKFDSPILSENAAEDSTELFETDYFGKPAFLSQSGQLYLEAGAMALGRVFDFGPVFRAEKSKTRRHLTEFWMMDAEYSFLSHEESLDLQEAYVKALIQGVLDRAPQALDILERDVEALKRYIAEPFKRVSYDDAITLLQEHEADEDTDYEHLEHGDDFGSPHETWISNYFGVPTFVVNYPASFKAFYMKPVPGNPERVLCADLLAPEGYGEIIGGSMREDDYDALVAKMDELGMDKSEYDFYLDLRKYGSVPHGGFGIGIERMVTFVAGTKHIREAIPFPRMLHRIKP

SEQ ID NO: 5521 - DNA, 1344 bp, Streptococcus pyogenes
atgtcaaaaaaacttatttcaattgttgatgttaaagattatgttggtcaagaagttactattggtgcttgggttgctaacaaatcaggtaaaggtaagattgcgtttgtacagttacgcgatggttctgcttttttccaaggtgtcgcttttaaaccaaacttcattgaaaaatatggtgaagaatcaggtcttgaaaaatttgacgttattaaacgtctcaaccaagaaacatctgtttatgtaacagggattgttaaagaggatgagcgttctaaatttggctatgaacttgatattactgaccttgaaatcattggagagtcacatgaatatcctataactcctaaagagcatgggacagacttcttgatggacaaccgtcatctttggttgcgttctcgtaaacaaatggctgttatgcaaattcgtaacgctattatttatgcaacttatgaattctttgaccaaaatggttttatcaaatttgatagcccaattttatcagaaaatgcagcagaagattcaacagagttattcgaaacagactattttgggaaaccagcatttcttagccaatctggtcaattataccttgaagctggagcaatggctctaggccgagttttcgactttggtccagtctttcgtgctgaaaaatctaaaacacgtcgccatttaacagaattttggatgatggatgctgagtattctttcttatcacatgaggaatcacttgaccttcaagaagcttatgttaaagcattgatccaaggcgttctagatcgtgcgcctcaagcacttgatattttagaacgtgatgttgaggctctcaaacgttatatcacagagccattcaagcgtgtttcttatgatgatgctattacacttcttcaagagcatgaagcagatgaagatacagattatgaacatttagagcatggtgatgactttggttccccacatgaaacttggatttctaattactttggagtaccgacatttgtagtgaattacccagcaagctttaaagcattttatatgaaaccagttcctggaaatccagaacgcgttctttgtgctgatcttttagctccagaaggttatggagagatcattggcggctcaatgcgtgaagacaactacgatgctcttgtggctaaaatggatgaactaggtatggataaatcagaatatgacttttaccttgaccttcgtaaatatggctctgttcctcatggcggttttggtataggtattgaacgtatggtaacttttgttgctggtaccaaacatattcgcgaagctattccattcccacgtatgttacatcggattagaccc

SEQ ID NO: 5522 - protein, 448 aa, Streptococcus pyogenes
MSKKLISIVDVKDYVGQEVTIGAWVANKSGKGKIAFVQLRDGSAFFQGVAFKPNFIEKYGEESGLEKFDVIKRLNQETSVYVTGIVKEDERSKFGYELDITDLEIIGESHEYPITPKEHGTDFLMDNRHLWLRSRKQMAVMQIRNAIIYATYEFFDQNGFIKFDSPILSENAAEDSTELFETDYFGKPAFLSQSGQLYLEAGAMALGRVFDFGPVFRAEKSKTRRHLTEFWMMDAEYSFLSHEESLDLQEAYVKALIQGVLDRAPQALDILERDVEALKRYITEPFKRVSYDDAITLLQEHEADEDTDYEHLEHGDDFGSPHETWISNYFGVPTFVVNYPASFKAFYMKPVPGNPERVLCADLLAPEGYGEIIGGSMREDNYDALVAKMDELGMDKSEYDFYLDLRKYGSVPHGGFGIGIERMVTFVAGTKHIREAIPFPRMLHRIRP

SEQ ID NO: 5523 - DNA, 555 bp, Streptococcus agalactiae
atgacaaaatcacctgctcgtttaatttcatttatctcaatcgctatcgccatcaaccttgttggggctaatttagctctatttttacgcctacctatctatctagatactataggtacattgttaatagcagttatcctgggaccatggtacgctgccagcactgcttttctcagtgcactcatcaattggatgactactgatattttttcactttattattcaccagtcgccatcgtggttgctatcattacgggtatcttgattaaaaggaattgtaaaccctctagcctattgtggaaatcactgattatttctttaccaggaactattattgcttcagttataacagttatcctttttaaaggaattacctctagtggctcaagtattatagcacaattcttacatggaattggattagacatgacaagtagtttgatacttgttcaagttggaacagattatatggatcgactaatcagtcttatccttgtcttttcgacaatcacattgttaaaaaaacatagtcccaatttaattaaccaacgattc

SEQ ID NO: 5524 - protein, 185 aa, Streptococcus agalactiae
MTKSPARLISFISIAIAINLVGANLALFLRLPIYLDTIGTLLIAVILGPWYAASTAFLSALINWMTTDIFSLYYSPVAIVVAIITGILIKRNCKPSSLLWKSLIISLPGTIIASVITVILFKGITSSGSSIIAQFLHGIGLDMTSSLILVQVGTDYMDRLISLILVFSTITLLKKHSPNLINQRF

SEQ ID NO: 5525 - DNA, 981 bp, Streptococcus agalactiae
atgaataaagaaaaaattattatcgattgcgatcccggtattgatgataccttagcactgatgtatgctattcagcatcctaagttagaagttgttgctattactataacagcaggcaattcgcctgttgagctaggactaaagaatacctttgtaacgcttgaattactaaaccgtcacgacattccagtttatgttggtgataacttgcctttacaacgtgaatttgtatctgctcaggatactcatggaatggatggccttggagagaataactttacattggcgcaaccaattatctttcaagaagaatcagcagattgttttttagcaaactattttgaacacaaaaatgatacttctattatagctctcggacctctgaccaatatcgctcgagccttacaaactaatcccaaattaggcaaacattgcaagcgatttattagcatgggaggaagttttaaatcacatggcaattgttctccagttgctgaatacaactattggtgtgatcctcatgctgcacaatatgtatttgaaaaccttgacaaaaaaatagagatggttggactagacatcacacgtcatattgtattaacccccaatcatttatcttatatggagcgtattaatccagacgtatcaagttttatccaaaaaatcacaaagttctacttcgattttcactggcaatatgagcatattattggatgtgtgataaatgatcctttagctattgcttactttgttaatgaaaatatcgctactggttttgatagctataccgatgttgcttgtcacggaatcgccatgggacaaacaattgtagatcagtatcatttttataaaaaagatgctaacagtaagattttaacctcagtcaatactaatttattttggaatgattttatgaccgtcctattacatgcacaaaattcagtcatcattgaagacttagaaatgttaggacttaacaaa

SEQ ID NO: 5526 - protein, 327 aa, Streptococcus agalactiae
MNKEKIIIDCDPGIDDTLALMYAIQHPKLEVVAITITAGNSPVELGLKNTFVTLELLNRHDIPVYVGDNLPLQREFVSAQDTHGMDGLGENNFTLAQPIIFQEESADCFLANYFEHKNDTSIIALGPLTNIARALQTNPKLGKHCKRFISMGGSFKSHGNCSPVAEYNYWCDPHAAQYVFENLDKKIEMVGLDITRHIVLTPNHLSYMERINPDVSSFIQKITKFYFDFHWQYEHIIGCVINDPLAIAYFVNENIATGFDSYTDVACHGIAMGQTIVDQYHFYKKDANSKILTSVNTNLFWNDFMTVLLHAQNSVIIEDLEMLGLNK

SEQ ID NO: 5527 - DNA, 411 bp, Streptococcus agalactiae
atgctttatgaagtaacctcatcaaacactcaaggcgttgatggaaaagtttatctctccaatggaaaaattgtggagaccaatcaccctttaaatcatttaccaggatttaatcctgaggaattaattgctttagcatggtcaacatgtttaaatgcaactataaaagctattttagaacaaaaaggattcaaagacctaaaatctcgcgttgatgttacttgccagctcatgaaggaaaagcaagtaggtaagggattttatttccaagttaacgctgttgctagtattgaaaaactgtcattatctgatagtaagctaatcgttaacaaagcacacagcagatgtccgatttcaaaattaatttcaaatgctaaaacaatcaatctagacactgttaaatggtcagtt

SEQ ID NO: 5528 - protein, 137 aa, Streptococcus agalactiae
MLYEVTSSNTQGVDGKVYLSNGKIVETNHPLNHLPGFNPEELIALAWSTCLNATIKAILEQKGFKDLKSRVDVTCQLMKEKQVGKGFYFQVNAVASIEKLSLSDSKLIVNKAHSRCPISKLISNAKTINLDTVKWSV

SEQ ID NO: 5529 - DNA, 888 bp, Streptococcus agalactiae
atgtcagacgaacaaatcaaacttgtgattgtaacaggtatgagtggggcaggaaagacagtggctattcagtcatttgaagatttaggatattttacaatagataatatgccgcctactctagtgcctaagtttttagaattagcagcacaatcaggagatacaagcaagattgctatggtagttgacatgcgtagtcgtcttttctttagagaaattaactctattttggatagccttgaaattaatgataatattaactttaagattctatttttagatgctactgacaccgagctagtgtcacgatataaagagacacgtcgtagccaccctcttgctgccgacggcagagtgttagatggtatttctctagagagagaactattagcaccgcttaaaagtatgagtcagaacgttgtggacactagtgaattaacaccaagacaactacgtaaggtcatttctaaagaattctcaaatcaagatagtcaaagttcttttcgtatcgaagttatgagttttggttttaaatatggtatacctttggatgcggatttagtattcgatgtgcgttttttaccaaatccatactataaaccagaattaagagataagacaggtttagatactgaggtttatgactatgtcatgagttttgatgaatcagatgatttttatgaccatcttcttgccttaataaagccaatcttaccaggctatcaaaatgaagggaaatctgttttgactgtggcaatcggatgtacaggtgggcaacatcgtagcaccgcttttgctcatagattatcagaagatttaaaagcagattggacagttaatgaaagccatcgtgataaaaataagcgtaaggagacggtaaatcgttca

SEQ ID NO: 5530 - protein, 296 aa, Streptococcus agalactiae
MSDEQIKLVIVTGMSGAGKTVAIQSFEDLGYFTIDNMPPTLVPKFLELAAQSGDTSKIAMVVDMRSRLFFREINSILDSLEINDNINFKILFLDATDTELVSRYKETRRSHPLAADGRVLDGISLERELLAPLKSMSQNVVDTSELTPRQLRKVISKEFSNQDSQSSFRIEVMSFGFKYGIPLDADLVFDVRFLPNPYYKPELRDKTGLDTEVYDYVMSFDESDDFYDHLLALIKPILPGYQNEGKSVLTVAIGCTGGQHRSTAFAHRLSEDLKADWTVNESHRDKNKRKETVNRS

SEQ ID NO: 5531 - DNA, 888 bp, Streptococcus pyogenes
atgtcagacaaacacattaatttagttattgtgacaggaatgagcggcgctggaaaaacagttgccattcagtcttttgaggatctaggctactttaccattgataatatgcccccagccttggttccaaaatttttagaattaattgaacaaaccaatgaaaatcgtagggtggctttggttgtcgatatgagaagtcgtttgtttttcaaggaaattaattctaccttagatagtattgaaagcaatcctagcattgattttcggattctttttttggatgcaacggatggagaattggtgtcacgctataaagaaaccagacggagccaccctttggctgcggacggtcgtgtgcttgatggtattcgattggaaagagaactcctatctcctttgaaaagcatgagccaacatgtggtggatacaacaaaattgacccctagacaattgcgtaaaaccatttcagaccagttttctgaagggtctaatcaagcctctttccgtattgaagtgatgagctttgggttcaaatatggtcttcctttggatgcggatttggtttttgatgtgcgttttctacccaatccttattatcaggtagagcttcgtgaaaaaacaggactagatgaggacgtttttaattatgtgatgtctcacccagaatcagaggtgttttacaagcatttgttaaaccttattgtccctatcttaccggcttaccaaaaagaagggaagtctgtcttgacggtggctattggctgcacaggaggccaacaccgcagcgttgcctttgcccattgcttggcagaaagtctggcaacagattggtcggttaatgaaagccatcgtgatcaaaatcgtcgtaaggaaacggtgaatcgttca

SEQ ID NO: 5532 - protein, 296 aa, Streptococcus pyogenes
MSDKHINLVIVTGMSGAGKTVAIQSFEDLGYFTIDNMPPALVPKFLELIEQTNENRRVALVVDMRSRLFFKEINSTLDSIESNPSIDFRILFLDATDGELVSRYKETRRSHPLAADGRVLDGIRLERELLSPLKSMSQHVVDTTKLTPRQLRKTISDQFSEGSNQASFRIEVMSFGFKYGLPLDADLVFDVRFLPNPYYQVELREKTGLDEDVFNYVMSHPESEVFYKHLLNLIVPILPAYQKEGKSVLTVAIGCTGGQHRSVAFAHCLAESLATDWSVNESHRDQNRRKETVNRS

SEQ ID NO: 5533 - DNA, 972 bp, Streptococcus agalactiae
atgagaaaacctaaaataaccgttatcggcggaggaacgggaattccagttattttgaaaagtcttcgcttagaagatgttgagattacagcggttgtcacggttgcagatgatggtggttcgtcaggtgagttgcgctcagttatgcaactaacaccaccaggagatctaagaaatgttttggttgccttgagtgatatgccgaagttttacgaacaaattttccaatatcgttttgcagaaggtgatggggattttgcaggtcatcctttaggaaatcttattattgctggtgttgctgaaatgcaaggttcaacttataacgctatgcagagtttaacacagttctttcatacaacaggaaagatatatccatctagtgaacatccgctcactctgcatgctgtttttaaagatggccatgaagtggttggagagagtcaaatagccgattataaaggcatgattgaccatgtgtatgtcactaatacttataatgaagagactcctacggccagccgcaaagttgttgatgcaattttagaaagtgatatgattgtgttggggccagggtcacttttcacctctattttacctaacctagttattccagaaattaaacaagctcttttagaaactcgggcagaggtagcttatgtatgcaatattatgacacaacgtggtgaaactgagcattttacagacgcagaccacgttgaagtattgaaacgtcatttaggacaagatgctatcgatacagttttggttaatattgaaaaagtgccagagtcttatatggaaaacaatcattttgatgagtatttggtacaggttgaacatgatttttcagggcttagaaaacatgccagacgtgtcatctcgtctaactttttaaaattagaaaaaggtggagccttccatcatggtgacttcgttgttgaggaactaatgaatttagtaggaacacattta

SEQ ID NO: 5534 - protein, 324 aa, Streptococcus agalactiae
MRKPKITVIGGGTGIPVILKSLRLEDVEITAVVTVADDGGSSGELRSVMQLTPPGDLRNVLVALSDMPKFYEQIFQYRFAEGDGDFAGHPLGNLIIAGVAEMQGSTYNAMQSLTQFFHTTGKIYPSSEHPLTLHAVFKDGHEVVGESQIADYKGMIDHVYVTNTYNEETPTASRKVVDAILESDMIVLGPGSLFTSILPNLVIPEIKQALLETRAEVAYVCNIMTQRGETEHFTDADHVEVLKRHLGQDAIDTVLVNIEKVPESYMENNHFDEYLVQVEHDFSGLRKHARRVISSNFLKLEKGGAFHHGDFVVEELMNLVGTHL

SEQ ID NO: 5535 - DNA, 975 bp, Streptococcus pyogenes
atgaaaaatcctaaaatgactgttataggtgggggtactggcatctccattatcctaaaaagccttcgtaatgaagcagttgatattactgctgtggtcactgttgcagatgatggtggttcctcaggagaacttcgtaatgccatgcaattagctccgccaggagacttacggaatgtcttgttagcgatgagtgacatgccaaaattttatgagcgggttttccaataccgttttaacgagagtgatggagccttggctggtcaccctctaggcaatctcattattgctggtatctctgaaatgcaaggctcaacctacaatgccattcaaattttaaccaaatttttccatattacaggtaaaatttacccctctagcgagcaggccttgacccttcatgctgtttttaaagatgggcatgaagtagcaggagaaagttctattgccaaatacccaggcatgattgaccatgtctatgtgaccaacacctacaacgaccaaaagcctcaggccagtcgtaaggtggttgaggctattctagaaagtgacatgattgtcttgggaccaggctcactgtttacctctattttacctaatttggtcattccagaaattaaagaagctttgcgccagactaaagcagaagtggtgtatatttgtaatatcatgacccagtatggtgaaacagaacaattttcagatgcagaccatgtggctgttttaaatcagcacttaggaagagatttgattgatacggttttggtaaatgtggctaaggtgccgcaggcttacatgaattctaacaaatttgatgaatacctcgttcaggttgatcacgactttgctggcctttgcagggctgctaagcgtgtgatttcgtcttattttttacggttggagaatggcggagcttttcacgatggtaacttagtggtggaagaattaatgaatttagtgaggatagtcaagcaa

SEQ ID NO: 5536 - protein, 325 aa, Streptococcus pyogenes
MKNPKMTVIGGGTGISIILKSLRNEAVDITAVVTVADDGGSSGELRNAMQLAPPGDLRNVLLAMSDMPKFYERVFQYRFNESDGALAGHPLGNLIIAGISEMQGSTYNAIQILTKFFHITGKIYPSSEQALTLHAVFKDGHEVAGESSIAKYPGMIDHVYVTNTYNDQKPQASRKVVEAILESDMIVLGPGSLFTSILPNLVIPEIKEALRQTKAEVVYICNIMTQYGETEQFSDADHVAVLNQHLGRDLIDTVLVNVAKVPQAYMNSNKFDEYLVQVDHDFAGLCRAAKRVISSYFLRLENGGAFHDGNLVVEELMNLVRIVKQ

SEQ ID NO: 5537 - DNA, 909 bp, Streptococcus agalactiae
atgagttttacagtaaaagtcaaagaagagctgctaggtcataagagtgaaaataagatggaactgtcagctattatcaaaatgtcaggtagtttaggattagctaaccacggccttaacctttctattactacagaaaatgctaaaattgctcgtcatatttatagcatgctagaagaacattatcatttgcagccagaaatcaaataccatcaaaaaacgaacttacgaaagaatcgtgtgtatactgtttttattgaagaaaaagttgatgttattcttgctgatttgaagttggctgatgctttttttggtattgaaactggtattgaacactctatattggacaatgatgaaaatggaagagcttatctcaggggagcattcttatcaacgggtactgttagagaacctgattctgggaaatatcaactagaaattttttctgtttatctagaccatgcacaagacttagctaatcttatgaaaaaatttatgttagatgcaaaggttattgaacataaacatggagcagtaacttatttgcaaaaagcagaagatattatggatttcttgatagtcattgatgccatggaagctagagatgcttttgaagagattaaaatgatacgtgagacacgtaatgatattaatcgtgctaacaacgttgaaacagctaatattgctagaacaatcacagctagtatgaagactatcaataatattatcaagattatggatactattggttttgatgcactgcctagtgatttaagacaagtagctcaggtgcgtgtggctcatccagattactctattcaacaaatagcagacagtttagaaacgcctctgagtaagagtggcgttaaccatcgcttacggaaaataaataaaattgcagatgaatta

SEQ ID NO: 5538 - protein, 303 aa, Streptococcus agalactiae
MSFTVKVKEELLGHKSENKMELSAIIKMSGSLGLANHGLNLSITTENAKIARHIYSMLEEHYHLQPEIKYHQKTNLRKNRVYTVFIEEKVDVILADLKLADAFFGIETGIEHSILDNDENGRAYLRGAFLSTGTVREPDSGKYQLEIFSVYLDHAQDLANLMKKFMLDAKVIEHKHGAVTYLQKAEDIMDFLIVIDAMEARDAFEEIKMIRETRNDINRANNVETANIARTITASMKTINNIIKIMDTIGFDALPSDLRQVAQVRVAHPDYSIQQIADSLETPLSKSGVNHRLRKINKIADEL

SEQ ID NO: 5539 - DNA, 909 bp, Streptococcus pyogenes
atgagttttacaaccaaggtcaaagaggaattaattcacttgtccacaggtgacaacaatgaattggccgccattatcaaattatcaggcagcttgggcttagctcaccaaagccttcatttatccattaccactgaaaatgctaaaattgcccgctacatttattctcttattgaagacgcctatgttatcgtgccagaaatcaggtatcatcaaaagacgaacctgcgcaaaaaccgtgtttacaccgtctatgttgagcaaggtgtggaaaccattttagccgatttgaaattagcggactccttttttggtctggaaacaggcatcgaacctcaggttttatcagacgataatgctggccgttcttatcttaaaggggcttttctagcggcaggtagcatcagagatcctgagtcaggcaagtatcagttagaaatctattcagtttatcttgatcatgctcaagatttagctcaactcatgcaaaaatttatgctagatgccaaaaccatcgagcataaaagcggtgcagttacttatttgcaaaaggcagaagatatcatggactttttaattataattggtgccatgtcctgcaaagaagactttgaagccatcaaattacttcgagaagctcgaaatgatattaaccgtgccaataatgcagaaacagctaatattgccaaaactatcagtgctagcatgaaaaccattaataatattattaaaatcatggacacaattggtttagaaagtttaccgattgaattgcaacaggtagcccagcttcgggttaagcatccagactattccattcaacaagttgctgatgctcttgagttcccaatcaccaagagcggggtcaaccatcgcttgcgtaaaatcaataaaattgcagatgactta

SEQ ID NO: 5540 - protein, 303 aa, Streptococcus pyogenes
MSFTTKVKEELIHLSTGDNNELAAIIKLSGSLGLAHQSLHLSITTENAKIARYIYSLIEDAYVIVPEIRYHQKTNLRKNRVYTVYVEQGVETILADLKLADSFFGLETGIEPQVLSDDNAGRSYLKGAFLAAGSIRDPESGKYQLEIYSVYLDHAQDLAQLMQKFMLDAKTIEHKSGAVTYLQKAEDIMDFLIIIGAMSCKEDFEAIKLLREARNDINRANNAETANIAKTISASMKTINNIIKIMDTIGLESLPIELQQVAQLRVKHPDYSIQQVADALEFPITKSGVNHRLRKINKIADDL

SEQ ID NO: 5541 - DNA, 1395 bp, Streptococcus agalactiae
atggcttgtacaacaatattggttggtaaaaaggcttcttatgatggttcgactatgatcgctagaacggaagactctgttaatggcgatttcacacccaaaaaattaaaggtaatgacatctaaagatcaaccgcgtcattacaaatcagttttatcaaattttgaagtagatttaccagataacccacttccttatacttcagtaccggacgcattgggaaaagatggtatatggggtgaagccggtattaacagtaaaaatgtagcgatgagtgctacagaaactattacaacgaattcccgcgttttgggtgcagatcctttggtttcagatggtataggggaagaggatatactcactttagtgcttccctatattcagtcagcgcgagaaggtgtggagcgtttaggtgctattttggaaaaatatggaacctatgaatcaaatggtattgctttttcagataccgaagaaatatggtggttagaaacaattggtgggcatcattggattgctcgtcgcgtacctgatgatgtttatgttactaatcctaaccaactaggaattgatcattttgaatttaataactgtgatgactacatgtgctctagtgatttgaaagagtttatcgaacaataccatttagatttgacctattctaatgagcatttcaatcctcgatatgcttttggtagccaacgtgataaagatcgtcattacaacacaccaagaagttgggcaatgcagcgttttttaaatcctgaaattgaacaggatccacgtagcttgtttattccctggtgtcaaaagccttaccgaaaaattactgttgaggatattaaatatgtgttgagtgatcattatcaagacagtgtgtatgacccatatggaccagaaggggatgcggtaagtaggagagcttttcgttcagttggtatcaaccgaactagtcaaacgtctattctacaattacgaccaaataaatcacttgaaacgacaggtgttcaatggttatcttatggctctatgccatttgcaaccatggtgccgttgtttacacaagttgagactgtaccaaactatttttcgaatacaaccaaggatgcttcaacagataatttttattggaccaatcgtttaattgcagctctagcagatccacacttttatcaacatgaagctgatattgaaagctatatcgagagaacgatggctcaaggacatgcacatattaacggtgttgatagagaagttgctgagaataaagagattgattttcaacagaaaaatcaagaaatgagtgactatatccaaaaagaaagccaagaattgttaaatcgtattctatttgatgcaagtaatttaatgacaaatcgcttttcaatgggagat

SEQ ID NO: 5542 - protein, 465 aa, Streptococcus agalactiae
MACTTILVGKKASYDGSTMIARTEDSVNGDFTPKKLKVMTSKDQPRHYKSVLSNFEVDLPDNPLPYTSVPDALGKDGIWGEAGINSKNVAMSATETITTNSRVLGADPLVSDGIGEEDILTLVLPYIQSAREGVERLGAILEKYGTYESNGIAFSDTEEIWWLETIGGHHWIARRVPDDVYVTNPNQLGIDHFEFNNCDDYMCSSDLKEFIEQYHLDLTYSNEHFNPRYAFGSQRDKDRHYNTPRSWAMQRFLNPEIEQDPRSLFIPWCQKPYRKITVEDIKYVLSDHYQDSVYDPYGPEGDAVSRRAFRSVGINRTSQTSILQLRPNKSLETTGVQWLSYGSMPFATMVPLFTQVETVPNYFSNTTKDASTDNFYWTNRLIAALADPHFYQHEADIESYIERTMAQGHAHINGVDREVAENKEIDFQQKNQEMSDYIQKESQELLNRILFDASNLMTNRFSMGD

SEQ ID NO: 5543 - DNA, 1416 bp, Streptococcus pyogenes
atggataaaaaaatacagcgtttttcatgtacaactatactcgtcggtaaaaaggcatcttatgatggctcaaccatggttgctcgaacagaagattctcaaaatggtgatttcacgcctaaaaaaatgattgtggtgaaaccagaagatcaaccgagacattaccgttcggtgcaatcttcctttgaaatggacttaccggacaatcccatgacttacacgtctgttcccgatgcgcttggtaaagatggtatctgggcagaagcaggcgtgaacgaggctaatgtggccatgtcagcaactgaaaccatcactaccaattctcgtgttttaggggcagatcctctagtagcttctggtattggtgaggaggacatggtgaccttagtgctcccttatatccgttctgcgcgtgaaggggttttgcgccttggtgccattttagaagactatggcacttacgagtcaaatggtgtggctttttcagatgaacatgacatttggtggctggaaacgattggtggtcatcactggattgcaagacgggtgccagatgatgcttatgtcaccaatcccaatcaatttggcattgatcattttgaatttaacaatcctgaagattacctttgctcagctgatttaaaggactttattgacacgtatcacttagatttaacctatagccatgagcattttaatccgcgctatgcctttggtagtcaacgtgacaaagaccgtcagtataatacgccacgtgcttggatcatgcaaaaattcttaaacccagaaattgtgcaagacccgcgcagctttgcccttgcttggtgtcaaaaaccttaccgtaaaataacagtagaagatgtcaaatatgtattgagtagtcactatcaggacacgggttatgacccttacggttcagaaggaactcctgttagtaagaaagtctttcgccctattggcattaaccgtaccagccaaaccgctatcttacacattcgtcctaataaacctcaagaaattgccgctattcaatggatggcttatgggtcaatgccatttaataccatggtgccttttttcacacaggtgaagactattccagattattttgccaacacttacgaaaatgtgtttaccgacaatttctattggaccaaccgtctgattgcggctttggcagatcctcactacaatcatcatgaaactgatttggacaattacttggaagaaaccatggcaaaaggtcatgccatgttacatgctgtggaagtacagttattggctggtgaaacagtcgatttggaagaggaaaatcaaaaaatgagtgactatgtgcaaggagaaacgcagacgctgttgaacaagattctctttgacgctagcaatctaatgaccaatcgtttcagtttgagcgat

SEQ ID NO: 5544 - protein, 472 aa, Streptococcus pyogenes
MDKKIQRFSCTTILVGKKASYDGSTMVARTEDSQNGDFTPKKMIVVKPEDQPRHYRSVQSSFEMDLPDNPMTYTSVPDALGKDGIWAEAGVNEANVAMSATETITTNSRVLGADPLVASGIGEEDMVTLVLPYIRSAREGVLRLGAILEDYGTYESNGVAFSDEHDIWWLETIGGHHWIARRVPDDAYVTNPNQFGIDHFEFNNPEDYLCSADLKDFIDTYHLDLTYSHEHFNPRYAFGSQRDKDRQYNTPRAWIMQKFLNPEIVQDPRSFALAWCQKPYRKITVEDVKYVLSSHYQDTGYDPYGSEGTPVSKKVFRPIGINRTSQTAILHIRPNKPQEIAAIQWMAYGSMPFNTMVPFFTQVKTIPDYFANTYENVFTDNFYWTNRLIAALADPHYNHHETDLDNYLEETMAKGHAMLHAVEVQLLAGETVDLEEENQKMSDYVQGETQTLLNKILFDASNLMTNRFSLSD

SEQ ID NO: 5545 - DNA, 1518 bp, Streptococcus agalactiae
atgagaaagaaatttcttttattgatgagctttgtagctatgtttgcagcttggcaacttgttcaagttaaacaagtttgggctgatagtaaacttaaagtggtaacaactttttacccagtttatgagtttacaaaaaatgtcgttggtgataaagctgatgtatctatgttaattaaagcaggtacagaaccgcatgattttgaaccatcaactaaaaacatcgctgccatccaagattcaaatgcttttgtttacatggatgataacatggaaacttgggctccaaaagtagctaagtcagttaaatccaaaaaagtaacaactattaaaggtactggcgatatgttacttactaaaggcgtcgaagaagaaggtgaagaacatgaaggacatggtcatgaagggcatcatcatgaacttgacccacacgtatggttgtctccagaacgtgcgatttctgttgtagaaaacatccgtaataaatttgtcaaagcttatccaaaagatgcagcttcatttaacaaaaatgcagatgcttacattgcaaaattaaaagagcttgacaaagaatacaaaaatggtttgtcaaatgctaaacaaaagagttttgtgactcaacacgcagcgtttggttacatggcgcttgattacggtttaaatcaagttccaattgctggtcttactccagatgcagaaccttcatcaaaacgtttaggcgaattagctaaatacatcaagaaatataacatcaactacatttattttgaagaaaatgcttcaaataaagttgctaaaactttagcagatgaagttggcgtgaaaacagctgtgcttagtccacttgaaggactttctaaaaaagaaatggcagctggcgaagattacttctcagttatgagacgtaatttgaaagttcttaaaaagacaacagatgttgcaggtaaagaagtagctcctgaagaagataaaactaaaacagttgaaacaggttactttaaaactaaagatgttaaagaccgtaaattgacagattactctggtaattggcaatcagtatatcctcttcttcaagatgggacacttgatccagtttgggattacaaagctaaatctaaaaaagatatgactgctgcagagtacaaaaaatattatacagcaggttacaagactgacgtagaatcaatcaagattgatggtaaaaaacatcaaatgacctttgtacgtaatggtaaatcacaaacatttacatacaaatatgcaggttacaaaatcttaacttataaaaaaggtaatcgtggagtacgttatctctttgaagctaaagaaaaagatgctggtcaattcaaatatatccaatttagtgaccatggtattaaaccgaataaagctgaacacttccatatcttctggggttcagaaagccaagaaaaattatttgaggaaatggaaaactggccaacatacttcccagctaaaatgtctggacgtgaagttgcccaagaccttatgtctcat

SEQ ID NO: 5546 - protein, 506 aa, Streptococcus agalactiae
MRKKFLLLMSFVAMFAAWQLVQVKQVWADSKLKVVTTFYPVYEFTKNVVGDKADVSMLIKAGTEPHDFEPSTKNIAAIQDSNAFVYMDDNMETWAPKVAKSVKSKKVTTIKGTGDMLLTKGVEEEGEEHEGHGHEGHHHELDPHVWLSPERAISVVENIRNKFVKAYPKDAASFNKNADAYIAKLKELDKEYKNGLSNAKQKSFVTQHAAFGYMALDYGLNQVPIAGLTPDAEPSSKRLGELAKYIKKYNINYIYFEENASNKVAKTLADEVGVKTAVLSPLEGLSKKEMAAGEDYFSVMRRNLKVLKKTTDVAGKEVAPEEDKTKTVETGYFKTKDVKDRKLTDYSGNWQSVYPLLQDGTLDPVWDYKAKSKKDMTAAEYKKYYTAGYKTDVESIKIDGKKHQMTFVRNGKSQTFTYKYAGYKILTYKKGNRGVRYLFEAKEKDAGQFKYIQFSDHGIKPNKAEHFHIFWGSESQEKLFEEMENWPTYFPAKMSGREVAQDLMSH

SEQ ID NO: 5547 - DNA, 1545 bp, Streptococcus pyogenes
atgaaaaagaaaattcttttaatgatgagtttaatcagtgtcttttttgcttggcaacttactcaggcaaaacaagtcttagcagagggtaaagtgaaggtggtgacaactttctatcctgtttatgaatttacaaaaggggttattggtaatgatggcgatgttttcatgcttatgaaagcaggaacggaacctcatgattttgagccttctacaaaagacattaaaaaaatccaagatgcagatgcatttgtttatatggatgacaatatggaaacttgggtttctgatgtgaaaaaatcattgacatctaaaaaagtgaccatcgtcaagggaactggtaacatgctcttggtagcaggagctggacatgaccatccccatgaggatgctgacaaaaagcatgagcataataaacatagcgaagaaggacacaaccatgcttttgacccacacgtgtggttgtcaccataccgtagcattacagtcgttgaaaatattcgcgacagtctttcaaaagcttacccagaaaaagcagagaacttcaaagccaatgccgctacttatattgaaaaattaaaagagcttgacaaagactatacggcagcactttcagatgctaagcaaaagagctttgtgacacaacacgcagcttttggttatatggcacttgactatggcttgaaccaaatttctattaatggtgtcacaccagatgcagaaccatcagcaaaacgtattgctactttgtcaaaatacgttaaaaaatatggcatcaaatacatttattttgaggaaaatgcgtcaagtaaagtcgcaaaaaccctagctaaagaagcaggagttaaagcggctgtgcttagtccgcttgaaggtttgactgaaaaagagatgaaagctggccaagattactttacggtcatgcgtaaaaaccttgaaaccttacgcttaaccactgatgtggctggtaaagaaattcttccagaaaaagacacgactaagacagtttacaatggttatttcaaagacaaagaagtcaaagatcgtcaattatctgactggtcaggtagctggcaatctgtttacccctatctacaagatggtactttagaccaagtttgggactacaaggctaaaaaatctaaaggtaaaatgacagcagccgagtacaaagattactacactactggttataaaactgacgtggaacaaatcaaaatcaatggtaagaaaaagaccatgacctttgttcgtaatggtgaaaagaaaaccttcacttacacatacgccggcaaagaaatcttgacctatccaaaaggaaatcgcggggttcgtttcatgtttgaagctaaagaagcagatgctggcgaattcaaatacgttcaattcagtgaccatgccattgctcctgaaaaagcaaagcatttccacctgtactggggtggtgacagccaagaaaaattacataaagagttagaacattggccaacttactacggttcagacttatctggtcgtgaaatcgcccaagaaatcaatgctcat

SEQ ID NO: 5548 - protein, 515 aa, Streptococcus pyogenes
MKKKILLMMSLISVFFAWQLTQAKQVLAEGKVKVVTTFYPVYEFTKGVIGNDGDVFMLMKAGTEPHDFEPSTKDIKKIQDADAFVYMDDNMETWVSDVKKSLTSKKVTIVKGTGNMLLVAGAGHDHPHEDADKKHEHNKHSEEGHNHAFDPHVWLSPYRSITVVENIRDSLSKAYPEKAENFKANAATYIEKLKELDKDYTAALSDAKQKSFVTQHAAFGYMALDYGLNQISINGVTPDAEPSAKRIATLSKYVKKYGIKYIYFEENASSKVAKTLAKEAGVKAAVLSPLEGLTEKEMKAGQDYFTVMRKNLETLRLTTDVAGKEILPEKDTTKTVYNGYFKDKEVKDRQLSDWSGSWQSVYPYLQDGTLDQVWDYKAKKSKGKMTAAEYKDYYTTGYKTDVEQIKINGKKKTMTFVRNGEKKTFTYTYAGKEILTYPKGNRGVRFMFEAKEADAGEFKYVQFSDHAIAPEKAKHFHLYWGGDSQEKLHKELEHWPTYYGSDLSGREIAQEINAH

SEQ ID NO: 5549 - DNA, 282 bp, Streptococcus agalactiae
atggcagaaaggaaatttttaaagatgaaaaaagacatccatccagattatcgtccagttgttttcttagatacaactacaggttacaaattccttagtggttcaactaaatcaactaaagaaacagtagaattcgaaggtgaaacttacccacttattcgtgtggaaatctcatcagattcacatccattctatacaggacgtcaaaaattcactcaagcagatggacgtgtggaccgtttcaacaaaaaatatggtctcaaagacgcaaacgctgctcaa

SEQ ID NO: 5550 - protein, 94 aa, Streptococcus agalactiae
MAERKFLKMKKDIHPDYRPVVFLDTTTGYKFLSGSTKSTKETVEFEGETYPLIRVEISSDSHPFYTGRQKFTQADGRVDRFNKKYGLKDANAAQ

SEQ ID NO: 5551 - DNA, 258 bp, Streptococcus pyogenes
atgagaaaagacattcatccagattatcgtccagttgttttcctagatacaactacaggttaccagttccttagcggctcaacaaaagcttctaaagaaactgttgagtttgaaggtgaaacttacccacttatccgtgtggaaatttcatcagattcacacccattctacacaggacgtcaaaagttcactcaagcagatggacgtgtggaccgcttcaacaaaaaatacggtctcaaagacgcaaacgcagcaaaa

SEQ ID NO: 5552 - protein, 86 aa, Streptococcus pyogenes
MRKDIHPDYRPVVFLDTTTGYQFLSGSTKASKETVEFEGETYPLIRVEISSDSHPFYTGRQKFTQADGRVDRFNKKYGLKDANAAK

SEQ ID NO: 5553 - DNA, 966 bp, Streptococcus agalactiae
atgcagtattaccagttacaaaacatccatgttgacatggatgatatatacattgttaatggtgttagtgagggaatctctatgtcaatgcaagctttgcttgataatgatgacgaggttctagttccaatgccagattacccgttatggacagcttgtgttagccttgctggtggaaatgctgtgcattatatttgtgatgaggaagctaattggtatcctgatattgatgatatcaaatcaaaaatcacatccaaaacaaaagcaattgtcctcattaatccaaataatccaactggagcagtctatccgcgtgaaattctgcaagagattgtggatatcgctagacaaaatgacttgattattttttcagacgaggtttatgaccgtttagttatggatggaatggagcatatcccaattgcttctattgcagaggatatttttacagttactttatctggcttatctaaatcacatcgcatctgtggtttccgcgttggttggatggtattgtctggtccgcgacaacatgttaaaggttatattgaaggtttgaatatgttagctaacatgaggctgtgttcaaatgttcttgctcaacaggttattcaaacatcgttaggcggacagcaatctattgatagtatgttgttgccaggaggtcgtatctacgagcaacgtaattatatccataaagcaattaatgaaatacctggtttatctgctgtaaaaccaaatgctggactgtatcttttccctaaaattgatacagatatgtaccgtattgataatgatgaagagtttgtgcttaatttcttaaaacaagaaaaagtattactaacacacggtagaggatttaatatgaataccgctgaccattttagaattgtttacttaccacgtgttgatgaattgactgaactacaagaaaaaatggctcgctttttaagccaatacaagcgc

SEQ ID NO: 5554 - protein, 322 aa, Streptococcus agalactiae
MQYYQLQNIHVDMDDIYIVNGVSEGISMSMQALLDNDDEVLVPMPDYPLWTACVSLAGGNAVHYICDEEANWYPDIDDIKSKITSKTKAIVLINPNNPTGAVYPREILQEIVDIARQNDLIIFSDEVYDRLVMDGMEHIPIASIAEDIFTVTLSGLSKSHRICGFRVGWMVLSGPRQHVKGYIEGLNMLANMRLCSNVLAQQVIQTSLGGQQSIDSMLLPGGRIYEQRNYIHKAINEIPGLSAVKPNAGLYLFPKIDTDMYRIDNDEEFVLNFLKQEKVLLTHGRGFNMNTADHFRIVYLPRVDELTELQEKMARFLSQYKR

SEQ ID NO: 5555 - DNA, 843 bp, Streptococcus agalactiae
ttgcaaaagctaaaatgctttgatataattgtaacgcaaaacatacaaaggatgaaggaaatgccgaatttattagaaaaaactagaaaaattacatccatcttacagcgttccgtagatagcttagatgccgaactaccatataatacaatggcggctcaattagctgatattattgactgtaacgcatgtattattaatggtggtggtaacttacttggctatgccatgaaatataaaacaaacactgaccgtgtggaagaattttttgaaacaaaacaattcccagattactatgttaaatctgctagtcgtgtttatgatacagaagctaacttatcagtagataatgatttgtcaattttcccagttgagacaaaggaaaacttccaagatggtattacaacaatcgctccaatttatggtggtggaatgcgcttgggaacatttattatctggcgtaatgataaagaatttagcgacgatgatttgattttagttgaaattgcaagcaccgttgttggtattcaattacttaaccttcaaacagaaaatctagaagaaaatattcgtaaacaaacagcggtgacaatggctatcaacactctatcttattcagaaatgaaagctgtagctgctatcttaggagaattagatggacttgaaggacgcctaacggcatctgttattgcagaccgtattggaattacacgttccgttattgtaaatgctcttcgtaaattggagtctgcgggaatcattgagagccgctcactcggtatgaagggaacatacctcaaagttattaacgaaggtatttttgacaaattaaaagaatataat

SEQ ID NO: 5556 - protein, 281 aa, Streptococcus agalactiae
MQKLKCFDIIVTQNIQRMKEMPNLLEKTRKITSILQRSVDSLDAELPYNTMAAQLADIIDCNACIINGGGNLLGYAMKYKTNTDRVEEFFETKQFPDYYVKSASRVYDTEANLSVDNDLSIFPVETKENFQDGITTIAPIYGGGMRLGTFIIWRNDKEFSDDDLILVEIASTVVGIQLLNLQTENLEENIRKQTAVTMAINTLSYSEMKAVAAILGELDGLEGRLTASVIADRIGITRSVIVNALRKLESAGIIESRSLGMKGTYLKVINEGIFDKLKEYN

SEQ ID NO: 5557 - DNA, 780 bp, Streptococcus pyogenes
atgcctaacttattagaaaaaactcgtaaaatcacatctattttgcagcgttccgtagatagcctagaaacagaattaccgtataacacaatggcatctcgcctagcagatatcattgactgcaatgcttgtattatcaatggcggcggcacactgcttggttatgccatgaaatataaaactaacactgatcgtgttgaggaattttttgaagctaaacaatttccagatacttatgtaaaggctgctagccgagtttacgatacagaagctaacctttctgtcgaaaatgaattgactatattccctgttgagtctaaagacacttatccaggaggtctaacgactattgcgccgatttatggtggagggatgcgccttggatcactcattatctggcgtaatgacaatgagtttagtgatgatgatttgattttggttgagatctcaagtactgttgtggggattcaactattaaatcttcagacagaaaacttagaagacaccatccgtaaacaaacagcggtcaacatggcaattaatacgctttcttattcagaaatgaaagctgttgcagcaattcttggagagttagatggtaacgaaggacgattgacagcttctgttattgctgatcgtattggtattacccgttctgttattgtcaatgctctgcgtaaactagaaagtgcagggattattgaaagtcgttctcttggtatgaaagggacatacctcaaagttatcaacgaaggtatttttgctaaattaaaagaattt

SEQ ID NO: 5558 - protein, 260 aa, Streptococcus pyogenes
MPNLLEKTRKITSILQRSVDSLETELPYNTMASRLADIIDCNACIINGGGTLLGYAMKYKTNTDRVEEFFEAKQFPDTYVKAASRVYDTEANLSVENELTIFPVESKDTYPGGLTTIAPIYGGGMRLGSLIIWRNDNEFSDDDLILVEISSTVVGIQLLNLQTENLEDTIRKQTAVNMAINTLSYSEMKAVAAILGELDGNEGRLTASVIADRIGITRSVIVNALRKLESAGIIESRSLGMKGTYLKVINEGIFAKLKEF

SEQ ID NO: 5559 - DNA, 546 bp, Streptococcus agalactiae
atgacaaaagcactcatctcaatagactacacatatgattttgtggcagatgatgggaaattaacggcaggtaaaccagcgcaatctatcgcttcagctatagctgacgttacagagaaagcataccggtcaggggattatattttttttgcgattgataatcatgatattggagatgtttttcatccagagagcaatctttttcctgagcataatattaaagggacttctggtagaaacctatatggtcctttgggaactctatatgaaactattaaggaagatagtcgtgttttttggatagataagcgtcattattctgccttttctggcactgatttagatattcgcctacgtgaaagacgagtagatactttgatattgacaggagtattgacagatatttgtgtattacacacagcaattgatgcttataacttaggttataaaattgaggtcccagcagcagctgtagctagcttaaatgatagtaatcatcaatgggctttaaatcattttaaaactgttcttggtgcaactattctt

SEQ ID NO: 5560 - protein, 182 aa, Streptococcus agalactiae
MTKALISIDYTYDFVADDGKLTAGKPAQSIASAIADVTEKAYRSGDYIFFAIDNHDIGDVFHPESNLFPEHNIKGTSGRNLYGPLGTLYETIKEDSRVFWIDKRHYSAFSGTDLDIRLRERRVDTLILTGVLTDICVLHTAIDAYNLGYKIEVPAAAVASLNDSNHQWALNHFKTVLGATIL

SEQ ID NO: 5561 - DNA, 555 bp, Streptococcus pyogenes
gtgatgagagcattgatttcaattgattacacaaatgattttgtagcagatgatggtaaattaagtgcaggtaaatctgctcaggctattgccactaaaatagcagaggtaactaaaacggcatttgatcaaggagactatattttttttgctattgattgtcatgatcaaaatgattcttggcatcctgagagtaagctatttgcagcacataatatcaaaggaactactggacgccatctttatggtccactagctgaagtttacagttatatgaagcaacatcccagagttttttggattgataagcgttattattcagctttttcggggactgatttagatattagactacgagaaagaggtatcactcaattagtgttaacaggagttttatctgatatctgtgtcttacatactgctattgacgcttatcatcttggttatcaattagagattgttaaatcggctgtcgctagccttacaaaagaatcttatgagtggtctttggctcactttgagcaggttcttggtgctaagcttattaacgattac

SEQ ID NO: 5562 - protein, 185 aa, Streptococcus pyogenes
VMRALISIDYTNDFVADDGKLSAGKSAQAIATKIAEVTKTAFDQGDYIFFAIDCHDQNDSWHPESKLFAAHNIKGTTGRHLYGPLAEVYSYMKQHPRVFWIDKRYYSAFSGTDLDIRLRERGITQLVLTGVLSDICVLHTAIDAYHLGYQLEIVKSAVASLTKESYEWSLAHFEQVLGAKLINDY

SEQ ID NO: 5563 - DNA, 99 bp, Streptococcus agalactiae
ttgctaaaaatttgtcaggccgtcctgttatatcagcaaactgacttggaacaagtgttgaagaatttgttgcaaagattgtctttgaaggtgccactt

SEQ ID NO: 5564 - protein, 33 aa, Streptococcus agalactiae
MLKICQAVLLYQQTDLEQVLKNLLQRLSLKVPL

SEQ ID NO: 5565 - DNA, 1131 bp, Streptococcus agalactiae
ttgtatactatttattttatatgttatattatatatctttttttactgaaatcaagtaaaaaaagatactattttaaaaataatcatactatatatttgcttttagacatatcttttgttaaactttcttcgaaaacgttttcgaatataagtatcggaggttgtaatatgacaattaaaaatctcactgttgcaggaagtggcgttctaggtagtcaaatcgcctttcaagcagcttacaaaggaatgtctgtcaccatatatgacattaacgatgaagctttaaataagggaaaagaacgcatcaaaaaattagctaaagtctatcaatcagaaattgaaacagcaaaagaagcatatagtgataaagctaaaagtatcaagtataataaaaacttattgcctagcttagaccatatttttctttcaaaagttgccgattcattagacttgattgctgatttaccaaaccaaattactttttcaaaaaacttagaccaagctgtaagtgacgccgatttagtaatcgaagctgtcccagaaacagttagtataaaagaagatttttataaacaattagctaaagtggcaccttcaaagacaatctttgcaacaaattcttcaacacttgttccaagtcagtttgctgatataacaggacggcctgacaaatttttagcaatgcatttcgctaacaatatttggcaaaataatattgttgaaattatgggacataagggaactgacgacgaggttatcaaagaagctttggcattctcaaaagatattggtatggtgcctttacatattcataaagaacaacctggctatattcttaattcaatactagttccattcttagagagtgcactagcattgtactatgataaggtttctgattctgaaactattgataaaacctggaagttaggaacaggagcaccgatgggacctttagaaattttagatattattggcatcgataccgcttataatatcatgaagaattattcagataccaacagcgatcctaatagtcttcatgctcaccttgcaaaaatgcttaaagaagaattcattgataaaggacgtaccggtaaagctgctggacacggcttttatgattacgac

SEQ ID NO: 5566 - protein, 377 aa, Streptococcus agalactiae
MYTIYFICYIIYLFLLKSSKKRYYFKNNHTIYLLLDISFVKLSSKTFSNISIGGCNMTIKNLTVAGSGVLGSQIAFQAAYKGMSVTIYDINDEALNKGKERIKKLAKVYQSEIETAKEAYSDKAKSIKYNKNLLPSLDHIFLSKVADSLDLIADLPNQITFSKNLDQAVSDADLVIEAVPETVSIKEDFYKQLAKVAPSKTIFATNSSTLVPSQFADITGRPDKFLAMHFANNIWQNNIVEIMGHKGTDDEVIKEALAFSKDIGMVPLHIHKEQPGYILNSILVPFLESALALYYDKVSDSETIDKTWKLGTGAPMGPLEILDIIGIDTAYNIMKNYSDTNSDPNSLHAHLAKMLKEEFIDKGRTGKAAGHGFYDYD

SEQ ID NO: 5567 - DNA, 510 bp, Streptococcus agalactiae
ttggcggttttaagtatgctaggtatcatagatgcaaaacctaaggttggttatttttatttaggacagtatcatgcttcaatagggacaagtcattttgaaaagatgacagtttcagaaattatggggatccctctgacagttcatcaaaaagattcagtttatgatgttattgtacatatttttatggaagatgctggttgtgcttttatcttggatgatgatgattttctctgtggagtcgtgtcacgtaaagatttactaaaaatcagtattggcggaggagatctttctaaaatgccaataggaatggtgatgacacgtatgccacacgtgacaactgttttagaaaatgaaagtctttttgcggcagctgataaattagtgagcagaaaagtggatagtctccctgtcgttcgtcatgataagcaatatcccgaaaaatttaaagtgatcgggaaattatctaaaacaatcctcgctagtttgtttttagaaataagagattat

SEQ ID NO: 5568 - protein, 170 aa, Streptococcus agalactiae
MAVLSMLGIIDAKPKVGYFYLGQYHASIGTSHFEKMTVSEIMGIPLTVHQKDSVYDVIVHIFMEDAGCAFILDDDDFLCGVVSRKDLLKISIGGGDLSKMPIGMVMTRMPHVTTVLENESLFAAADKLVSRKVDSLPVVRHDKQYPEKFKVIGKLSKTILASLFLEIRDY

SEQ ID NO: 5569 - DNA, 828 bp, Streptococcus agalactiae
atggaagatcaactcactatatttattatttcagattctttaggggaaacagccaaagctattgcgaaagcatgtttgtcacaatttccaggacatgatgattggcattttcaacgtttttcctatattaacagtcaggaacgcttagaacaagtttttgaagaggctagccagaagacagtatttatgatgtttagtttagttgatgttgctttggcttcctatgcacagaaacgatgtgaaagtgaacattatgcttatgttgacttattaacaaatgttattcaaggaatatcaaggatatcgggtatagatcctttgggagaaccagggattttacgacgcttagacaatgattatttcaaaagagtagaatcaatagaatttgcagtaaaatatgatgatgggagagatccgcgaggtattttacaagcagatttagttattataggaatttcaagaacttctaaaacaccattaagtatgtttttagcagataaaaatattaaagttattaatattcctttggttccagaggttcctgttcctaaagaattacgtatgattgattctagaaggattatcggactaactaattcggttgatcatcttaatcaagtccgaaaagttcgattaaagtccttaggtctttctagtacggcaaattatgccagtttagaacggattttggaggagacgaggtatgctgaagaagttatgaaaaatttaggttgcccaatcattaatgtatctgataaagcaatcgaagaaacagcaacgattattttagaaatcttaaaaacaaatggacaagtagctaaaaatctg

SEQ ID NO: 5570 - protein, 276 aa, Streptococcus agalactiae
MEDQLTIFIISDSLGETAKAIAKACLSQFPGHDDWHFQRFSYINSQERLEQVFEEASQKTVFMMFSLVDVALASYAQKRCESEHYAYVDLLTNVIQGISRISGIDPLGEPGILRRLDNDYFKRVESIEFAVKYDDGRDPRGILQADLVIIGISRTSKTPLSMFLADKNIKVINIPLVPEVPVPKELRMIDSRRIIGLTNSVDHLNQVRKVRLKSLGLSSTANYASLERILEETRYAEEVMKNLGCPIINVSDKAIEETATIILEILKTNGQVAKNL

SEQ ID NO: 5571 - DNA, 2643 bp, Streptococcus agalactiae
atggaaactaagtttgtgtatcattttgatgaaggttgtaaggaaatgaaggaactgctaggtggtaagggggctaatctagctgaaatgacgagtattgggttaccggtaccacaaggttttactattacaacacaggcttgtaatgattattatgataacgcttgccatatccgagagagtattcttagtcaaattgatcaagcaatggcacaattggaggttgaacagaacaagcaattaggaagtgttgatgatcctttgttggtgtcagttcggtcaggatcagttttttcaatgcctggtatgatggacacagttttaaatttagggttaaatgatcgtagtgtccaaggtttagtgaaaaagacagaagacgagcgttttgcttatgacagttatcgtcgttttatccaaatgtttgcagatgtggttacaggcattccaaaatataaatttgataccattttagatcgacttaagacagataaatgttatcaagatgacacagaactaactggttcagatttaaagagacttgttgaattttacaaggaactatatcaaaaagaagcaggagaaaaatttccgcaagatcctaaaaggcagcttttgttagcaattgaggcagtttttaaatcatggaataatccaagagctaagatttatcgtaaattaaatgatattccggagacgcttgggacagccgttaatatccaagctatggtttttgggaatatgggaaataacagcggaacgggagttgcttttacacgaaacccatcaactggagcagcaaatttatttggtgagtatttgattaatgcacaaggagaagatgttgttgcaggtatcagaacaccacaatccatatcaaaattggcagaacaaatgcctattatttaccaagagtttgtaagcgttacccaaaagttagaagctcattatcgcgatatgcaagatatggagtttacaattgaaaatggtaatctttatatgcttcagacgagaagcggtaagcgtacagcgaaggcagctatcaaaatagcagtagatcaagtaaatgaaggcctaattagtaaagaagaagctatactacgtatcgagcccaaacaattagatcagttattacacccttcttttgacttgaaaagtttaaagaaagctattattttgacgacaggacttccagcttctcctggagctgcttatgggaaagtttatttccatgcagaagatgttgttaaagagatgaaaaagggaaatccagtgctattggtcagacaagagacatcacctgaagatatcgaggggatggttagtgcaaacgggattataacagcaagaggcggaatgacttcccatgcggcagtagtagccagaggaatggggaaaccatgcgttgcaggctgtagtcaattattggttgatgaagtaagacgagaaatttctattgggcatcaaacgataaaagaaggtgagatgttatcaatcgatggtgctacaggaaatgtttatataggacaagttccgatggcagagactagcgtagatcgtgattttgagatatttatgaaatgggtagatgaaaatcgagatatgatggtgtgttcaaatgcagataatccgagagatgctcaaaaggccttggactttggagcagaaggaataggtctttgtcgcacggaacatatgttttttgacgatgaacgtattccagtcgttagagaaatgattttagcggatgaaatattgagccgaaggaaggctctagaaaggcttttatctttccaaagagacgatttttatcaaatttttaaagtattgaaaggtaaagcttgtacgattcgtttgcttgaccctcctttacatgaattcttaccccatgataaagagtctatagaatctatggcaagacaaatggggatatctactttagctattgaaaaacggattcaaacattagaagaattcaaccctatgttaggtcatcgtggttgtagacttgcgattacctatccggaaatttaccaaatgcaggtgagagctcttgtacaaggcgctatacttgcaatgaaagagggatatgaggcaaagccagaaattatgattcctttagtgacagcgcatgaagaaatctctataatacgtgatctgattgaagagacaattgttgaggagagtaaatctaaaaaaattaacttatcattccctattgggacaatgattgaaacaccaagagcttgtatgatagcggatgatattgcaaagtttgcggatttctttagttttgggaccaatgatttaacacaaatgagctttggattttcacgagatgatgctggaaaattcttaggagaatacgttgataaaggacttctaaaaaaagaccctttccaagttttagatcaaaaaggaataggaaggtttattgggcaggcagtgaggttaggaaaagaagttaagccaaaccttaaaataggtatctgtggagagcatggtggagaaccatcatctattgagttctgttaccaactggggttacattatgtatcgtgttcgccgtttaggattcctattgctaaattagcggctgcacaggctaaaatcaaacaaagcagaaatgatataacaatagataaa

SEQ ID NO: 5572 - protein, 881 aa, Streptococcus agalactiae
METKFVYHFDEGCKEMKELLGGKGANLAEMTSIGLPVPQGFTITTQACNDYYDNACHIRESILSQIDQAMAQLEVEQNKQLGSVDDPLLVSVRSGSVFSMPGMMDTVLNLGLNDRSVQGLVKKTEDERFAYDSYRRFIQMFADVVTGIPKYKFDTILDRLKTDKCYQDDTELTGSDLKRLVEFYKELYQKEAGEKFPQDPKRQLLLAIEAVFKSWNNPRAKIYRKLNDIPETLGTAVNIQAMVFGNMGNNSGTGVAFTRNPSTGAANLFGEYLINAQGEDVVAGIRTPQSISKLAEQMPIIYQEFVSVTQKLEAHYRDMQDMEFTIENGNLYMLQTRSGKRTAKAAIKIAVDQVNEGLISKEEAILRIEPKQLDQLLHPSFDLKSLKKAIILTTGLPASPGAAYGKVYFHAEDVVKEMKKGNPVLLVRQETSPEDIEGMVSANGIITARGGMTSHAAVVARGMGKPCVAGCSQLLVDEVRREISIGHQTIKEGEMLSIDGATGNVYIGQVPMAETSVDRDFEIFMKWVDENRDMMVCSNADNPRDAQKALDFGAEGIGLCRTEHMFFDDERIPVVREMILADEILSRRKALERLLSFQRDDFYQIFKVLKGKACTIRLLDPPLHEFLPHDKESIESMARQMGISTLAIEKRIQTLEEFNPMLGHRGCRLAITYPEIYQMQVRALVQGAILAMKEGYEAKPEIMIPLVTAHEEISIIRDLIEETIVEESKSKKINLSFPIGTMIETPRACMIADDIAKFADFFSFGTNDLTQMSFGFSRDDAGKFLGEYVDKGLLKKDPFQVLDQKGIGRFIGQAVRLGKEVKPNLKIGICGEHGGEPSSIEFCYQLGLHYVSCSPFRIPIAKLAAAQAKIKQSRNDITIDK

SEQ ID NO: 5573 - DNA, 300 bp, Streptococcus agalactiae
atgaaaatttctgaagaagaagtgcgtcatgttgccaatctgtcaaaattgcgcttttctgatcaagagactaaagaatttgcgtcaagtttgtcaaagattgttgatatgattgaactcttaaatgaagttgacacagaaggcgtaccagtaacaacgaccatggcagatcgcaaaaccgtgatgcgtgaagatattgctcaaccaggccataatcgtgatgacttatttaaaaatgtaccacagcatcaagattattatattaaagtacctgcaattcttgaggatggaggagatgcc

SEQ ID NO: 5574 - protein, 100 aa, Streptococcus agalactiae
MKISEEEVRHVANLSKLRFSDQETKEFASSLSKIVDMIELLNEVDTEGVPVTTTMADRKTVMREDIAQPGHNRDDLFKNVPQHQDYYIKVPAILEDGGDA

SEQ ID NO: 5575 - DNA, 312 bp, Streptococcus pyogenes
atgggagaaatcatgaaaatttctgaagaagaagttcgccatgtcgcgaagctatcaaaattatcattttcagaaagtgagacaacaacctttgcaacgaccttatccaaaatcgttgatatggttgaattgctgaacgaagttgataccgaaggtgtcgccattacaacaaccatggcagataagaaaaatgtgatgcgtcaagatgtcgctgaagaaggaacagaccgtgccttgctctttaaaaatgttcctgaaaaagaaaatcactttatcaaggtacctgctattttggatgacggaggagatgcc

SEQ ID NO: 5576 - protein, 104 aa, Streptococcus pyogenes
MGEIMKISEEEVRHVAKLSKLSFSESETTTFATTLSKIVDMVELLNEVDTEGVAITTTMADKKNVMRQDVAEEGTDRALLFKNVPEKENHFIKVPAILDDGGDA

SEQ ID NO: 5577 - DNA, 279 bp, Streptococcus agalactiae
gtgcagttattgaggaagttagtttaccgcattctaaatacggtgttgctgtttattatattgttgcttcatcggaagcttcttcaaacttacaacgttttgatggtattcgttatggataccgtacagaaaattataaaaacttggatgatatctatgtcaatacacgatctgaaggttttggagacgaagttaagcgtcgcattatgctgggaacgttcagtttatcttctgggtattacgatgcttattataaaaaagcaggtcaagttcgtagtt

SEQ ID NO: 5578 - protein, 93 aa, Streptococcus agalactiae
MQLLRKLVYRILNTVLLFIILLLHRKLLQTYNVLMVFVMDTVQKIIKTWMISMSIHDLKVLETKLSVALCWERSVYLLGITMLIIKKQVKFVV

SEQ ID NO: 5579 - DNA, 1464 bp, Streptococcus agalactiae
atgtcgtttaataatcaatcaattgatcagttgcatgattttctcgttaaaaaagaaatttcagcaactgaattaacaaaagctacattggaagatattcatgcgcgtgaacaagcggttggatcttttattactatttctgatgagatggcaatagctcaagccaaagaaattgatgataaaggaattgatgctgataatgttatgtcaggtattcccttagcagttaaagataatatttcaacaaaggggattcttacaacagctgcttctaaaatgctctataactatgagccaatctttgatgctacggctgttgaaaagttatatgctaaagatatgattgtgattggtaaagcaaacatggatgaatttgccatgggaggctctacagaaacatcttattttaaaaagacaaataacgcttgggaccatagtaaagttccgggaggatcatcaggtggttctgcagcagcagtagcttcaggacaagtacgtttatcattgggctctgatacaggtggttcaattcgccaaccggcttcatttaatggaatcgttggtatgaagccaacttacggacgtgtatcacgctttggtttgtttgctttcggtagttcgcttgaccagattggaccgatgtctcaaacagtaaaagagaatgcacagcttttgacagttatttctgggcatgatgtaagagattcaacttcttctgagcgtactgtaggcgattttactgctaaaattggtcaagatattcaaggaatgaaaattgctttaccaaaagaatatttgggagaaggaatagcgcaaggagttaaagaaacgattattaaggccgcaaaacatctggaaaaactaggtgcagttattgaggaagttagtttaccgcattctaaatacggtgttgctgtttattatattgttgcttcatcggaagcttcttcaaacttacaacgttttgatggtattcgttatggataccgtacagaaaattataaaaacttggatgatatctatgtcaatacacgatctgaaggttttggagacgaagttaagcgtcgcattatgctgggaacgttcagtttatcttctgggtattacgatgcttattataaaaaagcaggtcaagttcgtagtttgattattcaagattttgaaaaagttttcgcagattatgacttgattttaggtccaacagctccaacaacagcctttgacttagattctttaaatcacgatccagttgcaatgtacctagctgatattctaacaataccagttaatttggctggtttaccaggtatttcaatccctgctggttttgatcaaggtctaccggttggtatgcagttgattggtccgaaattcagtgaagaaacaatatatcaggttgctgctgccttcgaagcaacgacagattatcataaacaacaacctaaaatttttggaggtgagaac

SEQ ID NO: 5580 - protein, 488 aa, Streptococcus agalactiae
MSFNNQSIDQLHDFLVKKEISATELTKATLEDIHAREQAVGSFITISDEMAIAQAKEIDDKGIDADNVMSGIPLAVKDNISTKGILTTAASKMLYNYEPIFDATAVEKLYAKDMIVIGKANMDEFAMGGSTETSYFKKTNNAWDHSKVPGGSSGGSAAAVASGQVRLSLGSDTGGSIRQPASFNGIVGMKPTYGRVSRFGLFAFGSSLDQIGPMSQTVKENAQLLTVISGHDVRDSTSSERTVGDFTAKIGQDIQGMKIALPKEYLGEGIAQGVKETIIKAAKHLEKLGAVIEEVSLPHSKYGVAVYYIVASSEASSNLQRFDGIRYGYRTENYKNLDDIYVNTRSEGFGDEVKRRIMLGTFSLSSGYYDAYYKKAGQVRSLIIQDFEKVFADYDLILGPTAPTTAFDLDSLNHDPVAMYLADILTIPVNLAGLPGISIPAGFDQGLPVGMQLIGPKFSEETIYQVAAAFEATTDYHKQQPKIFGGEN

SEQ ID NO: 5581 - DNA, 1464 bp, Streptococcus pyogenes
atgtcttttaatcataaaaccattgaagagttgcatgacctccttgtagctaaggagatttcagcaacagaattgacccaagcaacacttgaagacatcaagtctcgtgaggaggctgtcggatcgtttatcactgtttcagaagaagttgctcttaaacaagctgcggcaattgatgccaaaggtattgatgctgataacctcatgtcaggtattccgttagctgttaaggataatatttcaaccaaggaaatcctaaccacagccgcttcaaaaatgttgtataactacgagccgatttttaatgccacatcagtagcaaatgcctacgctaaagacatgattgttattggaaaaaccaacatggacgaatttgccatgggtggttcaacagaaacctcttatttcaagaaaacgaaaaatgcttgggaccacacaaaagtacctggaggctcatcaggtggttcggcaacagcagtcgcttcaggacaagtccgtttatctcttggttcagacactggtggttctattcggcagccagctgcatttaatagtgttgtcggtttgaaaccaacctatggcactgtttctcgctatggtctcattgcttttggaagttcacttgatcagattggaccttttgctccgacagttaaagaaaacgcccaattattaaatgtgattgcaagtagcgatgtcaaggatgccacttcagcgcctgtccgcattgcagactacacatctaagattggtcgtgacattaaaggcatgaagattgcccttcctaaagagtatcttggcgaagggattgatcctgagattaaggaaacggttcttgcgtcagttaaacaatttgaagccttaggagctactgttgaggaagtcagccttccacatagcaagtacggtgtggctgtttattatattatcgcttcgtcagaagcgtcttcaaacttacaacgttttgatggcattcgctatggtttccgtgctgacgatgctaaaaacttggatgaaatctatgttaacactcgtagccaaggctttggtgatgaggtgaaacgtcgtatcatgcttggaacctttagtttgtcatcgggttattatgacgcttatttcaaaaaggccggtcaagtgcgcactttgattattcaagattttgacaaggtttttgcggattatgatcttattctaggcccaacaacaccgacggttgcttttggcttagacacactcaaccacgatcctgttgccatgtatttggccgacttattgaccattccggttaacttggctggtctgccaggtatttctattccagcaggattcgtcgatggcttgccagtagggcttcaattaattggtccgaaatacgctgaagaaaccatctatcaagcagcagcagcctttgaagcggtgacagattatcacaagcaacaaccgattatttttggaggtgacaag

SEQ ID NO: 5582 - protein, 488 aa, Streptococcus pyogenes
MSFNHKTIEELHDLLVAKEISATELTQATLEDIKSREEAVGSFITVSEEVALKQAAAIDAKGIDADNLMSGIPLAVKDNISTKEILTTAASKMLYNYEPIFNATSVANAYAKDMIVIGKTNMDEFAMGGSTETSYFKKTKNAWDHTKVPGGSSGGSATAVASGQVRLSLGSDTGGSIRQPAAFNSVVGLKPTYGTVSRYGLIAFGSSLDQIGPFAPTVKENAQLLNVIASSDVKDATSAPVRIADYTSKIGRDIKGMKIALPKEYLGEGIDPEIKETVLASVKQFEALGATVEEVSLPHSKYGVAVYYIIASSEASSNLQRFDGIRYGFRADDAKNLDEIYVNTRSQGFGDEVKRRIMLGTFSLSSGYYDAYFKKAGQVRTLIIQDFDKVFADYDLILGPTTPTVAFGLDTLNHDPVAMYLADLLTIPVNLAGLPGISIPAGFVDGLPVGLQLIGPKYAEETIYQAAAAFEAVTDYHKQQPIIFGGDK

SEQ ID NO: 5583 - DNA, 1440 bp, Streptococcus agalactiae
atgaattttgaaacagtcattggacttgaagtccatgttgaattaaatacgaactctaaaattttctcaccttcttccgctcattttggtcaggaacaaaatgctaatacaaatgtaattgactggtctttcccaggtgtccttccagtcatgaataaaggagttattgatgcaggaatcaaggcggcacttgccttgaatatggatatccatcaaaacatgcattttgatcgtaaaaattatttctatccagataatcctaaagcttatcaaatttcacagtttgatgagcctattggttacaatggttggattgaaatcgaattagaagatggtacacgaaaaaaaattcgtattgagcgtgcccacctcgaagaagatgcaggaaaaaatacacatgggacagatggttattcctatgttgaccttaatagacaaggtgttccactgattgaaattgtatcagaagctgatatgcgttctcctgaggaagcttatgcttatttgacagctctcaaagagattatccaatatactggaatttctgacgttaaaatggaagaaggttctatgcgtgtagatgccaatatttcacttcgtccttatggtcaagaagagtttggtactaaagcagaacttaagaaccttaactcattcaataatgtacgtaaaggtttgatacatgaagaaaaacgtcaagcacaagttttacgatctggtggtcaaattcagcaagagactcgtcgttttgatgaaacaacaggtgagactattttgatgcgtgtcaaggaaggctcatcagattatcgctatttccctgaaccagatttaccactatttgatatctcggatgaatggattgatcaagttcgtttagaattaccagaatttccacaggaacgtcgtgcgaaatatgtatcgtcttttggtctatcatcttatgatgctagccaattaacagctacaaaagcaacttctgatttctttgaaaaagctgttgctattgggggtgatgcaaaacaagtttccaattggttacaaggagaagtggcgcaatttcttaacagtgaatcaaaatcaatcgaagaaattggtctgactcctgagaatttggttgagatgattggcttgattgctgacggtacaatttcatccaaaattgctaaaaaagtttttgtgcatttagctaaaaatggtggttcagctgaagaattcgttaaaaaggctggtttagttcaaatttcagatcctgaagtattaatcccaattattcatcaagtctttgcagataatgaagctgctgtgattgactttaagtcaggaaaacgcaatgctgataaggccttcacaggttatctaatgaaagcaacaaaaggacaagctaatccacaagttgctctgaagctgttagcgcaagaattagcaaaattaaaagaagaa

SEQ ID NO: 5584 - protein, 480 aa, Streptococcus agalactiae
MNFETVIGLEVHVELNTNSKIFSPSSAHFGQEQNANTNVIDWSFPGVLPVMNKGVIDAGIKAALALNMDIHQNMHFDRKNYFYPDNPKAYQISQFDEPIGYNGWIEIELEDGTRKKIRIERAHLEEDAGKNTHGTDGYSYVDLNRQGVPLIEIVSEADMRSPEEAYAYLTALKEIIQYTGISDVKMEEGSMRVDANISLRPYGQEEFGTKAELKNLNSFNNVRKGLIHEEKRQAQVLRSGGQIQQETRRFDETTGETILMRVKEGSSDYRYFPEPDLPLFDISDEWIDQVRLELPEFPQERRAKYVSSFGLSSYDASQLTATKATSDFFEKAVAIGGDAKQVSNWLQGEVAQFLNSESKSIEEIGLTPENLVEMIGLIADGTISSKIAKKVFVHLAKNGGSAEEFVKKAGLVQISDPEVLIPIIHQVFADNEAAVIDFKSGKRNADKAFTGYLMKATKGQANPQVALKLLAQELAKLKEE

SEQ ID NO: 5585 - DNA, 1437 bp, Streptococcus pyogenes
atgaattttgaaaccattattgggcttgaagtccatgtggaattaaataccaattccaaaattttctcaccttcgtcagctcactttggtgaggacccaaatgccaacacgaatgtgattgattggtctttcccaggggtcttaccagtcatgaacaaaggggtgattgatgcgggcataaaagcagcgcttgcccttaatatggacatccataaagagatgcactttgaccgcaaaaattatttctacccagataatcctaaagcttatcaaatttcacagtttgatgagccgattggctacaacggctggattgatatcaaactagaagacggttcaaccaagaaaattcgtattgaacgcgcacacttggaagaagatgctggtaaaaacactcatggcacagatggttattcttatgtggaccttaaccgccaaggagttcctttgattgagattgtgtcagaagccgacatgcgttctcctgaagaagcctatgcttatttgacagctctgaaagaaatcatccagtatacgggtatttctgatgtcaagatggaagaaggctccatgcgtgtggatgccaatatttctcttcgtccttacgggcaagaacaatttggaacaaagaccgaattgaaaaacttgaactccttctcaaatgtccgtaaagggcttgaatttgaggtggaacgtcaagccaaactcttgcgttcaggtggtgtgatacgccaagaaacgcgccgctatgacgaagcgaataaggggactattttgatgcgggtcaaagaaggggcagcggactatcgttatttcccagaaccagacctgccattatatgagattgatgatgcttggattgacgagatgcgtgctcaattacctcaattcccagctcagcgtcgtgctaaatacgaagaggaacttggcctctcagcttatgatgctagccagctaacagctaccaaagtcttgtcagatttctttgaaactgcagtaagtcttggtggcgatgccaagcaagtctctaactggttgcaaggagaagttgcccaattcttaaatgcagaaggcaaaaccattgaagaaatcgctctgacaccagaaaatttggtggagatgattgctatcattgctgatggtacaatctcttctaaaatggctaagaaggtctttgtgcatttggctaaaaacggtggctcagcacgtgcctacgtcgaaaaggcaggacttgttcagatttctgatcccgctgttttggtaccaattattcaccaagtctttgctgataatgaagctgcagtagctgatttcaaatcaggcaaacgtaatgctgataaggctttcacaggcttcttgatgaaggcaaccaaaggtcaagctaatccacaagtcgctcaacaattattggcacaagaattgcaaaaattgcgagat

SEQ ID NO: 5586 - protein, 479 aa, Streptococcus pyogenes
MNFETIIGLEVHVELNTNSKIFSPSSAHFGEDPNANTNVIDWSFPGVLPVMNKGVIDAGIKAALALNMDIHKEMHFDRKNYFYPDNPKAYQISQFDEPIGYNGWIDIKLEDGSTKKIRIERAHLEEDAGKNTHGTDGYSYVDLNRQGVPLIEIVSEADMRSPEEAYAYLTALKEIIQYTGISDVKMEEGSMRVDANISLRPYGQEQFGTKTELKNLNSFSNVRKGLEFEVERQAKLLRSGGVIRQETRRYDEANKGTILMRVKEGAADYRYFPEPDLPLYEIDDAWIDEMRAQLPQFPAQRRAKYEEELGLSAYDASQLTATKVLSDFFETAVSLGGDAKQVSNWLQGEVAQFLNAEGKTIEEIALTPENLVEMIAIIADGTISSKMAKKVFVHLAKNGGSARAYVEKAGLVQISDPAVLVPIIHQVFADNEAAVADFKSGKRNADKAFTGFLMKATKGQANPQVAQQLLAQELQKLRD

SEQ ID NO: 5587 - DNA, 924 bp, Streptococcus agalactiae
atgaggggaaaaatgactaaaaaagaaaaaggaacaatgatgaccttagctgccggactagcatggggcatttctggaattagtggtcaatacttgatgtcgcacggagtacacgttaaccttttgacttctttacgattgttgataacaggtatctttctcttgtctttagctagatcaaaacaaaaggagcatttagtagcagcgtggaaacagccaaaatttttaaagcaggttttacttttttctatatttggtttagttttaaatcaatatgcttttctcagagcgattcatttaacaaatgctggaactgcaacggttttgcaatatatggcaccaatacttattttgagtattgtttgtatcctaaacagacaaagaccaacatcttttgaaataatagcaattgctatggcaattttaggaacctatatgattgcaacgcatgggaagttaggaagtttagctatcacaccgaaaggattaatgtgggggcttggttccgccattacttattctatttatattttattacctgtgaaacttattcatgaatggggaagtacgattgttattggttcaggaatgtttataggtgggattttatttagtttggtgacaaaagcgtggcaataccccttacaaattaatgtgatgagtatacttgcttatattggcattattggtattgggactatttttgcttacacttttttccttaaaggggttagtattgtaggtgctgtcaagggtagcttattagcatcggtagagccagtttcttcggtatttttgacagtacttgttttaggagaaattttttatccaatagatttacttgggatgctgtttatttttcttgctgtaactctaatctcttacaaagatttaattgcattgaagaaaatgaaacgagtaaga

SEQ ID NO: 5588 - protein, 308 aa, Streptococcus agalactiae
MRGKMTKKEKGTMMTLAAGLAWGISGISGQYLMSHGVHVNLLTSLRLLITGIFLLSLARSKQKEHLVAAWKQPKFLKQVLLFSIFGLVLNQYAFLRAIHLTNAGTATVLQYMAPILILSIVCILNRQRPTSFEIIAIAMAILGTYMIATHGKLGSLAITPKGLMWGLGSAITYSIYILLPVKLIHEWGSTIVIGSGMFIGGILFSLVTKAWQYPLQINVMSILAYIGIIGIGTIFAYTFFLKGVSIVGAVKGSLLASVEPVSSVFLTVLVLGEIFYPIDLLGMLFIFLAVTLISYKDLIALKKMKRVR

SEQ ID NO: 5589 - DNA, 558 bp, Streptococcus agalactiae
atgaatagtaaaatatattttttggagatgaaattgagtatagatgattataggccgaccttcgtggttgaggcagtttatgatttaagagcagaagatttattacgtcatggcattcgtgcggttttagttgatttagataatacactcattgcttggaataatccagatggtactgctgaggtgcgtgcatggttagatgagatgacaacagcggatatttcagttgtagtagtgtctaataacaatcatgctcgcgtagaacgtgcagtatcacgttttggtgtggattttgtaagtcgtgcgatgaaaccatttactcgtggtataaacatggcaattgagcgttatggctttgatcgtgacgaggtgattatggttggagatcaattgatgacagatattcgtgctagtcatcgcgcaggaataaagtccgtattggtaaaaccaattgttaaatctgatgcttggaataccaagttcaatcgcttacgtgaacgtcgcgtttggaaaaaaatagaagagaattacggtaaaatcgtatatcaaaaaggaatt

SEQ ID NO: 5590 - protein, 186 aa, Streptococcus agalactiae
MNSKIYFLEMKLSIDDYRPTFVVEAVYDLRAEDLLRHGIRAVLVDLDNTLIAWNNPDGTAEVRAWLDEMTTADISVVVVSNNNHARVERAVSRFGVDFVSRAMKPFTRGINMAIERYGFDRDEVIMVGDQLMTDIRASHRAGIKSVLVKPIVKSDAWNTKFNRLRERRVWKKIEENYGKIVYQKGI

SEQ ID NO: 5591 - DNA, 582 bp, Streptococcus pyogenes
atgctatttcaaaaaaaatatgataaaatagaaagtactaattattttggagatgacatgagtatcgatgattataggccgacctatatggtagaggctatttatgatttaagagcaaatgatttgttgcgtcatggtattacggctgttttagtggatttagataataccttaattgcatggaataatcctgatggcacaccagaggttcgcgcttggcttgatgaaatgactatcgcggatattagcgtggttgttgtttcaaataataaacattctcgtgttgagcgtgccgtttcacgatttggtgttgactttattagccgtgctttgaagccatttgcttatggtattgaaaaagccattgctcgttatggatttgatcgcaacgaggttatcatggttggagatcaactaatgactgatatcagagctagtcatagagctggaataaaatcagttttagtcaaaccacttgttgcttctgatgcttggaatactaaaattaaccgctggcgtgaacgccgtgtgatggcaaaattagaagagaaatatggtaaattatcatatcaaaaaggaatt

SEQ ID NO: 5592 - protein, 194 aa, Streptococcus pyogenes
MLFQKKYDKIESTNYFGDDMSIDDYRPTYMVEAIYDLRANDLLRHGITAVLVDLDNTLIAWNNPDGTPEVRAWLDEMTIADISVVVVSNNKHSRVERAVSRFGVDFISRALKPFAYGIEKAIARYGFDRNEVIMVGDQLMTDIRASHRAGIKSVLVKPLVASDAWNTKINRWRERRVMAKLEEKYGKLSYQKGI

SEQ ID NO: 5593 - DNA, 1116 bp, Streptococcus agalactiae
atggaagagttattttgtattggctgcggagccaggattcaaactgaaaataaagatgctgctggctatacacctcgtgcagcacttgaaaaaggtttagagacaggagaattatactgtcagcgttgtttcagattgcgccactataatgagattactgacgttcatatcactgatgatgaatttttgaaattactacatgaggttggagatagtgatgcccttgtggtgaatgtcattgatatttttgatttcaatggttcaattattcctggtcttagtcgtttcgttgcaggaaacgatgttcttttagtaggaaataaaaaagatattcttcccaaatcggttaaagatggaaaagtaacacaatggttaactgagagagctcatgaagaggggcttcgtcctgttgatgtcatcttgacaagtgcccaaaatcatcatgctattaaggatttgattgatacgattgaaaagtatcgtcatggtcaagatgtttatgttgttggggttactaatgttggaaagtcaactcttattaacgctattattcgtgaaattactggtagtcgtgatgttattacgacctcacgtttcccaggtacaacgttagataaaatagaaatacctcttgatgatggtagctatatttttgataccccgggtattattcatcgtcatcaaatggctcattatttgacagcaaaaaatcttaaatatgttagtcctaaaaaagaaataaaacccaaaacttatcagcttaattcagaacaaacattattcttggctggcctagcacgttttgattttatttctggtcaaaaacaaggttttacggcatattttgataataacctgaatttacaccgcactaaactagttggagcagatgaattttacactaaacatgttggaaaattattgacaccaccaacaggtaaggaagtttcagattttcctaaattagttcgtcatgaatttacaatcaaagataaaatggatattgtttattcgggtcttggttggatacgtgtgaaatcagaagcagaaaatccagtagtagtagctgcttgggctccagaaggcgtggcagttgttttacgcaaagctttaatt

SEQ ID NO: 5594 - protein, 372 aa, Streptococcus agalactiae
MEELFCIGCGARIQTENKDAAGYTPRAALEKGLETGELYCQRCFRLRHYNEITDVHITDDEFLKLLHEVGDSDALVVNVIDIFDFNGSIIPGLSRFVAGNDVLLVGNKKDILPKSVKDGKVTQWLTERAHEEGLRPVDVILTSAQNHHAIKDLIDTIEKYRHGQDVYVVGVTNVGKSTLINAIIREITGSRDVITTSRFPGTTLDKIEIPLDDGSYIFDTPGIIHRHQMAHYLTAKNLKYVSPKKEIKPKTYQLNSEQTLFLAGLARFDFISGQKQGFTAYFDNNLNLHRTKLVGADEFYTKHVGKLLTPPTGKEVSDFPKLVRHEFTIKDKMDIVYSGLGWIRVKSEAENPVVVAAWAPEGVAVVLRKALI

SEQ ID NO: 5595 - DNA, 1116 bp, Streptococcus pyogenes
atggaagaattattttgtataggctgtggtatccagattcaaactgaagataaagaaaaagctggttttacgccagctgctgctttgaaaaagggtatggaaacaggagaactctattgtcagcgctgctttagattgaggcattataatgaaattacagatgtccatattaccgatgatgaatttttaagacttcttcacgaagtgggtgatagtgatgctcttgtggttaatgtgattgatatttttgactttaatggttctattattccaggtctatctcgctttatttctggtaatgatgtcttactggttgggaataaaaaagatattttgccaaagtctgttaaggatggtaaagttactcaatggttgacggaacgtgcacacgaagaaggtcttcgcccattagacgttatgttaacgagcgctcaaaataaatatgcgattaaagacttgattgggcgtatcaatgagttacgtaatggtcgagatgtttatgttgtgggggtcactaatgttggtaaatcaaccttgattaatgctattatccaagagattactggtaacaaggatgtcatcacgacgtctcgttttcctgggacaactcttgacaaaattgaaattcctttggatgatgggacgttcatttttgatacgccaggaattattcacaggcaccagatggctcattatttatcccctaaagagctaaaaatagtgagtcctaagaaggaaatcaagcctaagacgtatcaattaaatccagaacaaactctctttttaggtggtctggctcgctttgactttatcaacggtgagcgtcaaggatttacagctttttttgacaatcaactagaattacatcgtacaaaattagctggagcagatgctttttatgataagcatgttggaactttgttaaccccgccagataagaaagagttgactgcatttcctaaattagttcgtcatgaatttacaattgatcagaaaatggatattgttttttctggtctaggatggattcgtgttaatggtcaaaaagactcaaaagcgatagttgctgcatgggctcctgaaggggttgctgtcattgttcgtaaagcgattatt

SEQ ID NO: 5596 - protein, 372 aa, Streptococcus pyogenes
MEELFCIGCGIQIQTEDKEKAGFTPAAALKKGMETGELYCQRCFRLRHYNEITDVHITDDEFLRLLHEVGDSDALVVNVIDIFDFNGSIIPGLSRFISGNDVLLVGNKKDILPKSVKDGKVTQWLTERAHEEGLRPLDVMLTSAQNKYAIKDLIGRINELRNGRDVYVVGVTNVGKSTLINAIIQEITGNKDVITTSRFPGTTLDKIEIPLDDGTFIFDTPGIIHRHQMAHYLSPKELKIVSPKKEIKPKTYQLNPEQTLFLGGLARFDFINGERQGFTAFFDNQLELHRTKLAGADAFYDKHVGTLLTPPDKKELTAFPKLVRHEFTIDQKMDIVFSGLGWIRVNGQKDSKAIVAAWAPEGVAVIVRKAII

SEQ ID NO: 5597 - DNA, 315 bp, Streptococcus agalactiae
atgttaacatctaaacaacgtgctttcttaaaatcagaagcacattctatgaaacccattattcaaattgggaaaaatggtttaaatgatcaaatcaaaacaagcgtacgtaatgcactcgatgcacgtgagctaatcaaagtaacccttttacaaaataccgatgaagatatccacgatgtcgctgaagttctggaagatgaaattggctgcgatactgtccttaaaataggacgtatcttgattctttataaagagtcagcgcgcaaagaaaatcgtaaaatttcagttaaagtaaaagcagtaaaatcaaac

SEQ ID NO: 5598 - protein, 105 aa, Streptococcus agalactiae
MLTSKQRAFLKSEAHSMKPIIQIGKNGLNDQIKTSVRNALDARELIKVTLLQNTDEDIHDVAEVLEDEIGCDTVLKIGRILILYKESARKENRKISVKVKAVKSN

SEQ ID NO: 5599 - DNA, 306 bp, Streptococcus pyogenes
atgcttacaagtaaacaaagagctttcttaaaatctgaggctcatagcttaaaaccgattgtacaaattggcaaaaatggattaaatgaccacattaagactagtattcgtcaagctttggatgctagagaattgataaaggtcactttgttgcaaaatactgatgaagatattcatgaagtagcagagattttagaagaagaaattgggtgtgatacggttttgaaaattggtcgtatcttgattctctataaggtttctgctaagaaagaaaaccgcaagttgtcccctaaagttaaagcaatc

SEQ ID NO: 5600 - protein, 102 aa, Streptococcus pyogenes
MLTSKQRAFLKSEAHSLKPIVQIGKNGLNDHIKTSIRQALDARELIKVTLLQNTDEDIHEVAEILEEEIGCDTVLKIGRILILYKVSAKKENRKLSPKVKAI

SEQ ID NO: 5601 - DNA, 672 bp, Streptococcus agalactiae
gtgtttgtttttttagagatactacttgttcatggaggaattatggcactcgaattgctaacaccatttacaaaagttgaattagaagagaaaaagcgagatactaaccgaaaacaaattggaattatgggaggaaattttaaccctgttcataacgcccaccttgttgttgcagatcaagtacgtcagcaattgtgtttagaccaagttctgttgatgcctgaatttcagccaccacatattgataaaaaagagacaattgatgaacagcatcgtctcaagatgcttgaattagcaatagaaggcattgatggtttatctattgaaccaattgaaattgaacgtaaaggtatcagctatacatacgatacgatgaagcttctaattgaaaaaaatccagatgttgattattatttcattattggggcagatatggtggaatatctacctaagtggcatcgtattgatgaacttgttaaaatggtgcagtttgttggtgttcaacgtccaaaatataaagctggtacatcatatcccgttatttgggtggatctgccattgatggatatctcatcaagtatgattcgtcaatttattaaaagtaatcgtcagcccaactatttactgcctagagaggtattagattatatcaggaaagaaggtctttacaaa

SEQ ID NO: 5602 - protein, 224 aa, Streptococcus agalactiae
MFVFLEILLVHGGIMALELLTPFTKVELEEKKRDTNRKQIGIMGGNFNPVHNAHLVVADQVRQQLCLDQVLLMPEFQPPHIDKKETIDEQHRLKMLELAIEGIDGLSIEPIEIERKGISYTYDTMKLLIEKNPDVDYYFIIGADMVEYLPKWHRIDELVKMVQFVGVQRPKYKAGTSYPVIWVDLPLMDISSSMIRQFIKSNRQPNYLLPREVLDYIRKEGLYK

SEQ ID NO: 5603 - DNA, 630 bp, Streptococcus pyogenes
atggcattagaattgttgacgccttttacgaaggtggaattagaggaagaaaaaaaagaaagcaaccgcaaacagattgggattttaggagggaattttaatcctattcacaatgcacaccttgtggttgcagatcaagttcgccagcaattaggattagatcaggtgctattgatgcctgaatgtaaaccaccgcatgtggatgccaaagagactattgatgagaagcatcgtcttcgcatgttggaattggctattgaagatgttgaagggctagctattgaaacctgtgaacttgaacgtcagggaatcagctatacctatgatacgatgctttatttgactgagcagcatcctgatgttgatttttattttatcatcggagctgatatggttgattatttgccaaagtggcaccgtattgatgaactggtcaaactcgttcaatttgttggagttcaacgtccaaaatataaagctggaacctcttacccggtcatttgggtagatcttcctttgatagatatttcttctagtatgattagggattttattaaaaaaggtcgtcagcccaattatctcttacctaagcgggttttagactacattactcaagaaggtttgtatcaa

SEQ ID NO: 5604 - protein, 210 aa, Streptococcus pyogenes
MALELLTPFTKVELEEEKKESNRKQIGILGGNFNPIHNAHLVVADQVRQQLGLDQVLLMPECKPPHVDAKETIDEKHRLRMLELAIEDVEGLAIETCELERQGISYTYDTMLYLTEQHPDVDFYFIIGADMVDYLPKWHRIDELVKLVQFVGVQRPKYKAGTSYPVIWVDLPLIDISSSMIRDFIKKGRQPNYLLPKRVLDYITQEGLYQ

SEQ ID NO: 5605 - DNA, 585 bp, Streptococcus agalactiae
atgacctacaaagattacacaggtttagatcggactgaacttttgagtaaagtgcgtcatatgatgtccgacaaacgttttaatcatgtgttaggagtagagcgtgctgcaatagagttagcagaacggtatggttatgacaaggaaaaagcgggtctagctgctttattacatgattatgctaaggaactatctgatgatgaatttcttagattaattgataaataccaaccagatcccgacctaaaaaaatggggtaataatatttggcatggtcttgttggcatttataaaatacaagaggatctagctatcaaagatcaagatattttagctgctattgcaaaacatactgttggttcagcccaaatgtccacattggataaaatcgtttatgtagcagattacattgaacacaatcgagattttccaggagttgaagaagctcgtgagttagcgaaagttgaccttaataaagcagtagcttatgagactgctagaacagttgcgtttttagcaagtaaggctcagcctatctatcctaaaacgattgaaacctataatgcttatataccttatctcgac

SEQ ID NO: 5606 - protein, 195 aa, Streptococcus agalactiae
MTYKDYTGLDRTELLSKVRHMMSDKRFNHVLGVERAAIELAERYGYDKEKAGLAALLHDYAKELSDDEFLRLIDKYQPDPDLKKWGNNIWHGLVGIYKIQEDLAIKDQDILAAIAKHTVGSAQMSTLDKIVYVADYIEHNRDFPGVEEARELAKVDLNKAVAYETARTVAFLASKAQPIYPKTIETYNAYIPYLD

SEQ ID NO: 5607 - DNA, 591 bp, Streptococcus pyogenes
atgacatatgaagattatcttccttatagcaggaccgaactgttagcaaaaattgcagagcagatgagccctaaacggtttaaacatgtacttggcgtggaaaaggcagccttgtccttggcagagtgttatggttgtaacccagacaaagcagggttagcagctcttttacatgattatgccaaggagtgccctgaccaggtctttttagacttaattgacaagtaccaattatctccagaattagctaaatggaataataatgtctggcatggtatggttggtatttataagattcaagaagacctggggctaaaagacaaagatatcttgcgagctattgaaattcacaccgttggtgctgctgagatgaccttgctggataaggtcttatacgttgctgattatattgaagaaggtcgcatttttcctttggttgatgacgctagaaaaatcgcgaagctcgatttgaatcaggctgttgcctatgaaacagtgaacactgtcgcttatttagcctcaaaagcgcagcctattttcccacaaactctggatacctataatgcgttttgcagctatttaaaggaatac

SEQ ID NO: 5608 - protein, 197 aa, Streptococcus pyogenes
MTYEDYLPYSRTELLAKIAEQMSPKRFKHVLGVEKAALSLAECYGCNPDKAGLAALLHDYAKECPDQVFLDLIDKYQLSPELAKWNNNVWHGMVGIYKIQEDLGLKDKDILRAIEIHTVGAAEMTLLDKVLYVADYIEEGRIFPLVDDARKIAKLDLNQAVAYETVNTVAYLASKAQPIFPQTLDTYNAFCSYLKEY

SEQ ID NO: 5609 - DNA, 573 bp, Streptococcus agalactiae
ttgaataatggtcatgataggtttggcgatgcagtggtcattttggaggaaagtatgacttgtgcacttttactaattgatatccaacaaggtattatggataagaaaccaaagcatttaacaaattttgcagtgcttttagatgatttacttttaagtgccaaaggttctaattgtgaagtgatatggataaggcatcatgataaggaattgcctcaaggttctccacagtgggaaatttgggaacagcgacatcttgtgacgcatcacaaaataattgataaaacttacaatagttgttttaaagatactcatttacatgattacttgcaaagtaagcatattagtcaattaatcatgatgggacttcaaacagaatactgttttgatacatcagtaaaagttgcttttgaatatggttatgatatctttattccacaaggtggacacctaacatttgatacaccaactttaagtggggattctattaaaaaacattacgagaatatttggcatcatcgttttgcgacaatggtagcaaaagatagcttattgaaattaataaacgaggaa

SEQ ID NO: 5610 - protein, 191 aa, Streptococcus agalactiae
MNNGHDRFGDAVVILEESMTCALLLIDIQQGIMDKKPKHLTNFAVLLDDLLLSAKGSNCEVIWIRHHDKELPQGSPQWEIWEQRHLVTHHKIIDKTYNSCFKDTHLHDYLQSKHISQLIMMGLQTEYCFDTSVKVAFEYGYDIFIPQGGHLTFDTPTLSGDSIKKHYENIWHHRFATMVAKDSLLKLINEE

SEQ ID NO: 5611 - DNA, 354 bp, Streptococcus agalactiae
atgacagaaaaagacttactacagctagtcgttaaggctgcggatgaaaaacgagcagaagatattgtaattttagatttacagcctgtaacgagtgttgcagattactttgtgattatgagtgcaagtaatagtaggcagttagaagcaatcgcagacaatatccgtgaacaagtaaaaggaaatggtggggatgctagccaccttgaaggcgatagtaaagctggttgggtacttcttgacctcaatagcgtcgtggttcatatcttctctgaagatgagagacagcactataaccttgaaaaactttggcatgaagcaccattgcttgatgctgaagtctttatgacagaa

SEQ ID NO: 5612 - protein, 118 aa, Streptococcus agalactiae
MTEKDLLQLVVKAADEKRAEDIVILDLQPVTSVADYFVIMSASNSRQLEAIADNIREQVKGNGGDASHLEGDSKAGWVLLDLNSVVVHIFSEDERQHYNLEKLWHEAPLLDAEVFMTE

SEQ ID NO: 5613 - DNA, 399 bp, Streptococcus pyogenes
ttgcagctatttaaaggaatactaatggataatgatatgaggaataaaatgaaaaaagaagaactcttaaaaattgttgtggaagcaactgaggaaaagcgtgctaaagatattttagccttggatttagaggggttaactagtttgaccgattattttgtgattgcgagtgcaacaaacagtcgtcaattagaggctattgcggataatattcgtgaaaaggtaaaagaggctggtggagatgctagccatgttgaaggtaatagccaagcaggctgggtcttgcttgatttgaccgatgtggtggtacatctttttttagaagacgagcgttaccactataatcttgaaaaattgtggcatgaagcgcctgctgtggctctagatgcctatttagct

SEQ ID NO: 5614 - protein, 133 aa, Streptococcus pyogenes
LQLFKGILMDNDMRNKMKKEELLKIVVEATEEKRAKDILALDLEGLTSLTDYFVIASATNSRQLEAIADNIREKVKEAGGDASHVEGNSQAGWVLLDLTDVVVHLFLEDERYHYNLEKLWHEAPAVALDAYLA

SEQ ID NO: 5615 - DNA, 96 bp, Streptococcus agalactiae
gtgcaaatcgaacagactgaattcccgtaccacatgctaattccaaaagttttttcttaccttttggaaaatgacgaagtgaaaaatcagtccatt

SEQ ID NO: 5616 - protein, 32 aa, Streptococcus agalactiae
MQIEQTEFPYHMLIPKVFSYLLENDEVKNQSI

SEQ ID NO: 5617 - DNA, 732 bp, Streptococcus agalactiae
atggcaacgtatgaaacttttgcagctgtttatgatgctgtcatggatgatactttatatgctaaatggactgatttttcacttcgtcattttccaaaaggtaagaaaaaacttttggaattagcatgtggtacgggaattcagtctgttcgatttgcacaagctggttatgctgttacaggacttgatcttagtggcgatatgctgaaacttgccaaaaaacgtgcaacttctgctcaccaaagtatccagtttattgaaggaaatatgttagatttatctaatgttggtaaatatgatctcatcacgtgctattcagactctatttgttatatgcaagatgaagtcgaggttggtgatgtttttatcgaagtctataaggccttagaagaaaatggcgtctttatttttgatgttcattcgacttatcaaacagataaagtatttcctggttattcttatcatgaaaatgcagatgactttgctatggtgtgggatacttatgaagatgatgcacctcattctattgtccatgaattaacattttttgttcaagaagaagatggtcgatttacacgtcatgatgaagttcatgaagagcgtacttatgatattttgacttatgatattttacttgaacaggcaggttttaaagatgttaaggtgtatgcagattttgaagataaaaaaccaactgcaacttctgctcgctggttttttgtagctcataaa

SEQ ID NO: 5618 - protein, 244 aa, Streptococcus agalactiae
MATYETFAAVYDAVMDDTLYAKWTDFSLRHFPKGKKKLLELACGTGIQSVRFAQAGYAVTGLDLSGDMLKLAKKRATSAHQSIQFIEGNMLDLSNVGKYDLITCYSDSICYMQDEVEVGDVFIEVYKALEENGVFIFDVHSTYQTDKVFPGYSYHENADDFAMVWDTYEDDAPHSIVHELTFFVQEEDGRFTRHDEVHEERTYDILTYDILLEQAGFKDVKVYADFEDKKPTATSARWFFVAHK

SEQ ID NO: 5619 - DNA, 789 bp, Streptococcus pyogenes
atgttacaaagagaccttgtcaatacgacagggtttttgaggatgataatggaacataattatgaaaaatttgcgtcagtttatgatgctgtgatggatgattctctatatgacttgtggacagatttttcacttcgacatttaccaaagtctaagggtcgaaatcgtttgttagagttggcctgtggaaccggtattcagtcagttcgttttgctcaagcaggttttgatgtgactggtttagacttaagtcaagacatgctggctattgctaaaaagcgtgcgcaatctgctaaaaagaaaattgattttattcaaggtaacatgctggatttgtcacaggtggggcagtttgattttgtaacctgctattcggattccatttgctatatgcaagacgaagttgatgttggcgatgtttttaaagaagtttatgatgttttagcaaacgatggcatctttatttttgatgtgcattcaacctatcaaacggatgagtgtttccctggttattcctatcatgagaatgcagatgattttgcaatggtttgggatacctatgctgacgaggctcctcactctgttgttcacgaactcactttctttatccaagaagacgatggacgtttttctcgctttgatgaagtgcatgaggaacgaacgtatgagttattgacttatgatattttgttggaacaagcagggttcaagtcatttaaggtctatgctgattttgaagataaggagccaactaagaccagcaagcgttggttttttgtagcatataaa

SEQ ID NO: 5620 - protein, 263 aa, Streptococcus pyogenes
MLQRDLVNTTGFLRMIMEHNYEKFASVYDAVMDDSLYDLWTDFSLRHLPKSKGRNRLLELACGTGIQSVRFAQAGFDVTGLDLSQDMLAIAKKRAQSAKKKIDFIQGNMLDLSQVGQFDFVTCYSDSICYMQDEVDVGDVFKEVYDVLANDGIFIFDVHSTYQTDECFPGYSYHENADDFAMVWDTYADEAPHSVVHELTFFIQEDDGRFSRFDEVHEERTYELLTYDILLEQAGFKSFKVYADFEDKEPTKTSKRWFFVAYK

SEQ ID NO: 5621 - DNA, 1107 bp, Streptococcus agalactiae
atgacagttacaggaattgttgccgaatttaatccctttcataatgggcataagtaccttttagaacaagctcaaggcataaaagtaatagccatgtcgggtaattttatgcaacgtggtgagccggcgattgtagataaatggacccgttcccagatggcactagaaaatggtgctgatttagtgattgaactcccttttctggtttcggtacagtcagcggattatttcgctagtggagctgtgtctatcctggcacgattaggtgtggataacttatgcttcggtaccgaagaaatgcttgattatgcccgtattggggatatttatgtgaataaaaaagaggagatggaagcttttttgaaaaaacaatcggattctctttcctatccacaaaaaatgcaagctatgtggcaagaatttgcagggattacattttcgggacaaaccccaaatcacattttaggcttagcctacaccaaagcagctagccaaaatggtattcgattaaatccgatacaacgtcaaggagctggttatcattcatcagaaaaaacagagatatttgcttctgcaacaagtcttcgtaaacatcaatctgatcgtttctttgtagaaaaaggtatgcctaacagtgacttgtttttgaatagtccacaagtagtttggcaagattattttagtttactcaaatatcagataatgacgcattctgatttgacacaaatttatcaagtgaatgaagagatagccaatcgtataaaaagtcaaattcgttatgtggagactgtggatgagttagttgataaagtcgcaactaaacggtataccaaagcaagaattcgacgtttattaacctatatcttgataaatgctgtggaaagtcctataccaaatgctattcatgtcttaggttttacacaaaaaggtcaacagcatttaaagtctgtgaagaagtctgtggatatcgtgacgaggattggttcacaaacgtgggatagtttgacgcaacgagcagattctgtttatcagatgggaaatgctaatatagcagagcaaacatggggacgtatccctttttatcaacctgttagtcaaagtgacctt

SEQ ID NO: 5622 - protein, 369 aa, Streptococcus agalactiae
MTVTGIVAEFNPFHNGHKYLLEQAQGIKVIAMSGNFMQRGEPAIVDKWTRSQMALENGADLVIELPFLVSVQSADYFASGAVSILARLGVDNLCFGTEEMLDYARIGDIYVNKKEEMEAFLKKQSDSLSYPQKMQAMWQEFAGITFSGQTPNHILGLAYTKAASQNGIRLNPIQRQGAGYHSSEKTEIFASATSLRKHQSDRFFVEKGMPNSDLFLNSPQVVWQDYFSLLKYQIMTHSDLTQIYQVNEEIANRIKSQIRYVETVDELVDKVATKRYTKARIRRLLTYILINAVESPIPNAIHVLGFTQKGQQHLKSVKKSVDIVTRIGSQTWDSLTQRADSVYQMGNANIAEQTWGRIPFYQPVSQSDL

SEQ ID NO: 5623 - DNA, 1104 bp, Streptococcus pyogenes
atgactgttaccggaattatagctgagtttaatccgtttcacaatggacacaaatatttgctagaaacagcagagggactaaaaattattgctatgtcaggaaattttatgcaaagaggagagcctgctcttattgataaatggattcgatcagagatggctcttaaaaatggtgcagatattgttgtggaattgccctttttcgtttcagttcaatcagcagactattttgctcaaggagctattgatattctttgtcaattaggaattcagcaattagcatttgggacagagaatgtgattgattatcaaaaactgattaaggtctatgagaaaaaatcagagcaaatgactgcctatttatcgacgcttgaagatacatttagctatccacaaaaaacacaaaaaatgtgggaaatctttgctggagttaaattttcagggcaaacgccaaatcatattttggggttaagttacgcaaaggctagcgctggaaagcatatacaactatgtcctatcaagcgtcaaggggctgcctaccattcgaaagacaaaaatcatctgctagcttctgcaagtgccattagacagcacctgaatgattgggatttcataagtcattcagtaccaaatgcaggtttacttataaacaatccccatatgtcatgggaccattatttttcattcttaaaatatcaaattctgaaccattctgatttaactagtatttttcaggtcaatgatgaattggcaagtcgtattaaaaaagcgataaaagttagtcaaaatattgaccacctagttgacactgttgctaccaaacgctatacaaaagctcgtgtaagacgtattttaacctacattttggttaatgctaaggaacctactttacctaaaggaattcatattctagggtttacctcaaaaggacaagcacatttaaaaaaattaaaaaaaagcaggcctctgattactagaattggagcagaaacttgggatgagatgacacaaaaagcagacagcatctatcaacttgggcatcaggatatcccagaacaaagttttggaagaatacctattataataaaaaatgagaggctcaat

SEQ ID NO: 5624 - protein, 368 aa, Streptococcus pyogenes
MTVTGIIAEFNPFHNGHKYLLETAEGLKIIAMSGNFMQRGEPALIDKWIRSEMALKNGADIVVELPFFVSVQSADYFAQGAIDILCQLGIQQLAFGTENVIDYQKLIKVYEKKSEQMTAYLSTLEDTFSYPQKTQKMWEIFAGVKFSGQTPNHILGLSYAKASAGKHIQLCPIKRQGAAYHSKDKNHLLASASAIRQHLNDWDFISHSVPNAGLLINNPHMSWDHYFSFLKYQILNHSDLTSIFQVNDELASRIKKAIKVSQNIDHLVDTVATKRYTKARVRRILTYILVNAKEPTLPKGIHILGFTSKGQAHLKKLKKSRPLITRIGAETWDEMTQKADSIYQLGHQDIPEQSFGRIPIIIKNERLN

SEQ ID NO: 5625 - DNA, 711 bp, Streptococcus agalactiae
atgaaaacagttaaagaaataagtcacatttctggtattagtgtgcgcacacttcattattatgatgaaatagatttgttatctccttcatttgtaggagagaatggttatcgttactatgatgatgaatcactgattaagttacaagaaattttgttatttaaggaactggaatttcctcttaaaaaaataaaagagataatggatagtccaaattatgatcgtaatcaagcacttcttgatcaaattaggtggctggaactaaagaaacagcgactagaagaagtaattgaacatgcaaagtctatccagaggggtaaaaatatgtcagattttacagcttataatcaagaagaattagaagcatttcaagaggaagctagaacacgctggggggatacagatagttacaaagaatttgaaaatagccatagtaagaatgatttttcaatgatttcacaagctatgagtcagatttttaaagactttggacagttgaaagaactttctccgacagatgagaaagttcaaaaacaagttcagattttacaagattatatcacagctcagttttacaactgcactaacgatttattagcaagtcttggaataatgtacatccaagatgagcgtttccaaaagtctattgataattggggaggccagggaacagcattatttgtttctaaagctatagatagctattgtcat

SEQ ID NO: 5626 - protein, 237 aa, Streptococcus agalactiae
MKTVKEISHISGISVRTLHYYDEIDLLSPSFVGENGYRYYDDESLIKLQEILLFKELEFPLKKIKEIMDSPNYDRNQALLDQIRWLELKKQRLEEVIEHAKSIQRGKNMSDFTAYNQEELEAFQEEARTRWGDTDSYKEFENSHSKNDFSMISQAMSQIFKDFGQLKELSPTDEKVQKQVQILQDYITAQFYNCTNDLLASLGIMYIQDERFQKSIDNWGGQGTALFVSKAIDSYCH

SEQ ID NO: 5627 - DNA, 402 bp, Streptococcus agalactiae
atgaaaggatttcatgggaatatcgaaaaattgacactaggaaatacaaatttccgccaagtcctctataccgcagaacattgtcaactcgttttaatgacactgcctgttggtggagaaattggtagcgagattcatgcagaaaatgatcagtttttccgttttgaagctggtcatggtaaggttgtcattgatggtaatgaatatgaagttgcagatggagacgctataatagttccggcaggtgctgaacataacgtaattaacacttctgaaactgagatgttaaaactctatacaatttacagtccagctcatcacaaagatggtattatccgtgccacaagagaagaagctgaagaaaatgaagaagattttgatggagttactactgaaactaaa

SEQ ID NO: 5628 - protein, 134 aa, Streptococcus agalactiae
MKGFHGNIEKLTLGNTNFRQVLYTAEHCQLVLMTLPVGGEIGSEIHAENDQFFRFEAGHGKVVIDGNEYEVADGDAIIVPAGAEHNVINTSETEMLKLYTIYSPAHHKDGIIRATREEAEENEEDFDGVTTETK

SEQ ID NO: 5629 - DNA, 711 bp, Streptococcus agalactiae
atgactcaatttcttggggaatttttaggaacatttattttggttcttcttggggatggcgtagttgcaggaaatgtgctcagtaaaaccaaagaagaaggaactggatggactgctattgtttttggctggggaattgcttgtaccgttgctgtttatgtttctggattattcagtcccgctcatctaaatccagcagtcacattagcaatggcttctattggagcaatttcttggggacaagttatcccctttatcattgcacagatgttaggagcaatggttgcggcaactattttatggttacactattatcctcattggaaagaaacaaaagatagtggacttatccttgccagcttctcaaccggacctgctatccgccatacaccatcgaatctccttggtgaaattatcggtactgctattcttgtgattacaattatggcaattggtcctagtaaagttgcagcaggtcttggtccaattatcgttggtatagttattttcgcagtaggattctctcttgatccaacaactggttatgctattaaccctgcacgtgacctagggcctcgtcttatgcatgctatcttacctattgaaaataagggtaactcagattggtcatacgcttggattccagttgtaggtccaattatcggcggtgtccttggggctatcttatacaatattgctttgactttagtt

SEQ ID NO: 5630 - protein, 237 aa, Streptococcus agalactiae
MTQFLGEFLGTFILVLLGDGVVAGNVLSKTKEEGTGWTAIVFGWGIACTVAVYVSGLFSPAHLNPAVTLAMASIGAISWGQVIPFIIAQMLGAMVAATILWLHYYPHWKETKDSGLILASFSTGPAIRHTPSNLLGEIIGTAILVITIMAIGPSKVAAGLGPIIVGIVIFAVGFSLDPTTGYAINPARDLGPRLMHAILPIENKGNSDWSYAWIPVVGPIIGGVLGAILYNIALTLV

SEQ ID NO: 5631 - DNA, 372 bp, Streptococcus agalactiae
atgtctgatattggtattattgttgtttctcactctaaaaatattgctcaaggagttgttgatcttatttcagaggtagcaaaggatgtctcaataacttacgtgggtggaacagaagatggtgagattggtacttcttttgatcaagttcaacagattgtagagcaaaatgataaaaagacgttattagctttctttgatttaggttcagcaaaaatgaatttagagttagtagctgatttttcagaaaaaaatattatcattaactctgtcccagtagtggagggagcttacaccgctgctgctcttctacaggcaggtgctgacctggatagtattcaatcacaattagctgaattaactatcaataaa

SEQ ID NO: 5632 - protein, 124 aa, Streptococcus agalactiae
MSDIGIIVVSHSKNIAQGVVDLISEVAKDVSITYVGGTEDGEIGTSFDQVQQIVEQNDKKTLLAFFDLGSAKMNLELVADFSEKNIIINSVPVVEGAYTAAALLQAGADLDSIQSQLAELTINK

SEQ ID NO: 5633 - DNA, 576 bp, Streptococcus agalactiae
atggaagtaaaaactgcaatagaatggatgcacacttttaaccaaaaaattcaatccaacaaggactatttatccgaactagatactccaataggtgatggcgaccatggtggcaatatggcgcgtggtatgactgctgttattgaaaaccttgataacaatgaatttagtagtgctgccgatgttttcaaaaccgtgtccatgcaacttttaagcaaagtaggcggagcatctggaccactctatggttctgcatttatgggaattacaaaagctgaacagagtaaaagtaccatttcagaggcacttggcgcaggacttgaaatgattcaaaaacgtggtaaagctgaacttaatgaaaaaacaatggttgatgtttggcacggtgttattgaagcgattgaaaaaaatgaattgactgaagaccgtatcgattccttagtagatgctacaaaagggatgaaagcaacaaaaggacgcgcttcttatgttggagaacgctcagtaggacacattgatccaggatcattttcttcaggattattatttaaagcattactagaagttggaggtgtc

SEQ ID NO: 5634 - protein, 192 aa, Streptococcus agalactiae
MEVKTAIEWMHTFNQKIQSNKDYLSELDTPIGDGDHGGNMARGMTAVIENLDNNEFSSAADVFKTVSMQLLSKVGGASGPLYGSAFMGITKAEQSKSTISEALGAGLEMIQKRGKAELNEKTMVDVWHGVIEAIEKNELTEDRIDSLVDATKGMKATKGRASYVGERSVGHIDPGSFSSGLLFKALLEVGGV

SEQ ID NO: 5635 - DNA, 1662 bp, Streptococcus pyogenes
gtgtcaaatattacaacaagcttattccaagaaatggtccaagcggcagcgactcgccttggcaaacaagcagaatatgttaattccttaaatgtttttcctgttccagatggtgatacaggaacaaacatgagcatgactatggacaatggtgccaaggaagttgctgataaacctgcgtcaactgtgggagaagttggacaaatgttatcaaaaggtcttttgatgggagcgcgtggaaattctggagttattacttcacaactttttcgtggttttggtcaaagcattaagggaaaagatgagctgacaggtaaagatttggcacaagcctttcaagtgggtgtagaagttgcctacaaagcagtgatgaaacctgttgaaggaacaattttaactgtttctcggggtgcagcgactgctgccttaaaaaaagcagatcttacagacgacgccgtggaagtcatgcaagctgctttagacggtgccaaaggtgcccttgctaagacacctgatttattaccagtccttaaagaagttggtgtggttgattcaggcggtcaaggtcttgtctttatctatgaaggtttcctatctgctttgaatggcgactatgtgacttcagcagactttaaagcgactcctgctaacatgtctgaaatgattaatgctgagcatcacaaatccgttgttggtcatgtggctactgaagacattacctacggttattgtactgaaatcatggttgcccttaaacaaggcccaacctatgtgaaagaattcaactatgatgagtttcaaggctaccttagtggccttggtgactcgctgttagtggtcaatgatgatgagattgttaaagttcacgtccatactgaagaccccggacttgtgatgcaagaaggtcttaaatatggttcgctcatcaagattaaagtggacaatatgcgtaaccagcatgaagcacaggttcaaaagactgatgtcgaaaaaaacaaggctgaagtaaaagactttggcttgattgcagtagtagctggagaaggtttatctgaaattttcaaggcgcaaggtgttgattacgtgatttctggtggtcaaaccatgaatccatctacagaagatattgttaaagctattgaagcagttaatgccaaacaagtcattatcttgccaaacaataaaaatatctttatggctgcccaatctgctgcagaagtggtggatattccggctgctgttgttgcaacacgtactgttccgcaaggatttaccagcttgttggcctttgatccttcaaaatctttagaggacaatgtagcagatatgtcaactagtctttctgacgtggtcagtggaagcgttactttggcagtccgtgacaccaccattgatggtttagaaatccatgaaaatgatttcttgggaatggttgatggtaaaatcatcgtttcaaacccagacatggaagcaactctaaaagctgcctttgaaaagatgattgacgaagatagcgagattgtgactatctttgttggtgaagaaggtgatcaagacttagcagaagaacttgctgggtatttaggagagacttacgaagatgtggaagttgagatccatcaaggagatcagcctgtttacccatatctcatgagtgtagaa

SEQ ID NO: 5636 - protein, 554 aa, Streptococcus pyogenes
VSNITTSLFQEMVQAAATRLGKQAEYVNSLNVFPVPDGDTGTNMSMTMDNGAKEVADKPASTVGEVGQMLSKGLLMGARGNSGVITSQLFRGFGQSIKGKDELTGKDLAQAFQVGVEVAYKAVMKPVEGTILTVSRGAATAALKKADLTDDAVEVMQAALDGAKGALAKTPDLLPVLKEVGVVDSGGQGLVFIYEGFLSALNGDYVTSADFKATPANMSEMINAEHHKSVVGHVATEDITYGYCTEIMVALKQGPTYVKEFNYDEFQGYLSGLGDSLLVVNDDEIVKVHVHTEDPGLVMQEGLKYGSLIKIKVDNMRNQHEAQVQKTDVEKNKAEVKDFGLIAVVAGEGLSEIFKAQGVDYVISGGQTMNPSTEDIVKAIEAVNAKQVIILPNNKNIFMAAQSAAEVVDIPAAVVATRTVPQGFTSLLAFDPSKSLEDNVADMSTSLSDVVSGSVTLAVRDTTIDGLEIHENDFLGMVDGKIIVSNPDMEATLKAAFEKMIDEDSEIVTIFVGEEGDQDLAEELAGYLGETYEDVEVEIHQGDQPVYPYLMSVE

SEQ ID NO: 5637 - DNA, 987 bp, Streptococcus agalactiae
atgaaaaaaattctcaatcaaccaactgatgttgttactgaaatgctagatggattagcatatgttcataatgatttagtacatcgcatagaaggttttgatatcattgctcgcaatgaagagaagtcaggaaaagtggctctcatttctggcggaggaagtggacatgagccttcacatgctggtttcgtaggcgaaggaatgttatctgcagctgtgtgtggtgcagtatttacttctccaactcctgaccaagttcttgaagcaattaaagaagctgatgagggggctggagttttcatggttatcaaaaattattcaggggatatcatgaactttgaaatggcacaagatatggctgaaatggaaggcatagaagttgcaagtgtggtcgttgatgatgatattgcagtcgaagacagtctttacacacaaggaaaacgtggtgtagctggtacgatactcgtccataaaattctaggacatgctgctcgtcatggcaaatcacttcaggaaatcaaagctattgctgatgaattagtaccaaacattcacactgttggacttgcactaagcggggctactgttcctgaagtaggcaagccaggatttgttcttgcagaagatgaaattgaatttggtatcggtattcatggtgaaccaggttatcgtaaagaaaaaatgcaaccttcaaaggctttagcgacagaattagttgataagttaattgaatcgttcgatgctaaatctggcgaaaaatatggtgtccttattaacggtatgggtgcaaccccacttatggaacaatatgtctttgctaacgatgttgccaaactccttgaggataaaggcattgaagtgaattacaaaaaacttggtaactatatgacttcaattgatatggctggtttatcactaaccttgattaaactggaaaatcaagagtggttagaagcacttaatagtgacgttacaaccattgcttgg

SEQ ID NO: 5638 - protein, 329 aa, Streptococcus agalactiae
MKKILNQPTDVVTEMLDGLAYVHNDLVHRIEGFDIIARNEEKSGKVALISGGGSGHEPSHAGFVGEGMLSAAVCGAVFTSPTPDQVLEAIKEADEGAGVFMVIKNYSGDIMNFEMAQDMAEMEGIEVASVVVDDDIAVEDSLYTQGKRGVAGTILVHKILGHAARHGKSLQEIKAIADELVPNIHTVGLALSGATVPEVGKPGFVLAEDEIEFGIGIHGEPGYRKEKMQPSKALATELVDKLIESFDAKSGEKYGVLINGMGATPLMEQYVFANDVAKLLEDKGIEVNYKKLGNYMTSIDMAGLSLTLIKLENQEWLEALNSDVTTIAW

SEQ ID NO: 5639 - DNA, 534 bp, Streptococcus agalactiae
atgacttcttcgcttattactaagaaaaaaatagccaagtcatttaaacgtttatttatttcgcaagcttttgacaaaatatcggtgagtgatattatggaagatgcaggtattagacgtcaaacattttataatcactttgttgataaatatgctttattagaatggattttccaaacagaattaagcgaacaagttacggataatttagactatatctcaggttttcagttgttatcagagttgttgactttttttaaaatgaatcaagaattctatattaaattatttcaaattgaagatcaaaatgatttttcttcgtattttgagtcttactgtgagcagttagtagataagcttctttctgattatagtaaatctaactttaatcagaaagaaagagttacatttattaattatcatagtaaagccctctcttattttataaaatatgagttaataaataactcaaaagaagaattatttaataggaaagtcattgaaaaaattatcagaacatcaatagaaaattat

SEQ ID NO: 5640 - protein, 178 aa, Streptococcus agalactiae
MTSSLITKKKIAKSFKRLFISQAFDKISVSDIMEDAGIRRQTFYNHFVDKYALLEWIFQTELSEQVTDNLDYISGFQLLSELLTFFKMNQEFYIKLFQIEDQNDFSSYFESYCEQLVDKLLSDYSKSNFNQKERVTFINYHSKALSYFIKYELINNSKEELFNRKVIEKIIRTSIENY

SEQ ID NO: 5641 - DNA, 540 bp, Streptococcus pyogenes
atgaccaaaagacatactgaaaccaaagcttatgtaaagaccgccttaaccaccttactaactgaacaatcttttgaaactcttactgtctctgaccttactaaaaaggctggtatcaatagaggaaccttctacctccactacactgataaatttgacatgatgaatcacttcaaaaatgacactctggatgatttgtaccgtttgttaaatcaggctgaaatctacacagacactcgacaagtcctcaatcaaaccttgtcctaccttatagaacatagagaatttataaccgcactcgctactatttcttacctcaaatttccgcaactcatcaaggatttctgttaccaatttttgactactattactggtttccaagacattgtgaccaatcaataccatattccttatccctatgctttagaagtttaccttgccagtattgagagcattatcagctattggattgctaatggctatcaagaaaccactgaagaggttgccgatattattctcaaagcagttactctagacaat

SEQ ID NO: 5642 - protein, 180 aa, Streptococcus pyogenes
MTKRHTETKAYVKTALTTLLTEQSFETLTVSDLTKKAGINRGTFYLHYTDKFDMMNHFKNDTLDDLYRLLNQAEIYTDTRQVLNQTLSYLIEHREFITALATISYLKFPQLIKDFCYQFLTTITGFQDIVTNQYHIPYPYALEVYLASIESIISYWIANGYQETTEEVADIILKAVTLDN

SEQ ID NO: 5643 - DNA, 144 bp, Streptococcus agalactiae
gtggctgacttacttgctacacctaaagtagccattgaagttgtcaaagatagtcctagctgttctaattcatctaagcttgctccttctaaagcagcttgtccaataattttatgtagcaacacagtaccagcaacgcctcga

SEQ ID NO: 5644 - protein, 48 aa, Streptococcus agalactiae
MADLLATPKVAIEVVKDSPSCSNSSKLAPSKAACPIILCSNTVPATPR

SEQ ID NO: 5645 - DNA, 984 bp, Streptococcus agalactiae
atgagaaaaacagaacatcataaaatggaatatgtttttgaaacaataaaagcaatcactaaaactaatcctaaagtagagcaaataaaagatttgcccgctattcattatttagggcaatccgagcaagtaattccgattttatcaggaggaggcagcggacatgagccggctcactttggatatgttggtgagggaatgctatcggcagcgattagtggtcctatttttgtaccaccatgtgctagtgatattctagagactattagatttatcaatcgaggcaaaggtgtctttgttattatcaaaaattttgaagctgatttggaagaattttcccaagcgattgaacaggctcgtcaagaaggcattccaatcaaatacatcgtttctcatgatgacatctctgttgaaacatcaaattttaaaattcgtcatcgaggcgttgctggtactgtgttgctacataaaattattggacaagctgctttagaaggagcaagcttagatgaattagaacagctaggactatctttgacaacttcaatggctactttaggtgtagcaagtaagtcagccactattttaggtcagcatcaacctgtttttgatatagaagaaggttacatctcatttggaatcggtattcatggtgagccaggataccggacaatgcctttcgtgtccatggaacatttggcaaacgaactagttaacaaattgaaaatgaaattacgttggcaagatggagaagcattcattctattgataaataatcttggaggaagttctaaaatggaggaattactttttacaaatgctgtcatggaatttctggctttagacgatttacaattaccttttattaaaacaggccacctaattacaagtttagatatggctggtttatcagttaccttgtgtcgtgtaaaggatagtagatggattgattacttaaaacataagacagatgctagagcttgg

SEQ ID NO: 5646 - protein, 328 aa, Streptococcus agalactiae
MRKTEHHKMEYVFETIKAITKTNPKVEQIKDLPAIHYLGQSEQVIPILSGGGSGHEPAHFGYVGEGMLSAAISGPIFVPPCASDILETIRFINRGKGVFVIIKNFEADLEEFSQAIEQARQEGIPIKYIVSHDDISVETSNFKIRHRGVAGTVLLHKIIGQAALEGASLDELEQLGLSLTTSMATLGVASKSATILGQHQPVFDIEEGYISFGIGIHGEPGYRTMPFVSMEHLANELVNKLKMKLRWQDGEAFILLINNLGGSSKMEELLFTNAVMEFLALDDLQLPFIKTGHLITSLDMAGLSVTLCRVKDSRWIDYLKHKTDARAW

SEQ ID NO: 5647 - DNA, 771 bp, Streptococcus agalactiae
ttgcttgccaatatgagccagcaggttattaaaaatgaaatcaaaggagattttccaatgggacgtaagtgggccaatattgttgccaaaaagactgctaaagatggtgctaactcaaaagtatacgctaaattcggtgttgaaatatatgttgctgcaaagcaaggtgaaccagaccccgagtcaaactcagctctaaaattcgttttggaccgtgctaagcaagcacaagttccaaagcatgttattgataaagcgattgataaagccaaaggaaacacagatgaaactttcgtagagggacgctatgaaggttttggtccaaatggttcaatgattattgtggatactttgacatcaaatgttaaccgtacggcagcaaatgtacgtactgcttacggtaagaacggtggcaatatgggagcttcaggatcggtatcctacttatttgataaaaaaggtgtcatcgtttttgctggtgatgatgctgacactgtcttcgaacaattacttgaagcggatgtagacgtagatgatgttgaagcagaagagggaacaataacagtttataccgccccaacagatcttcataaaggtatccaagcacttcgcgataatggtgtagaagaattccaagttactgaacttgaaatgattcctcaatcagaagtagtattggaaggtgatgaccttgaaacttttgaaaagcttattgacgcactcgaatcagatgatgatgttcaaaaagtttatcataatgtagcagatttc

SEQ ID NO: 5648 - protein, 257 aa, Streptococcus agalactiae
MLANMSQQVIKNEIKGDFPMGRKWANIVAKKTAKDGANSKVYAKFGVEIYVAAKQGEPDPESNSALKFVLDRAKQAQVPKHVIDKAIDKAKGNTDETFVEGRYEGFGPNGSMIIVDTLTSNVNRTAANVRTAYGKNGGNMGASGSVSYLFDKKGVIVFAGDDADTVFEQLLEADVDVDDVEAEEGTITVYTAPTDLHKGIQALRDNGVEEFQVTELEMIPQSEVVLEGDDLETFEKLIDALESDDDVQKVYHNVADF

SEQ ID NO: 5649 - DNA, 714 bp, Streptococcus pyogenes
atgggacgtaaatgggcaaatattgttgctaaaaaaactgctaaagatggagcaacatcaaaggtctatgccaaatttggtgttgaaatttatgtggctgccaaacaaggcgagccagatccagagttaaatacagctcttaaatttgtcattgatcgtgcaaagcaagcacaagtgccaaagcatgttattgataaagcgattgataaagctaaaggaaacacagatgaaactttcgtagagggacgctatgaaggttttggtccaaatggttcaatgattattgtggatactttgacatcaaatgttaaccgtacagcggcaaatgtacgtacggcttacggtaagaacggtggcaatatgggagcttcaggatctgtatcctacttatttgataaaaaaggggtcatcgtttttgctggtgatgatgctgacagtgtctttgaacaattacttgaagcggatgtagacgtagatgatgttgaagcagaagagggaacaataacagtttacactgccccaacagatcttcataaaggtatccaagcacttcgcgataatggtgtagaagaattccaagttactgaacttgaaatgattcctcaatcagaagtagttttggaaggtgatgaccttgaaacttttgaaaagcttattgatgcacttgaatcagatgatgatgttcaaaaagtgtatcataatgtagcagatttt

SEQ ID NO: 5650 - protein, 238 aa, Streptococcus pyogenes
MGRKWANIVAKKTAKDGATSKVYAKFGVEIYVAAKQGEPDPELNTALKFVIDRAKQAQVPKHVIDKAIDKAKGNTDETFVEGRYEGFGPNGSMIIVDTLTSNVNRTAANVRTAYGKNGGNMGASGSVSYLFDKKGVIVFAGDDADSVFEQLLEADVDVDDVEAEEGTITVYTAPTDLHKGIQALRDNGVEEFQVTELEMIPQSEVVLEGDDLETFEKLIDALESDDDVQKVYHNVADF

SEQ ID NO: 5651 - DNA, 111 bp, Streptococcus agalactiae
ttgataggtattgttaaagaagtgataggtaaaaaatattattcaaaaagtttttttaggtgtaaaatgataattattagacagttgttggttgatgagggagcaaaatgt

SEQ ID NO: 5652 - protein, 37 aa, Streptococcus agalactiae
MIGIVKEVIGKKYYSKSFFRCKMIIIRQLLVDEGAKC

SEQ ID NO: 5653 - DNA, 687 bp, Streptococcus agalactiae
atgttaacaaagcctattattggtattacaggaaatgaaagagaaatgtcagatattccaggttattattatgattcggtatctaggcatatttcggaaggagttaaaaacgcaggcgggttaccagttatcctaccaataagtgaagcagaaagtgccaaagcttatgttgagatgatagataagctgatcatatctggtggccaaaatgttttaccatcctattatggtgaagagaagataattgagagtgatgattattcacttgcgcgtgatatttttgaatttgcattagtcgaagaagcgttgaaacaaaataaaccaatctttgcgatttgccgtggcatgcagttagtaaatgtggcgcttggtggtacacttaatcaatctattgataatcactatcaagagccttacattggatttgctcattatttaaatgtggaaaaagggagttttctagaaggctttatatcaggtgattttaagatcaattctcttcatagacaaagtgttaaactgttagctgaaggtctgatagttagtgctagagatcctagagatgggacagtagaagcttatgaaagtcgaacagaacaatgtattataggtgttcaatggcatccagaattaatgcttcaccaaattgaaaaccaaaccttatttggttattttgttaatgaaacg

SEQ ID NO: 5654 - protein, 229 aa, Streptococcus agalactiae
MLTKPIIGITGNEREMSDIPGYYYDSVSRHISEGVKNAGGLPVILPISEAESAKAYVEMIDKLIISGGQNVLPSYYGEEKIIESDDYSLARDIFEFALVEEALKQNKPIFAICRGMQLVNVALGGTLNQSIDNHYQEPYIGFAHYLNVEKGSFLEGFISGDFKINSLHRQSVKLLAEGLIVSARDPRDGTVEAYESRTEQCIIGVQWHPELMLHQIENQTLFGYFVNET

SEQ ID NO: 5655 - DNA, 693 bp, Streptococcus pyogenes
atgaccaaaccgattattggaataactgcaaatcaaagactaaatatggctttggataatctcccatggtcatatgcacctactggatttgtacaggcagtcactcaatctggggggctgccgcttcttttacccattggtgatgaagccgccgctaaaacttatgtatctatggttgataaaatcattttaattggtgggcaaaacgttgacccaaaatattatcaagaagagaaggctgcttttgatgatgatttttcaccagagcgagacacatttgagctagctatcatcaaggaggctataacattaaaaaaaccaatcttagggatttgtcgtggtacacagttaatgaatgttgccttaggaggaaatcttaaccaacacattgactcacattggcaagaagcgccttctgatttcttatcacacgaaatgattattgagccagactctatcttatatcctatttatggtcataagacattaattaattcttttcatcgccaaagtttaaaaactgttgctaaggatttaaaagtaatcgctagggatccacgtgatggtaccatcgaagcagtcatatcaaccaacgatgccattccttttttaggtgttcagtggcatcctgaacttctccaaggtgttcgagatgaagatttacaattgttccgcttattcgtcaatgacttc

SEQ ID NO: 5656 - protein, 231 aa, Streptococcus pyogenes
MTKPIIGITANQRLNMALDNLPWSYAPTGFVQAVTQSGGLPLLLPIGDEAAAKTYVSMVDKIILIGGQNVDPKYYQEEKAAFDDDFSPERDTFELAIIKEAITLKKPILGICRGTQLMNVALGGNLNQHIDSHWQEAPSDFLSHEMIIEPDSILYPIYGHKTLINSFHRQSLKTVAKDLKVIARDPRDGTIEAVISTNDAIPFLGVQWHPELLQGVRDEDLQLFRLFVNDF

SEQ ID NO: 5657 - DNA, 102 bp, Streptococcus agalactiae
atgatgtcgtgtacaattaaagaggagaaaaaagatgacaataaaaaaagtgttaagtgtaacaggaattattttagtgacagtagcgtctctagctgcttg

SEQ ID NO: 5658 - protein, 34 aa, Streptococcus agalactiae
MMSCTIKEEKKDDNKKSVKCNRNYFSDSSVSSCL

SEQ ID NO: 5659 - DNA, 498 bp, Streptococcus agalactiae
gtgacagtagcgtctctagctgcttgtagctcaaaatctcatactactaagacgggcaaaaaagaagttaattttgcaactgttggaacaacggcacctttttcttatgtgaaggatgggaaactgactggctttgatattgaagtagccaaagctgtttttaaaggttcagataactataaagtcacttttaaaaaaacagaatggtcatcggtatttaccggcattgattcaggaaagtttcaaatgggtggaaataatatttcttattcatcagagagatctcaaaaatatttattttcatacccaataggctctactccttcagttttagcagttcctaagaatagtaatatcaaagcttataatgatattagtggtcataaaacacaggttgtccaaggaacgacaactgccaagcaattagaaaatttcaataaagagcatcagaaaaatcctgttactctaaaatatactaatgaaaatttacacagattc

SEQ ID NO: 5660 - protein, 166 aa, Streptococcus agalactiae
MTVASLAACSSKSHTTKTGKKEVNFATVGTTAPFSYVKDGKLTGFDIEVAKAVFKGSDNYKVTFKKTEWSSVFTGIDSGKFQMGGNNISYSSERSQKYLFSYPIGSTPSVLAVPKNSNIKAYNDISGHKTQVVQGTTTAKQLENFNKEHQKNPVTLKYTNENLHRF

SEQ ID NO: 5661 - DNA, 282 bp, Streptococcus agalactiae
ttgagtgatggaaaagctgattttaaactttttgacggaccaactgttaacgctatcataaagaatcaaggtctcacgaatttaaaaaccatccctttgactatgagagatcagccttatatttatttcatctttggtcaggatcaaaaagacttgcaaaagtatgtgaataatcgccttaaacaattacgtaaagatgggacactttcaaaaatagctaaagaataccttggaggtgattacgtaccaaatgagaaagatctcgttactcctaaggagaag

SEQ ID NO: 5662 - protein, 94 aa, Streptococcus agalactiae
MSDGKADFKLFDGPTVNAIIKNQGLTNLKTIPLTMRDQPYIYFIFGQDQKDLQKYVNNRLKQLRKDGTLSKIAKEYLGGDYVPNEKDLVTPKEK

SEQ ID NO: 5663 - DNA, 882 bp, Streptococcus agalactiae
ttgattctaataacttcctatgggataatatctttatcacaaaaattgagggaatttattatgaagttaaaacatattgtcttaggattagccttaacaacacttttaggagtcacatttagtaatcaagaagtttcagcaagctcaacttcaagtaaagttgttaaagttggtgttatgaccttttctgacactgaaaaagcacgttgggataaaattgaaaagctagtaggtgataaagctaaaatcaaatttacagaatttacagattatacacaaccaaatcaagcgacagccaataaggatgtggatattaatgcctttcaacattacaatttcttagaaaactggaataaggaaaataagaaaaacttaattccacttgaaaagacttacttagctccaattcgtatctattctgagaaggtaaaatctcttaaaaaattgaaaaaaggagccactattgcaattccaaatgatgcaacaaatggtagccgtgcattgtatgtccttcagtcagcaggtttaatcaaattgaatgtttctggtaagaaggttgcaacagttgctaatatcacatctaataaaaaggatattaatattcaggagttagatgcgagtcaaacaccacgtgcactcaaagatgtagatgcagctattattaataatacatacattgagcaagctaatttaaaaccttcagatgctatctttgttgagaaatcagataaaaattcaaaacaatggattaatatcattgcgggacgtaaaaattggaaaaagcaaaagaacgctaaagctatccaagctatcttggatgcttatcacacagatgaagtgaaaaaagttatcaaagatacttcagctgatattccacaatgg

SEQ ID NO: 5664 - protein, 294 aa, Streptococcus agalactiae
MILITSYGIISLSQKLREFIMKLKHIVLGLALTTLLGVTFSNQEVSASSTSSKVVKVGVMTFSDTEKARWDKIEKLVGDKAKIKFTEFTDYTQPNQATANKDVDINAFQHYNFLENWNKENKKNLIPLEKTYLAPIRIYSEKVKSLKKLKKGATIAIPNDATNGSRALYVLQSAGLIKLNVSGKKVATVANITSNKKDINIQELDASQTPRALKDVDAAIINNTYIEQANLKPSDAIFVEKSDKNSKQWINIIAGRKNWKKQKNAKAIQAILDAYHTDEVKKVIKDTSADIPQW

SEQ ID NO: 5665 - DNA, 1374 bp, Streptococcus agalactiae
atgactttaacaaacgaagaaaatcaaattcaaaagtttctatctgatactattgttcaggatgatatcaatattttaagagatttaattgcaattaagtcaatttttgctcagaaagttggtttaaatgacttatcaagctatcttggagaagttttcataaaagctggcgcagaagtcattatagatgacagctatagcgctccctttatcgtggcaaatttcaaatcatcaaaagtagatgctaagcgtattattttttacaatcattatgatactgtaccagcagatgaggtagaacagtggactgaggacccttttacactttcacttcgatatggtaagatgtatggacgtggtgtagatgatgataaaggtcacattaccgcacgtttatcagcagttaaaaaatatttatcaagacacaaaggggaacttcctctagatatcacttttattgtggaaggagcagaggaatcagcttcagtaggccttgattattatttagaaaagtatcaagagcagctacaaggggctgatttgatcgtgtgggaagatggccctaaaaatcctaaaggacagttggaaattgctggtggaaataaaggcattgtcacttttgatttatcagtaagttcagcggatgttgatattcattcatcctttggtggggttgttgattcctcgacatggtatttaattcaagccctcaatacgttaagggataacaaaggtcatatattggtagaaggtatttatgataaagttattccccctactaagagagagttagaattagttgaaaaatattcttatagatctgcaaaggcgctagaaggtgcttaccaattagttttgcccagtttagcagatagtcataaaacttttttgagaaagctttattttgaaccttctatagccattgaaggtataacctcaggttatcaaggtgaaggcgtcaaaacaattttacctgcttatgctaaatgtaaagcagaggttaggttagtaccagggttaaccccgaaaggtgtactagattcaatacaaaatcatttgaaagagaatggctttaaagacattgagctaacctatacccttggtgaaatgtcttatcgtagtgatatgtcagcgccatctatcctaaaggttgttgatttagctgagcaattttatccagaagggatatctctgttacctacctcaccaggtacaggaccaatgtatttagttcatcaagctctaagagcgccaattgcagctattggcataggacatgccaatagtcgagaccatggcgttgatgaaaatgttagtattgctgattattacacccatattgaattagtggaggctttaatagaatcatatgag

SEQ ID NO: 5666 - protein, 458 aa, Streptococcus agalactiae
MTLTNEENQIQKFLSDTIVQDDINILRDLIAIKSIFAQKVGLNDLSSYLGEVFIKAGAEVIIDDSYSAPFIVANFKSSKVDAKRIIFYNHYDTVPADEVEQWTEDPFTLSLRYGKMYGRGVDDDKGHITARLSAVKKYLSRHKGELPLDITFIVEGAEESASVGLDYYLEKYQEQLQGADLIVWEDGPKNPKGQLEIAGGNKGIVTFDLSVSSADVDIHSSFGGVVDSSTWYLIQALNTLRDNKGHILVEGIYDKVIPPTKRELELVEKYSYRSAKALEGAYQLVLPSLADSHKTFLRKLYFEPSIAIEGITSGYQGEGVKTILPAYAKCKAEVRLVPGLTPKGVLDSIQNHLKENGFKDIELTYTLGEMSYRSDMSAPSILKVVDLAEQFYPEGISLLPTSPGTGPMYLVHQALRAPIAAIGIGHANSRDHGVDENVSIADYYTHIELVEALIESYE

SEQ ID NO: 5667 - DNA, 1068 bp, Streptococcus agalactiae
atgagtaaagaaccaattattaaattagacaacattgatgttactttccaccaaaagaaacgtgagattaatgctgttaaagatgttactatccatattaatcaaggtgatatatatggaattgtcggttattcaggagccggaaaatctacccttgttcgtgttattaatttgctacaagaaccttcagcaggtaaaattactattgatgaccaagttatttacgacaacaaggtgacactgactagcacacaattacgcgaacagcgccgtgaaattggaatgatttttcaacattttaacctaatgtcacagttgacagcagagcagaatgtagcttttgctcttaaacattcaggtttatcaaaagaggcgaaagcagctaaggttgctaaattattagaacttgttggattatccgatcgtgctcaaaactatccttcacaattatcaggagggcaaaaacagcgtgttgccattgcgcgtgcattggctaacgatcctaaaatcttaatttcagatgagtctacctctgcacttgaccctaaaacaacaaaacaaatacttgcccttctccaagatctgaataaaaaattgggacttacgattgttttgattacacatgagatgcaaattgtcaaagacattgctaatcgcgttgctgttatgcaaaatggtaaattgattgaagaaggatcagttttagacattttttcacatcctagagagagtcttacacaagattttataaaaatagctactggtattgatgaggcaatgcttaagattgagcaacaagaagttgtcaaaaatctaccagtaggtagcaaattagttcaactgaaatacgctgggcatagcacggatgagccgcttttaaatcaaatttataaagaatttgaagtaactgctaacatcctctatgggaatattgaaattttagatggtattccagttggagaaatggtagttatcttatcaggtgacgaagaaaaattaagacaagcctgccaagcaattacagattcgcaagttcaattaacgttattgaaagaaggtggtaaagca

SEQ ID NO: 5668 - protein, 356 aa, Streptococcus agalactiae
MSKEPIIKLDNIDVTFHQKKREINAVKDVTIHINQGDIYGIVGYSGAGKSTLVRVINLLQEPSAGKITIDDQVIYDNKVTLTSTQLREQRREIGMIFQHFNLMSQLTAEQNVAFALKHSGLSKEAKAAKVAKLLELVGLSDRAQNYPSQLSGGQKQRVAIARALANDPKILISDESTSALDPKTTKQILALLQDLNKKLGLTIVLITHEMQIVKDIANRVAVMQNGKLIEEGSVLDIFSHPRESLTQDFIKIATGIDEAMLKIEQQEVVKNLPVGSKLVQLKYAGHSTDEPLLNQIYKEFEVTANILYGNIEILDGIPVGEMVVILSGDEEKLRQACQAITDSQVQLTLLKEGGKA

SEQ ID NO: 5669 - DNA, 690 bp, Streptococcus agalactiae
atgatagagtggattcaaacacatttaccaaatgtatatcaaatgggttgggaaggtgcttacggctggcagacagctattgtacaaaccctttatatgactttttggtcgttccttattggaggtttaatgggattgttaggaggtttattccttgttttaactagtcctagaggagttattgctaataaattagtatttggagttttagataaagttgtttctgtttttagagctctgcccttcattattcttcttgctttgattgcgccagtaactcgcgtaattgtaggaacaacacttggttcaccagcagctttggtacctctttctttggcagttttcccattttttgctcgtcaagttcaagttgttttagctgaacttgatggtggagttattgaggctgcacaagcctcaggtggaacactttgggatattattgtagtttatcttcgtgaaggtctaccagatttaattcgagtatcaacggttactttgatttctttagtaggtgaaacagctatggctggcgctattggtgcaggaggattgggttctgttgctattactaaaggatataactattctcgtgatgatattactttagtagcgactattctgattttattattaattttctttatccaatttttaggtgattttttaacacgtcgcttgagtcataaa

SEQ ID NO: 5670 - protein, 230 aa, Streptococcus agalactiae
MIEWIQTHLPNVYQMGWEGAYGWQTAIVQTLYMTFWSFLIGGLMGLLGGLFLVLTSPRGVIANKLVFGVLDKVVSVFRALPFIILLALIAPVTRVIVGTTLGSPAALVPLSLAVFPFFARQVQVVLAELDGGVIEAAQASGGTLWDIIVVYLREGLPDLIRVSTVTLISLVGETAMAGAIGAGGLGSVAITKGYNYSRDDITLVATILILLLIFFIQFLGDFLTRRLSHK

SEQ ID NO: 5671 - DNA, 660 bp, Streptococcus pyogenes
atgtttatgaactcggatggtcatggagatgcaggttggggcttagcgatttggaatactttatacatgaccattgtgccttttattgttgggggggctattggtctcttattaggcttgttattagttttaacaggaccggacggtgttattgaaaacaaaacgatttgttgggttattgataaagttacctctatttttagagccattccttttgttattttgattgctattttagctagctttacctatttgcttttaagaacaactttaggagcaacagcggccttggtacctttaacctttgcgacttttcctttttatgcccgtcaggtccaagttgttttttcagaattagacaagggtgttattgaagcagcacaagcttcaggtgctactttctgggatattgtcaaagtgtatctcagtgaaggtttaccagatcttattcgtgtttctacagtcaccttaatttctttagttggggaaactgccatggcaggagctatcggtgctggaggattaggaaatgtagcgatttcttatggttataatcgttttaacaatgatgtgacttgggtagcgactattattattcttttaattatttttgctatccaatttattggtgatagcttgactagaaggtttagtcataaa

SEQ ID NO: 5672 - protein, 220 aa, Streptococcus pyogenes
MFMNSDGHGDAGWGLAIWNTLYMTIVPFIVGGAIGLLLGLLLVLTGPDGVIENKTICWVIDKVTSIFRAIPFVILIAILASFTYLLLRTTLGATAALVPLTFATFPFYARQVQVVFSELDKGVIEAAQASGATFWDIVKVYLSEGLPDLIRVSTVTLISLVGETAMAGAIGAGGLGNVAISYGYNRFNNDVTWVATIIILLIIFAIQFIGDSLTRRFSHK

SEQ ID NO: 5673 - DNA, 756 bp, Streptococcus agalactiae
ttgccttcacattgtgaagatggcgggtggattttaggacatcttattgaaggtactcaagcagaatatgttcatattccacatgcagatggtagcctttatcatgcacctgaaggtgtttgtgacgatgcattggttatgttatctgatattttaccaacttcatacgaaatcggcgtcttaccttctcacattaaaccaggtgatactgtttgtattgtaggcgctggaccaattggactatctgccttactaactgcacaattctattctcctgccaaaattattatggttgatttatctcaaaaacgacttgaagcctctaaaaaatttggtgcaacacacaccattctatcaacgtctactcaagaagttaaagaagaaattgataaaattaccaaaggccgtggcgttgatgtcgtattagaatgtgttggttatcctgcaacatttgatatttgtcaaaatgtagtttctattggaggacatatcgcaaatgttggtgttcatggtaaacctgttgaatttaacctccaagatttatggataaaaaatataacccttaatactggattagttaatgctaatacaactgaaatgctccttgaagttcttgagacaggcaaaatcgatgcaacacaactagtaacacatcacttcaagctatctgaaatcgaagaagcttataaggtatttaaagctgctgaagaaaacaatactctcaaagttatcatcgaaaacgatattactccagcc

SEQ ID NO: 5674 - protein, 252 aa, Streptococcus agalactiae
MPSHCEDGGWILGHLIEGTQAEYVHIPHADGSLYHAPEGVCDDALVMLSDILPTSYEIGVLPSHIKPGDTVCIVGAGPIGLSALLTAQFYSPAKIIMVDLSQKRLEASKKFGATHTILSTSTQEVKEEIDKITKGRGVDVVLECVGYPATFDICQNVVSIGGHIANVGVHGKPVEFNLQDLWIKNITLNTGLVNANTTEMLLEVLETGKIDATQLVTHHFKLSEIEEAYKVFKAAEENNTLKVIIENDITPA

SEQ ID NO: 5675 - DNA, 204 bp, Streptococcus agalactiae
ttgaaaataaataatttttggaggaactctaatatgagagctgcaacttatctttcagctaatgaattatcacttactgataaggctaaacctcaagtaataaaacccacagatgcggttgtaagwcttgtcaracwaccatttgtggtactgatctacatatccttggtggcgatgttcctgcttgtaaaccaggaacaactt

SEQ ID NO: 5676 - protein, 68 aa, Streptococcus agalactiae
  MISC_FEATURE (1)..(68): Xaa = Any Amino Acid
MKINNFWRNSNMRAATYLSANELSLTDKAKPQVIKPTDAVVXLVXXPFVVLIYISLVAMFLLVNQEQL

SEQ ID NO: 5677 - DNA, 192 bp, Streptococcus agalactiae
atggcaaagaaaggtccaatagataggtatagtgctactgcaaagaaaatagcatatgttttagagacaggtttggtgaagctttcaacatcggttgctcctgagtacgccacagctgcaacaccaagtaggggtaaagttacgcctgttaagcagaacccaatgatagcccacgcccaattagaaccagag

SEQ ID NO: 5678 - protein, 64 aa, Streptococcus agalactiae
MAKKGPIDRYSATAKKIAYVLETGLVKLSTSVAPEYATAATPSRGKVTPVKQNPMIAHAQLEPE

SEQ ID NO: 5679 - DNA, 762 bp, Streptococcus agalactiae
atggatgcccttgcatcaattgcttttgctattatcgttattcaagcaagtaaacagtacggagcaattaccaaaaaagaaattacttctatggcacttaaatctggtgctatcgctacatttcttttagcttttatttatatttttgtaggacgtattggtgcaacttcacaaagcttgtttaaatttgcaaatggttccttcttacttcacaatactccaatagacggtgggcatgttcttagtcaatcagctaacttctatttaggaattgtgggacaagctattttaggtacggctatttttcttgcttgcttaacaacagctactggattaatcactgcttgtgcggaatacttccacaaattacttccaaagattagtcacattacttgggctacaatctttactttaattgctattacgttctattttggtggtttatcagagattatccgttggtcactaccagttctctaccttctctatccattaactatagtcttaattttcttagtcttttttgatcaaaaatttgaaagtagccgcattgtctaccaaacttctattgccgccactgctgtcgctgctttatacgatgccttatcaaaactcggcgaaatgactggtttatttaccattccatccgctttgaccacattctttactaaagttgttcctttaggtgaatattctatgggatggattagttttgcaatttgtggtgtcttagttggtcttattctaaaaaaagtaaaagca

SEQ ID NO: 5680 - protein, 254 aa, Streptococcus agalactiae
MDALASIAFAIIVIQASKQYGAITKKEITSMALKSGAIATFLLAFIYIFVGRIGATSQSLFKFANGSFLLHNTPIDGGHVLSQSANFYLGIVGQAILGTAIFLACLTTATGLITACAEYFHKLLPKISHITWATIFTLIAITFYFGGLSEIIRWSLPVLYLLYPLTIVLIFLVFFDQKFESSRIVYQTSIAATAVAALYDALSKLGEMTGLFTIPSALTTFFTKVVPLGEYSMGWISFAICGVLVGLILKKVKA

SEQ ID NO: 5681 - DNA, 228 bp, Streptococcus agalactiae
  MISC_FEATURE (1)..(228): n = a, c, g, or t
atgcctacaattaaccagttggtacgtaaaccacgtaaatctaaagttgaaaaatcagattcacctgctttgaatattggttacaacagtcacagaaaagttcacactaaattatctgcaccacaaaaacgtggtgttgcaactcgtgttggaactatgacacctaaaaaacctaactctgcccttcgtaaatttgctcgtgtacgtttgagcannnnnttaattaat

SEQ ID NO: 5682 - protein, 76 aa, Streptococcus agalactiae
  MISC_FEATURE (1)..(76): Xaa = Any Amino Acid
MPTINQLVRKPRKSKVEKSDSPALNIGYNSHRKVHTKLSAPQKRGVATRVGTMTPKKPNSALRKFARVRLSXXLIN

SEQ ID NO: 5683 - DNA, 342 bp, Streptococcus pyogenes
ttgaacattggttacaacagtcacaaaaaagttcaaactaaaatggctgccccacaaaaacgtggcgttgctactcgtgttggaacaatgacacctaaaaaacctaactcagcccttcgtaaattcgctcgtgtacgtttgagcaaccttatcgaagtaactgcctacatcccaggtatcggacacaacttgcaagagcacagcgttgttcttatccgtggcggacgtgtaaaagaccttccaggggtacgttaccatatcgttcgtggcgcacttgatactgcaggtgttgctgaccgtaaacaaggccgttctaaatacggtgcgaaacgtccaaaagga

SEQ ID NO: 5684 - protein, 114 aa, Streptococcus pyogenes
LNIGYNSHKKVQTKMAAPQKRGVATRVGTMTPKKPNSALRKFARVRLSNLIEVTAYIPGIGHNLQEHSVVLIRGGRVKDLPGVRYHIVRGALDTAGVADRKQGRSKYGAKRPKG

SEQ ID NO: 5685 - DNA, 810 bp, Streptococcus agalactiae
atgaaattaagacgtagcgaacgcatggttgttatttcaaattacctaataaataatccctatacattaactagtttaaatacatttgctagtaaatacggtgccgcgaaatcttcgatttcagaagatattgctattatcaaaaaagcttttgaacaagctcaaatcggagatattaaaactgtgactggtgcaagtggaggtgttatctttacaccaactattgctgaagcagaagcgaaagaaatcgttgaagaattaagacagcgtttatctgaaaacgatcgtattcttccgggaggttacatttatctttcagatctactcagtacaccaaaaatgttacaaagtattggtcgcattatagcgaacgcttacagaggtcaaaaaattgatgctgtcatgacggttgcaacaaaaggtgttcctttagcaaacgcagtagcaaatgttttagatgttccttttgttattgtgagacgtgatttgaagattacggaaggttctactgtgtcagtaaactacgctagtggttcaagtggccgtattgaaaaaatgtttctttctaagcgtagcttaaaacctaacagtcgagttttaatagttgatgatttcttgaaaggtggaggtactgtttcggggatgattagtttactctcagaattcgatagcacattagtaggtgtcgctgtatttgcagaaaatgctcaggaacaacgtgagaagatggcctataaatctcttctgagagtatctgaaattgatgtaaaaaataatagagtctctgtagaagcggggaatatatttgat

SEQ ID NO: 5686 - protein, 270 aa, Streptococcus agalactiae
MKLRRSERMVVISNYLINNPYTLTSLNTFASKYGAAKSSISEDIAIIKKAFEQAQIGDIKTVTGASGGVIFTPTIAEAEAKEIVEELRQRLSENDRILPGGYIYLSDLLSTPKMLQSIGRIIANAYRGQKIDAVMTVATKGVPLANAVANVLDVPFVIVRRDLKITEGSTVSVNYASGSSGRIEKMFLSKRSLKPNSRVLIVDDFLKGGGTVSGMISLLSEFDSTLVGVAVFAENAQEQREKMAYKSLLRVSEIDVKNNRVSVEAGNIFD

SEQ ID NO: 5687 - DNA, 837 bp, Streptococcus pyogenes
atgaaattaagacgaagtgaacgtatggttgtcatttcaaattatttgattaacaatccgtataaattaactagtttaaacacctttgcaactaaatatgaggccgcaaaatcttctatctcagaagatatcgctattatcaagaaagcttttgaagaagctaacattggtgatatcgatacacttacaggagcaagtggaggcgtaatttttacccccagtatttcagaaacagaagcgcgtaccattgttgaagacctgtgtcaaaggttatcagagagtgatcgcatcttacctggaggctatatctatttgtcagacttgctgagtacacctaaaattttacaaaatattggtcgtattattgccaatgcctttaaaggagaaaagattgacgctgtgatgacagttgcaaccaaaggagttcctttagcaaatgcagtggctaatattttaagtgttccttttgtcattgttagacgtgatttaaaaataacagaaggatcgacagtgtctgtcaattatgcgagtgcttctagtgatcgtattgaaaagatgtttctgtcaaagcgtagtttgaaacccaatagtcgtgtattgattgtagatgatttcttgaagggcggggggacgattacaggaatgatcagtctcttgacagaatttgacagcactttagttggtgttgctgtgtttgcagaaaacgctcaatcagagcgtgagcaaatgaccttcaaatcattgctgaaagtttcagagattgatgtcaaaaacaacaatgttgttgtagaagttggtaatattttcgataaatggaaaaaggagagagaatggact

SEQ ID NO: 5688 - protein, 279 aa, Streptococcus pyogenes
MKLRRSERMVVISNYLINNPYKLTSLNTFATKYEAAKSSISEDIAIIKKAFEEANIGDIDTLTGASGGVIFTPSISETEARTIVEDLCQRLSESDRILPGGYIYLSDLLSTPKILQNIGRIIANAFKGEKIDAVMTVATKGVPLANAVANILSVPFVIVRRDLKITEGSTVSVNYASASSDRIEKMFLSKRSLKPNSRVLIVDDFLKGGGTITGMISLLTEFDSTLVGVAVFAENAQSEREQMTFKSLLKVSEIDVKNNNVVVEVGNIFDKWKKEREWT

SEQ ID NO: 5689 - DNA, 939 bp, Streptococcus agalactiae
atgaaaattaaccaaatgaaaaaagacgagctttttgaggggttttaccttataaagaaagcagaagttcgtaaaacgcgtgcaggtaaagactttattgcctttacctttcaagatgatactggcgaaatttcaggaaatatgtgggatgcacagacctataatgtagaagagtttgtagccggtaaaattgttcatatgaaagggcgtcgtgaagtttataatggaactccccaagtcaaccaaattacattaagaaacatcaaagatggtgaacctaatgatcctagagattttaaagaaaaacctccaatcaatgttgacaacgtgagagagtacatggaacaaatgctctttaaaattgaaaatgcaacctggcagcgtgtggtaagagcactttatcgtaaatacaataaggaattttttacctatccagccgccaaaacaaaccaccacgcttttgaatcaggattggcatatcacacggcaacaatggttcgtttggcagatagtatcggagatatctatccagaacttaataaaagtttgatgtttgctggtattatgctacatgatttagccaaggtcattgagttatcgggtcctgataatacagaatatactattcgaggtaatcttatcggtcatatttcacttattgatgaggaattaacaaaaatactagcagagcttaatattgatgatacaaaagaagaggttacagtgttacgccatgttattctgagtcatcatggacaattagaatatggaagcccggttcgtcctagaatcatggaggcagaaattatccatatgatcgataacattgatgcaaatatgatgatgatgacaacagctttaaaccgtgtcaacgaaggtgaaatgacaaatcgcatttttgccatggataaccgttctttttataaaccgaacattaaa

SEQ ID NO: 5690 - protein, 313 aa, Streptococcus agalactiae
MKINQMKKDELFEGFYLIKKAEVRKTRAGKDFIAFTFQDDTGEISGNMWDAQTYNVEEFVAGKIVHMKGRREVYNGTPQVNQITLRNIKDGEPNDPRDFKEKPPINVDNVREYMEQMLFKIENATWQRVVRALYRKYNKEFFTYPAAKTNHHAFESGLAYHTATMVRLADSIGDIYPELNKSLMFAGIMLHDLAKVIELSGPDNTEYTIRGNLIGHISLIDEELTKILAELNIDDTKEEVTVLRHVILSHHGQLEYGSPVRPRIMEAEIIHMIDNIDANMMMMTTALNRVNEGEMTNRIFAMDNRSFYKPNIK

SEQ ID NO: 5691 - DNA, 936 bp, Streptococcus pyogenes
atgaaaattaatcaaatgaaaaaagaccagctttttgaagggttctacctcattaagtcggcagaggttcgtaagacaagagctggtaaagattttattagccttacctttcaggatgacactggcgagatttcaggaaatctgtgggatgcccaaccttataacgttgaagaatttactgctggtaaagtcgtgtttatgaaagggcgacgcgaggtgtataatggtacccctcaggttaatcaaatcaccttgcgaaatgttcgcccaggtgagcccaatgatccaaaggacttcaaagaaaaggcacctgtcagtgtgacagaagtacgtgactatttggaacagatgctctttaaaattgaaaatgcaacgtggcaacgaattgtaagggctctttatcgtaagtatgataaagaattttatacttatcctgcagctaaaacaaaccaccatgcttttgagtcaggcctcgcctaccatactgctacgatggtcagactagcagatagcattggagatatctaccctgacttaaataagagtctactgtttgcaggtattatgttacatgacttagctaaagtcatagaattaacaggaccagataatacagaatacaccgttcgtggtaacttgattgggcatatttctctcattaacgaagaaattacaaaagtaatttcagaactacaaatcgatgataccaaagaagaagtcattgtccttaggcacgtgattttaagccatcacgggcaattagaatacggtagtccggtacgtccacgcatcatggaagctgaaattattcatatgattgacaatattgatgctaatatgatgatgatgacaacagctcttagccgtgttagcgagggcgagatgaccaatcggatttttgccatggataatcggtctttttacaagccaaactat

SEQ ID NO: 5692 - protein, 312 aa, Streptococcus pyogenes
MKINQMKKDQLFEGFYLIKSAEVRKTRAGKDFISLTFQDDTGEISGNLWDAQPYNVEEFTAGKVVFMKGRREVYNGTPQVNQITLRNVRPGEPNDPKDFKEKAPVSVTEVRDYLEQMLFKIENATWQRIVRALYRKYDKEFYTYPAAKTNHHAFESGLAYHTATMVRLADSIGDIYPDLNKSLLFAGIMLHDLAKVIELTGPDNTEYTVRGNLIGHISLINEEITKVISELQIDDTKEEVIVLRHVILSHHGQLEYGSPVRPRIMEAEIIHMIDNIDANMMMMTTALSRVSEGEMTNRIFAMDNRSFYKPNY

SEQ ID NO: 5693 - DNA, 1272 bp, Streptococcus agalactiae
atgcttgtcatcattttgatcattgtactagctagtctgacagtgacgataatttcttaccaaaaaatgacggaattaacaaagtccgttgaaaaacaacttgaagataatgctgataatctatcagaccaactgacatatcagatagaagtggcgcaaaaagatcaaattctaacgttgactaatcagctaaaccgtatgcaacaggaaatttatcagttgcttaccgatatgcgtacagaattaaatcagcatttaacggagagtcgagatcgatcagacaaacgcttggaattgattaactccaatttatctcagtcagttcagaaaatgcaagattccaatgaaaaacgcttggatcaaatgcgccaaactgttgaggaaaagctagaaaaaacgctacaaacgcgtttgcaaacttcttttgaaactgtatcgcgtcaactagagagcgtcaatcaaggtcttggggagatgaaaactgttgcccaagatgttggtacactgaacaaagtcttgtcaaatactaagacaaggggaatattaggggagttacaactcggccaaattatagaagatattatgacagttagtcaatatgagagagaatttcctacggtgtctggctcttctgagcgtgttgaatatgctattaaattacctggaaatggtcagggagattatatctatttgcctattgactctaagtttcctctagaagattattaccgattggaagatgcttatgaattgggtgacaaggttcaaatagaactctatcgtaaatctttactggcaagtattcgtaaatttgcaaaagatataaacaataagtacttaaatcctcctgaaacgacaaattttggtatcatgttcttaccaactgaagggctctattctgaagtggtaagaaatgcaacattctttgatagtctaagacgtgacgaaaatattgtagtagctggaccgtcaaccttatctgctttactaaattcattatctgttggctttaaaaccttaaatattcaaaagaatgctaatgatattagtaaaattttagggaatgtcaaggttgaatttggaaaatttggtggcatgttatcaaaagctcaaaaacaattaaatacagcaagtaaaagtattgatagtttactcacaacgcggacaaacgctattatcagagtcttaaatacagttgaagaacatcaagatcaagcaaccactagcttgttaaaccttcctataacagaagaagaggaaattaatgaaaat

SEQ ID NO: 5694 - protein, 424 aa, Streptococcus agalactiae
MLVIILIIVLASLTVTIISYQKMTELTKSVEKQLEDNADNLSDQLTYQIEVAQKDQILTLTNQLNRMQQEIYQLLTDMRTELNQHLTESRDRSDKRLELINSNLSQSVQKMQDSNEKRLDQMRQTVEEKLEKTLQTRLQTSFETVSRQLESVNQGLGEMKTVAQDVGTLNKVLSNTKTRGILGELQLGQIIEDIMTVSQYEREFPTVSGSSERVEYAIKLPGNGQGDYIYLPIDSKFPLEDYYRLEDAYELGDKVQIELYRKSLLASIRKFAKDINNKYLNPPETTNFGIMFLPTEGLYSEVVRNATFFDSLRRDENIVVAGPSTLSALLNSLSVGFKTLNIQKNANDISKILGNVKVEFGKFGGMLSKAQKQLNTASKSIDSLLTTRTNAIIRVLNTVEEHQDQATTSLLNLPITEEEEINEN

SEQ ID NO: 5695 - DNA, 1269 bp, Streptococcus pyogenes
atggaccttatcttgttccttttggtcttggttctcttaggtttaggggcttatctgttgttcaaagtcaacggccttcaacatcagcttgcccaaaccctagaaggcaacgcggataatttgtctgaccaaatgacctaccagttggatacagctaacaaacaacaattgttagagctaacacagctgatgaaccgacaacaagcaggcctttaccaacaattaacagatattcgtgacgtcttgcaccgtagtttgtctgatagtagggaccggtctgacaaacgcttagaaaaaattaaccagcaggtcaaccaatcgctcaaaaatatgcaagaatctaacgaaaaacgtttggagaaaatgcgccagatcgttgaagaaaaattggaagaaaccttaaaaaatcgtctgcacgcctctttcgattctgtatccaagcaactagaaagtgtcaataaaggcttgggagaaatgcgtagcgtggctcaagatgtgggtactttaaataaggttttgtccaataccaaaacacgaggcattttaggcgaacttcaactaggccaaatcattgaggatatcatgacatcaagccagtacgaaagagaatttgtaacggttagtggttctagtgaacgcgtagaatatgcgattaagctcccaggaaatggtcaaggcggttatatttacctaccgattgactcaaaattccctcttgaagattattaccgattagaagatgcttacgaagttggtgataaactggccatcgaggctagccgaaaagcacttctggcagctatcaaacgctttgccaaagacattcataaaaagtacttgaaccccccagagacgaccaatttcggagttatgttcttaccaacagaaggtctttattcagaagtggtcagaaatgcgtctttctttgatagccttcgtcgggaagaaaatattgtggttgcaggcccttcgaccctgtctgctttgctgaattccttatctgttggtttcaagacccttaatatccaaaaaaatgctgatgacatcagtaaaattttaggcaatgtcaagttagaattcgataaatttggcggcctgcttgccaaggctcaaaaacaaatgaatacagctaataatacgctggatcagctcatttcaacaaggacaaatgccattgttcgagccttgaataccgttgaaacttatcaagaccaagcaacaaaatctctcttgaacatgcccttattagaagaggaaaataatgaaaat

SEQ ID NO: 5696 - protein, 423 aa, Streptococcus pyogenes
MDLILFLLVLVLLGLGAYLLFKVNGLQHQLAQTLEGNADNLSDQMTYQLDTANKQQLLELTQLMNRQQAGLYQQLTDIRDVLHRSLSDSRDRSDKRLEKINQQVNQSLKNMQESNEKRLEKMRQIVEEKLEETLKNRLHASFDSVSKQLESVNKGLGEMRSVAQDVGTLNKVLSNTKTRGILGELQLGQIIEDIMTSSQYEREFVTVSGSSERVEYAIKLPGNGQGGYIYLPIDSKFPLEDYYRLEDAYEVGDKLAIEASRKALLAAIKRFAKDIHKKYLNPPETTNFGVMFLPTEGLYSEVVRNASFFDSLRREENIVVAGPSTLSALLNSLSVGFKTLNIQKNADDISKILGNVKLEFDKFGGLLAKAQKQMNTANNTLDQLISTRTNAIVRALNTVETYQDQATKSLLNMPLLEEENNEN

SEQ ID NO: 5697 - DNA, 630 bp, Streptococcus agalactiae
atgactaaaattgctttatttgctggcggtgacttaacttattttgaatatgattttgactattttgtcggaattgaccgtggaagcctatttttattaaaaaatgggctttctttggacatggcagtgggtgattttgattctataacagaagatgaactgctttatatcaaacactattgtagcaatatcgtttctgctagtgcagaaaaaaatgatacagatacagaattagctttaaaaactattttcaaagaatttccagaagctcaggtgaccgtatttggagcatttggtggcaggattgaccatatgatgtctaatatctttttaccaagtgacagagatctagaaccatttatgtcacaaatcagactcaaagatgaacaaaacatagtgacttatctaccatccgggaaaaatcaagtctcaaggattgaagggatgtcctatgtctcgttcatgcctgagagtgagtctactttgcagatttctggggctaaatatgaattgaacaaaagtaattattttaagaaaaaaatgtattccagtaatgaatttatgacttcgccaattgaagtagagctcaaagatggttacttaatcattatttatagtaaggatagaggt

SEQ ID NO: 5698 - protein, 210 aa, Streptococcus agalactiae
MTKIALFAGGDLTYFEYDFDYFVGIDRGSLFLLKNGLSLDMAVGDFDSITEDELLYIKHYCSNIVSASAEKNDTDTELALKTIFKEFPEAQVTVFGAFGGRIDHMMSNIFLPSDRDLEPFMSQIRLKDEQNIVTYLPSGKNQVSRIEGMSYVSFMPESESTLQISGAKYELNKSNYFKKKMYSSNEFMTSPIEVELKDGYLIIIYSKDRG

SEQ ID NO: 5699 - DNA, 630 bp, Streptococcus pyogenes
atgtctaaagttgctctttttgcgggaggagatctctcttatatcagccgtgattttgattattttgtcggtattgatagagggagcctatttttattagaaaatgggcttcctttgaatatggctgttggtgattttgattcggtttcccaaaaagcgtttacggatataaaagagaaggcagagctttttattactgctcatccagaaaaaaatgatacggatacggaattagcccttaaagaggtctttgctcgttttcctgaggcggaagtgaccatttttggggcttttgggggtcgaatggaccacctcttatccaatattttcttgcctagcgaccctggtattgctccctttatggcacaaatcgccttgcgtgaccaacaaaatatgattacctaccgcccggcaggtcagcaccttatccatcaagaagaagggatgacctatgtggcatttatggcagaaggagaagctgacttgaccattactggtgctaaatttgagttgacgcaagataattttttcaaaaagaaaatctattccagtaatgcctttatccatcaacctattacagttagtttgccaagtggctacttgattattattcaaagtaaagattggagt

SEQ ID NO: 5700 - protein, 210 aa, Streptococcus pyogenes
MSKVALFAGGDLSYISRDFDYFVGIDRGSLFLLENGLPLNMAVGDFDSVSQKAFTDIKEKAELFITAHPEKNDTDTELALKEVFARFPEAEVTIFGAFGGRMDHLLSNIFLPSDPGIAPFMAQIALRDQQNMITYRPAGQHLIHQEEGMTYVAFMAEGEADLTITGAKFELTQDNFFKKKIYSSNAFIHQPITVSLPSGYLIIIQSKDWS

SEQ ID NO: 5701 - DNA, 660 bp, Streptococcus agalactiae
atgtcaaccaataaaattgccccatcgatattagcagcagactatgctaattttgctaacgaattgaaacgtattgaagagacaacagcagaatacgttcatattgatatcatggatggtcaatttgtccctaatattagttttggtgcggatgttgtatccagcatgcgtaaacacagtaaacttgtttttgattgtcatctgatggttgttgatccagaacgttatattgaggcttttgctcaagctggtgctgatatcatgaccattcatgttgaagcaacgaaacatatacatggtgcgcttcaaaagataaaagaggcaggaatgaaagcaggtgtggttattaacccaggaacacccgtagaatctcttattcctatcttagatttggttgaccagattttaattatgactgttaatcctggctttggtggacaagcctttattccagaaatgatgtcaaaagtaaagacagttgcagcatggcgcaaagagtacggtcatcattatgatattgaagttgatggcggtatagataatactacaattaaggcagcagcagaggctggtgcaaatgtctttgttgcaggttcttatctctttaaagcaagtgatttacctgcacaagtagaaaccttaagggtggcgctcgatgac

SEQ ID NO: 5702 - protein, 220 aa, Streptococcus agalactiae
MSTNKIAPSILAADYANFANELKRIEETTAEYVHIDIMDGQFVPNISFGADVVSSMRKHSKLVFDCHLMVVDPERYIEAFAQAGADIMTIHVEATKHIHGALQKIKEAGMKAGVVINPGTPVESLIPILDLVDQILIMTVNPGFGGQAFIPEMMSKVKTVAAWRKEYGHHYDIEVDGGIDNTTIKAAAEAGANVFVAGSYLFKASDLPAQVETLRVALDD

SEQ ID NO: 5703 - DNA, 660 bp, Streptococcus pyogenes
atgtcaactctaaaaattgccccatctattctagcagctgattatgctaattttgcttctgagctagctcgtattgaagaaacagatgccgaatacgttcacattgatattatggatggtcaatttgttcctaacatcagttttggtgcagatgttgtggcaagtatgagaaagcacagtaaattggtctttgattgccatctaatggtggttgatcctgaacgctatgttgaggcttttgcacaagctggtgctgatatcatgaccattcacacagaaagtactcgtcatattcatggagcccttcaaaaaatcaaggcagctggcatgaaagcaggggtagtgattaatccaggaactcctgcaacagccctagaacctttgctagacttagttgaccaagtcctcattatgacagtcaacccaggttttgggggtcaggcctttatcccagaatgtttagaaaaagtggctaccgtagccaaatggcgagatgaaaaaggattgtcctttgacattgaggttgatggcggagtagacaataagaccattcgtgcttgttatgaagcaggggccaatgtctttgtggcaggttcttaccttttcaaggccagtgacctagtgagccaagtccaaaccttaaggacggccttgaatgtc

SEQ ID NO: 5704 - protein, 220 aa, Streptococcus pyogenes
MSTLKIAPSILAADYANFASELARIEETDAEYVHIDIMDGQFVPNISFGADVVASMRKHSKLVFDCHLMVVDPERYVEAFAQAGADIMTIHTESTRHIHGALQKIKAAGMKAGVVINPGTPATALEPLLDLVDQVLIMTVNPGFGGQAFIPECLEKVATVAKWRDEKGLSFDIEVDGGVDNKTIRACYEAGANVFVAGSYLFKASDLVSQVQTLRTALNV

SEQ ID NO: 5705 - DNA, 870 bp, Streptococcus agalactiae
ttgcaaggtagaattgtcaagtcgctagcaggtttttattatgtggaatctgacggtgttgtttatcagacacgtgcgcgtggaaattttagaaaaaaaggtcaaattccctacgttggggattgggttgaattttcttcgcaagatcaatcagaaggatatattctatcaattgaagagcgtaaaaatagcctcgtacgaccacctattgttaatattgatcaagctgtcgttatcatgtctgctaaagaacctgattttaacgctaacttattagaccggttcttagtacttctagaatataagatgattcagcctatcatttatatttccaagttggatttgttagacgatttggttgttattgatgatattcgcgaacattatcagaatataggctacgttttctgttattctcaagaggaactcttgcctctgttagcaaataaagtgactgtttttatgggccagacaggtgtcggaaaatcaacgcttctcaacaaaattgctcctgagttgaaacttgaaactggtgaaatttcgggtagtttaggccgtggccgacacaccacaagagcagttagtttctataacgttcataaaggaaaaattgcagacactcctggtttttcttctttggactatgaagtggataatgcagaggacttaaacgaatcctttccagagcttcgtagacttagtcatttttgtaaattccgctcgtgtacgcatacacatgagcctaaatgtgctgtaaaagaagccttaactcaaggtcagttatggcaagtccgctatgataactacctccaatttttaagtgaaattgagagccgtcgtgaaacatataagaaagttattaaaagaaag

SEQ ID NO: 5706 - protein, 290 aa, Streptococcus agalactiae
MQGRIVKSLAGFYYVESDGVVYQTRARGNFRKKGQIPYVGDWVEFSSQDQSEGYILSIEERKNSLVRPPIVNIDQAVVIMSAKEPDFNANLLDRFLVLLEYKMIQPIIYISKLDLLDDLVVIDDIREHYQNIGYVFCYSQEELLPLLANKVTVFMGQTGVGKSTLLNKIAPELKLETGEISGSLGRGRHTTRAVSFYNVHKGKIADTPGFSSLDYEVDNAEDLNESFPELRRLSHFCKFRSCTHTHEPKCAVKEALTQGQLWQVRYDNYLQFLSEIESRRETYKKVIKRK

SEQ ID NO: 5707 - DNA, 870 bp, Streptococcus pyogenes
ttgcaaggtaaaatcattaaatctctggctggtttttattacgtggagtcagaaggacaggtatatcagacgcgagcgcgtggtaattttaggaagcgcggtgagacaccttatgttggagatatcgtggatttctcagcagaggacaactctgaaggttatattttagcgattcatcctcgtaaaaacagtttggtaagacctcctatcgtcaatattgatcaagcagtggttattatgtctgctaaagaaccagaatttaacagcaatcttctagaccgctttctcatcttgcttgaacacaaagccattcatccagtggtttatatctctaagatggacttattagatagtcccgaggagattaaggctattggtcgacagtatcaggcaatcggttacgattttgtgaccagtcttgaggaattgctgcctttgctagctgataaaattaccgtctttatgggacaaacaggtgttgggaaatcaacccttctcaaccgaatcgcccccgaattggctcttgaaataggagaaatctcagatagtctagggcgtggtcgtcacaccacccgagctgtgagtttttacaatacccatggcggaaaaatcgcggatacgccaggtttttcatcattagactatgatattgctaatgctgaagatttgaacgaggcttttccagagctgcgccggctgagccatgagtgtaagtttagatcctgtacccatacccacgaacccaagtgtgctgtcaaggcagcgcttgaaacgggagagttgtggccagttcgttatgagcattacctgcaatttctcagtgaaattgaaaaccgtcgtgaaacatataaaaaagttatcaaaagaaag

SEQ ID NO: 5708 - protein, 290 aa, Streptococcus pyogenes
LQGKIIKSLAGFYYVESEGQVYQTRARGNFRKRGETPYVGDIVDFSAEDNSEGYILAIHPRKNSLVRPPIVNIDQAVVIMSAKEPEFNSNLLDRFLILLEHKAIHPVVYISKMDLLDSPEEIKAIGRQYQAIGYDFVTSLEELLPLLADKITVFMGQTGVGKSTLLNRIAPELALEIGEISDSLGRGRHTTRAVSFYNTHGGKIADTPGFSSLDYDIANAEDLNEAFPELRRLSHECKFRSCTHTHEPKCAVKAALETGELWPVRYEHYLQFLSEIENRRETYKKVIKRK

SEQ ID NO: 5709 - DNA, 849 bp, Streptococcus agalactiae
atgttggttgacaagaagtggcgttttgaagatagtgcaagttatttcgcttgtcctaaatgtcaaaatcccttgataaaagaaagtaatagcctcaaatgctctgataatcattgttttgatttatccaaatttggatatgttaatcttcttggaggaaagaaggtagatgaacattatgataaaaaatcatttgaaaatcggcagcttgtcttagaaaacgggtattataatcatattttagaagctatttcaaaggttttggaaaataattctcagtttcattcggttttagatattggttgtggagagggcttttattctcgtcaattagttaacaagcatgagaagactttcttggcttttgatatttctaaagattcgattcaattagctgctaaaagtgatcagtctaggcttgtgaaatggtttgtttctgatttagctaaccttcctattcaagactcatcaattgatatcattttagacattttttctcctgcaaattataaagaatttaggcgggtgctgagtgatgatggtatccttgtaaaggttgttcctgtagctgaacatgttcaagaattgcgagaaaaagctagtcaatacttgaaacagaaagattactctaatcaaaaaattctagatcactttagagaaaattttgaaattatttctgagcagaaagttgttcaaagctataactgttctcaacaagaacgtcaagcttttattgatatgacaccgttgttattcagcgtagataaaacgactattgattgggcgagtatatcagaaattacagtaggtgccttaatagtaattggaaaaaagcgcagtgtatctaaa

SEQ ID NO: 5710 - protein, 283 aa, Streptococcus agalactiae
MLVDKKWRFEDSASYFACPKCQNPLIKESNSLKCSDNHCFDLSKFGYVNLLGGKKVDEHYDKKSFENRQLVLENGYYNHILEAISKVLENNSQFHSVLDIGCGEGFYSRQLVNKHEKTFLAFDISKDSIQLAAKSDQSRLVKWFVSDLANLPIQDSSIDIILDIFSPANYKEFRRVLSDDGILVKVVPVAEHVQELREKASQYLKQKDYSNQKILDHFRENFEIISEQKVVQSYNCSQQERQAFIDMTPLLFSVDKTTIDWASISEITVGALIVIGKKRSVSK

SEQ ID NO: 5711 - DNA, 870 bp, Streptococcus agalactiae
atgagaatcgcagataaaaccgttacccgcgctattttggagcgtcatgggtttacatttaagaaatcattcggtcagaactttttgaccgatactaatattttacagaagattgttgacacggcagagattgacaagggtgtcaacgtgattgagattggtcctggtatcggggctttgacagagtttttggctgagaatgcagctgaggttatggcttttgagattgatgatcgtctcattcctatccttgctgatacgcttgcgcgttttgacaatgtccaagtggtcaatcaggatatcctcaaggctgatttgcagacccagattcaggctttcaagaatcctgatctgcctatcaaggtggtcgcaaacctaccttactacatcacaacaccaatccttatgcacttgattgagagcaagattccttttgcggagtttgtggtcatgatacaaaaagaagtggcagatcgtatttcagctatgccaaatactaaagcatacggttctttgtcaatcgcagtgcagtattatatgactgccaaagtatcatttatcgttccgagaactgtttttgttcctgctccaaatgtagattcagctattttgaaaatggtccgtagagatcaaccagtagtgagtgttcaagatgaggatttctttttcagagtgtcaaaagtagccttcgtacatcgtcgtaaaacactttggaataatctaacgagtcattttggaaaatcagaagatactaaagcaaaattggaaaaagcattagaaatagcaaaaattaagccatctattcgcggagaagccttatctatccctgattttgcaagtttagcagatgccttgaaagaggttgggata

SEQ ID NO: 5712 - protein, 290 aa, Streptococcus agalactiae
MRIADKTVTRAILERHGFTFKKSFGQNFLTDTNILQKIVDTAEIDKGVNVIEIGPGIGALTEFLAENAAEVMAFEIDDRLIPILADTLARFDNVQVVNQDILKADLQTQIQAFKNPDLPIKVVANLPYYITTPILMHLIESKIPFAEFVVMIQKEVADRISAMPNTKAYGSLSIAVQYYMTAKVSFIVPRTVFVPAPNVDSAILKMVRRDQPVVSVQDEDFFFRVSKVAFVHRRKTLWNNLTSHFGKSEDTKAKLEKALEIAKIKPSIRGEALSIPDFASLADALKEVGI

SEQ ID NO: 5713 - DNA, 894 bp, Streptococcus pyogenes
gtgatcataaaaagaagagaatatatgagaattgcagattatagcgtgaccaaggctgtccttgatcgtcacggatttacctttaagaaatcttttggtcagaactttttgaccgataccaatattttacagaaaatcgttgacacggctgagattgatcagaatgtcaatgttatcgagattggtcctggaattggggctttgacggaatttttggcagaaaatgctgctgaagtgatggcttttgagattgatgaccgcttggtgccgattttggcagataccttgcgcgattttgataatgtgcaagtggtcaatcaagatattttaaaagctgatttgcagacccaaatcaagcagtttaaaaatcctgatttgcccattaaggtggtggctaatctaccttactacatcacaacgcctattctcatgcacttgattgagagcaaaattccattccaagagtttgtggtcatgatgcagcgtgaagtggcagatcgtatttctgcggagccaaacactaaagcttatggttccttgtccattgcggtgcagtattacatgactgccaaggttgccttcattgtgccgcgcaccgtctttgtacctgcaccaaatgtcgatagtgctatcctcaaaatggtgcgtcgcgaccagcctttgattgaggttaaggacgaagatttctttttcagagtgtctcgtctcagttttgtccatcgtcgcaagaccctgtggaataacttgactagccattttgggaagtctgaagacatcaaggctaaacttgaaaaaggtctggcactagcagatatcaagccttctattcgtggtgaggccttgtcgattcaagattttggcaaattagctgatgctttaaaagaagttggatta

SEQ ID NO: 5714 - protein, 298 aa, Streptococcus pyogenes
VIIKRREYMRIADYSVTKAVLDRHGFTFKKSFGQNFLTDTNILQKIVDTAEIDQNVNVIEIGPGIGALTEFLAENAAEVMAFEIDDRLVPILADTLRDFDNVQVVNQDILKADLQTQIKQFKNPDLPIKVVANLPYYITTPILMHLIESKIPFQEFVVMMQREVADRISAEPNTKAYGSLSIAVQYYMTAKVAFIVPRTVFVPAPNVDSAILKMVRRDQPLIEVKDEDFFFRVSRLSFVHRRKTLWNNLTSHFGKSEDIKAKLEKGLALADIKPSIRGEALSIQDFGKLADALKEVGL

SEQ ID NO: 5715 - DNA, 489 bp, Streptococcus agalactiae
gtggagtataatgtaacggaagcattgactagagctggggtagatttagcaacgcttgcagtcaaagggactgcaactatggtaaccagtaaaattcaatcaataaaggatgtaaaagatgctgcaacattgagagctacttatgatgatttaattaacgaattattagctgaacgggagcaagcaattcgcattgcacagtcatataaagaagagtatgaaaaaattaatatagatgatgaggatattgaatatctatccaatactctcgagcaaggaatctcattgttatataatttttctggtctaaatgaggaacaggaacgaacaatgaaacaattggttacattattgaataaagatactttaaaaacaatgcagttgattggatttaattataagcaagcaataggaggaccactaaccgaagcttgtgcaactgcaattaaaaataagtttataactcagaatagtaaaggcaaaaggaag

SEQ ID NO: 5716 - protein, 163 aa, Streptococcus agalactiae
MEYNVTEALTRAGVDLATLAVKGTATMVTSKIQSIKDVKDAATLRATYDDLINELLAEREQAIRIAQSYKEEYEKINIDDEDIEYLSNTLEQGISLLYNFSGLNEEQERTMKQLVTLLNKDTLKTMQLIGFNYKQAIGGPLTEACATAIKNKFITQNSKGKRK

SEQ ID NO: 5717 - DNA, 561 bp, Streptococcus agalactiae
ttgatgaaaaaaattgatattcaagaagtgatcgttgtcgaagggaaagatgatactgctaatctgcgacgcttttacaatgttgatacctatgaaactagaggttcagcaattgatgaagatgatttagagcgtatcgaacgtttgcacaatttgcggggagttatcgtctttacagacccagattataatggcgagcgtatccgtaaaatcatcatgaatgccattccgacagtccgccatgccttcctcaatcgagacgaggcaaagccaggctcaaagaccaagggacgatctctgggtgtcgagcatgccagctttgaagatttgcagaaggcactctcaaaagtgactcagcatttcgatgatgaagatcatttcgatatcacccaagcagacctcattcgttggggattcattactgctagcgatagccgaaaacgccgtgagtatcttgggaatcaactccgtatcggctactcaaatggtaaacaactcctcaaacgcctcagactcttcggagtgaccaaggcagaagttgaagagtgtatggaggggtat

SEQ ID NO: 5718 - protein, 187 aa, Streptococcus agalactiae
MMKKIDIQEVIVVEGKDDTANLRRFYNVDTYETRGSAIDEDDLERIERLHNLRGVIVFTDPDYNGERIRKIIMNAIPTVRHAFLNRDEAKPGSKTKGRSLGVEHASFEDLQKALSKVTQHFDDEDHFDITQADLIRWGFITASDSRKRREYLGNQLRIGYSNGKQLLKRLRLFGVTKAEVEECMEGY

SEQ ID NO: 5719 - DNA, 609 bp, Streptococcus pyogenes
ttgcaaaagcaacgactgctaatgcaaagagggtattcaagcttgactgaaaaaattaatattcaagaggttcttgttgtagaaggcaaggacgacacggctaacctacgccgtttttacgaggtggatacctatgagactagaggctctgctatcactgaagaagatttagaacgaatcaatcgcctaaacgatttgcgtggtgttatcgttttaacagacccagattataatggtgagcgcattcgtaagctcattatggctgctgtgccaacagctcgtcatgcctttttaaaccgaaacgaggcggttccgagttctaagagtaagggtcgttccttaggggttgaacatgccaattttgaggatctccaaaaggcacttgctcatgtcactcagcaatatgatgatgagtcttattttgacattcgtcaaacagacctgattcgtctagggcttttaatggcgtcagatagccgtaaacgcagggaatacttgggtgaaaagctccgcatcggttatgccaacggcaaacaactgctcaagcgcctcgaattatttggcattaccctagcagaagtggaagaagtgatggagacatatgaggag

SEQ ID NO: 5720 - protein, 203 aa, Streptococcus pyogenes
LQKQRLLMQRGYSSLTEKINIQEVLVVEGKDDTANLRRFYEVDTYETRGSAITEEDLERINRLNDLRGVIVLTDPDYNGERIRKLIMAAVPTARHAFLNRNEAVPSSKSKGRSLGVEHANFEDLQKALAHVTQQYDDESYFDIRQTDLIRLGLLMASDSRKRREYLGEKLRIGYANGKQLLKRLELFGITLAEVEEVMETYEE

SEQ ID NO: 5721 - DNA, 852 bp, Streptococcus agalactiae
atgcttcagtcttatgttataataataaagattaatgcttgtagctacgataagcaaagaaagaacgatgatatgataaaaatatttgatacccatacccaccttaacgtagaaaattttgaaggaaagatagacgaggaaattaatttagctagcgaactcggtgttacaaaaatgaatgttgtcggctttgaccaagataccatttcaaaatctttggaattatcttcccaatatgcacaggtatatagcacaataggatggcatccaactgaagctggttcttatgatgataatattgagtcaatgattatcagtcatttagaaaatcccaaggttattgcacttggtgaaattggtctggattattattggatggaggatcccaaagatattcagatcgaggtgtttaagcgtcaaattgaactttcaaaagagtataaccttccttttgtcgttcatacacgtgatgcgttagaagacacttatgaagtcattaaggaatctggagttgggccttttggtggtataatgcactctttttctggttctttggaaatggctcagaaatttattgatttagggatgatgatttccttttctggtgttgtgacctttaagaaggcattagatgtacaagaagctgcacgagagttgccattagataagatattagtggaaacagatgctccttatttggctcctgtacctaaaagaggtcgagaaaacaaaaccgcttatacgagatatgtcgttgaaaaaatagcagagctacgaggcataactgtggaagaggtagcggaggctacataccaaaatgcagtaaggatatttagacttgatgaaaaaaat

SEQ ID NO: 5722 - protein, 284 aa, Streptococcus agalactiae
MLQSYVIIIKINACSYDKQRKNDDMIKIFDTHTHLNVENFEGKIDEEINLASELGVTKMNVVGFDQDTISKSLELSSQYAQVYSTIGWHPTEAGSYDDNIESMIISHLENPKVIALGEIGLDYYWMEDPKDIQIEVFKRQIELSKEYNLPFVVHTRDALEDTYEVIKESGVGPFGGIMHSFSGSLEMAQKFIDLGMMISFSGVVTFKKALDVQEAARELPLDKILVETDAPYLAPVPKRGRENKTAYTRYVVEKIAELRGITVEEVAEATYQNAVRIFRLDEKN

SEQ ID NO: 5723 - DNA, 885 bp, Streptococcus pyogenes
gtgtcagctagcaaagggttttacgatcaacctaaacggcagaagttctcaccaagttttctgatgtggttaagatctttatgttataataacatcatgacaaataaagtagaaaaactaactatttttgatacccatacgcacctgaatgtagcagaatttcaaggacacgaaactgaagaattgactttggctcaagaaatgggcgtggcctaccataatgtggttggctttgaccaggccactattagtggggcactaactctagccaataaatatgccaatatttatgcaactattgggtggcatccaacagaagcaggttcttattcagaggctgttgaggaggctatcgtctctcaattatcacattccaaagtgattgccttaggtgaaattggcttagactattattggatggaggaccccaaagaggtgcaaatagaggtttttaagcgccaaatgcaattagcaaaagaccatgatttgccttttgtggtgcacacccgcgatgccttggaagatacctatgaggtcatcaaagcagctggtgttggccctcgtggaggcatcatgcattcttactcagggtcattagagatggctgaacgtttcattgaacttggcatgatgatttccttttcaggtgtggtcactttcaaaaaggctcttgatattcaagaggcagcgcagcacttgcctttggataagattttggtggaaacagatgccccttatcttacaccagttccaaaacgtggcaaacaaaatcatacagcttatacccgctatgtggttgataaaatcgcagagctacgggggatgactgtggaagaagttgcaaaagcaacgactgctaatgcaaagagggtattcaagcttgac

SEQ ID NO: 5724 - protein, 295 aa, Streptococcus pyogenes
VSASKGFYDQPKRQKFSPSFLMWLRSLCYNNIMTNKVEKLTIFDTHTHLNVAEFQGHETEELTLAQEMGVAYHNVVGFDQATISGALTLANKYANIYATIGWHPTEAGSYSEAVEEAIVSQLSHSKVIALGEIGLDYYWMEDPKEVQIEVFKRQMQLAKDHDLPFVVHTRDALEDTYEVIKAAGVGPRGGIMHSYSGSLEMAERFIELGMMISFSGVVTFKKALDIQEAAQHLPLDKILVETDAPYLTPVPKRGKQNHTAYTRYVVDKIAELRGMTVEEVAKATTANAKRVFKLD

SEQ ID NO: 5725 - DNA, 279 bp, Streptococcus agalactiae
ttgagtttaatgtgggatgtcctgactggtaaggagtcagtaaggactttaaaaaaacaattggataaagaattgatacatagcgtgtacgcgccacgcaagagatctaagtttcacgatattattacgtcgcatcataaagaaatagacgaagtagccatcaacacaaagacagctattcataaagttgctaatcaattggacgaggcaataaaaggagaatttcgttcaaaggttgaggaggctattgaaagcaatcagcaaaaatataatcattta

SEQ ID NO: 5726 - protein, 93 aa, Streptococcus agalactiae
MSLMWDVLTGKESVRTLKKQLDKELIHSVYAPRKRSKFHDIITSHHKEIDEVAINTKTAIHKVANQLDEAIKGEFRSKVEEAIESNQQKYNHL

SEQ ID NO: 5727 - DNA, 390 bp, Streptococcus agalactiae
atggcactgattgatatcattgaaaaacaattagctgatactcagagaaaaatatcagatttagatgatgcctatcaccatagttgttgccagtttgaagaaaaattagacgatctctcagtaagaaaaaataagattattaatatgcttcaagaaacttacgacgctgttgaatatgatttgagatatagtaatgatagctcagatatgatgacgctcaatcgtattttagattcttatcatgacgacttagagcaagcttaccataaagagtactatgccttgtccgctcaagaagaagaatatagagctaactatattcggcaacgttcagaacatgaactaacctttgaagagttgcaaagggaaaagaaaagagaattaatgaag

SEQ ID NO: 5728 - protein, 130 aa, Streptococcus agalactiae
MALIDIIEKQLADTQRKISDLDDAYHHSCCQFEEKLDDLSVRKNKIINMLQETYDAVEYDLRYSNDSSDMMTLNRILDSYHDDLEQAYHKEYYALSAQEEEYRANYIRQRSEHELTFEELQREKKRELMK

SEQ ID NO: 5729 - DNA, 1290 bp, Streptococcus agalactiae
atggaaaaagtcttgactgatttagatagggtaaatatagcgaagcaagagtatgaattaggtagccaacttgatacactagtcaaaataatgagccaagataaggtactccccatcggtaaagttgctcacgttcaagatggaggcaaagaaaccggggaacaaatttataccatcactccaaatggaactttagacaagccagaggatgttaaggaagttacggttttatttaaggggtcaacagcaccgtttggaggggatgattggaaaacagactggtttaaaaatgatattccaatagctagtaaactattattaaagaaatttggttcacaaagtgtatctcataaacaaggtacaaagcagttagaacaatcagctcatctgctaaaagaagttatgaataaatatcctaacgcaaaaatttcggtctacggacactcgttagggtcaatgaatgcacagtatgctattgcagaattggatgataatcaaatttaccgagttcaaggagcttggatatataacggtccaaacctttatagtattttgacagataaacaaaaagaacaggttgataaaataaaaggggtggtcaataattacgttgattccaaggataaaattggaataggttatcctaaagaaggaagcgataatgctgtcggaattgttaaaatagttgacagtaaagctgtttcaggaggtagctgggttgctaattttaccaatcagcatatttggggaggctaccagtacaatccagatggttctttaaaattagcagaagataaatttgcttacaaagaaaactattcagtagttcatacgaatgtgaatcaaagaatgcatgctattaaagcgaaacttagtagctttaaaagtacgggaaaagaagttagtaagaatcaagctattttcctagatagtcaacaagcaaaagtgatctctagtggtttggtaacgatatcaaaagaagcagttgaagaagttaaaaaagttgagcaaaaagcagttgctaaagcagaagagctttatcaatctttaaaagtagctcctacaggagttactgaactaagtcctcaagaattggaagaagcgtatgctcagtcaggtgttagctatgcgagcattgtcggagaagctcaaacctttttctcaaataaaactcaagcggcagaaagcatttctcacgcttacgttgaattagaaaaccaaattaataaaggagttgaagctatgttgcgacaagatagtaacttgtcaggggagtttaaacaatggcac

SEQ ID NO: 5730 - protein, 430 aa, Streptococcus agalactiae
MEKVLTDLDRVNIAKQEYELGSQLDTLVKIMSQDKVLPIGKVAHVQDGGKETGEQIYTITPNGTLDKPEDVKEVTVLFKGSTAPFGGDDWKTDWFKNDIPIASKLLLKKFGSQSVSHKQGTKQLEQSAHLLKEVMNKYPNAKISVYGHSLGSMNAQYAIAELDDNQIYRVQGAWIYNGPNLYSILTDKQKEQVDKIKGVVNNYVDSKDKIGIGYPKEGSDNAVGIVKIVDSKAVSGGSWVANFTNQHIWGGYQYNPDGSLKLAEDKFAYKENYSVVHTNVNQRMHAIKAKLSSFKSTGKEVSKNQAIFLDSQQAKVISSGLVTISKEAVEEVKKVEQKAVAKAEELYQSLKVAPTGVTELSPQELEEAYAQSGVSYASIVGEAQTFFSNKTQAAESISHAYVELENQINKGVEAMLRQDSNLSGEFKQWH

SEQ ID NO: 5731 - DNA, 408 bp, Streptococcus agalactiae
atgataaaaggaggagagatgaagtcaataaaattacttagttttattgtaataatccttttagggcttggtttcactgtaggaggtttaaaagtgactgaaaacaataaacaacaagaattatgggaaatagctaatagcaaagacgctaaaaatgcttatcaaaagtggatttatgcagaagatgaagatgctttcaaagagaatgctgttattaagtcgtatgatattgacaaagaaagtatcaaaaaaaatcctatgggagggatttcggtaaggttaatcattaataaagatcctaacttatatattacttgtaatttggatagggataatcaagggcatttggtcagtcaaagtagccatcaatctccccagttaactcatttattggaaagtagaggtcat

SEQ ID NO: 5732 - protein, 136 aa, Streptococcus agalactiae
MIKGGEMKSIKLLSFIVIILLGLGFTVGGLKVTENNKQQELWEIANSKDAKNAYQKWIYAEDEDAFKENAVIKSYDIDKESIKKNPMGGISVRLIINKDPNLYITCNLDRDNQGHLVSQSSHQSPQLTHLLESRGH

SEQ ID NO: 5733 - DNA, 1260 bp, Streptococcus agalactiae
atgcttaaacgtctaggtaaagtatttggacctctagtttgtgctttactattgttggtaggattatattttgtttttcctgtttctcagcctcatcatttaggtaaggaaaaaaacagtgcagtagcgttgacgaaggcaggttttaaaagcagagttcaaaaagttagagctttcagtgatcctaaagccaattttgtccctttctttggttcaagtgagtggctaagatttgacgcaatgcatccatcagttttagcagaggcttacaataggtcttatatcccatatcttttaggtcaaaaaggggcggcttctctgacacaatactatggcattcaacagattaaaggacaaatcaaaaataaaaaagctatctatgttatttctccgcaatggtttgttcgcaagggagccaacaaaggtgcttttcaaaactatttcagcaacgatcaaaccattcgatttttgcaaaatcaaacagggacaacctacgataggtatgctgctcgtcgattgttaaaattatatcctgaagcttctatgtcagatttgatagaaaaagttgcagatggccaaaaactatcaaataaagacaaacaaagactaaagtttaatgattgggtatttgagaagacagatgctatttttagctatctaccactaggaaaaacttataatcaggcaataatgcctcatgttggtaaattaccgaaagcattctcatataatcatttatcgcgtattgcatcacaagatgctaaagtagcaacgagatcaaatcaatttggtattgatgatcgcttttaccaaacaagaattaaaaagcacttaaaaaaattgaaagggtcacaacgacatttcaattatactaagtcaccagaatttaatgatttacagttggttcttaatgaattctcaaaacaaaatacagatgtcctttttgtcataccaccagtaaataaaaagtggacagactacacagggcttgatcaaaaaatgtatcaaaaatctgtagaaaaaataaaacaccaacttcaaagtcaaggtttcaatcatatcgctgacctttctcgagatggaggtaagccatactttatgcaagatacaatccatttaggttggaatggttggttagagctagataagcatatcaatccatttttaacagaggaaaacagcaagccgaattatcacattaataataaatttttgaagaaatcttgggcaaaatatacaggacgtccaagtgattacaag

SEQ ID NO: 5734 - protein, 420 aa, Streptococcus agalactiae
MLKRLGKVFGPLVCALLLLVGLYFVFPVSQPHHLGKEKNSAVALTKAGFKSRVQKVRAFSDPKANFVPFFGSSEWLRFDAMHPSVLAEAYNRSYIPYLLGQKGAASLTQYYGIQQIKGQIKNKKAIYVISPQWFVRKGANKGAFQNYFSNDQTIRFLQNQTGTTYDRYAARRLLKLYPEASMSDLIEKVADGQKLSNKDKQRLKFNDWVFEKTDAIFSYLPLGKTYNQAIMPHVGKLPKAFSYNHLSRIASQDAKVATRSNQFGIDDRFYQTRIKKHLKKLKGSQRHFNYTKSPEFNDLQLVLNEFSKQNTDVLFVIPPVNKKWTDYTGLDQKMYQKSVEKIKHQLQSQGFNHIADLSRDGGKPYFMQDTIHLGWNGWLELDKHINPFLTEENSKPNYHINNKFLKKSWAKYTGRPSDYK

SEQ ID NO: 5735 - DNA, 1248 bp, Streptococcus pyogenes
atgcttaagagactctggttaattctaggtcctcttcttattgcctttgttttagtagtgattactatttttagttttcctacacaacttgatcattccatagctcaggaaaaagcaaatgccgttgcgatcacagatagttcttttaaaaatggtttgattaaaagacaagctttatcagatgagacttgtcgttttgtgcctttttttggttctagcgaatggagtcgaatggatagtatgcacccttcggtgcttgcagagcgctacaagcggagctatagaccatttttaattggtaagagaggatcagcatctttgtcgcattattatggtatacaacaaattaccaatgaaatgcaaaagaaaaaagccatctttgtagtatctcctcaatggtttactgctcaagggattaatcctagtgcggttcagatgtacttgtctaacactcaagtgattgaatttttactaaaagctagaactgataaagaatcacagtttgcagcaaagcgtttgcttgagcttaaccctggtgtgtctaaatcaaacttattgaaaaaagtaagtaagggtaagtctcttagtcggttagacagagctattttgaaatgtcaacatcaagtagcattgagagaagagtccctttttagttttttaggcaaatctactaactatgaaaaaagaattttgcctcgcgttaagggattacctaaagtattttcgtataaacaattgaatgcattagcaactaagagaggccaattagcaacaaccaacaaccgttttgggattaaaaatacattttatcgtaaacgaatagcacctaaatacaatctttataagaatttccaagttaattatagttacctggcgtcaccagaatacaatgattttcagcttttattatcagaatttgctaaacgaaaaacagatgtactctttgttataactcctgttaataaagcttgggcggattataccggcttaaatcaagataagtatcaagcggcagttcgtaaaataaaattccagttaaagtcacaaggatttcatcgcattgctgacttctcaaaagatggtggtgagtcctactttatgcaagataccatccatctcggttggaatggctggttagcttttgataagaaagtgcaaccatttctagaaacgaagcagccagtgcccaactataaaatgaacccttatttttatagtaaaatttgggcaaataggaaagacttgcaa

SEQ ID NO: 5736 - protein, 416 aa, Streptococcus pyogenes
MLKRLWLILGPLLIAFVLVVITIFSFPTQLDHSIAQEKANAVAITDSSFKNGLIKRQALSDETCRFVPFFGSSEWSRMDSMHPSVLAERYKRSYRPFLIGKRGSASLSHYYGIQQITNEMQKKKAIFVVSPQWFTAQGINPSAVQMYLSNTQVIEFLLKARTDKESQFAAKRLLELNPGVSKSNLLKKVSKGKSLSRLDRAILKCQHQVALREESLFSFLGKSTNYEKRILPRVKGLPKVFSYKQLNALATKRGQLATTNNRFGIKNTFYRKRIAPKYNLYKNFQVNYSYLASPEYNDFQLLLSEFAKRKTDVLFVITPVNKAWADYTGLNQDKYQAAVRKIKFQLKSQGFHRIADFSKDGGESYFMQDTIHLGWNGWLAFDKKVQPFLETKQPVPNYKMNPYFYSKIWANRKDLQ

SEQ ID NO: 5737 - DNA, 237 bp, Streptococcus agalactiae
atggatattaaatcagaagtattagcaattattgatgacctatttatggaggatgtttcttctatgatggatgaagacttatttgacgcaggagttctagacagcatgggtactgttgaactaattgttgagttggaaagccactttaatattgatattccgattgcggaatttggtcgtaatgactggaacacagctaataaaattgttgctggagtaacggagctctgcaatgct

SEQ ID NO: 5738 - protein, 79 aa, Streptococcus agalactiae
MDIKSEVLAIIDDLFMEDVSSMMDEDLFDAGVLDSMGTVELIVELESHFNIDIPIAEFGRNDWNTANKIVAGVTELCNA

SEQ ID NO: 5739 - DNA, 237 bp, Streptococcus pyogenes
atgtctattgaagaaactgtaattgaattgtttgaccgtttgtttatggaagatgtttcagagatgatggacgaagacttgtttgatgcaggtgtgttggatagtcttgggacagtcgaattgattgttgagttagagtcaacgttcaatattaaagtacctatttcagaatttggtcgtgatgattggaacacagtaactaagattgttcaaggtgtagaggaattgcaacatgct

SEQ ID NO: 5740 - protein, 79 aa, Streptococcus pyogenes
MSIEETVIELFDRLFMEDVSEMMDEDLFDAGVLDSLGTVELIVELESTFNIKVPISEFGRDDWNTVTKIVQGVEELQHA

SEQ ID NO: 5741 - DNA, 1263 bp, Streptococcus agalactiae
gtgatacaggcatttttagaaaaacttcctcacttggatgtttatgggaatccacaatatttcttctaccttatcttagctgtcctaccaatttacatcggcttattctttaagaagcgttttgccttatatgagattatttttagtctaagttttattgtaatgatgttgactggtagtacttttaatcaattgaagtcactattggcatacgttgtcggacagtctctgctagtttttatctataaagcttaccggaaacgatttaatcatactttggtcttttatgtaacggtttgtttatctatttttccgctatttttggtaaaattaattccagctatatctgaggatgggcatcagtcactttttgggtttctaggaatttcttaccttacttttagagctgttgctatgattattgaaatgagagacggtgtcttgaaagaatttactttatgggaattcttaagatttttactcttctttccaactttctcaagtggaccaattgatcgttttaaacgattcaatgaggattacattaatatcccagatcgaaacgaactcctagatatgttaggtcaagcgattcattatttgatgttaggttttctctataagtttattttagcctatatttttggaagtctgattatgcctcctctaaaagaattagcgctagaacagggtggtgtgtttaattggccaacacttggggttatgtatgcctttggttttgatttgttctttgattttgcaggttacacaatgtttgcgttggctatttctaacctaatggggattaagtctccgattaactttgacaaacctttcaaatcacgcgacctaaaagaattttggaatagatggcatatgagcctttctttctggtttagagactttgttttcatgaggcttgttaagcttttagttaaaaataaagtttttaaaaaccgtaatgttacttcaagtgtagcttatattatcaatatgcttcttatgggattctggcatgggttaacttggtactatatagcctatggtctctttcatgggattggcctagttattaatgacgcttgggtacgtaagaagaaaaatattaataaagaaagaagattggctaaaaaaccacttttaccagaaaacaaatggacttatgctttgggtgtcttcatcacctttaatgtagttatgttttctttcttgattttttcaggatttttagatcttttgtggttcccacaaccgcataacaaa

SEQ ID NO: 5742 - protein, 421 aa, Streptococcus agalactiae
MIQAFLEKLPHLDVYGNPQYFFYLILAVLPIYIGLFFKKRFALYEIIFSLSFIVMMLTGSTFNQLKSLLAYVVGQSLLVFIYKAYRKRFNHTLVFYVTVCLSIFPLFLVKLIPAISEDGHQSLFGFLGISYLTFRAVAMIIEMRDGVLKEFTLWEFLRFLLFFPTFSSGPIDRFKRFNEDYINIPDRNELLDMLGQAIHYLMLGFLYKFILAYIFGSLIMPPLKELALEQGGVFNWPTLGVMYAFGFDLFFDFAGYTMFALAISNLMGIKSPINFDKPFKSRDLKEFWNRWHMSLSFWFRDFVFMRLVKLLVKNKVFKNRNVTSSVAYIINMLLMGFWHGLTWYYIAYGLFHGIGLVINDAWVRKKKNINKERRLAKKPLLPENKWTYALGVFITFNVVMFSFLIFSGFLDLLWFPQPHNK

SEQ ID NO: 5743 - DNA, 1254 bp, Streptococcus pyogenes
atgatgatgttttttagccacattccctacatggaaccttacggtaaccccatttactttgtctatcttattttggctttcttaccagtcatcattgggatttttaaacaaaagcgcttaagcacttatgaaaccttggtgagtttggtatttattctctttatgtttggaggagatcattatcaacaattagttgcttttctcttttatcttttgtggcaaatcatcagtgtttttgcttaccagaaataccgtgagaatgctaatagtgcaggagtgttttacttagctattgcgatggccttattcccccttatctgggtcaaagttgctcccctaacaggtccttcttctcaaacactctttagttttctagggatttcatatttgacctttaaaagtattggaatgattattgagatgcgtgacgggactctccaagaggttcgtttaccggattttattcgcttcatgattttcttccccaccttctcaagtggccccattgatcgcttcagacattttcaggaagattatcataaacttcctgaacgtgatgattattttgcaatgctcaataaggcagtcatgtatctcatgttaggttttctatacaagcatatcatttcctattgtttgggtggcatcttacttcctctccttgaaaataaggctttgatggttggtggctactttaataaggaaactattctggttatgtacgtatatggcttgaatctcttttttgactttgctggttattcgatgtttgcgattggtatttcctacctattgggtattcgaacaccagaaaactttaacatgcctttcttatctgcaagtttgaaagatttttggaatagatggcacatgagtttgtccttctggtttagagattatgtgtttatgcgattggttcatctattgattaagcataaaacctttaaaaaccgaaatgtcacttcaggtgttgcctatctggttaatatgctagtcatgggattttggcatggcttaacctggtattatatcgcttatgggcttttccatggtataggacttattattaatgatgcttggattcgtaagaaaaaagaaatcaaccgtcaccgtaagaaaaaaggcttatcacccctctttcaaagcagggcattccatgtcttatgtatcgtggtaactttccacgttgtcatgttttcacttctgttattctctggttttttaaatgacctttggtttaacagaccactacat

SEQ ID NO: 5744 - protein, 418 aa, Streptococcus pyogenes
MMMFFSHIPYMEPYGNPIYFVYLILAFLPVIIGIFKQKRLSTYETLVSLVFILFMFGGDHYQQLVAFLFYLLWQIISVFAYQKYRENANSAGVFYLAIAMALFPLIWVKVAPLTGPSSQTLFSFLGISYLTFKSIGMIIEMRDGTLQEVRLPDFIRFMIFFPTFSSGPIDRFRHFQEDYHKLPERDDYFAMLNKAVMYLMLGFLYKHIISYCLGGILLPLLENKALMVGGYFNKETILVMYVYGLNLFFDFAGYSMFAIGISYLLGIRTPENFNMPFLSASLKDFWNRWHMSLSFWFRDYVFMRLVHLLIKHKTFKNRNVTSGVAYLVNMLVMGFWHGLTWYYIAYGLFHGIGLIINDAWIRKKKEINRHRKKKGLSPLFQSRAFHVLCIVVTFHVVMFSLLLFSGFLNDLWFNRPLH

SEQ ID NO: 5745 - DNA, 1542 bp, Streptococcus agalactiae
atggtacaaatgatacatgatatgattaaaacaattgagcattttgctgagacacaagctgattttccagtgtatgatattttaggggaagtccatacttatggacaacttaaagtagactctgactctctagctgctcatattgatagcctaggccttgttgaaaaatcacctgtcttagtattcggtggtcaagaatatgaaatgttggcgacatttgttgctttaacaaagtcagggcatgcttatataccggttgaccaacactctgctttggatagaatacaggctattatgacagttgctcaaccaagccttatcatttcaattggtgaatttcctcttgaagttgataatgtcccaatcctagacgtttctcaagtttcagctatttttgaagaaaagactccttatgaggtaacacattctgttaaaggtgatgataattactatattattttcacttcagggactactggtttaccaaaaggtgtgcaaatttcacatgacaatttattgagctttacaaattggatgatttctgatgatgagttttcagttcctgaaagaccgcaaatgttggctcaaccgccatattcatttgacttatcagttatgtattgggcaccaacactagctatgggaggcaccctgtttgccctaccaaagacagtagttaatgatttcaaaaaactattcgctaccattaatgaattgccaatacaggtttggacttcgacaccatcatttgctgatatggcgctactatctaacgatttcaattcagagaccttgccacagttaacacatttttattttgatggggaagagttaactgtcaagactgcacaaaaacttcgtcaacgttttccaaaagctcgtatcgttaatgcatatgggccaacagaagcaacagttgctctatccgcagtagcaattactgatgaaatgttagaaacatgcaaacgccttccaattggttacactaaagatgactcaccaacgtatgtgattgatgaagaaggtcataaattaccaaacggagagcaaggtgaaatcattattgctggaccagcagtatcaaaaggctatcttaacaatccagaaaagacagctgaggcatttttccaattcgaaggtctacctgcttaccataccggtgacttaggaagtatgaccgatgaaggtcttctgctttacggtgggcgtatggatttccaaattaaatttaacggctatcgtattgaattagaagatgtttctcaaaacttaaacaaatcgcagtatgtaaaatcagcagtagcagtgccacgttataacaaggatcataaagttcaaaacttattagcctatattgtcttaaaagaaggtgtaagagatgattttgaacgtgatttggatttgacaaaagcaattaaggaagacttaaaggacattatgatggattacatgatgccatctaaatttatctatcgagaggatttacctttgacaccaaatgggaaaattgatatcaaaggtcttatgagcgaggtaaacaag

SEQ ID NO: 5746 - protein, 514 aa, Streptococcus agalactiae
MVQMIHDMIKTIEHFAETQADFPVYDILGEVHTYGQLKVDSDSLAAHIDSLGLVEKSPVLVFGGQEYEMLATFVALTKSGHAYIPVDQHSALDRIQAIMTVAQPSLIISIGEFPLEVDNVPILDVSQVSAIFEEKTPYEVTHSVKGDDNYYIIFTSGTTGLPKGVQISHDNLLSFTNWMISDDEFSVPERPQMLAQPPYSFDLSVMYWAPTLAMGGTLFALPKTVVNDFKKLFATINELPIQVWTSTPSFADMALLSNDFNSETLPQLTHFYFDGEELTVKTAQKLRQRFPKARIVNAYGPTEATVALSAVAITDEMLETCKRLPIGYTKDDSPTYVIDEEGHKLPNGEQGEIIIAGPAVSKGYLNNPEKTAEAFFQFEGLPAYHTGDLGSMTDEGLLLYGGRMDFQIKFNGYRIELEDVSQNLNKSQYVKSAVAVPRYNKDHKVQNLLAYIVLKEGVRDDFERDLDLTKAIKEDLKDIMMDYMMPSKFIYREDLPLTPNGKIDIKGLMSEVNK

SEQ ID NO: 5747 - DNA, 1536 bp, Streptococcus pyogenes
atgattaaggatatgattgacagtattgagcagtttgctcagacacaggctgattttccagtttatgattgtttaggggaacgccgcacttacggacaactcaaaagagattctgatagcattgctgcatttatagatagcttagctttactggcaaaatctccagttttggtttttggggcgcaaacttatgatatgttagctacttttgtagctttaaccaaatctggtcatgcctatatcccagtagatgtgcattcagcaccagaacgtattttagcgattattgagattgcaaagcccagtttaatcattgctattgaggaattccctcttactattgaagggatttcccttgtctcactatcagagattgagtcagcaaaattagcagaaatgccctatgagcgaacacattctgttaaaggagatgataattattacattattttcacctctggaacaacgggccaaccaaaaggggtgcaaatttcacatgacaatcttttgagctttaccaactggatgatcgaagatgcagcatttgatgtacctaaacagccacaaatgctggcgcagccaccctattcctttgacctttctgtcatgtactgggcacctaccttggctttaggtggaaccttatttgcacttccaaaagaattggtggcagactttaaacagttatttacaacgattgcgcaacttccagttggcatttggacatcgactccttcatttgctgatatggccatgcttagcgatgatttttgccaggctaagatgccagctttaacgcatttttattttgatggcgaagaattaaccgtttctacggctcgaaaactctttgaacgtttcccgagtgccaagattatcaatgcctatggaccaacagaagcgactgtagccttatccgctattgaaattaccagagaaatggtggataattatacccgcttgccgattggctaccccaaaccagattctccgacctatattattgatgaagatggtaaggagttatcttcaggggagcagggtgaaattattgttacagggcctgctgtgtcaaaaggttacctcaacaatcctgagaaaaccgcagaagctttctttacttttaaaggacagcctgcttatcatacaggggacattggctcactgacagaagataatattttgttgtatggtgggcgtttggattttcagattaaatatgctggttatcgtattgaactagaagatgtttcccaacagttgaatcaatcaccaatggtagcatcggctgtggctgttccaaggtacaataaagaacataaggttcaaaatctcttggcctatatcgttgtcaaagatggggttaaagagcgttttgatagggaattggagttaaccaaagctatcaaagcctctgttaaggatcatatgatgagttatatgatgccttctaagtttctttatcgagatagtctaccattaactccaaatggtaagatagatattaaaactttgattaatgaggtcaataaccga

SEQ ID NO: 5748 - protein, 512 aa, Streptococcus pyogenes
MIKDMIDSIEQFAQTQADFPVYDCLGERRTYGQLKRDSDSIAAFIDSLALLAKSPVLVFGAQTYDMLATFVALTKSGHAYIPVDVHSAPERILAIIEIAKPSLIIAIEEFPLTIEGISLVSLSEIESAKLAEMPYERTHSVKGDDNYYIIFTSGTTGQPKGVQISHDNLLSFTNWMIEDAAFDVPKQPQMLAQPPYSFDLSVMYWAPTLALGGTLFALPKELVADFKQLFTTIAQLPVGIWTSTPSFADMAMLSDDFCQAKMPALTHFYFDGEELTVSTARKLFERFPSAKIINAYGPTEATVALSAIEITREMVDNYTRLPIGYPKPDSPTYIIDEDGKELSSGEQGEIIVTGPAVSKGYLNNPEKTAEAFFTFKGQPAYHTGDIGSLTEDNILLYGGRLDFQIKYAGYRIELEDVSQQLNQSPMVASAVAVPRYNKEHKVQNLLAYIVVKDGVKERFDRELELTKAIKASVKDHMMSYMMPSKFLYRDSLPLTPNGKIDIKTLINEVNNR

SEQ ID NO: 5749 - DNA, 1185 bp, Streptococcus agalactiae
atgtttagtgatttacgcaaaaaatttgtctttttgaccatgtcaatccttattgtcgttgttctctttctatttgcagttagtaatcgctacaatcaatattgggatgaatatgatgcatataggattgttaaattagttgccaaaaatgattatttaggaataccaggcgatgaaccgattgctttggtgactatagataaccaaaagatggttaagattcaaagcaataatactgatttgacaaatgatgttatcgaaaaatctagtttgaagctccttgagcaaggaaagaagtcacgaaaatggaagtcttttatatattccataaaagaatataaagataaaacctacaccatagctattatggatttggctagttatgaagtcccttatgcaaggcgttttctaattcttgtttttactatttttggattttgtttattagcagctgtaagtctttatctttctcgatttattgtaggacctgtagagacagaaatgactcgcgaaaaacagttcgtttcagatgcgagtcatgagctgaagacccctattgcagctatacgagccaacgttcaggttctggaacagcaaattccagggaatcgttatctggatcatgttgtttcggagactaagcgaatggagtttttaattgaagatttgcttaatttgtctagacttgatgaaaaacgctccaaggtaaatttcaaaaagttaaacttatctgtcttatgtcaagaagtacttctaacatatgaaagtttggcatatgaagaagaaaagtgtttaaatgatacgattgaagatgatgtctggattgttggagaagagagtcagattaagcaaattttaataattcttttggataatgctattaggcattctttgtcaaaatcagcaatccagtttagtcttaaacaagctcgaagaaaagctattctgacaatatcaaatccaagtgctatctattccaaagaggttatggataatctctttgagcgtttttatcaagctaaagatgatcatgcagattctctcagttttggtctaggcttatctattgctaaagcaatcgtggaacgccataaggggagaattagagcatatcaagaaaaagaccaattacgtcttgaagtccagttaccaattgatggattttggaccaataccatgattaat

SEQ ID NO: 5750 - protein, 395 aa, Streptococcus agalactiae
MFSDLRKKFVFLTMSILIVVVLFLFAVSNRYNQYWDEYDAYRIVKLVAKNDYLGIPGDEPIALVTIDNQKMVKIQSNNTDLTNDVIEKSSLKLLEQGKKSRKWKSFIYSIKEYKDKTYTIAIMDLASYEVPYARRFLILVFTIFGFCLLAAVSLYLSRFIVGPVETEMTREKQFVSDASHELKTPIAAIRANVQVLEQQIPGNRYLDHVVSETKRMEFLIEDLLNLSRLDEKRSKVNFKKLNLSVLCQEVLLTYESLAYEEEKCLNDTIEDDVWIVGEESQIKQILIILLDNAIRHSLSKSAIQFSLKQARRKAILTISNPSAIYSKEVMDNLFERFYQAKDDHADSLSFGLGLSIAKAIVERHKGRIRAYQEKDQLRLEVQLPIDGFWTNTMIN

SEQ ID NO: 5751 - DNA, 1257 bp, Streptococcus pyogenes
ttgtttattagaaaaataggaggtgacatgtttaatcgtatccgcattcgttttatcatgattgcttctattgccatttttattattttaagttcaattgttggtattattaacacggcacgctgttaccaaagtcaacaagaaattaaccgtattttacatttaatttcctcaaataaaggtaaattacctggcactacggaaagctctaaacgacttggaacgaaactgtctgaagatagcctaagccagtttcggtattatagtgtcatttttaatgctaatggacatctactttcttctaatactgctaatatttcagctttagatagagaagaagcccaatattttgctagactttttgctaagtctggggaagaaaaaggcagttaccgtcaccaagatagtgtttattcgtacttgattactcagctgccaaatgaagaaaaactggttgtaattttagatactaccttttattttcgtagtgtaggagatttattagctgtttcagtgatgttggcctttggaggatttatcttttttgttgttttagtgagtcttttttccggtatggtcatcaaaccttttgtccaaaattatgagaagcagcgtcgctttattactaatgcaggccacgagttaaaaacaccactagccattatctcagccaataatgaattggtcgaattaatgactggagaatcagaatggaccaagagtacaagtgatcaggtgaagcgattgacaggcttgattaatcaaatgattactttggctcgtttggaggaacagccagatgtggtattacatatggtagacttttcagctattgctcaagatgcagctgaagattttaagagtctggttttgaaagatggtaaacgttttgatttgacgattcaaccgaatattatgattaaagcggaggaaaagtcattgtttgaacttgtgacaattttagttgataatgccaataaatattgtgatcctaaaggcttggtcaaggtatctttaaccactattggaagaagacgaaaacgagcgaaattagaagtttctaatacctatttggaaggaaaatccattgattacagccgcttctttgaacgcttttatcgcgaagacgaatcccataatagcaaagaaaaaggttatggaattggtttatctatggcagaaagtatggttaagttatttaaaggaacgataactgtaaattataaaaacgatgctattgtttttacagtggtgatt

SEQ ID NO: 5752 - protein, 419 aa, Streptococcus pyogenes
LFIRKIGGDMFNRIRIRFIMIASIAIFIILSSIVGIINTARCYQSQQEINRILHLISSNKGKLPGTTESSKRLGTKLSEDSLSQFRYYSVIFNANGHLLSSNTANISALDREEAQYFARLFAKSGEEKGSYRHQDSVYSYLITQLPNEEKLVVILDTTFYFRSVGDLLAVSVMLAFGGFIFFVVLVSLFSGMVIKPFVQNYEKQRRFITNAGHELKTPLAIISANNELVELMTGESEWTKSTSDQVKRLTGLINQMITLARLEEQPDVVLHMVDFSAIAQDAAEDFKSLVLKDGKRFDLTIQPNIMIKAEEKSLFELVTILVDNANKYCDPKGLVKVSLTTIGRRRKRAKLEVSNTYLEGKSIDYSRFFERFYREDESHNSKEKGYGIGLSMAESMVKLFKGTITVNYKNDAIVFTVVI

SEQ ID NO: 5753 - DNA, 672 bp, Streptococcus agalactiae
atgagacttcttgtagttgaggatgaaaaaagtatagcagaggctattcaggctttattggcagataaaggttattctgttgatttagcatttgatggagatgatgggttagaatacattttgacaggtctctatgatttagtcctgttggatattatgttacccaaacgctcaggattatctgttttaaaaagagtgagggaagctggtttagaaaccccaataatctttttaactgcaaaatcacagacttatgataaagttaatggtttagatttaggggcagatgattatatcacaaaaccctttgaagcagatgaattgctagctagaattaggctgagaaccagacaatcttctctaatcagagcaaatcaattgcggcttggaaatataaggcttaacacagattcacatgagctagaatctaaagaaagtagtgtaaaattatccaataaagaatttctcttgatggaagtttttatgcgaaatgcaaagcagattattcctaaaaatcagttgatttctaaggtttggggaccttcagacaattcagaatataaccagttagaagtatttatttcttttttgcgaaaaaaattgcgctttttaaaagcagacattgaaataataaccactaagggctttggatattccttggaggagaggaca

SEQ ID NO: 5754 - protein, 224 aa, Streptococcus agalactiae
MRLLVVEDEKSIAEAIQALLADKGYSVDLAFDGDDGLEYILTGLYDLVLLDIMLPKRSGLSVLKRVREAGLETPIIFLTAKSQTYDKVNGLDLGADDYITKPFEADELLARIRLRTRQSSLIRANQLRLGNIRLNTDSHELESKESSVKLSNKEFLLMEVFMRNAKQIIPKNQLISKVWGPSDNSEYNQLEVFISFLRKKLRFLKADIEIITTKGFGYSLEERT

SEQ ID NO: 5755 - DNA, 132 bp, Streptococcus agalactiae
gtgaaacgtacttatcaaccaagtaaaatccgtcgccaacgtaaacacggattccgtcaccgtatgtcaactaaaaacggacgtcgcgtgcttgctagccgccgtcgtaaaggacgtaaagtgttatcagct

SEQ ID NO: 5756 - protein, 44 aa, Streptococcus agalactiae
MKRTYQPSKIRRQRKHGFRHRMSTKNGRRVLASRRRKGRKVLSA

SEQ ID NO: 5757 - DNA, 132 bp, Streptococcus pyogenes
gtgaaacgtacttatcaaccaagtaaaatccgtcgtcaacgtaaacacggattccgtcaccgtatgtcaactaaaaacggacgtcgcgtgcttgctgcacgtcgtcgtaaaggacgtaaagtattatcagct

SEQ ID NO: 5758 - protein, 44 aa, Streptococcus pyogenes
VKRTYQPSKIRRQRKHGFRHRMSTKNGRRVLAARRRKGRKVLSA

SEQ ID NO: 5759 - DNA, 435 bp, Streptococcus agalactiae
atgaagacttttgtcaataatgcctctaagacagtacttagtttatggtttggcgttatgccaacaattatgactgtcggaacaatagctttgattatttcagtatcaacacctatttttaaaattttaggtacaccattccttccgttccttgaacttttagggattccagaagcagatattgcgagtcaaaccatgattgttggtttttcagatatggttgttccttcgataatggcggctgaaattcacagtgagatgacaagatttattgtcgcaacagtttctattgtgcaattaatttatatgtctgagactggtgcggtgatattaggttccaagatccctatcaacattctagaattatttatcatttttatagagagaacaattatttcattacctattattgttttgatggcacatcttttcttt

SEQ ID NO: 5760 - protein, 145 aa, Streptococcus agalactiae
MKTFVNNASKTVLSLWFGVMPTIMTVGTIALIISVSTPIFKILGTPFLPFLELLGIPEADIASQTMIVGFSDMVVPSIMAAEIHSEMTRFIVATVSIVQLIYMSETGAVILGSKIPINILELFIIFIERTIISLPIIVLMAHLFF

SEQ ID NO: 5761 - DNA, 1137 bp, Streptococcus agalactiae
ttggcagttgatttagattcaggaaaaatcttgtatgaaaaagatgctaacaaacccgctgctattgcttccttgactaaaataatgaccgtttatatggtctataaagaaattgataacggtaacctcaagtggaataccaaagtaaatatatctgactacccttatcaactaacacgcgaatctgatgctagtaatgttcctttagaaaaaaggcgctatactgttaaacagctcgtggacgctgccatgatttctagtgctaacagtgcagccattgctttggctgaacatatttcaggaaccgaaagtaaatttgttgataaaatgactgctcaattggaaaagtggggaattcatgatagccacctagtcaatgcttctggcttaaataatagtatgttaggcaatcacatttatccaaaatcgtcacaaaacgacgaaaataaaatgagtgcacgtgatattgctattgttgcctaccatttggtcaacgaatatccttccattcttaagattactagtaagtccgttgctaaatttgataaagatattatgcattcttataactacatgctaccagatatgcctgtctttagaccaggtattacaggtttgaaaactgggacaacggaattagctggccaatcttttattgctacatctactgaaagtggaatgagactactcactgttattatgcatgctgataaggccgataaagacaaatatgctcgctttacagcaactaactctctcttgaactatatcacaaacacctacgaacctaaccttgtattagctaaaggagctgcatataaaggtaaagaagcaagtgtgagagacggaaaagaacaatcggtcatcgctgttgctaaaaacgatttgaaagtagtacagaagaaaaatatcactaaacaaaatcagttaaaaattaactttaaaaaagagcttactgctcctattacaaaaaaagagaacctagggaaagcttattacgttgaccttaataaggttggaaaaggctatctcataaaggaacctagcgttcatttagtggcaaaagatagtattgagcgcagtttcttcctcaaagtgtggtggaatcattttgtgcgctacgttaacgaaaaactt

SEQ ID NO: 5762 - protein, 379 aa, Streptococcus agalactiae
MAVDLDSGKILYEKDANKPAAIASLTKIMTVYMVYKEIDNGNLKWNTKVNISDYPYQLTRESDASNVPLEKRRYTVKQLVDAAMISSANSAAIALAEHISGTESKFVDKMTAQLEKWGIHDSHLVNASGLNNSMLGNHIYPKSSQNDENKMSARDIAIVAYHLVNEYPSILKITSKSVAKFDKDIMHSYNYMLPDMPVFRPGITGLKTGTTELAGQSFIATSTESGMRLLTVIMHADKADKDKYARFTATNSLLNYITNTYEPNLVLAKGAAYKGKEASVRDGKEQSVIAVAKNDLKVVQKKNITKQNQLKINFKKELTAPITKKENLGKAYYVDLNKVGKGYLIKEPSVHLVAKDSIERSFFLKVWWNHFVRYVNEKL

SEQ ID NO: 5763 - DNA, 1230 bp, Streptococcus pyogenes
atgatcaaacgattaatttccctagtggtcatcgccttattttttgcagcaagcactgttagcggtgaagagtattcggtaactgctaagcatgcgattgccgttgaccttgaaagtggcaaagttttatacgaaaaagatgctaaagaagttgtcccagtcgcctcagtcagtaagctcttgacaacctatctggtttacaaagaagtttctaagggcaagctaaattgggatagtcctgtaactatttctaactacccttatgaactcactacaaactatactattagtaacgttcctcttgataagagaaaatataccgttaaagaacttttaagtgcgttagttgttaataacgccaatagccccgctattgctttagctgaaaaaataggcggaaccgaacccaaatttgttgacaaaatgaaaaaacaattaagacaatggggcatttccgatgcaaaggtcgtcaattcaactggcttaactaaccattttttaggagctaatacttatcctaatacagaaccagatgatgaaaattgtttttgcgccactgatttagctattattgccaggcatctcttattagaatttccagaagtactgaaattatctagcaaatcctccactatttttgctggacaaaccatttacagttataattacatgcttaaaggcatgccttgttatcgagaaggcgtggatggtctttttgttggttattctaaaaaagccggtgcttcttttgtagctactagtgtcgaaaatcaaatgagggttattacagtagttttaaatgctgatcaaagccacgaggatgatttagctatatttaaaacaaccaatcaattgttgcagtaccttttaattaattttcaaaaagtccagttaattgaaaataataaaccagtaaaaacgttatatgtcttagacagtcctgaaaaaactgtcaaacttgtagcccaaaatagtttattttttatcaaaccaatacatacaaagaccaaaaataccgtccatattactaagaaatcatccacaatgatcgcacctctatcaaagggacaagtcttaggtagagcaacccttcaagataaacatcttattggacaaggttatctggatactcctccttctatcaatcttatccttcaaaaaaacatttctaaaagtttctttttaaaggtctggtggaaccgttttgtgaggtatgtcaatacctcttta

SEQ ID NO: 5764 - protein, 410 aa, Streptococcus pyogenes
MIKRLISLVVIALFFAASTVSGEEYSVTAKHAIAVDLESGKVLYEKDAKEVVPVASVSKLLTTYLVYKEVSKGKLNWDSPVTISNYPYELTTNYTISNVPLDKRKYTVKELLSALVVNNANSPAIALAEKIGGTEPKFVDKMKKQLRQWGISDAKVVNSTGLTNHFLGANTYPNTEPDDENCFCATDLAIIARHLLLEFPEVLKLSSKSSTIFAGQTIYSYNYMLKGMPCYREGVDGLFVGYSKKAGASFVATSVENQMRVITVVLNADQSHEDDLAIFKTTNQLLQYLLINFQKVQLIENNKPVKTLYVLDSPEKTVKLVAQNSLFFIKPIHTKTKNTVHITKKSSTMIAPLSKGQVLGRATLQDKHLIGQGYLDTPPSINLILQKNISKSFFLKVWWNRFVRYVNTSL

SEQ ID NO: 5765 - DNA, 1185 bp, Streptococcus agalactiae
atgcctaaattaatcgtatctttcctctgcattttattatccctgacttgtgtaaactctgtgcaagctgaagaacataaagatattatgcaaattacccgagaagccggatatgatgttaaagatattaataaacctaaagcgtctatcgttattgacaataaaggtcatattttgtgggaagataacgctgatttagaacgtgatcccgctagcatgtctaaaatgtttactttatatttactatttgaagacttagctaaaggaaaaacaagcctcaacaccacagtgactgcaacagaaacagaccaagccataagtaagatttatgaaattagtaataataatattcatgctggggttgcttatcctattcgtgaactgattactatgacagctgtcccgtcatctaatgtagcaactattatgattgctaaccacttatcacaaaacaatcctgacgccttcattaaacgaatcaatgaaaccgccaagaaactcggtatgacaaaaactcacttttataaccccagtggggcggtagcgagtgcttttaatggactttactccccaaaagaatacgataacaatgctactaacgttacgactgcacgtgatctatcaattttaacctatcatttccttaaaaaataccctgatatactgaactatacaaaatatcctgaagtcaaggccatggtcggaactccttatgaagaaacatttacaacttataactactctacccccggcgctaaatttggattagaaggagtagatggcttaaaaactggttctagccctagcgctgcttttaatgccttagttacagctaaacgccagaatactcgcttgataactgtggttttaggagttggtgattggtcagaccaagacggagagtactatcgtcatccgtttgtcaacgctcttgtagaaaaaggttttaaagacgctaaaaatatttcttctaaaactcctgtattaaaagccgttaaacctaaaaaagaagttactaaaaccaaaaccaaatctattcaagaacagcctcaaacaaaagaacagtggtggacaaaaacagatcaatttattcaatcacattttgtatctattttaattgttctgggcaccatcgctatcctttgtcttttagctgggatagtattacttataaagcgctctaga

SEQ ID NO: 5766 - protein, 395 aa, Streptococcus agalactiae
MPKLIVSFLCILLSLTCVNSVQAEEHKDIMQITREAGYDVKDINKPKASIVIDNKGHILWEDNADLERDPASMSKMFTLYLLFEDLAKGKTSLNTTVTATETDQAISKIYEISNNNIHAGVAYPIRELITMTAVPSSNVATIMIANHLSQNNPDAFIKRINETAKKLGMTKTHFYNPSGAVASAFNGLYSPKEYDNNATNVTTARDLSILTYHFLKKYPDILNYTKYPEVKAMVGTPYEETFTTYNYSTPGAKFGLEGVDGLKTGSSPSAAFNALVTAKRQNTRLITVVLGVGDWSDQDGEYYRHPFVNALVEKGFKDAKNISSKTPVLKAVKPKKEVTKTKTKSIQEQPQTKEQWWTKTDQFIQSHFVSILIVLGTIAILCLLAGIVLLIKRSR

SEQ ID NO: 5767 - DNA, 1179 bp, Streptococcus pyogenes
ttgaccaaaagaattatactaactatttttacctttatttgcttttcggtgatgcctcttgtccacgccgaagatgtcatggatattacaaggcaagcaggctacacagttagtgaggttaatcgaccaaaatcttctattgtcgttgatgcaaatagttcagatattctttggcaagataatattgatattcctagggatcctgctagtatgtctaagatgtttacgctttacattttatttgaagagctcgctaagggaaaaattacgatggacactactattacggcaactccaaccgatcaagctatcgctaacatttatgagattagcaataataatatcgtcgctggagtagcttatcctattcgtgatcttattactatgacagctgtgccttcatcaaatgcagcaactgttatgattgccaattatttatcaaacaatgatgcttctgcgtttatcgatcgtgttaatgccacagccaaacaattaggcatgactaacactcatttttcaaacgctagtggtgcagcagcacaagcttttcaaggttattataatcctactaaatatgatttatctgcttcaaatattacgaccgctcgagatttgtccaagttactctatgccttcttaaaaaaataccctgaaattatctcctttacaaataaatctgttgtgcacactatggtaggaacgccatatgaagaagaatttcacacctataaccactctctcccagataatcaatttggtatgaaaggagttgatggattaaaaacaggttctagtcccagtgctgcttttaacgccatgataactgccaaaagaggcaaaactcgactcattactattgtcatgggggtcggagattggtcagatcaaaacggggagttttatagacatcctttcgtcaatgccttgactgagaaagggtttaaagatagtaagaccttatccaaaaaagcacgccaaaaactcgaaaaattagtgccacaaaccaaaaaagaaacatcatctaaacagcagcacttcaaagccactaaaaagcaatcgtacttggaaagagtcgaagattttatgaatcacaaccacactttcttgcttatttgcttagctatctttataattactatccttttactaagcctcgttgtctttgcaatgggacgccaa

SEQ ID NO: 5768 - protein, 393 aa, Streptococcus pyogenes
LTKRIILTIFTFICFSVMPLVHAEDVMDITRQAGYTVSEVNRPKSSIVVDANSSDILWQDNIDIPRDPASMSKMFTLYILFEELAKGKITMDTTITATPTDQAIANIYEISNNNIVAGVAYPIRDLITMTAVPSSNAATVMIANYLSNNDASAFIDRVNATAKQLGMTNTHFSNASGAAAQAFQGYYNPTKYDLSASNITTARDLSKLLYAFLKKYPEIISFTNKSVVHTMVGTPYEEEFHTYNHSLPDNQFGMKGVDGLKTGSSPSAAFNAMITAKRGKTRLITIVMGVGDWSDQNGEFYRHPFVNALTEKGFKDSKTLSKKARQKLEKLVPQTKKETSSKQQHFKATKKQSYLERVEDFMNHNHTFLLICLAIFIITILLLSLVVFAMGRQ

SEQ ID NO: 5769 - DNA, 1416 bp, Streptococcus agalactiae
atgtccgaaataaatgaaaaagtagaaccacagccaatagatcttggggaatataaatttggatttcatgacgatgtaaagccaatttattctacgggaaaaggtctaaatgaggctgttattcgtgagttatctgcagctaagggtgaacctgagtggatgttggactttcgtctaaaatccttggaaacgtttaataaaatgccaatgcagacctggggagcagatttatcagatattgattttgatgatattatttattatcaaaaagcatctgataaacctgcgcgtgattgggatgatgttccagaaaaaatcaaagaaacttttgaaagaattgggattccagaagctgaaagagcttatcttgcaggagcatcagcacaatatgaatcagaagtggtttatcataatatgaaagaagaatatgataagctgggtattgtttttacggatactgactctgcacttaaagagtacccagagctattcaaaaaatattttgctaaacttgtccctccaacagataataaattagctgctctgaactctgctgtatggtcaggtggaacatttatttatgtccctaaaggtgttaaggtggatattccacttcaaacttacttccgtattaataatgaaaatactggacaatttgaacgtactctcattattgtcgatgagggagcaagtgttcactatgttgaaggttgtaccgccccaacttattcttcaaatagtttacatgcagctatagttgaaatttttgcacttgatggagcttatatgcgctatacgactattcaaaattggtccgataatgtctataatttagtgacaaaacgtgctaccgctaaaaaagatgcaacagttgagtggatagatggaaatctaggtgctaaaacaacaatgaaatacccatcggtttaccttgatggtgaaggagcacgtggcacgatgttgtctattgcttttgcaaacaaaggacaacaccaagatacgggtgcaaagatgattcataatgctccccatactagttcatccattgtctctaaatcaattgctaagggtggaggaaaagttgattatcgaggtcaagtgacatttaataaagattccaaaaaatcagtgtcacatatagaatgtgacaccatattgatggatgatatttcaaaatcagataccataccgtttaatgagattcataattcacaggttgctttagagcatgaagcaaaggtgtctaagatttctgaagagcaactgtactacttgatgagtcgaggtttatctgaagctgaggcaacagaaatgattgttatggggtttgttgagccctttacgaaagaattaccaatggaatatgcggtagagttaaaccgcttaatttcctatgaaatggaaggttcagttggt

SEQ ID NO: 5770 - protein, 472 aa, Streptococcus agalactiae
MSEINEKVEPQPIDLGEYKFGFHDDVKPIYSTGKGLNEAVIRELSAAKGEPEWMLDFRLKSLETFNKMPMQTWGADLSDIDFDDIIYYQKASDKPARDWDDVPEKIKETFERIGIPEAERAYLAGASAQYESEVVYHNMKEEYDKLGIVFTDTDSALKEYPELFKKYFAKLVPPTDNKLAALNSAVWSGGTFIYVPKGVKVDIPLQTYFRINNENTGQFERTLIIVDEGASVHYVEGCTAPTYSSNSLHAAIVEIFALDGAYMRYTTIQNWSDNVYNLVTKRATAKKDATVEWIDGNLGAKTTMKYPSVYLDGEGARGTMLSIAFANKGQHQDTGAKMIHNAPHTSSSIVSKSIAKGGGKVDYRGQVTFNKDSKKSVSHIECDTILMDDISKSDTIPFNEIHNSQVALEHEAKVSKISEEQLYYLMSRGLSEAEATEMIVMGFVEPFTKELPMEYAVELNRLISYEMEGSVG

SEQ ID NO: 5771 - DNA, 1416 bp, Streptococcus pyogenes
atgtctgatataaatgagaaagtagagccaaagccaattgacttaggggactaccaatttggatttcacgatgatgtagagcccatttattctacaggaaaaggattgagtgaggcagtggttcgcgaactatcagctgccaaaaatgaacctgagtggatgttggagtttcgtttaaaatccttggaaacctttaataaaatgccgatgcaaacctggggagcagacttatcagatattaactttgatgatatcatttactatcaaaaagcatctgataagccagctcgttcttgggatgatgttccagaaaaaataaaagaaacctttgatcgtattggaattccagaagcagaacgtgcttatcttgctggggcatcagctcagtatgagtcagaagtggtttaccataacatgaagggtgaatttgaaaagctagggattatctttacagataccgattccgccctcaaagaatatcctgatttgttcaaacaatactttgccaaactggttccgccaacagacaacaaattagcagcccttaattcagcagcttggtctggtggtacctttatttatgttcctaaaggggtcaaggtagatatccctttgcaaacttatttccgcattaacaatgaaaatactggtcaatttgagcggacattgattattgttgatgaaggagcaagtgttcattatgttgaaggatgtacagctcccacttattcaagtaacagcttacatgctgctatcgttgaaatctttgcgcttgatggtgcatacatgcgttataccaccattcaaaactggtcagacaatgtgtataatctagtaacaaaacgtgcacgcgcccttacggatgcaacagtggaatggattgatggcaatctaggagctaaaaccaccatgaagtacccttctgtttatcttgatgggccaggtgcgcgtggcaccatgctgtctattgcctttgctaatgcaggtcaacaccaagatacaggggctaaaatgattcacaatgctccacatacatcatcatcaattgtgtcaaaatcaattgccaagtctggtggtaaagtagattatcgtggccaagtgacctttaacaagcaatctaaaaaatccgtttcccatattgaatgtgatactattttgatggacgatatttctaaatcagatacaatcccatttaacgaaattcataattcacaggtggcgttagaacatgaagccaaagtgtctaagatttctgaagaacaactctactatctcatgagccgtggcttatcagaaagcgaagccacagagatgattgtcatgggatttgtggagccttttaccaaagaattgccaatggaatacgcggtcgaactcaatcgattgatttcctatgagatggaaggttctgtcggt

SEQ ID NO: 5772 - protein, 472 aa, Streptococcus pyogenes
MSDINEKVEPKPIDLGDYQFGFHDDVEPIYSTGKGLSEAVVRELSAAKNEPEWMLEFRLKSLETFNKMPMQTWGADLSDINFDDIIYYQKASDKPARSWDDVPEKIKETFDRIGIPEAERAYLAGASAQYESEVVYHNMKGEFEKLGIIFTDTDSALKEYPDLFKQYFAKLVPPTDNKLAALNSAAWSGGTFIYVPKGVKVDIPLQTYFRINNENTGQFERTLIIVDEGASVHYVEGCTAPTYSSNSLHAAIVEIFALDGAYMRYTTIQNWSDNVYNLVTKRARALTDATVEWIDGNLGAKTTMKYPSVYLDGPGARGTMLSIAFANAGQHQDTGAKMIHNAPHTSSSIVSKSIAKSGGKVDYRGQVTFNKQSKKSVSHIECDTILMDDISKSDTIPFNEIHNSQVALEHEAKVSKISEEQLYYLMSRGLSESEATEMIVMGFVEPFTKELPMEYAVELNRLISYEMEGSVG

SEQ ID NO: 5773 - DNA, 441 bp, Streptococcus agalactiae
atggcactctctaaattagataatctctacatggcagtggtagctgatcattcaaaacaccctcatcatcatggatttttagaaggcgttgaacaagtgcagttaaataatcctacatgtggagatgttatttccttatctgttaaatttgatggaaatattatttcagatattgcatttgctggtaatggttgtacaatttctacggcttcatcaagcatgatgacagatgcagttattgggaaaacaaaagaagaagcattgcagcttgctgatgtattctccaaaatggttcaaggcgatcaaaatccaaaacaagagaaacttggggatgcagagtttctagctggggtatcaaaatttccacaacgtatcaaatgtgctacgctttcgtggaatgctttaagaaaggctattgagagagataatcaggcagaactc

SEQ ID NO: 5774 - protein, 147 aa, Streptococcus agalactiae
MALSKLDNLYMAVVADHSKHPHHHGFLEGVEQVQLNNPTCGDVISLSVKFDGNIISDIAFAGNGCTISTASSSMMTDAVIGKTKEEALQLADVFSKMVQGDQNPKQEKLGDAEFLAGVSKFPQRIKCATLSWNALRKAIERDNQAEL

SEQ ID NO: 5775 - DNA, 477 bp, Streptococcus pyogenes
atggcactctctaaactgaaccatctatacatggctgtggtagcggaccattcgaaacgtccacatcatcatgggcaactagatggcgtagaggctgttcaactgaataatccgacttgtggtgatgtgatttctttgaccgttaagtttgacgaagataaaattgaagatattgcttttgcaggcaacggctgtaccatttccacagcttcatcaagcatgatgacagatgctgttattggtaaaagtaaagaagaagcactcgcgttagctgatattttttcagagatggtacaaggacaggaaaatcctgctcaaaaagagctaggtgaagcagaattgttggcaggagttgcaaaatttccacagcgtatcaaatgctctaccctagcttggaatgctctcaaggaagccattaaacgaagtgccaatgctcagcacctcacggaccaaaatgtaaaggaagggaaaaatgtc

SEQ ID NO: 5776 - protein, 159 aa, Streptococcus pyogenes
MALSKLNHLYMAVVADHSKRPHHHGQLDGVEAVQLNNPTCGDVISLTVKFDEDKIEDIAFAGNGCTISTASSSMMTDAVIGKSKEEALALADIFSEMVQGQENPAQKELGEAELLAGVAKFPQRIKCSTLAWNALKEAIKRSANAQHLTDQNVKEGKNV

SEQ ID NO: 5777 - DNA, 1230 bp, Streptococcus agalactiae
atgacattactagatagttataaactaaagcaagatttcccaattttaaatcaattagttaatgatgagccgcttatctatttagataatgcagcaacgacacaaaaaccgaatcaagttttagaagctttgcgagactactaccaaaacgacaatgcaaatgtccatcgtggtgttcatactttagcagaacgagcgactgctcagtacgagaatgctcgtgaaaaagcaaggcagtttttaaatgctaaattaagtaaagaaattttattcacacgtggcaccacaacaggattaaattgggtagctaagtttgccgaaagtattttagaacgaggtgatgaggtacttatttccattatggagcatcattctaatattatcccatggcaacaagcttgcgagagaactggcgctaaattggtttatgcctatctaaaagatggttctttagatttagaagatttctataataaattatcctctaaaactaaatttgttagtttggcacatatctcaaatgtacttggctgtgttacaccagtaaaagcaatagcagaacgtgtacatcaagttggggcatacatggttgttgatggagctcaatcagcgccacatatggcgattgatgttcaagaccttgattgtgatttcttcgccttatctggccataagatgcttggtcctactggtattggtgttctttatgggaaagaaagcattttagataagatgccacctgtcgaatttggtggtgaaatgattgattttgtctatgagcaaagtgcaacatggaaggaattgccctggaagtttgaagctggaacgcctaatattgctggagcgatcgcttttggagaagctttagattatttaacggatgttggtatggatgagattcatcaatatgaacaaagtttagtttcttatgtgttgcctaaattacaggctatcgatggtttaactatttacggacctagtgatgctgaatctcatgtaggcgttattgccttcaatttagaaggtttacacccacatgatgtggcaactgcaatggattacgaaggagtggctgttcgtgcaggtcatcattgtgcacaaccccttattaatcatcttggtatccattcggcggttcgagcaagtttctatttctataataccaaagaggattgcgacaaattggtagacgctatccaaaaaactaaggagtttttcaatggcactctc

SEQ ID NO: 5778 - protein, 410 aa, Streptococcus agalactiae
MTLLDSYKLKQDFPILNQLVNDEPLIYLDNAATTQKPNQVLEALRDYYQNDNANVHRGVHTLAERATAQYENAREKARQFLNAKLSKEILFTRGTTTGLNWVAKFAESILERGDEVLISIMEHHSNIIPWQQACERTGAKLVYAYLKDGSLDLEDFYNKLSSKTKFVSLAHISNVLGCVTPVKAIAERVHQVGAYMVVDGAQSAPHMAIDVQDLDCDFFALSGHKMLGPTGIGVLYGKESILDKMPPVEFGGEMIDFVYEQSATWKELPWKFEAGTPNIAGAIAFGEALDYLTDVGMDEIHQYEQSLVSYVLPKLQAIDGLTIYGPSDAESHVGVIAFNLEGLHPHDVATAMDYEGVAVRAGHHCAQPLINHLGIHSAVRASFYFYNTKEDCDKLVDAIQKTKEFFNGTL

SEQ ID NO: 5779 - DNA, 1224 bp, Streptococcus pyogenes
ttgctagacgcaaaagacatcaaacaagactttcaaatcttaaatcaacaagtcaatgatgaaccccttgtttatttggataatgccgccaccacacaaaaaccggcgcttgttcttgaggctttgcaatcctattatcaagaagataatgctaatgtccaccgaggagttcataccttggctgaacgtgcaacgctcaaatatgaggccagtcgccagcaggttgctgactttattcatgctaaatcaagtaaggaagtgctctttaccagaggaacaacaaccagtttgaattgggttgctcggtttgcagagcaggtcttgacgccagaagatgaggtgttgatttcgattatggagcatcatgccaatatcattccttggcaacaagcctgtcaaaaaacaggagcaaggttagtctatgtttatttaaaagatggccaacttgacatggacgatttggcaaacaaattgacgacaaaaacacgttttgttagcctagtacatgtctccaatgttcttggttgcatcaatcccattaaagaaattgccaagctggcacatgctaaaggagcctaccttgttgttgacggtgcccagtcggttccacatttggctattgatgttcaagacttggattgtgatttctttgctttttcagctcataagatgttggggccaacaggtttgggtgttctttacggcaaagaagagcttttgaatcaagtggagcctcttgaatttggcggagaaatgattgattttgtttacgaacaagaggccacttggaaagaattgccctggaagtttgaagcaggaacacctcacatagctggtgctattgggctaagcgcagccatttcttaccttcagagactaggcatggctgatatacatgcgcatgaagcagaactaatagcctatgtcttgccgaaattagaagctattgaggggcttaccatatatggaccaagccagcctagtgcaagatctggtctgatttcttttaatctggatgatttgcatcctcatgacttggcaacagccttggactatgaaggtgttgcagtaagagcagggcaccactgcgcccaacctcttcttagttatttaggtgtaccagcaactgttagagcaagtttttatatctataacaccaaggcagattgtgaccgtctagtcgaagcaattctaaaagcaaaggagtttttcaatggcactctc

SEQ ID NO: 5780 - protein, 408 aa, Streptococcus pyogenes
LLDAKDIKQDFQILNQQVNDEPLVYLDNAATTQKPALVLEALQSYYQEDNANVHRGVHTLAERATLKYEASRQQVADFIHAKSSKEVLFTRGTTTSLNWVARFAEQVLTPEDEVLISIMEHHANIIPWQQACQKTGARLVYVYLKDGQLDMDDLANKLTTKTRFVSLVHVSNVLGCINPIKEIAKLAHAKGAYLVVDGAQSVPHLAIDVQDLDCDFFAFSAHKMLGPTGLGVLYGKEELLNQVEPLEFGGEMIDFVYEQEATWKELPWKFEAGTPHIAGAIGLSAAISYLQRLGMADIHAHEAELIAYVLPKLEAIEGLTIYGPSQPSARSGLISFNLDDLHPHDLATALDYEGVAVRAGHHCAQPLLSYLGVPATVRASFYIYNTKADCDRLVEAILKAKEFFNGTL

SEQ ID NO: 5781 - DNA, 1260 bp, Streptococcus agalactiae
atgtctaaagaagctatattaaattttttacaagccaaaggtgagcctacttggttacaagaattacgactaaaggcttttgaaaaaatagaagaactagaattaccagtaattgaacgtgtaaaatttcatagatggaatttaggtgatggaaccattttagagaatgactatacagctaacgttccagatttcacagagttaggaaacaatcccaagttggttcaaattgggacccaaaccgtccttgaacaagttcctatggaattaatagagaaaggcgttgtctttacagatttctattcggccttggaagaaattccagaagtcatagagcgctactttgggaaagcacgtccttttgaagaagatagacttgctgcctatcacacagcttacttcaacagtggtgcagtgctttatattccagataatgttgaaattactcaaccaatcgaaggtcttttttatcaagatagtcagtctaaagtaccatttaataagcatatccttcttattgttggaaagaatgcaaaagttagttacttagagcgatttgagtcaattggtgatgggacagaacgaacaagtgctaatatttctgtagaagtaattgcccaagcaggtagccaaattaaatttgcttcaattgatcgcctcggagaaaatgtgacaacgtttataagtcgtcgtggtcgtcacagtagcgatgcaacaatagattgggcccttggggtgatgaatgaaggcaatgttgttgctgactttgattctgatttaattggtgatggaagtcacgctaatttaaaagtagttgctgcctcgtcagggcgtcaagttcaaggaattgatacgcgtgttacaaactacggctgtaattcagtaggacatattttacagcatggggttattttagagcgtgggactcttacttttaatggtatcggacatattataaaaggtgcaaagggagcagacgcccaacaagaaagccgagttctcatgttatcagacaaagcacgttcagatgctaatcctatccttttgattgatgaaaatgatgttacagctggtcacgcagcctcaattggtcaggttgacccagaggatttatattatttgatgagccgaggcttgaaccaaaaaacagcagagcaattagttattcgtggatttttaggaacagtcattgctgaaataccagtaaaagaagttcgcgatgaaatgattgccgttattgatacaaaactagaaaaacgt

SEQ ID NO: 5782 - protein, 420 aa, Streptococcus agalactiae
MSKEAILNFLQAKGEPTWLQELRLKAFEKIEELELPVIERVKFHRWNLGDGTILENDYTANVPDFTELGNNPKLVQIGTQTVLEQVPMELIEKGVVFTDFYSALEEIPEVIERYFGKARPFEEDRLAAYHTAYFNSGAVLYIPDNVEITQPIEGLFYQDSQSKVPFNKHILLIVGKNAKVSYLERFESIGDGTERTSANISVEVIAQAGSQIKFASIDRLGENVTTFISRRGRHSSDATIDWALGVMNEGNVVADFDSDLIGDGSHANLKVVAASSGRQVQGIDTRVTNYGCNSVGHILQHGVILERGTLTFNGIGHIIKGAKGADAQQESRVLMLSDKARSDANPILLIDENDVTAGHAASIGQVDPEDLYYLMSRGLNQKTAEQLVIRGFLGTVIAEIPVKEVRDEMIAVIDTKLEKR

SEQ ID NO: 5783 - DNA, 1260 bp, Streptococcus pyogenes
atgacaaaagaaaaactagtggctttttcgcaagcccacgctgagcctgcttggctgcaagaacggcgtttagcggcattagaagccattccaaatttggaattaccaaccatcgaaagggttaaatttcaccgttggaatctaggagatggtaccttaacagaaaatgaaagtctagctagtgttccagattttatagctattggagataacccaaagcttgttcaggtaggcacgcaaacagtcttagaacagttaccaatggcgttaattgacaagggagttgttttcagtgatttttatacggcgcttgaggaaatcccagaagtaattgaagctcattttggtcaggcattagcttttgatgaagacaaactagctgcctaccacactgcttattttaatagcgcagccgtgctctacgttcctgatcacttggaaatcacaactcctattgaagctattttcttacaagatagtgacagtgacgttccttttaacaagcatgttctagtgattgcaggaaaagaaagtaagttcacctatttagagcgttttgaatctattggcaatgccactcaaaagatcagcgctaatatcagtgtagaagtgattgctcaagcaggcagccagattaaattctcggctatcgaccgcttaggtccttcagtgacaacctatattagccgtcgaggacgtttagagaaggatgccaacattgattgggccttagctgtgatgaatgaaggcaatgtcattgctgattttgacagtgatttgattggtcagggctcacaagctgatttgaaagttgttgcagcctcaagtggtcgtcaggtacaaggtattgacacgcgcgtgaccaactatggtcaacgtacggtcggtcatattttacagcatggtgtgattttggaacgtggcaccttaacgtttaacgggattggtcatattctaaaagacgctaagggagctgatgctcaacaagaaagccgtgttttgatgctttctgaccaagcaagagccgatgccaatccaatcctcttaattgatgaaaatgaagtaacagcaggtcatgcagcttctatcggtcaggttgaccctgaagatatgtattacttgatgagtcgaggactggatcaagaaacagcagaacgattggttattagaggattcctaggagcggttatcgctgaaattcctattccatcagtccgccaagagattattaaggttttagatgagaaattgcttaatcgt

SEQ ID NO: 5784 - protein, 420 aa, Streptococcus pyogenes
MTKEKLVAFSQAHAEPAWLQERRLAALEAIPNLELPTIERVKFHRWNLGDGTLTENESLASVPDFIAIGDNPKLVQVGTQTVLEQLPMALIDKGVVFSDFYTALEEIPEVIEAHFGQALAFDEDKLAAYHTAYFNSAAVLYVPDHLEITTPIEAIFLQDSDSDVPFNKHVLVIAGKESKFTYLERFESIGNATQKISANISVEVIAQAGSQIKFSAIDRLGPSVTTYISRRGRLEKDANIDWALAVMNEGNVIADFDSDLIGQGSQADLKVVAASSGRQVQGIDTRVTNYGQRTVGHILQHGVILERGTLTFNGIGHILKDAKGADAQQESRVLMLSDQARADANPILLIDENEVTAGHAASIGQVDPEDMYYLMSRGLDQETAERLVIRGFLGAVIAEIPIPSVRQEIIKVLDEKLLNR

SEQ ID NO: 5785 - DNA, 768 bp, Streptococcus agalactiae
atgtctgtacttgaaatcaaaaatcttcatgtttctattgaagataaagaaattttaaaaggtcttaatttaacgttgaaaacaggagaaattgctgctatcatgggtccaaatggtactgggaagtcgacactttcagcagctattatgggaaatcctaattatgaagttacagcaggtgaaattctttttgatggtgaagatattttagagctagaagtggatgaacgtgctcgtttgggtctatttcttgccatgcaatacccttcagaggttccagggattactaatgctgaatttatccgagcagctatgaatgcgggaaaggctgatgatgataaaatttccatccgccaatttatcactaagttagatgaaaagatggaactacttggcatgaaagaagaaatggcggaacgttatcttaacgaaggtttttcaggtggtgagaagaagcgcaatgaaattttacaactcctaatgttagagcctaagtttgccctcttggatgagattgactctggccttgatattgatgctcttaaagtggtatcaaagggagtcaatgaaatgcgtggtgaaggttttggtgctatgattattacacactatcaacgccttttgaattacattacaccagataaagtacacgttatgatggacgggaaggtagtattgtcaggaggaccagaattagcggttcgccttgagaaagaaggttatgctcaaatcgctgaagagcttggtttagagtataaagaagaagtc

SEQ ID NO: 5786 - protein, 256 aa, Streptococcus agalactiae
MSVLEIKNLHVSIEDKEILKGLNLTLKTGEIAAIMGPNGTGKSTLSAAIMGNPNYEVTAGEILFDGEDILELEVDERARLGLFLAMQYPSEVPGITNAEFIRAAMNAGKADDDKISIRQFITKLDEKMELLGMKEEMAERYLNEGFSGGEKKRNEILQLLMLEPKFALLDEIDSGLDIDALKVVSKGVNEMRGEGFGAMIITHYQRLLNYITPDKVHVMMDGKVVLSGGPELAVRLEKEGYAQIAEELGLEYKEEV

SEQ ID NO: 5787 - DNA, 768 bp, Streptococcus pyogenes
atgtcaattcttgagattaataatttacatgtttcaatagaaggtaaagagattttgaaaggggttaacctaactcttaaaactggggaagtagctgccattatggggccaaatgggacaggaaagtctaccctttcagcagctattatgggaaatcctaactacgaagtgacccaagggcaaattttgcttgacggggtcaatattctcgatctagaagttgatgagcgtgcgagactgggactttttctcgccatgcaatacccttcagaaattccagggattaccaacgctgaatttatgcgtgcagcaatgaatgccggtaaggcagatgaggataagatttccgtgcgagattttatcaccaaacttgatgagaaaatggctttgttaggtatgaaagaagagatggcagagcgttacctcaatgaaggtttttctggtggggagaaaaaacgcaatgaaattcttcaattgctcatgttagagcctaaatttgctttgttagatgagattgattctggtcttgatattgatgccctaaaagtagtctctaaaggggttaatgagatgcgtgggaaagactttggagctatgattatcacccactatcaacgtttgttgaattacattaccccagacctagttcatgttatgatggatggtcgtattgtcttatctggtgatgctgccttggctactcgtcttgaaaaagaaggctacgcaggtattgcacaggatctgggaatcgagtataaggaagaaagt

SEQ ID NO: 5788 - protein, 256 aa, Streptococcus pyogenes
MSILEINNLHVSIEGKEILKGVNLTLKTGEVAAIMGPNGTGKSTLSAAIMGNPNYEVTQGQILLDGVNILDLEVDERARLGLFLAMQYPSEIPGITNAEFMRAAMNAGKADEDKISVRDFITKLDEKMALLGMKEEMAERYLNEGFSGGEKKRNEILQLLMLEPKFALLDEIDSGLDIDALKVVSKGVNEMRGKDFGAMIITHYQRLLNYITPDLVHVMMDGRIVLSGDAALATRLEKEGYAGIAQDLGIEYKEES

SEQ ID NO: 5789 - DNA, 1173 bp, Streptococcus agalactiae
ttgagatgggataaaatgataccttttacaattgagtatatttttgtattgattggagcatttttattatcaatcattctaactcctattattcgagttatatctttgaaggtaggagcggttgataaaccgaacgctcgaagaatcaacaaagtaccaatgccaagtagtggtggtttagcaatatttctctcctttgttgtaacaacattatttttcatgccaatggcggccagtagacactttatagaagtctcttattttcactacattttgcctgtaattattggcggtctcgtagttacaacaacaggattcatagatgacatctttgaattaagacctcgttataaaatgttgggaattattattgcagctattatcatatggaaatttacacattttagatttgatagttttaagattccaataggtggtccactcttggagtttggtcctattttaactttctttttgacagttttatggattatttcaatcactaatgctatcaatctgattgatggtctagatggtctagttagtggtgtttcaattatcagtctagcaacgatggcagtggtttcttatttctttttacctaaaatagatttttttctcacgctaactattgttattttaatcgcctcaatagttggttttttcccttataattatcatccagccattatctacctaggtgatgctggtgccttgtttataggatttatgattggtgtattatcgcttcaaggtttaaaaaactccacagctgttgcagtgataacacctgtcattattttaggagttcctattttggatacagctgttgctattgtgaggcgtaaattatcagggaaaaagatttctgaagctgataagatgcacctgcatcaccgattgctatctatgggatttacacatagaggagcagttttagttgtttatggtattgcaattatcttttcgcttatcgctttgcttttaaatgtttctagtcgtattgggggaatttttcttctattggcgctactattagcgatggaaatttttatagaaggtttaaatatttggggtgagaatcggacaccactatttaatctcttaaagttcattggcaacagtgattacagacaaagtgttattgctaaatatagcgataagcatcaaaaa

SEQ ID NO: 5790 - protein, 391 aa, Streptococcus agalactiae
MRWDKMIPFTIEYIFVLIGAFLLSIILTPIIRVISLKVGAVDKPNARRINKVPMPSSGGLAIFLSFVVTTLFFMPMAASRHFIEVSYFHYILPVIIGGLVVTTTGFIDDIFELRPRYKMLGIIIAAIIIWKFTHFRFDSFKIPIGGPLLEFGPILTFFLTVLWIISITNAINLIDGLDGLVSGVSIISLATMAVVSYFFLPKIDFFLTLTIVILIASIVGFFPYNYHPAIIYLGDAGALFIGFMIGVLSLQGLKNSTAVAVITPVIILGVPILDTAVAIVRRKLSGKKISEADKMHLHHRLLSMGFTHRGAVLVVYGIAIIFSLIALLLNVSSRIGGIFLLLALLLAMEIFIEGLNIWGENRTPLFNLLKFIGNSDYRQSVIAKYSDKHQK

SEQ ID NO: 5791 - DNA, 1167 bp, Streptococcus pyogenes
atgttttcattcacaatagattatgtccttgttctgataggggctttgttaatgtccttattcttaacccctcttgttcgctttttagcctttcgtgtgggtgcagtagacaatcccaatgccagacgggtcaataaggttccgatgccaaccagtggtggattagctatttttatgtcttttttagtagcaagtttgggacttattccgattgcttctaaaggcgccatgttttttggtcagacctacttcagttatattttacctgtcgtgattggtgctacagtaattacccttactggttttttagatgatttgtatgagttaagtcctaaattaaagatgtttggtattctaattggtgcagtgattgtctgggcttttaccgactttaaatttgatagcttcaaaattccttttggagggccgttgttagtttttggtcctttcttaaccttattcttaacagtcctgtggattgtttccatcactaatgctattaacttgattgacggtttggatggtttggttagtggggtctctattattagtttagtgaccatggctattgtatcttatttctttttacctcaaaaggatttctttttgacgttaaccattttggtcttgatttctgctattgcaggattttttccttataattaccatccagctatgatttatttgggtgacacaggagccctctttattggctttatgataggggttttgtctcttcaaggattgaaaaattcaacggctgtggctgtggtgacacctgttattattcttggtgtacccattatggataccatcgtggctattattcgacgtagtttatcaggtcaaaaattctacgagccggataagatgcacctgcatcatcgactcttatcaatgggctttactcatcgaggagctgtcttagtagtttatggtattaccatgcttttttcccttatttctttacttttaaatgtttctagtcgaattggtggcgtcctcttgatgcttggacttttatttggtttagaagtttttattgaaggattggagatctggggtgaaaagcgaacgcctttgtttaacttgttaaagtttattggtaatagtgattatcgtcaagcaatgcttctgaaatggaaagaaaagaaggatttgaaacac

SEQ ID NO: 5792 - protein, 389 aa, Streptococcus pyogenes
MFSFTIDYVLVLIGALLMSLFLTPLVRFLAFRVGAVDNPNARRVNKVPMPTSGGLAIFMSFLVASLGLIPIASKGAMFFGQTYFSYILPVVIGATVITLTGFLDDLYELSPKLKMFGILIGAVIVWAFTDFKFDSFKIPFGGPLLVFGPFLTLFLTVLWIVSITNAINLIDGLDGLVSGVSIISLVTMAIVSYFFLPQKDFFLTLTILVLISAIAGFFPYNYHPAMIYLGDTGALFIGFMIGVLSLQGLKNSTAVAVVTPVIILGVPIMDTIVAIIRRSLSGQKFYEPDKMHLHHRLLSMGFTHRGAVLVVYGITMLFSLISLLLNVSSRIGGVLLMLGLLFGLEVFIEGLEIWGEKRTPLFNLLKFIGNSDYRQAMLLKWKEKKDLKH

SEQ ID NO: 5793 - DNA, 753 bp, Streptococcus agalactiae
atggaaatgaaacaaatcagtgaaacaacactgaaaattacaattagtatggaagatttagaagatcgtggtatggagctgaaagatttcctaatccctcaggagaagactgaggaatttttctattctgtcatggatgaattagacttgccagaaaactttaaaaatagtggtatgttaagttttcgagtaacacctaaaaaagatcgcattgatgtttttgttacaaagtctgaattaagtaaagatttaaatttagaagaattagcagatttgggtgacatttcaaaaatgtctccagaagacttttttaaaacattggaacaatcgatgttggaaaaaggggatacggatgcccatgccaaattagcagaaattgaaaatatgatggataaagcaactcaagaagtagttgaggaaaatgtttctgaagaacaacctgaaaaggaagtagaaacgattggatatgttcactatgtctttgattttgataatattgaagctgtagttcgattttcacaaacgattgattttccaatagaagcttctgaactctataaaaatggtaaaggctatcatatgacaattttgctagacttggaaaaccaaccaagctactttgctaatttgatgtatgctcgaatgcttgaacatgctaatgtgggcacaaaaacacgagcttacttgaaagagcatagtattcaattgattcatgatgatgctatttcaaaattacaaatgattgagatggga

SEQ ID NO: 5794 - protein, 251 aa, Streptococcus agalactiae
MEMKQISETTLKITISMEDLEDRGMELKDFLIPQEKTEEFFYSVMDELDLPENFKNSGMLSFRVTPKKDRIDVFVTKSELSKDLNLEELADLGDISKMSPEDFFKTLEQSMLEKGDTDAHAKLAEIENMMDKATQEVVEENVSEEQPEKEVETIGYVHYVFDFDNIEAVVRFSQTIDFPIEASELYKNGKGYHMTILLDLENQPSYFANLMYARMLEHANVGTKTRAYLKEHSIQLIHDDAISKLQMIEMG

SEQ ID NO: 5795 - DNA, 765 bp, Streptococcus pyogenes
ttgagaatggaaatgaaacaaattagcgagacaacgctaaaaataacaattagtatggacgatttagaagaaagaggaatggagttgaaagatttcttgattcctcaagaaaaaacagaagagtttttctattctgtgatggacgaactcgatcttccagataattttaaagatagtggtatgcttagttttcgagtgactccacgcaaggaccgtctagatgtttttgttaccaaatctgagataaataaagatattaatcttgaagatttagcagagtttggtgatatgtcccaaatgactccggaagattttttcaagagcttggagcaatccatgcgtgaaaagggagatgtcaaagctcatgaaaaattggaaaaaattgaagagataatggaagatgttgttgaagccactctagctaatcagtctgaggcggctgatccatcaactaatcatgagtcagaacctttagactatgtccattatgtattggatttttcaacgattacagaggcagtggcttttgctaaaacgattgatttttcgatagaagcttcagagttatataaggggagcaactgctaccatatgactattttattagatgttcagcaacaaccatcttattttgcgaacgtcatgtatgcgagattgattgagcatgcaaaccctggatcaaaaacaagagcttatttacaagagcatggcttacaattgatgcttgatggtgctgttgagcaattacaaaagattgagttggga

SEQ ID NO: 5796 - protein, 255 aa, Streptococcus pyogenes
LRMEMKQISETTLKITISMDDLEERGMELKDFLIPQEKTEEFFYSVMDELDLPDNFKDSGMLSFRVTPRKDRLDVFVTKSEINKDINLEDLAEFGDMSQMTPEDFFKSLEQSMREKGDVKAHEKLEKIEEIMEDVVEATLANQSEAADPSTNHESEPLDYVHYVLDFSTITEAVAFAKTIDFSIEASELYKGSNCYHMTILLDVQQQPSYFANVMYARLIEHANPGSKTRAYLQEHGLQLMLDGAVEQLQKIELG

SEQ ID NO: 5797 - DNA, 837 bp, Streptococcus agalactiae
atgttaataattgaattactcaaagccctatttttaggagtcgttgagggagtgacagaatggttacctgtttctagtactggccatttaatcttggttcaagagtttatgaagttgaaccaaagcaaatcctttgttgaaatgtttaatattgttatacaacttggggcaattatggcagttattgtcatttattttaaacgccttaacccatttcagccaggtaaatctgctagagaaattcgtttaacttggcaattatggttaaaagtagtgatagcttgtattccatctattttaattgctttaccatttgataattggtttgaagctcattttaatttcatgatcccgattgcaatagccctaatcttttatggttttgtcttcatatgggttgaaaaacgtaatgcacacctcaaaccacaggtaaccgaattggcaagtatgtcttacaagacagctttcttgattggatgcttccaggttctcagtattgttccgggaaccagtcgttctggagctactattttaggagcaattattattggaactagtcgttcggtcgctgctgactttactttcttccttgccatcccaactatgtttggttatagtggacttaaggcggttaaatactttttagatggtaacgtcttgagtttagaccaatctttaatacttttagtagcaagtctgacagctttcgtagttagtttatatgttattcgtttcttgacagactatgtcaaacgacacgatttcaccatctttggtaagtatcgtatagtcttaggaagtttactcatcctctactggttagttgttcatttattc

SEQ ID NO: 5798 - protein, 279 aa, Streptococcus agalactiae
MLIIELLKALFLGVVEGVTEWLPVSSTGHLILVQEFMKLNQSKSFVEMFNIVIQLGAIMAVIVIYFKRLNPFQPGKSAREIRLTWQLWLKVVIACIPSILIALPFDNWFEAHFNFMIPIAIALIFYGFVFIWVEKRNAHLKPQVTELASMSYKTAFLIGCFQVLSIVPGTSRSGATILGAIIIGTSRSVAADFTFFLAIPTMFGYSGLKAVKYFLDGNVLSLDQSLILLVASLTAFVVSLYVIRFLTDYVKRHDFTIFGKYRIVLGSLLILYWLVVHLF

SEQ ID NO: 5799 - DNA, 837 bp, Streptococcus pyogenes
atgttaattatcgaattgctaaaagccattttctttggcatcattgagggaatcacagaatggttaccagtttcaagcactggtcacctcattttggtgcaggaatttatccgactaaatcaggataaggcttttatagaaatgtttaatatcgttattcaattaggggcgattatcgctgttatgttgatttattttgaacgtctcaatccctttcaacctgggaaaacagcaagagaagtacagcttacctggcaattatggctaaaagtggtgattgcgtgtattccttctattttaatagcggttcctcttgataattggtttgaagcacatttttattttatggttccgattgccatcgctttaatcgtctacgggattgcctttatctggattgaaaaacgaaatgctcaacaagaacctgctgtcactgaattagctagaatgtcttacaaaacagctttcttcattggttgttttcaagtcttaagtattgtgcctggtactagtcgatcaggggctaccatcttaggagctattattttaggaactagtcgaacagtggccgctgatttcaccttctttttggccattcctaccatgtttggatatagtggattaaaggctgtaaaatttttccttgatggccatcaccttgattttgcacaagtccttattcttttagtggctagcttgaccgcttttgtggttagtttattggcgattaggttcttgacagattatgttaagaaacacgatttcaccatttttgggaaataccgtattgtgttaggaagccttttacttatttatagcttctttaaatttgttttt

SEQ ID NO: 5800 - protein, 279 aa, Streptococcus pyogenes
MLIIELLKAIFFGIIEGITEWLPVSSTGHLILVQEFIRLNQDKAFIEMFNIVIQLGAIIAVMLIYFERLNPFQPGKTAREVQLTWQLWLKVVIACIPSILIAVPLDNWFEAHFYFMVPIAIALIVYGIAFIWIEKRNAQQEPAVTELARMSYKTAFFIGCFQVLSIVPGTSRSGATILGAIILGTSRTVAADFTFFLAIPTMFGYSGLKAVKFFLDGHHLDFAQVLILLVASLTAFVVSLLAIRFLTDYVKKHDFTIFGKYRIVLGSLLLIYSFFKFVF

SEQ ID NO: 5801 - DNA, 1944 bp, Streptococcus agalactiae
ttgaaagcgattaattgtatttttatgttaaaatggtatacaaacaaaggaaggaggatgataatgaagaaatgttttttggctatttgtttagctcttagtttttttatggtttcagttcaagcagatgaggtggactataacattcctcattatgagggtaatctaactattcacaatgataatagtgctgattttacagagaaggttacttaccaatttgattcgtcctataatggacagtatgtcacattaggtacggcgggtaagttacctgacaattttgatattaataataagccacaggttgaagtttcaattaatggtaaagtaaggaaagttagttaccagatagaagatttggaggatggctaccgtttgaaagtgtttaatggtggtgaagcaggtgatactgttaaagtcaatgttcagtggaaactaaaaaatgttctatttatgcataaggatgttggtgaacttaactggattcctattagcgactgggataaaacgttagagaaagtagatttttggatatcaactgacaaaaaggttgctctttctcgtctttgggggcacttgggttatcttaaaactcctcctaaaataagacaaaataataatcgttaccatttgacagcttttaatgtaaacaaacgattagaatttcatggttattgggatagatcttattttaatctacctacaaacagtaaaaataattacaagaaaaaaattgaatatcaagagaagatgatagagcgtcatggttttatcctaagtttcttgttaaggatattattaccttcattctttattattgtgacactattcatctcaattagggtgttcctgtttagaaaaaaagttaataaatacgggcaattccctaaggaacatcatttatatgaagcacctgaggacctttcaccactagagttaactcaaagcatttatagtatgagttttaaaaattttcaagatgaggagaagaaaactcaccttatcagtcaagaacaactcattcagtcaattctattagacttgattgatagaaaagtattgaattatgatgataacttgttatctctagctaacttagatagagcttctgatgcagaaatagattttatagagtttgcttttgcggattctacgagtttgaagccagatcaactcttttctaattaccaatttagttataaagaaacactacgtgaactgaaaaagcagcacaaggcttcagatctgcaaactcaaatgagacgccgaggaagtaatgccttatcaagaattacgcgtctcacaaggttgatttctaaagacaatataaactctcttagaagaaagggaatttcatccccttatcgtaaaatgtcttcagaagagtctaaagaattatctaggttgaaaagattcagttacctatcacctcttatttcttttgttgttataatttatacgctttttttaaattattttacctatttctgtatctatctcttattgtttggtgttatcctgttgttgaataaaatcatttttatgatgacaagaaaaataagtaacggttatattgtaactgaagatggagcaagtcgtgtctaccaatggactagttttaggaacatgctaagggatatcaaatcgtttgatcgttcagagttagaaagtatcgtattatggaatcgaatattggtttacgctactttattcggctacgctgaccgtgttgagaaagcactcagagtgaaccaaatagatattccagaaagatttgcaaacattgatagtcatcaatttgcgatttcagtcaatcaatctagtaatcatttttcaacgataactgaagatgttagtcacgcttctaattttagtgttaattcaggcggttcttcaggtggtttctcaggcggcggaggcggcggaggtggtggtgccttc

SEQ ID NO: 5802 - protein, 648 aa, Streptococcus agalactiae
MKAINCIFMLKWYTNKGRRMIMKKCFLAICLALSFFMVSVQADEVDYNIPHYEGNLTIHNDNSADFTEKVTYQFDSSYNGQYVTLGTAGKLPDNFDINNKPQVEVSINGKVRKVSYQIEDLEDGYRLKVFNGGEAGDTVKVNVQWKLKNVLFMHKDVGELNWIPISDWDKTLEKVDFWISTDKKVALSRLWGHLGYLKTPPKIRQNNNRYHLTAFNVNKRLEFHGYWDRSYFNLPTNSKNNYKKKIEYQEKMIERHGFILSFLLRILLPSFFIIVTLFISIRVFLFRKKVNKYGQFPKEHHLYEAPEDLSPLELTQSIYSMSFKNFQDEEKKTHLISQEQLIQSILLDLIDRKVLNYDDNLLSLANLDRASDAEIDFIEFAFADSTSLKPDQLFSNYQFSYKETLRELKKQHKASDLQTQMRRRGSNALSRITRLTRLISKDNINSLRRKGISSPYRKMSSEESKELSRLKRFSYLSPLISFVVIIYTLFLNYFTYFCIYLLLFGVILLLNKIIFMMTRKISNGYIVTEDGASRVYQWTSFRNMLRDIKSFDRSELESIVLWNRILVYATLFGYADRVEKALRVNQIDIPERFANIDSHQFAISVNQSSNHFSTITEDVSHASNFSVNSGGSSGGFSGGGGGGGGGAF

SEQ ID NO: 5803 - DNA, 1896 bp, Streptococcus pyogenes
atgaaaaaaattttgatgacgcttgtgctctgcttcagtcttttagggatacgaataaaagcagctgatgtagactatagcatcaccaactatgaaggtcagttactgttatcaaaagaaaatactgctcggtttgagcaaaaagtaacctatcaatttgacacttcttataacggccagtatatttcgctgggccggacaggtcatttgccagcgggctttgctattgaccaaaagcctaaagttgaggtatatcagaatggtcaacaggtacctgttagtcaagagtttagtgaccttggagatggctatcgtttaaaactttataatgctggccaagctggtgataaggttgacgtcaaggttatctggcaactgcaccaccttttaacagcttatcaagacgtggcagagctgaattggacaccgattagtgattgggacaaaacattagaaaaggtgagtttgaccgtcactaccccaactgatattcaggattctaatctatgggctcacagaggatattaccaaaagaaacctcaagtgttaaaagaaggtaacagtcgctatcagattaatgccaagaatgtctcagggcaactggaattgcatgcttattgggataaaaaagcattattgggaaaagagccagttgatgtttcaacgagtaaaaagaataaaattgtagcgttagaaactaagatttccagacgaaggaccttgttacagctgctatttggcaaagtcattcctctggtagaggtaggttttcttctttggcagttaatacagtttacaagattaaagaaacaattcaatcgttatcatttggctaaccatacagatcacagttacgaagtccctgaagatctttcgcctcttgtgttgacacaagcgatttatggacagagttttgcctatttatcccctacagcatcagaaagccagaaattattgatccctaaaggagtgacctttgaggcccttgttcaagctaccttgttggatctgatcgaccaaaaggtgcttttattaacgaaagaagaagggaaagcttatcttgaaatcagtcagttagatcgtgtgacagatgaggaagctgccttcttagatatggcttttggaaacaaggtgacattgccggtggatcaattgtttagtcaataccattatgatgctgataccattaaacaattaaagaaaacgtacaaaggtaaaaagctcgagcaagaagtccgtcaatcgtctgagcaggtgattaaggcgatgaaaaaagcgtcggcagctattacaaacaatgtcctagaaactatcaaaaagttaaacttaccagatacttatcgtcaaatgaccccggcagagaaacgaaaaagcaatagtgtccagggattaggttgtttgttgcttattctaaatagtggtttattgatttacttggctattaaagaaagtgggttagccctcatttaccttgctttaatggtgctaacgatgtgccttggcttttacattagcctgaagttagatcaatacaagaaattgggtattgaaacacctgaggggggtgttcggttacatcaatggcagagctttaaaaacatgatacgagacattgacaaatttgaggatgttgctattgaaggtttggttgtttggaaccgtgttttggtttatgccaccttatttggttacgctaagaaagtggaacgctatttgaaagtccatcgtattgccttacctgaggtttaccaagctgttcgaccaggtgaattatcaatggtaatgtatgctacgacaccaacctttgtgtctagcttgtcttcagctacaacttcctcaaatttctcagtctcttccggaggcgggattagtggtggtggcggcggcggtgccttt

SEQ ID NO: 5804 - protein, 632 aa, Streptococcus pyogenes
MKKILMTLVLCFSLLGIRIKAADVDYSITNYEGQLLLSKENTARFEQKVTYQFDTSYNGQYISLGRTGHLPAGFAIDQKPKVEVYQNGQQVPVSQEFSDLGDGYRLKLYNAGQAGDKVDVKVIWQLHHLLTAYQDVAELNWTPISDWDKTLEKVSLTVTTPTDIQDSNLWAHRGYYQKKPQVLKEGNSRYQINAKNVSGQLELHAYWDKKALLGKEPVDVSTSKKNKIVALETKISRRRTLLQLLFGKVIPLVEVGFLLWQLIQFTRLKKQFNRYHLANHTDHSYEVPEDLSPLVLTQAIYGQSFAYLSPTASESQKLLIPKGVTFEALVQATLLDLIDQKVLLLTKEEGKAYLEISQLDRVTDEEAAFLDMAFGNKVTLPVDQLFSQYHYDADTIKQLKKTYKGKKLEQEVRQSSEQVIKAMKKASAAITNNVLETIKKLNLPDTYRQMTPAEKRKSNSVQGLGCLLLILNSGLLIYLAIKESGLALIYLALMVLTMCLGFYISLKLDQYKKLGIETPEGGVRLHQWQSFKNMIRDIDKFEDVAIEGLVVWNRVLVYATLFGYAKKVERYLKVHRIALPEVYQAVRPGELSMVMYATTPTFVSSLSSATTSSNFSVSSGGGISGGGGGGAF

SEQ ID NO: 5805 - DNA, 1548 bp, Streptococcus agalactiae
atgaaaaaaatattactaagtttattcactgctttgcttatcacctttggaggtatgacaagtatacaagcagatgaatatctacgtgtcggtatggaggcagcctatgctcctttcaactggacacaaaatgataacacaaatggtgcagttcctattgaaggaactgatcaatatgctaatggttatgatgtacaagtcgctaaaaagttagctaaaaagttaaataaaaaagttgttgttgtcaaaacaaaatgggaaggccttgttccagcactaacttctggaaaactcgatatgattattgcaggaatgagtcctaccgaagaacgtaaaaaagaaattaatttttcaaagccttactacatttcagaacctactctagttgttaatgctgaaggaaaatatactaatgctaaaaatattagtgatttcaaaaatgctaaagtaactgcccaacaaggagtctacttatacaacctcattgatcaaatcaatggtgtcaaaaaagaagttgccatgggggacttcaatcaattaagacaagctgtagaatctggtgttgtagacgcctatgtttcagaacgtccagatgcaacttccgctcaaactgctaatcctaaattaaaaatgattgaactgcaccaagggtttaaaacatctgatgccgatacaaatatttctgttgggatgcgtaaaggtgacaatcgtattaatcaagttaatcaagttctcgaaagcatttctagagataaacaaatcgccttgatggataagatgattaaagaacagccatccgttaaaaaagaaaaaaatgggaaaccaaacttctttgaacagatggcaactattttaaaaaacaatggttctcaattcctcagaggaacagctacaaccctcctaatttctatggtaggaacaatcgtcggattatttatcggccttctcatcggtgttttccgtacagcaccaaaatctgacaataagttaaaggctgccttacaaaaattattaggttggttacttaacatctatattgaggtcttccgcgggacacctatgattgtacaatcgatggttatctactacggaacagcacaagcttttggagtttcgctggaccgtacactagcagctatatttattgtttcaatcaatactggtgcttatatgagcgaaattgtacgtggtggtattttctctgttgataaaggacaatttgaagccgcaactgcacttggtttcacccacggacaaaccatgcgaaaaattgttctaccacaagttgtacgtaacatactcccagctactggtaatgagtttgttatcaatatcaaagatacctctgtactgaacgttatctctgttgtcgaactctacttctctggtaatactgttgcaacacaaacctaccaatatttccaaacattcaccattattgcgattatttacttcatcttaaccttcaccgtaacacgtatcttacgttacattgaaaaacgttttgattcagataattacacaaccggtgcgaatcaattacaagtc

SEQ ID NO: 5806 - protein, 516 aa, Streptococcus agalactiae
MKKILLSLFTALLITFGGMTSIQADEYLRVGMEAAYAPFNWTQNDNTNGAVPIEGTDQYANGYDVQVAKKLAKKLNKKVVVVKTKWEGLVPALTSGKLDMIIAGMSPTEERKKEINFSKPYYISEPTLVVNAEGKYTNAKNISDFKNAKVTAQQGVYLYNLIDQINGVKKEVAMGDFNQLRQAVESGVVDAYVSERPDATSAQTANPKLKMIELHQGFKTSDADTNISVGMRKGDNRINQVNQVLESISRDKQIALMDKMIKEQPSVKKEKNGKPNFFEQMATILKNNGSQFLRGTATTLLISMVGTIVGLFIGLLIGVFRTAPKSDNKLKAALQKLLGWLLNIYIEVFRGTPMIVQSMVIYYGTAQAFGVSLDRTLAAIFIVSINTGAYMSEIVRGGIFSVDKGQFEAATALGFTHGQTMRKIVLPQVVRNILPATGNEFVINIKDTSVLNVISVVELYFSGNTVATQTYQYFQTFTIIAIIYFILTFTVTRILRYIEKRFDSDNYTTGANQLQV

SEQ ID NO: 5807 - DNA, 738 bp, Streptococcus agalactiae
atgacacaagctattttagaaattaaacatttgaaaaaatcttacggaagcaatgaagtgttaaaagatatttcgctttcggtcaacaaaggcgaagttatttctatcattggttcttctggatcaggaaaatcaactttcctacgttctattaacctcttagaagaaccaagtggaggagaaatcttatatcacggtcacaatgttcttgaaaaaggctatgatttaaataattatcgtgaaaaacttgggatggtctttcaatcttttaacctctttgaaaatttaaatatcttagagaatgctattgtcgcacagactactgttctaaaacgtgaacgccaagaagctgaaaagattgctaaagaaaacttaaatgctgttggcatgactgagcaatattggaaagctaaaccaaaacaattatcaggtgggcaaaagcaacgtgtcgcaatcgcccgagcactttctgttaacccagaagctatactttttgatgaaccaacttcagccttggatccagaaatggttggtgaggtccttaaaacaatgcaagatctagctaaatctggattaacaatgataattgtgacacacgagatggaatttgctaaagaagtatcagaccgcgttattttcatggacaaaggaatcattgcagagcagggtactcctaaacaacttttcgaaaatccaacacaagaaagaactaaggaatttctacaacgcttcttaaaa

SEQ ID NO: 5808 - protein, 246 aa, Streptococcus agalactiae
MTQAILEIKHLKKSYGSNEVLKDISLSVNKGEVISIIGSSGSGKSTFLRSINLLEEPSGGEILYHGHNVLEKGYDLNNYREKLGMVFQSFNLFENLNILENAIVAQTTVLKRERQEAEKIAKENLNAVGMTEQYWKAKPKQLSGGQKQRVAIARALSVNPEAILFDEPTSALDPEMVGEVLKTMQDLAKSGLTMIIVTHEMEFAKEVSDRVIFMDKGIIAEQGTPKQLFENPTQERTKEFLQRFLK

SEQ ID NO: 5809 - DNA, 885 bp, Streptococcus agalactiae
atgatgtcattaattattcttacggttattttggttttagtgattgttctgttgataacttctttatacgttgttaaacaacagacagtagccatcattgaacgctttggtaaatatcaaaagactgctactagcggtattcatattcgtgtaccattgggtatcgataagattgcagcacgagtgcagttacgtcttttacagagtgaaattatcgttgagacaaaaacaaaagataatgtttttgtcactttaaatattgctacacaatatcgtgtcaatgaaaataacgttacagacgcttattacaaattaataaagccagaagctcagattaaatcttatatcgaagatgctttgcgttcatcagtacctaaacttacattagacgagctatttgaaaagaaagatgaaatagccttggaagttcaacatcaagtggcagaagaaatgtcaacatacggctacatcattgttaagactttaattactaaggttgagccagatgcagaagtaaaacaatccatgaacgaaatcaatgctgcacaacgtaaacgtgtagcagctcaagaattagcgaatgctgataagatcaaaattgtaactgctgcagaagcagaagcagaaaaagatcgtctacatggtgtgggtattgcgcaacaacgtaaagcaattgtagatgggttagctgattcgattcaagaattgaaagatgctaacgtgacattgacagaagaacaaatcatgtctatcttgttaacaaatcaatatttagatactttaaatacatttgctattaatggtaatcaaacgattttcttaccaaataacccagaaggtgttgaagatattcgtacacaagttttatctgctcttaaaacaaga

SEQ ID NO: 5810 - protein, 295 aa, Streptococcus agalactiae
MMSLIILTVILVLVIVLLITSLYVVKQQTVAIIERFGKYQKTATSGIHIRVPLGIDKIAARVQLRLLQSEIIVETKTKDNVFVTLNIATQYRVNENNVTDAYYKLIKPEAQIKSYIEDALRSSVPKLTLDELFEKKDEIALEVQHQVAEEMSTYGYIIVKTLITKVEPDAEVKQSMNEINAAQRKRVAAQELANADKIKIVTAAEAEAEKDRLHGVGIAQQRKAIVDGLADSIQELKDANVTLTEEQIMSILLTNQYLDTLNTFAINGNQTIFLPNNPEGVEDIRTQVLSALKTR

SEQ ID NO: 5811 - DNA, 888 bp, Streptococcus pyogenes
atgttaggaccatttatctttattgcttttggggttattgtaatcctagctattgttgccagtaccctttatgttgttcgtcaacaatctgttgccatcgtggaacgttttggtagataccaaaaaacagccacgagtggtattcatatccgacttccgtttgggattgacaaaattgctgcgcgtgtgcagctgcgtcttttacagtcagaaatcatcgttgaaaccaaaaccaaggacaatgtgtttgtaactttgaatgttgccactcagtatcgtgttaacgaacaaaatgtaacagatgcttactacaaattaatgaaacctgaatctcaaatcaagtcttatattgaagatgccttgcggtcatccgtgccgaagttgaccttagacgaattgtttgagaaaaaagatgaaattgccttggaagtacaacatcaagtggcagaagaaatgtcaacctatggatatattattgtcaaaaccttgattaccaaggtggagcctgatgctgaagtcaaacagtcaatgaatgaaatcaatgcggctcaacgcaaacgtgtagctgctcaagagttggcaaacgcagataaaattaaaattgtgacagcagcagaagcagaggctgaaaaagatcgattgcacggggtagggattgcccaacagcgtaaggccattgtggatggtttggcggagtctattcaagagcttaaagaagcgaatatttccttaaacgaagaacaaatcatgtccattttgttgaccaaccaatacctggataccctcaatacctttgcggcaaaaggaaaccaaaccctttttctaccaaatacaccaagtggggtagaggatatccgtacacaagttttatctgcccttaaaacaaaa

SEQ ID NO: 5812 - protein, 296 aa, Streptococcus pyogenes
MLGPFIFIAFGVIVILAIVASTLYVVRQQSVAIVERFGRYQKTATSGIHIRLPFGIDKIAARVQLRLLQSEIIVETKTKDNVFVTLNVATQYRVNEQNVTDAYYKLMKPESQIKSYIEDALRSSVPKLTLDELFEKKDEIALEVQHQVAEEMSTYGYIIVKTLITKVEPDAEVKQSMNEINAAQRKRVAAQELANADKIKIVTAAEAEAEKDRLHGVGIAQQRKAIVDGLAESIQELKEANISLNEEQIMSILLTNQYLDTLNTFAAKGNQTLFLPNTPSGVEDIRTQVLSALKTK

SEQ ID NO: 5813 - DNA, 1533 bp, Streptococcus agalactiae
atggggatgactatggaaaacggagccaaggaagtttcggacaaaccagcgacgactgttggagaagttggtcaaattctttctaaaggtgtattgatgggagcacgtggaaattcaggtgtaattacatcacaattattccgtggttttggtcaaagtatcaaggataaagaagaattaacgggtcaagatttggcacacgctttccagaatggtgttgaagtagcttataaagccgttatgaaaccagttgaaggaactatcttgacagtatcacgcggtgcagctaccgctgctctaaaaaaagctgaagaaactgatgatgcagttgaagttatgcgcgcaactctcaaaggtgctaagcgtgctcttgctaaaacaccggatatgctacctgttcttaaagaggttggtgttgttgattctggtggtcaaggactcgtctttatttacgaaggtttcctctcagcactgactggggaatatatcgcatcagaagattttaaagcaactcccgcaacaatgactgaaatggttaatgcagagcaccataaagctgtagtaggccacgtagccacagaagatattaaatatggctattgtacagaagtcatggttggtttaaagcaaggaccaacttacgttaaggaatttaactacgaagaatttcaaggttatcttagcaatctaggggattctttactagttgttaatgatgatgaaattgtcaaggttcatgttcatacagaagatccaggtcttgttatgcaagaaggtttgaaatatggatcgcttgtgaaggttaaagttgaaaacatgcgtaaccaacatgatgcccaaatgcaaaaggttgaagttgaagaaactgtcaaagaaactaaagaatatggtattattgctgttgtagctggtgacggtctagctgagatttttaaatcacaaggtgttgattatatcatctctggcggccagactatgaacccatctacagaagatattgtaaaagcgattgaaaaagtaaacgctagaaatgttattattttaccaaacaataagaacatcttcatggctgcacagtcagctgcagatgtcgttgatattccagcagcagtagtagagacacgtacagttccacaaggatttactagcttacttgcttttgatcctgctaagtctcttgaaactaatgtagctgatatgacaaatagcctctcagatgtcattagtggtagtgtgactttagctgttcgtgatacaacgatagatggccttgaaattcatgaaaacgacatccttgggatggttgatggtaaaattctagtatctacaccagatatggaaaaagcacttaaagacacttttgataaaatgattgatgaagatagtgaaatcgtgacaatctatgttggtgaagatggtaagcaagcattagctgagaccttgtcggaatatcttgaggaaacttatgaagatgttgaagttgagatccaccaaggagatcaacctgtatatccatacctcatgagcgttgaa

SEQ ID NO: 5814 - protein, 511 aa, Streptococcus agalactiae
MGMTMENGAKEVSDKPATTVGEVGQILSKGVLMGARGNSGVITSQLFRGFGQSIKDKEELTGQDLAHAFQNGVEVAYKAVMKPVEGTILTVSRGAATAALKKAEETDDAVEVMRATLKGAKRALAKTPDMLPVLKEVGVVDSGGQGLVFIYEGFLSALTGEYIASEDFKATPATMTEMVNAEHHKAVVGHVATEDIKYGYCTEVMVGLKQGPTYVKEFNYEEFQGYLSNLGDSLLVVNDDEIVKVHVHTEDPGLVMQEGLKYGSLVKVKVENMRNQHDAQMQKVEVEETVKETKEYGIIAVVAGDGLAEIFKSQGVDYIISGGQTMNPSTEDIVKAIEKVNARNVIILPNNKNIFMAAQSAADVVDIPAAVVETRTVPQGFTSLLAFDPAKSLETNVADMTNSLSDVISGSVTLAVRDTTIDGLEIHENDILGMVDGKILVSTPDMEKALKDTFDKMIDEDSEIVTIYVGEDGKQALAETLSEYLEETYEDVEVEIHQGDQPVYPYLMSVE

SEQ ID NO: 5815 - DNA, 282 bp, Streptococcus agalactiae
ttgcggaacattccctcaccagaacacggaccgtcaaaaacaataagatcaaaaaaagaattaaaacatttggctagtcgttgggagctttcattagtcacgataacatttctagcaccaaaacgttcgacattttcgactaaaattttactacgtttatttgaaatttcattactaactaatagaccagtattgtttaaatatgatagaaggtgtgttgtttttccaccaggtgcagctgctaaatctagcactttcattccttcttgtggttcagcaatc

SEQ ID NO: 5816 - protein, 94 aa, Streptococcus agalactiae
MRNIPSPEHGPSKTIRSKKELKHLASRWELSLVTITFLAPKRSTFSTKILLRLFEISLLTNRPVLFKYDRRCVVFPPGAAAKSSTFIPSCGSAI

SEQ ID NO: 5817 - DNA, 936 bp, Streptococcus agalactiae
  MISC_FEATURE (1)..(936): n = a, c, g, or t
atgaaattaccgaatgaatttattgaaaaatatcagactatacttaaagatgaagcagaagctttttttgacagttttgaacaaaaacccatatcggcatatcgcaccaatcctctcaaagaaaagcaacttgattttccaaatgccatcccaagtaccccttgggggcattatgggaaaatatcaggaaaatcaatagaacacacaactggccttgtttattctcaagaacctgctgctcagatagtggctcagattgctgaaccacaagaaggaatgaaagtgctagatttagcagctgcacctggtggaaaaacaacacaccttctatcatatttaaacaatactggtctattagttagtaatgaaatttcaaataaacgtagtaaaattttagtcgaaaatgtcgaacgttttggtgctagaaatgttatcgtgactaatgaaagctcccaacgactagccaaatgttttaattctttttttgatcttattgtttttgacggtccgtgttctggtgagggaatgttccgcaaagatcctcaagcaatacaatattggcacaaagattaccccactgaatgtgcacagttacaaagagatattttaaaagaagcaatcaaaatgctagctcatggtggtatacttgtatactctacttgtacatggtcaccagaagagaacgaagaagtggttaattggctccttcaagagtatgattacttagaacttgttgatattcctaaactaaatgggatggttgaagggattaatgtaccacaagttgcaaggatgtaccctcatcattttcaaggtgaaggacaattcgttgcaaaactgagagatactagatctaaggaagcacagaaaattaagccaaaagcacagaaaataaataaaatgcagttacaattgtggcaacaatttgcannnnnt

SEQ ID NO: 5818 - protein, 312 aa, Streptococcus agalactiae
  MISC_FEATURE (1)..(312): Xaa = Any Amino Acid
MKLPNEFIEKYQTILKDEAEAFFDSFEQKPISAYRTNPLKEKQLDFPNAIPSTPWGHYGKISGKSIEHTTGLVYSQEPAAQIVAQIAEPQEGMKVLDLAAAPGGKTTHLLSYLNNTGLLVSNEISNKRSKILVENVERFGARNVIVTNESSQRLAKCFNSFFDLIVFDGPCSGEGMFRKDPQAIQYWHKDYPTECAQLQRDILKEAIKMLAHGGILVYSTCTWSPEENEEVVNWLLQEYDYLELVDIPKLNGMVEGINVPQVARMYPHHFQGEGQFVAKLRDTRSKEAQKIKPKAQKINKMQLQLWQQFAXX

SEQ ID NO: 5819 - DNA, 1308 bp, Streptococcus pyogenes
atgatgtcattaccaaaagaatttattaacacttatcaagcaatactaggcaaagaattagaagatttcttggcaagttttaaccaagagccggtcaatgcttttcggattaaccccttaaagaatcaactaaaaacctttgaacaccccattccaaataccttatggggatattatggtaaactatctggcaagtctccagagcatgtgtcggggttggtttattcccaagaaccagcggctcaaatggtggcacaagtagcggctcctcaaaaggggagtcgtgttttagacttggcagctgcaccaggaggaaaatcaactcatttattagcttatttagacaatacaggtcttttagtcagcaatgaaatttctaagaagcgcagcaaggttttagttgaaaatatcgaacgttttggcgctagaaatgttgtggtgactaatgaatccgcagatcgtttagccaaggtattttctcattattttgatactatcgtctttgatggaccatgttctggtgaaggaatgtttcgcaaggaccctgatgctattcaatattggcatcacgggtatcccgcagaatgtgccaagttgcaaaaatctattttagaagacgccttagccatgttaaaaccaggaggagaattgatatactccacctgtacttgggctcctgaagaaaatgaagatgttgtgcagtggctcttagagacttatacctttttagaattggtcgatgttccaaaactaaatggaatggttagtggtatcggacttccagagactgctagaatgtaccctcatcgttatcaaggggaagggcaatttgtggccaagctaaaagataagcgtcaagaaggacaaagcactaaactaaaagcacctaaatccaacttgatcaaagaccagttacgtctttggaaaatgtttgaaaaagaccatctaaaccttaccctatcaggaacactacaaacctttggtgattacctatacctcttgccagatggtcttcctgctttagatggccttaaaattgctcggaacggtttagaattaggcgtcttcaagaagaaacgctttgaaccctcttacgccttgggattagctttaaagcctgatgaggtccgatcatctattgagcttagagaggaagactttagaccttatgtgtcaggtaacgtcattactttgccccaatcttatccaacaggctggtaccaattactcattaatggcaatggtctaggatttgccaaggtcgttgacaagaccatcaaaaataatttccctaaagggttaagattt

SEQ ID NO: 5820 - protein, 436 aa, Streptococcus pyogenes
MMSLPKEFINTYQAILGKELEDFLASFNQEPVNAFRINPLKNQLKTFEHPIPNTLWGYYGKLSGKSPEHVSGLVYSQEPAAQMVAQVAAPQKGSRVLDLAAAPGGKSTHLLAYLDNTGLLVSNEISKKRSKVLVENIERFGARNVVVTNESADRLAKVFSHYFDTIVFDGPCSGEGMFRKDPDAIQYWHHGYPAECAKLQKSILEDALAMLKPGGELIYSTCTWAPEENEDVVQWLLETYTFLELVDVPKLNGMVSGIGLPETARMYPHRYQGEGQFVAKLKDKRQEGQSTKLKAPKSNLIKDQLRLWKMFEKDHLNLTLSGTLQTFGDYLYLLPDGLPALDGLKIARNGLELGVFKKKRFEPSYALGLALKPDEVRSSIELREEDFRPYVSGNVITLPQSYPTGWYQLLINGNGLGFAKVVDKTIKNNFPKGLRF

SEQ ID NO: 5821 - DNA, 762 bp, Streptococcus agalactiae
ttggacgctaaatttgatttcgctaaacaattagtgtataaagctggtcaattcattaaatctgagatgcaaaatacttttgatgttgaggaaaagtctcgatttgatgatttagtgacaagtcttgataaaaaaacacaaaaattattaattcaagaaattattcaacattacccagatgataatatacttgccgaagaagatratgtgcgctcacccattgcacaaggtaatgtttgggttttagaccctattgatggaactgttaattttattgttcaaaaagataactttgctgttatgttagcttattacgaagaaggcgttggacaatttggtatcatctacgacgttatggctgatattctttacagcgggggaggacattttgatgtctatgctaacgataaaaaaattgttccttttcaagagtgtcctttagaacgttgcttacttggagtaaattctgctatgtatgcagaaaatgattgcggtattgcccatttagcttctgaaaccttaggtgttcgtatctatggtggtgctggaattagcatggcaaaagtcatgcagggcaaattattagcttatttttcgtatattcaaccttgggattatgctgcagcaaaaatcatgggggagacattaggatttaccttattaacgcttgacggggaagaacccaactattcaacaagacaaaaagtaatgttcctaccaaagtcgaaattaaatcttatccaatcctaccttaccaaaaaa

SEQ ID NO: 5822 - protein, 254 aa, Streptococcus agalactiae
MDAKFDFAKQLVYKAGQFIKSEMQNTFDVEEKSRFDDLVTSLDKKTQKLLIQEIIQHYPDDNILAEEDBVRSPIAQGNVWVLDPIDGTVNFIVQKDNFAVMLAYYEEGVGQFGIIYDVMADILYSGGGHFDVYANDKKIVPFQECPLERCLLGVNSAMYAENDCGIAHLASETLGVRIYGGAGISMAKVMQGKLLAYFSYIQPWDYAAAKIMGETLGFTLLTLDGEEPNYSTRQKVMFLPKSKLNLIQSYLTKK

SEQ ID NO: 5823 - DNA, 807 bp, Streptococcus pyogenes
ttgagaaaggattcttttcccttggaaactaaatacgcatttgcaaggcaaatcattaaagaagcagggctttttatcaagtcaaaaatgtcagagcagctagatattcaggtgaaaacacaatttgatgatctggttaccaatgttgatcaagaaactcaacagttactgatggatcgtattcatcagacctatccttgtgatgccattttagctgaagaaaatgacgttcgtcaccccattaatcaaggaaatgtttgggtcatcgatcccattgatggaacggttaactttattgtgcagggatcacagtttgcagtgatgattgcctattatgaacaaggaattggtcaatttgggcttatttatgatgtgatggcagatcaattactagctggtggtggtgattttgaagttactttaaacggtgataagcttccagcttaccaagaaaaacctttagagcgtagcttaattggctgcaatgcaggcatgtttgccagaaatgatcgtaaccttgctcatctaattgcaaagactttaggtgtaagggtttatggtggtgcaggtatctgcatggttaaggtcatgaagcaggaattactggcctatttttcatttatccaaccatgggattacgcagcagcaaaagtactaggcgataaactgggttatgttttactaactattgacggatatgagcctgattttcaaacacgtcaaaaaatcatgtttgttcctaaatgccaactcactaggatagcgtcttttctaacaaaggactctgccatcacacttgaagatcaa

SEQ ID NO: 5824 - protein, 269 aa, Streptococcus pyogenes
LRKDSFPLETKYAFARQIIKEAGLFIKSKMSEQLDIQVKTQFDDLVTNVDQETQQLLMDRIHQTYPCDAILAEENDVRHPINQGNVWVIDPIDGTVNFIVQGSQFAVMIAYYEQGIGQFGLIYDVMADQLLAGGGDFEVTLNGDKLPAYQEKPLERSLIGCNAGMFARNDRNLAHLIAKTLGVRVYGGAGICMVKVMKQELLAYFSFIQPWDYAAAKVLGDKLGYVLLTIDGYEPDFQTRQKIMFVPKCQLTRIASFLTKDSAITLEDQ

SEQ ID NO: 5825 - DNA, 300 bp, Streptococcus agalactiae
gtgctgaaattgagggaaaacatgattagtagtaattatagttatcctcttgatccttcatggaatacggaagatattactaaggtacttcgctttttaaatcaagttgaacacgcctatgaaaatagtattaaagttgatgatttgctagatagctataaagaatttaaaaaagttgttaaatccaaggcgcaggaaaaacaaattgaccgtgaattccagagaactagcggttattccacttatcaagctgttaaagcagcacaacaacaagcgaaaggatttatttcacttggacgc

SEQ ID NO: 5826 - protein, 100 aa, Streptococcus agalactiae
MLKLRENMISSNYSYPLDPSWNTEDITKVLRFLNQVEHAYENSIKVDDLLDSYKEFKKVVKSKAQEKQIDREFQRTSGYSTYQAVKAAQQQAKGFISLGR

SEQ ID NO: 5827 - DNA, 288 bp, Streptococcus pyogenes
ttgaggggtgatatgtcaggtaattattattatccacttgacttaagttggagcactgaagaaatatcctcagtgcttcattttttgaataaagtggaattagcatatgaaaaaaaagtagatgcaaaacaactcctagatagttataagacttataaaaccattgtcaaaagtaaagctcaggaaaagcaaatcgatcgtgattttcaaaaagttagtggttattcgacctatcaagttgttaaaaaagcgaaggcaattgagaaaggattcttttcccttggaaac

SEQ ID NO: 5828 - protein, 96 aa, Streptococcus pyogenes
LRGDMSGNYYYPLDLSWSTEEISSVLHFLNKVELAYEKKVDAKQLLDSYKTYKTIVKSKAQEKQIDRDFQKVSGYSTYQVVKKAKAIEKGFFSLGN

SEQ ID NO: 5829 - DNA, 411 bp, Streptococcus agalactiae
atgattaccttatttttatcacccagctgtactagttgtcgaaaagcgcgtgcttggctaagtaagcatgaggttgcttttgaagagcataacattattacaagtccactcaataaagaagaactattacaaattctatcgtttacagaaaatggtacagaagacattatttccacacgttcaaaagtctttcaaaaacttgctattgatgtagacgaattatcaacgtcttcattaatggaattaatttcagaaaatccaagtcttttacgacgcccaattattttagacaaaaaacgtatgcagattggttttaatgaggatgaaattcgtgccttcttaccgcgtgactatcgtaaacaagaactgaaacaggccactattcgtgctgaaattgagggaaaacatgat

SEQ ID NO: 5830 - protein, 137 aa, Streptococcus agalactiae
MITLFLSPSCTSCRKARAWLSKHEVAFEEHNIITSPLNKEELLQILSFTENGTEDIISTRSKVFQKLAIDVDELSTSSLMELISENPSLLRRPIILDKKRMQIGFNEDEIRAFLPRDYRKQELKQATIRAEIEGKHD

SEQ ID NO: 5831 - DNA, 402 bp, Streptococcus pyogenes
atggttaccttatttttatcacctagctgtaccagttgtcgtaaagcaagggcatggttagtaaaacacgaagttgactttcaagagcataatattattacaagtccattaagccgtgatgaattaatgtcaatcctctcttttacagagaatggaacggaggatattatttcaacacgttcaaaggtttttcaaaaacttgatattgatgtagaagagctttcaatttcagatttaattgatttaattgctaaaaatccaagtcttcttcgtcgccctattatcatggatcaaaaacgcatgcaaattggttttaatgaagatgaaattagagcgtttttatcgagagattatcgcaagcaagaactacgtcaagcaacgataaaagcagaaattgagggg

SEQ ID NO: 5832 - protein, 134 aa, Streptococcus pyogenes
MVTLFLSPSCTSCRKARAWLVKHEVDFQEHNIITSPLSRDELMSILSFTENGTEDIISTRSKVFQKLDIDVEELSISDLIDLIAKNPSLLRRPIIMDQKRMQIGFNEDEIRAFLSRDYRKQELRQATIKAEIEG

SEQ ID NO: 5833 - DNA, 930 bp, Streptococcus agalactiae
atgaaaatccattacattaatgattataaagatattcaagctaaagaagattgcgtcttagttttgggctattttgatggcttacatctgggacataaagccctctttgataaagctaaaaaaatcgcgaccgaaaaaaatttgaaaattgtcgtcttaacgtttaatgagacacctcgtctaaccttcgctcgcttccaacctgaattattgctacatcttacctctccagaaaaacgttctgaaaaatttcaagagtatggcgtcgatgagttatatttaatgaattttaccagtcatttttcaaaagtatcttctgacctttttattaagaaatatatttatggtctcagagcaaaagctgctgttgtcggttttgattataagttcggtcataatcgtaccagtggtgattatctagcgcgtaatttcaagggaccagtctatattattgatgaaatttctgaaggtggtgaaaaaatctcttctacacgtattcgtcaattgattacagagggtaatgttgagaaagctaaccaacttttgggttatgagttttcaacctgtggcatggtagtacatggagatgctagaggacgaactatagggttcccaactgctaatctagctcctattaatcgcacttacttacctgcagacggtgtttatatttccaatgttctgattaatggaaaatattatagagcaatgacgagcattggaaaaaatatcacttttggtggtacagaacttcgtttagaagctaatatctttgattttgatggcgacatttatggagaaactattgaaattttctggttaaaaagaatcagagaaatggtaaagtttaatggtattgacgatcttgtaaaacaacttaaaaaagataaagaaattgctttaaattggaaaaaagatagtcaaactctt

SEQ ID NO: 5834 - protein, 310 aa, Streptococcus agalactiae
MKIHYINDYKDIQAKEDCVLVLGYFDGLHLGHKALFDKAKKIATEKNLKIVVLTFNETPRLTFARFQPELLLHLTSPEKRSEKFQEYGVDELYLMNFTSHFSKVSSDLFIKKYIYGLRAKAAVVGFDYKFGHNRTSGDYLARNFKGPVYIIDEISEGGEKISSTRIRQLITEGNVEKANQLLGYEFSTCGMVVHGDARGRTIGFPTANLAPINRTYLPADGVYISNVLINGKYYRAMTSIGKNITFGGTELRLEANIFDFDGDIYGETIEIFWLKRIREMVKFNGIDDLVKQLKKDKEIALNWKKDSQTL

SEQ ID NO: 5835 - DNA, 930 bp, Streptococcus pyogenes
atggaaattgaatatatcaaagattatcgtgatattaaccaagaagatgatacagtcttgatattgggatattttgatggattacaccgtggtcataaagccttatttgacaaagcaagagaggttgcaaataaagaagggttaaaagtagtcgtttttacgtttacagagtctccgaaattggctttttcgcgtttttctcctgagttattgcttcatattacttatccaaagaagcgttatgaaaaatttgccgattacggtgtaaataaattatatttggttgattttacttctaaattctctaaggtctcatctgatcattttataactcattatattaaaaacctgaaagcaaagcatattgttgtcggttttgactataagtttgggcataatcgtacagatagtgattatttaaccagaaattttgaaggacaagtttataccattgaggaaataaaagaagatcatcgaaaaatttctgctacatggataaggaagcttattcaagaaggtaatgtagttaaagcaaaccacttgttaggctatgacttatcgacaaggggaagagtcgttcacggggatgcgcgtggccgtactattggtttcccaacagccaatctagctccaattgacaacacatacttaccagctgatggagtctatgttacaaatgttattgttgctaataaaatctatcgctctatgacgagtttaggtaaaaatgtgacatttggggggaaagagttgcgtctagaagttaacatttttgactttgacgaagagatctatggagaaattattgagattgtttggttagataagattcgagacatggaaaaattcgagggaatcgaagatttgactgatagattggaatatgataaacgaacagcattaaattggaaaaaagatagcaaattatct

SEQ ID NO: 5836 - protein, 310 aa, Streptococcus pyogenes
MEIEYIKDYRDINQEDDTVLILGYFDGLHRGHKALFDKAREVANKEGLKVVVFTFTESPKLAFSRFSPELLLHITYPKKRYEKFADYGVNKLYLVDFTSKFSKVSSDHFITHYIKNLKAKHIVVGFDYKFGHNRTDSDYLTRNFEGQVYTIEEIKEDHRKISATWIRKLIQEGNVVKANHLLGYDLSTRGRVVHGDARGRTIGFPTANLAPIDNTYLPADGVYVTNVIVANKIYRSMTSLGKNVTFGGKELRLEVNIFDFDEEIYGEIIEIVWLDKIRDMEKFEGIEDLTDRLEYDKRTALNWKKDSKLS

SEQ ID NO: 5837 - DNA, 882 bp, Streptococcus agalactiae
atgattacaggaataattaatttaaagaaagaagctggaatgacatcacacgatgctgtattcaagcttcgaaagatattacatacaaaaaaaataggacacggcggaactcttgatccagatgttgttggggttttaccaattgcggttggaaaagccactcgtgttattgaatatatgacagaaagtggcaaaatttatgaaggagaaatcactttaggatatgccacaagtacagaagattctagtggagaggtcatttcaagaactccactaactcaatccgatcttagcgaggatgttgtggatcatgcgatgaaaagttttaccggtccaattacacaagttcctcctatgtattcagcagttaaagtaaatggtaaaaaactctatgaatatgctcgttcaggagaagaagtagagcgacctaaacgacaaataacaatttctgaatttagacgcacaagcccattgtacttcgaaaaaggcatctgccgttttagtttctatgtctcatgcagtaaaggtacctatgttaggacgttagctgttgatctaggaataaaactaggatatgctagccatatgtctttcctaaaaagaacctcatctgcaggattatctattacacaatcattaacgcttgaagaaattaatgaaaaatataagcaagaagatttttcatttttacttccaattgaatatggtgttttagatctcccaaaagttaacctaactgaggaagataaagttgaaatctcatacggacgtcgtatcttattagaaaatgaagcagataccttagcagctttttatgaaaatagagttatcgctatactagaaaaacgtggcaatgaatttaaaccacacaaagtattgtta

SEQ ID NO: 5838 - protein, 294 aa, Streptococcus agalactiae
MITGIINLKKEAGMTSHDAVFKLRKILHTKKIGHGGTLDPDVVGVLPIAVGKATRVIEYMTESGKIYEGEITLGYATSTEDSSGEVISRTPLTQSDLSEDVVDHAMKSFTGPITQVPPMYSAVKVNGKKLYEYARSGEEVERPKRQITISEFRRTSPLYFEKGICRFSFYVSCSKGTYVRTLAVDLGIKLGYASHMSFLKRTSSAGLSITQSLTLEEINEKYKQEDFSFLLPIEYGVLDLPKVNLTEEDKVEISYGRRILLENEADTLAAFYENRVIAILEKRGNEFKPHKVLL

SEQ ID NO: 5839 - DNA, 882 bp, Streptococcus pyogenes
atgataaatggaatcattaatttaaaaaaagaagccggcatgacctctcatgacgcagtttttaaattacggaagttattacaagaaaaaaagattggacatggggggaccttagatcctgatgtggtcggtgttctaccaattgcagttggtaaggctactcgtgtgatcgaatacatgacagaagctggtaaagtttatgaaggacaagtgactctcggttactcaacaacgactgaggatgctagtggagaggtagttgcgaggtcctctttgccagctgtgctaacagaagaactcgttgatcaaacgatgacgactttccttgggaaaatcacacagaccccacctatgtattcagccgtaaaggttaatggccgtaaattatacgagtatgcgcgtgctggtgaaagtgtggaacgtcctagaagagaagtgactatttctctgtttgaacgcaccagccctttgaattttactgaagacggtctttgccgattctcttttaaagttgcttgtagcaaagggacttatgtgcggaccttagcagttgatttaggtcgagctctaggggtagagagtcatatgtccttcttgcagcgatcagcttcagcaggattaaccctcgagactgcctatactttgggagaaattgctgatatggtttctaaacaagagatgtcttttttgttaccgatcgagtatggcgttgctgatcttcctaaaatggttattgatgatactgaattgactgaaatttcatttggtcgccgtcttagtctccctagtcaagagccactgttagctgcttttcatggcgaaaaagtaattgctattttagaaaaaagagatcaagaatacaaacccaaaaaagttcttatt

SEQ ID NO: 5840 - protein, 294 aa, Streptococcus pyogenes
MINGIINLKKEAGMTSHDAVFKLRKLLQEKKIGHGGTLDPDVVGVLPIAVGKATRVIEYMTEAGKVYEGQVTLGYSTTTEDASGEVVARSSLPAVLTEELVDQTMTTFLGKITQTPPMYSAVKVNGRKLYEYARAGESVERPRREVTISLFERTSPLNFTEDGLCRFSFKVACSKGTYVRTLAVDLGRALGVESHMSFLQRSASAGLTLETAYTLGEIADMVSKQEMSFLLPIEYGVADLPKMVIDDTELTEISFGRRLSLPSQEPLLAAFHGEKVIAILEKRDQEYKPKKVLI

SEQ ID NO: 5841 - DNA, 435 bp, Streptococcus agalactiae
atgattatgaagattagaactgctacactagacgatagtgaaaaattagtccctttgtatcaagaattaggatacgcaatatcattatcagagattcaatctattttaaaggttattcttactcattcagattatggctttttgatagctgaggataatggcaaactcctcgccttcgttggatatcataaactttacttttttgaaaaaagtgggacttactatcgtattttagcactagtagttaatgaaaagcaccgtcgtaaaggcatcgctagtcaacttattaatcacgttaaacagctagctaaaacagatggaagtgaagtactggctttaaatagcagtttaaaagaatatcgtcaggaagcttatcatttttatgaaaacctagggttcaagaaggttagtacaggcttttcatactatttagat

SEQ ID NO: 5842 - protein, 145 aa, Streptococcus agalactiae
MIMKIRTATLDDSEKLVPLYQELGYAISLSEIQSILKVILTHSDYGFLIAEDNGKLLAFVGYHKLYFFEKSGTYYRILALVVNEKHRRKGIASQLINHVKQLAKTDGSEVLALNSSLKEYRQEAYHFYENLGFKKVSTGFSYYLD

SEQ ID NO: 5843 - DNA, 450 bp, Streptococcus pyogenes
atgttgagaccattaagtaaaacggactgtcctatgctacaagaaattaatgccaaagcccttggctatttagtttcgcttgacttgttagaaaggcaatatgaacgattgattgaggattgccatcactattttttagcttatgccgacaaggataccaatcaattattaggctatgttcacgctgaacggtatgaaaccctttatgcttctgatggtcttaatctcttgggcttggctgttttaccagcctatcagagaaggggaattgggagtgccttactaagggccctggaatcccaagctaggcaggaaggcattgcctttattcgcctcaattctgccagtcatcgtaaagaagcgcatgctttttaccgaaacctcgactatgcagatgataaaacacaattacgattcatcaaaaacttacaaggagatgacaatgatttt

SEQ ID NO: 5844 - protein, 150 aa, Streptococcus pyogenes
MLRPLSKTDCPMLQEINAKALGYLVSLDLLERQYERLIEDCHHYFLAYADKDTNQLLGYVHAERYETLYASDGLNLLGLAVLPAYQRRGIGSALLRALESQARQEGIAFIRLNSASHRKEAHAFYRNLDYADDKTQLRFIKNLQGDDNDF

SEQ ID NO: 5845 - DNA, 1269 bp, Streptococcus agalactiae
atgaacgaaatcaaatgccctcattgtggaacagcttttgccatcaacgagtctgaataccatcaattactagaacaaattcgcggagatgcttttgacaaagaagtaagtgaacggttggaaaaagaacgtctaatattaggggagcaagcaaaaaatcaattacaggaagttgttgtagaaaaagacaaggagatagctaaacttcagtacaaagtcaaacaatttcttatagaaaaagacaatcttctcaaagacaatgagtaccaactcgctgagcaattaaatcaaaaagacatgatgcttcgcgaccttgaaaaccaaatcgatagactacgtttagagcatgaaaatagcttgcaagaggcgctaacaaaagtcgaacgagaaagagatgcaatacaaaatcagttgcacattcaagaaaaagaaaaagatttagctttagcttcagtaaaaagtgattatgaagtacaactaaaggcagccaatgaacaagtagaattctataaaaacttcaaagctcaacagtctactaaagcagtaggagaaagtttagaacattatgctgaaacagaatttaataaagtgcgacatttggcctttcctaatgcttattttgagaaggacaatacattatcaagtcgtggctcaaagggggactttatctatcgagaaaaggatgaaaatgaccttgagtttttaagtatcatgtttgaaatgaaaaatgagtctgatgatactatcaagaagcataaaaatgaagattttttcaaagaattagataaagatcgtcgtgaaaaatcttgcgaatacgcagttttagtaactatgcttgaagcagacaatgactattataatactggaattgttgatgttagtcacaaataccctaaaatgtacgttatacgtccacaattttttatccaattaattggtattctaagaaatgcagcactcaataccttaaaatataaacaagagcttgctttgatgaaagaacaaaatattgacatcacacattttgaagaagatttagatattttcaaaaatgcatttgctaaaaattataattctgcaagcaaaaatttccagaaagcaatcgatgaaatagataaatctattaaacgtatggaagctgttaaggctgctttaacaacgtctgaaaatcaactacgtcttgcaaataataaattagacgatgtttctgtcaagaaattaacaagaaaaaatccaacaatgaaagcaaaattcgatgctctaaaagac

SEQ ID NO: 5846 - protein, 423 aa, Streptococcus agalactiae
MNEIKCPHCGTAFAINESEYHQLLEQIRGDAFDKEVSERLEKERLILGEQAKNQLQEVVVEKDKEIAKLQYKVKQFLIEKDNLLKDNEYQLAEQLNQKDMMLRDLENQIDRLRLEHENSLQEALTKVERERDAIQNQLHIQEKEKDLALASVKSDYEVQLKAANEQVEFYKNFKAQQSTKAVGESLEHYAETEFNKVRHLAFPNAYFEKDNTLSSRGSKGDFIYREKDENDLEFLSIMFEMKNESDDTIKKHKNEDFFKELDKDRREKSCEYAVLVTMLEADNDYYNTGIVDVSHKYPKMYVIRPQFFIQLIGILRNAALNTLKYKQELALMKEQNIDITHFEEDLDIFKNAFAKNYNSASKNFQKAIDEIDKSIKRMEAVKAALTTSENQLRLANNKLDDVSVKKLTRKNPTMKAKFDALKD

SEQ ID NO: 5847 - DNA, 1338 bp, Streptococcus pyogenes
atgaacgaaataaaatgccctcattgtcataccctatttactatcaatgagtcagagtatagtcaattattggaacaagtcagagggcaagcctttgatgaagaattgaaaaaacggctaatcaatgagatagccttgctggaagaaaaagcgaagcatcaattgcatgaggttgtcgcaaaaaaagaaacagctattaccagcttgacaaaccaattagagcaaattgaaaaagaacaagcctacctcagacaagaagaactggctaaaaaagaccagcttattgcttctttagaagcgaaacttgataaattagcctcgcaaaatgctttggaactggccaatcaattagctgagaaggacaaagaagtggttagtttgactaatcagctggacaaattagcacttgaaaaagatgccacgttccagtcaaaacttgctacaatcgaaaaagaacgcgatggaatcaaaaaccaattggcgcttcaagctaaagaaagtgaattgtcgttggcttcggtgcgcagcgactacgaagcacagttaaaagcggctaacgagcaagttgaattttataaaaatttcaaagcgcagcaatctaccaaagcaatcggagagagtctagaactctatgctgaaacagagtttaacaaagtaagaagctatgctttccccaatgctagctttgtcaaagataaccaattgtctagtcgtgggtcaaaaggggactatatttaccgagaggttgatgccaatggtgtagaaatcctctctatcatgtttgagatgaagaacgaggcagacaccaccaaaacaaaacataaaaatagtgattttttcaaggagttagataaagaccgtcgcgaaaaagattgtgagtatgctgttttggtaagcatgttagaagctgataatgattactacaatacagggattgttgatgtcagtcatgagtatcaaaagatgtatgtggttcgtcctcaactctttattcagttgatagggattctgcgaaatgcggccctgaatagtttacactataagcaagagttggccttggttaaggaacaaaatattgacatcactcacttcgaagaggatttggaccaatttaagaatgcctttgctaagaactatcagtctgccagcaacaactttaaaaaggctattgacgagattgataaatcgattaaacgcatggaggaagtgaaacgctttttaaccactagtgaaaatcagttacgcttagctaataataaattagaggatgtttcagttaaaaaactgacccgccaaaacccaaccatgcgagagaaatttgaagccctcaaggaccag

SEQ ID NO: 5848 - protein, 446 aa, Streptococcus pyogenes
MNEIKCPHCHTLFTINESEYSQLLEQVRGQAFDEELKKRLINEIALLEEKAKHQLHEVVAKKETAITSLTNQLEQIEKEQAYLRQEELAKKDQLIASLEAKLDKLASQNALELANQLAEKDKEVVSLTNQLDKLALEKDATFQSKLATIEKERDGIKNQLALQAKESELSLASVRSDYEAQLKAANEQVEFYKNFKAQQSTKAIGESLELYAETEFNKVRSYAFPNASFVKDNQLSSRGSKGDYIYREVDANGVEILSIMFEMKNEADTTKTKHKNSDFFKELDKDRREKDCEYAVLVSMLEADNDYYNTGIVDVSHEYQKMYVVRPQLFIQLIGILRNAALNSLHYKQELALVKEQNIDITHFEEDLDQFKNAFAKNYQSASNNFKKAIDEIDKSIKRMEEVKRFLTTSENQLRLANNKLEDVSVKKLTRQNPTMREKFEALKDQ

SEQ ID NO: 5849 - DNA, 588 bp, Streptococcus agalactiae
gtgccacaaaatccaacaagtaacccagagaaaaaaacttatttattatctgaattggtagactgctttaaaggtaaagctgtgccttcaaaagcagaagcaggtgatatccgtattattaatttgagtgatatgtctcctttaggaattgactaccataacttaagaacattccaagatgaacaacgatcgcttttaaaatatctacttcaggaaggcgatgttttaatcgcttcaaaaggaactgtcaagaaagttgctatttttgaagagcaagattaccctgtcgttgcctctgctaatattacaatactaaggcctacacaacacattagagggtactacttaaagcttttttttgattcagaagaaggtcaacaggcacttgagaatgctaacaaaggaaaagctgtgatgaatattagcacaaaggaactgttaaatattgcaataccaagtatcccgctttttagacaggattatcttatccaacgttataaacaggggctcaacgattacaaacgtaagatagcacgtgcagagcaggagtgggaacgtatccaaaatgacatcagacaacaacttagc

SEQ ID NO: 5850 - protein, 196 aa, Streptococcus agalactiae
MPQNPTSNPEKKTYLLSELVDCFKGKAVPSKAEAGDIRIINLSDMSPLGIDYHNLRTFQDEQRSLLKYLLQEGDVLIASKGTVKKVAIFEEQDYPVVASANITILRPTQHIRGYYLKLFFDSEEGQQALENANKGKAVMNISTKELLNIAIPSIPLFRQDYLIQRYKQGLNDYKRKIARAEQEWERIQNDIRQQLS

SEQ ID NO: 5851 - DNA, 594 bp, Streptococcus pyogenes
atggaaaatagcattgaggcctatctagcagatagcagagaaaaggtaacattaggcacagttgttgattgttttaaaggaaaagcagtctcaagtaaggttgtgccaggtgatgtgggattgattaatttatctgacatgggcaccttagggattcaatatcaccaattaagaactttccagatggatcgtaggcagctcttgcgttaccttttggaagacggagatgtcttaatcgcctctaagggaaccctaaaaaaagtctgtgtttttcataagcaaaatcgagatgtggtggcatcatcaaatatcactgtcttacgccctcaaaaactgttaaggggctactatatcaagttctttttggactcacctattggtcaagcgctcttggatgtagcggaccatggcaaagatgtgatcaatctctcaacgaaagaattgttggatattccaattcccgttattcctttagtgaaacaggactatttgattaatcactacttgagaggattaacagattatcatcgtaaactcaatcgagcagaacaggagtgggaatatattcagaatgaaattcaaaaaggattaggt

SEQ ID NO: 5852 - protein, 198 aa, Streptococcus pyogenes
MENSIEAYLADSREKVTLGTVVDCFKGKAVSSKVVPGDVGLINLSDMGTLGIQYHQLRTFQMDRRQLLRYLLEDGDVLIASKGTLKKVCVFHKQNRDVVASSNITVLRPQKLLRGYYIKFFLDSPIGQALLDVADHGKDVINLSTKELLDIPIPVIPLVKQDYLINHYLRGLTDYHRKLNRAEQEWEYIQNEIQKGLG

SEQ ID NO: 5853 - DNA, 474 bp, Streptococcus agalactiae
ttgatttggtttcttatttttgctgttggatggcaggtacaaagcgcatctgttgaaatattgtgtcgtggatggttacttccggtgagtgccacaaagtatagtaagatagtttctgtcagtatcagttcaatctttttcggtcttctgcatagcgctaataatcatgtaagccttatctcgattttcaatctgtgtctctttggactatttctatcgctctatgttattttaaaaggtaacatctggggggcgtgtggtattcatggcgcctggaactgtgtacaagggagtgtctttggaatcgaagttagtggagagccaatgttgtctaactccctagtccatgttaaaacctatggtgctgactggattagcggtggaaaatttggtgtggaaggaagcatgattaccagtattgttcttatcgtagcatgttattggctttatcaaaaatcgaattttccttacgac

SEQ ID NO: 5854 - protein, 158 aa, Streptococcus agalactiae
MIWFLIFAVGWQVQSASVEILCRGWLLPVSATKYSKIVSVSISSIFFGLLHSANNHVSLISIFNLCLFGLFLSLYVILKGNIWGACGIHGAWNCVQGSVFGIEVSGEPMLSNSLVHVKTYGADWISGGKFGVEGSMITSIVLIVACYWLYQKSNFPYD

SEQ ID NO: 5855 - DNA, 6834 bp, Streptococcus agalactiae
atgggagggaaaatgaatcaagaagtcttactacaaatgatgagagccactattcctcgtgatagagccttgcttgaggcatttttatattaccaagcagagcattttgatgaggagtgggatagtcttattcatcagtttatgaccaataggcaagaaataaataagtctgttcaagtacttcactttgagacagatgtttcagcttttgtccaggctagtccttatgatactgctcatgatctattgacctatacacaagttttcggccaaagtggtcttcaaaaactagataaactatcgccgtctgaaaaaaacttggtgatagaagtggccttgttcaatctggccactcgttttcaattattggattccaatggacactaccaaaccatatcgccggattcactcttacaaaagagtaggggagctaatttggtcaatgtgtatcgtgtggctaataatttagcggatcgtattagtcgagatattgaacagtttctcttaacttacgagcctgagcttgaaactagagctgatgaaactgttctagaaaatgaagaaactgttgatgagcacaaaacaagtgttcatcaagcaatatcttttcgagaagagggctctctggttattgctagtttggatgtagatttgtctcaactagatgttcaaataggaaaaaccagtcatctgccagcttatgaagagttatccttacgacgtaaatttgagattctaacatattttgaccaaattcgaaatgaacgttccaaagtcccaagttttagacgaggtgattttgacacagagatggaaatgacaccagtctttgatggcgaggaattacttacttatctcgaagctgatggcagtccctatgagctgaaacgaacgctgactacagtcgaagaaaaggaattagaaaaaattggacaagccattaggatagaaaatcaagaaaaattgactcagctagggattgatttatctcagtttgacccagaccgagtcggtattttattggatgcagcaggtcgttttcgtttaaaaaatgcagaccttgctttactaggtggttatcccaaagcctcggtaactcaactagcccttgcgacagaactactccaaatgggactaagtcatgaaaaggttgaatttttctttggtagccagctttccattgaagagctgcgacaagttgcctacgcctttttataccaagaactcagcagagaagatgcggagcaatttgaaaaagataaaggtaatcagccagatttaactctcagagattggaaaagcaagctagagaaagctgagggaaaagaagtagttgatgaagaattcgcggaaaatccactggttcagagagtattggacacttatcctctggggtcattggtttcctataagggacaggactttgaggtcatgtcggtcagcgatgctcgattgaacggtttgattcggattgagttagtcaatgacttttcggatatcattgaacaaaatccagttctttatgtgaggacctgggaagaagtcagtcaggcacttcatcagccaaaggcagaaccacaaacagagttagaagaagcggaccaagaattaaacctattctcatttctggaagaggagccagttcagagtattggactattggaaccagatgattcagaaaatggtcataacgatactgatcttgaagaaacagataatcaaattcctgaagaggaagtcgtcgaaacaattccagagattccagtaacggacttttattttccagaagatttgacggacttttatcctaagactgctagagataaggttgagacaaacattgtggccattcgtttggtaaaaaatctagaagtagagcaccgcaatgcttcaccaagtgaacaagaactccttgccaagtatgtaggctggggtggactagccaatgaattttttgatgactataatccaaaattttctaaggaacgagaagaactgaagagcctagtcacagataaagagtattcggatatgaaacagtcctccctgacagcctattacacagacccatccctgatccgtcagatgtgggataagttggaaagagatggctttacaggtggcaaaatcctagatccttccatgggaacagggaatttctttgcggctatgccaaaacacttaagagaaaagagtgagttgtatggcgtagagttagatactattacaggagctattgccaaacaccttcatcccaatagtcatattgaaattaagggatttgagacggtggcttttaacgacaatagttttgatttggtgatttcaaatgtgccctttgccaatatacgaattgcggataataggtacgataggccttacatgattcatgactactttgtcaaaaagtcacttgatttgcttcatgatggtggacaagtagcgattatctcttccacaggaactatggataagcgaacagaaaacatcttacaagatattcgtgagacaactgaatttcttggtggggttcgactgcctgactctgcctttaaggccattgcaggaacgagtgtcacaacggatatgttattcttccagaaacacttagacaagggatatgtggcagacgatttagccttttcaggttccattcgctatgacaaggatagtcgcatttggctcaatccttattttgatggagaatacaatagccaggtgctaggaacctacgaggtcaggaattttaacggaggaacactttctgttaaggggactagtgatgacttgattgcaagtgttgaaacagctctaaatcacgttaaggccccaagagagattgatagaaatgaggtcatcattaacccagatgtgttgaccaaacaagtcaatgatacctccattccagctgaaatgagggaaaatctaggtcagtacagttttggttatcaggggtctacagtttactatcgagataacaaaggcattcgagtcggaaccaagacggaagaaatcagttactatgtcgatgaagagggcaacttcaaagcatgggacaccaaacattctcaaaagcagattgatcgctttaatgccttagaagtgactgataacactgctctggatgtctatgtgaccgatgatgcagccaaacgtggtcagtttaaggggtattataaaaagacagttttctatgaagctccattgtcttataaagaagtggcacgtatcaaaggaatggtcgatattcgcaatgcctaccaagaagttattgccattcaacgctattatgactatgataaggagacctttaaccacttgttaggcaaactcaatcgtacctatgatagctttgtcaaacactatgggtatttgaatagtgctgtgaaccgcaatctttttgatagtgatgataagtattcgcttcttgctagtttggaagatgaaagtctggatccaagtggaaagtctgttatctatactaaatcccttgcctttgagaaggctctagtgcgtcctgaaaaagaggttaaaaaggtgcatactgcccttgatgccttaaattcgagcttggctgacggacgaggtgttgatttcgcttatatgatgtctatctatcaggttgaatcgcagatgaccttgattgaggagttaggcgacctcattatgcctgatcctgagaagtatttgaatggagaattgacctatgtttctcgccaagactttctttcaggggatgtcgtcactaagttagaagtggtagatctattcgtcaaacaagacaatcaggactttaactggtcacattatgcgggacttctagaagctatcaaaccagcccgtattactttggcagacattgattatcgaatcggttcacgctggattcctctggctgtttatggaaaatttgcccaagaaacctttatggggaaagcctatgaactgtcagaccaagaagtagcgacagtcctagaagtcagtcccattgacggggttatcacttaccaatctaagtttgcctacacctattccaacgcaacggataggagtttaggtgtccctgcttcacgctatgatagtggtcgaaaaatctttgaaaatctcctgaattccaatcaaccaaccatcacaaaacaagttgtcgaaggggataagaaaaagaatgtgacggatgtagagaaaacaacggtcctgcgtgccaaggaaacacacctacaagaactctttcaaggttttgtagcaaagtatccagaagtccaacaaatgattgaagacacctataataggctctacaatcgtacggtatcaaagtcctatgatggtagtcatttaaccattgatggacttgctcagaatatctccttacgtcctcaccaaaagaatgccattcaacgaattgtcgaggaaaaacgtgctctactagctcatgaagttggttcaggtaaaacacttaccatgcttggggcaggattcaaactgaaagaactcggaatggtacataaaccactttatgtggtgccgtctagtctgactgctcagtttggtcaagaaatcatgaaatttttccctaccaagaaagtctatgtgactactaagaaagactttgccaaagccaaacgcaagcagtttgtgtcccgtattattacaggggactatgatgccattgtcattggggattcacaatttgagaagataccgatgagtcgtgaaaaacaggtcacctatatcaatgacaaacttgagcaactccgagaaatcaagctaggaagtgacagtgattacacggtgaaagaagcggaacgttcgattaagggattagaacaccagttggaagaactccaaaaactagagcgagatacctttattgagtttgaaaaccttggaattgattttctttttgtggatgaggctcatcacttcaagaatatccgtccaatcactggacttgggaatgtagctggaatcaccaacacaacttctaaaaagaacgtggatatggagatgaaggtgagacaagtacaggcagagcatggagatagaaatgtcgtttttgcgacaggaacaccagtttctaactctattagtgaacttttcaccatgatggattacattcaacctgatgtcttggaacgatacctggtatcaaattttgactcctgggttggggcttttgggaatatcgaaaactccatggaactagccccgacaggagataagtaccaacccaagaaacggttcaagaaatttgtcaaccttcctgaactcatgcgaatctacaaggaaactgccgatattcagacctcagacatgcttgatttaccagtaccggaagctaagattattgcggtggaaagcgagttaacgcaagctcagaaatactatttggaagagctggtaaagcgttcagacgctatcaagtcaggtagtgttgatccaagtagagataacatgcttaaaatcacaggagaagccagaaaactagctattgatatgcggttgattgaccctacttactccttatcggataatcagaaaatccttcaagtagtcgataatgtcgagcggatttaccgtgatggagctggagacaaagccactcagatgattttctcagatattggaacccctaaaagtaaggaagaagggtttgatgtctacaatgaacttaaggacttgtttgtcgatcgagggataccaaaagaagaaattgcctttgtccatgatgccaatactgatgagaagaaaaactctctgtcacgcaaggtcaatagtggagaagtacggattctcatggcttctacggaaaaagggggaacaggattaaacgtccaatctcgcatgaaagctgtccactatttagacgttccctggaggccctcagacattgtccagcgaaatggacgactaattcgacaaggaaacatgcaccaggaggtagatatttatcactatattactaaagggagctttgacaattacctctggcagacgcaggagaataagctaaagtatatcacccagataatgacctcaaaagatcctgtgagatcagctgaagacattgatgaacaaaccatgaccgcctcagactttaaggcattggcaactgggaacccttatctcaaactcaaaatggagttggaaaatgaactgacagttttagagaatcaaaaacgagcctttaatcgctccaaagacgagtatcgccataccatttcctatagcgagaagcacctccctattatggaaaaacggttgagtcaatatgataaagatattgcccaatctttggcaaccaagtcgcaagattttgtcatgcgatttgacaatcaagcaatggataatcgtgctgaagctggggactatctgcgaaaactcattacctataaccgctcagagaccaaggaagtcaggacacttgccagctttagaggatttgatttaaaaatgactacacgaggtgctagtgagcccttaccagaaaccatttctttaatgattgtaggtgataaccagtatactgtcgcccttgatttgaaatcagacgtgggaaccattcaacggattagtaatgccattgaccatattatagatgaccaagaaaagacgcaagagctggtaaaggatttaaaagataagctacgagtagccaaagtagaagttgataaagtctttccaaaggaagaggactatcagcttgtaaaggctaagtatgatgttttagctcccttggttgaaaaagaagcagagattgaagagatagatgcagctttggccaagtttagtgaagatacaacaccccaaaagaagcaacaaatagcactcgagata

SEQ ID NO: 5856 - protein, 2278 aa, Streptococcus agalactiae
MGGKMNQEVLLQMMRATIPRDRALLEAFLYYQAEHFDEEWDSLIHQFMTNRQEINKSVQVLHFETDVSAFVQASPYDTAHDLLTYTQVFGQSGLQKLDKLSPSEKNLVIEVALFNLATRFQLLDSNGHYQTISPDSLLQKSRGANLVNVYRVANNLADRISRDIEQFLLTYEPELETRADETVLENEETVDEHKTSVHQAISFREEGSLVIASLDVDLSQLDVQIGKTSHLPAYEELSLRRKFEILTYFDQIRNERSKVPSFRRGDFDTEMEMTPVFDGEELLTYLEADGSPYELKRTLTTVEEKELEKIGQAIRIENQEKLTQLGIDLSQFDPDRVGILLDAAGRFRLKNADLALLGGYPKASVTQLALATELLQMGLSHEKVEFFFGSQLSIEELRQVAYAFLYQELSREDAEQFEKDKGNQPDLTLRDWKSKLEKAEGKEVVDEEFAENPLVQRVLDTYPLGSLVSYKGQDFEVMSVSDARLNGLIRIELVNDFSDIIEQNPVLYVRTWEEVSQALHQPKAEPQTELEEADQELNLFSFLEEEPVQSIGLLEPDDSENGHNDTDLEETDNQIPEEEVVETIPEIPVTDFYFPEDLTDFYPKTARDKVETNIVAIRLVKNLEVEHRNASPSEQELLAKYVGWGGLANEFFDDYNPKFSKEREELKSLVTDKEYSDMKQSSLTAYYTDPSLIRQMWDKLERDGFTGGKILDPSMGTGNFFAAMPKHLREKSELYGVELDTITGAIAKHLHPNSHIEIKGFETVAFNDNSFDLVISNVPFANIRIADNRYDRPYMIHDYFVKKSLDLLHDGGQVAIISSTGTMDKRTENILQDIRETTEFLGGVRLPDSAFKAIAGTSVTTDMLFFQKHLDKGYVADDLAFSGSIRYDKDSRIWLNPYFDGEYNSQVLGTYEVRNFNGGTLSVKGTSDDLIASVETALNHVKAPREIDRNEVIINPDVLTKQVNDTSIPAEMRENLGQYSFGYQGSTVYYRDNKGIRVGTKTEEISYYVDEEGNFKAWDTKHSQKQIDRFNALEVTDNTALDVYVTDDAAKRGQFKGYYKKTVFYEAPLSYKEVARIKGMVDIRNAYQEVIAIQRYYDYDKETFNHLLGKLNRTYDSFVKHYGYLNSAVNRNLFDSDDKYSLLASLEDESLDPSGKSVIYTKSLAFEKALVRPEKEVKKVHTALDALNSSLADGRGVDFAYMMSIYQVESQMTLIEELGDLIMPDPEKYLNGELTYVSRQDFLSGDVVTKLEVVDLFVKQDNQDFNWSHYAGLLEAIKPARITLADIDYRIGSRWIPLAVYGKFAQETFMGKAYELSDQEVATVLEVSPIDGVITYQSKFAYTYSNATDRSLGVPASRYDSGRKIFENLLNSNQPTITKQVVEGDKKKNVTDVEKTTVLRAKETHLQELFQGFVAKYPEVQQMIEDTYNRLYNRTVSKSYDGSHLTIDGLAQNISLRPHQKNAIQRIVEEKRALLAHEVGSGKTLTMLGAGFKLKELGMVHKPLYVVPSSLTAQFGQEIMKFFPTKKVYVTTKKDFAKAKRKQFVSRIITGDYDAIVIGDSQFEKIPMSREKQVTYINDKLEQLREIKLGSDSDYTVKEAERSIKGLEHQLEELQKLERDTFIEFENLGIDFLFVDEAHHFKNIRPITGLGNVAGITNTTSKKNVDMEMKVRQVQAEHGDRNVVFATGTPVSNSISELFTMMDYIQPDVLERYLVSNFDSWVGAFGNIENSMELAPTGDKYQPKKRFKKFVNLPELMRIYKETADIQTSDMLDLPVPEAKIIAVESELTQAQKYYLEELVKRSDAIKSGSVDPSRDNMLKITGEARKLAIDMRLIDPTYSLSDNQKILQVVDNVERIYRDGAGDKATQMIFSDIGTPKSKEEGFDVYNELKDLFVDRGIPKEEIAFVHDANTDEKKNSLSRKVNSGEVRILMASTEKGGTGLNVQSRMKAVHYLDVPWRPSDIVQRNGRLIRQGNMHQEVDIYHYITKGSFDNYLWQTQENKLKYITQIMTSKDPVRSAEDIDEQTMTASDFKALATGNPYLKLKMELENELTVLENQKRAFNRSKDEYRHTISYSEKHLPIMEKRLSQYDKDIAQSLATKSQDFVMRFDNQAMDNRAEAGDYLRKLITYNRSETKEVRTLASFRGFDLKMTTRGASEPLPETISLMIVGDNQYTVALDLKSDVGTIQRISNAIDHIIDDQEKTQELVKDLKDKLRVAKVEVDKVFPKEEDYQLVKAKYDVLAPLVEKEAEIEEIDAALAKFSEDTTPQKKQQIALEI

SEQ ID NO: 5857 - DNA, 549 bp, Streptococcus agalactiae
atgacttggaactttgacaccatgaaagaggctttgtctgaaatggagaaggtcgattaccaagagtttatcaaggcttttctctctttggaattaagtatttctaatagaacaatcctcaatcaggtttatcaagattatatggatgaggatgacctatccttgataagtgatgagctacgagttaaagttgatagttatcaggatgaagtacaggcagatatgactgacattctggaaaagctgtaccgaacaggtgaaggctctaattttattatggatttaatgtcctcaaatagtctctcagaaaccttggaacagtatgaggttttggatagtgacgattattcaccacttagccttgaaaccttacaggccatgatccaacaggacttggctatttccagtcaggattattttggagatttggttcaccttgccttgcaaaaagatttactagaccagaaaagtcatttcttacaacactatgtggcaattgtaatggaaggtattccacaagaaagagaccaacgaaccttggtcctagat

SEQ ID NO: 5858 - protein, 183 aa, Streptococcus agalactiae
MTWNFDTMKEALSEMEKVDYQEFIKAFLSLELSISNRTILNQVYQDYMDEDDLSLISDELRVKVDSYQDEVQADMTDILEKLYRTGEGSNFIMDLMSSNSLSETLEQYEVLDSDDYSPLSLETLQAMIQQDLAISSQDYFGDLVHLALQKDLLDQKSHFLQHYVAIVMEGIPQERDQRTLVLD

SEQ ID NO: 5859 - DNA, 189 bp, Streptococcus agalactiae
atgaatccaaaaactatttatgaaaaggattcagaccaggatggtctgacagatgctcaggaactagctttgggaaccgatccgcagtctgttgacacagatggtgatggtcaagctgatttagaggagctacaatctggacattcaccattagtcccacaaaaggagttgtacaatgacttggaactt

SEQ ID NO: 5860 - protein, 63 aa, Streptococcus agalactiae
MNPKTIYEKDSDQDGLTDAQELALGTDPQSVDTDGDGQADLEELQSGHSPLVPQKELYNDLEL

SEQ ID NO: 5861 - DNA, 4893 bp, Streptococcus agalactiae
atgaccaaaacatgtaatcatcactttcttgtcaatcaggaaaaaggcgagaaacacgtctttcgcaagagtaaaaaatatcgcactctatgttccgttgcccttggaaccatggtgacggctgttgttgcttggggaggaacggttgcacatgccgatgaagttacaacttcagttgacaccaccattcaacgaacggagaatccagccacaaatttaccagaagcacaaccaaaccctgtatctgaacaaactgaaagtatggcatcaactggacaatctaacggtgcgattgctgttaccgtaccacatgatacggtaacacaagcagttgaagaagcaaaggctgaaggtgtttctacggttgaagatagtccaatggatttaggaaatacaagatctgcggtagaaaccaaccaacaaatttcaaaagcagatgcagatacccaaaaacaggttgagactattaatgaagtcactaaaacctacaaagctgataaagcgacatacgaatcgaataaagctcgcatcgaacaggaaaataaggagctgtcacaggcctacgagggggccaaccaaactggtaaagagacaaatgcttgggttgatactaaagtcaatgacctaaaagctcggtatgcagatgctgatgtgacagtaaaagaacaagtagtttcatcaggaaatgggacatctgtccttgactatacaaactatggcaaggctgttgaaaccattcaatcaactaacgaacaagctgtagcggattatctaacaaagaaaacaaaggcagatgatattgttgcgaaaaatcaggccattcaaaaagaaaatgaagctggacttgctaatgcaaaggcagataatgaagccattgaaaggcgtaatcaggctggtcaagcagctgttgatgctgaaaaccgtgcaggtcaagccgcagtagatcaagctaatcaggagaaacaacaattagtttcagatcgtgcagccgagattgaagctattacaaaacgtaataaagaaaaagaagccgcagccagaaaagagaatgaagcgattgatgcctataataccaaagaaatggaacgctatcaacgtgacttggccgagatttcaaaaggtgaagaaggttatatttctgaagcccttgctcaagccctcaatctcaacaacggtgaaccccaagcacaacatggggccattacccgaaatcctgatcagatcatttcaactggcgatgctttgctgggaggctactcaagaatattggattcaacaggattctttgtctatgacatgttcaaaacaggtgagactcttagttttaactatcaaaatcttcaacatgcacgatttgatggtaaaaagattagtcgtgtgacttacgatattaccaaccttgtatcaccagctggaaccaatgccgtgaaattggttgtgccaaatgatccaaccgagggttttattgcctatcgaaatgacggaaacggtgactggcgaacagacaagatggagtttcgtgtagttgccaagtattacttggaagacggttcacaagttaccttctccaaagaaaagccaggagtcttcacacactcttccctcaatcataatgacattggtttagaatatgtcaaagattcatctgggaaatttgtgccgattaatggttcaactgttcaagtgactaatgaaggtctagcacgttctttgggttccaaccgtgcaagtgatttgaatttacctgaggaatgggataccacatcaagtcgttatgcttataaaggagctattgtctcaacagttacatcaggtaatacctacacagtaacctttggccaaggcgatatgccacagaatgttggcttgtcatactggttcgccttaaataccctaccagtggcacgtacagtaacaccatatagtcccaaacctcatgtaacggtggaacttgaacccattccagaacctattacggtaacaccagatatctatacaccaaaaacatttacaccagaaaagcctgtaactttcacaccaaagcctttggatgaagtagtgcagcctagtctaactttgaccaaggtaaccttgcctgtcaaacctattccaaaagaacttccaacgccaccacaagtaccaactgtccattatcatgcgtaccgtttgacgacaacttcagagattatgaaagaagtggtcaatagtgaccaagctaatcttcatgagaaaactgtcgcaaaagattcaacggtgatttatcccttaacagttgatgccttatcgcccaatcgtgcccaaacgactagtctcatttttgaggactacttgcctgctggttacctatttgataaggaaacaacacaaaaagagaatggaaactatgtccttagctttgatgagactaagaattttgtgaccttaaccgcaaaggaaaacttgttgcaggaggtaaataaagatttaactcaggtttatcaattgaccgccccaaaactctatggttctgttcaaaatgatggggcaacctattccaatagttacaaactccttttgaacaagggtacaaccaatgcttacacagtcacttcaaatgttgtaacggttcgtacaccaggtgatggggagacaaccacgctcattacaccagataaaaacaatgaaaatgcggatggtgtcctcattaatgacacggtcgtagcccttggtacaaccaaccactatcgtttgacttgggatttggaccagtataagggagatcgttctgctaaagagacaattgcacgaggcttcttctttgtggacgattacccagaggaagtgcttgatgtggtggaaaatggcacggctatcacaacccttgacggtcagaaggtatcaggaattacagttaaaaactatgcttccctaaatgaagcccctaaagaccttcaagataaattggctcgtgctaagattacaccgacaggtgcctttcaagtctttatgccggatgacaaccaagccttttatgaccagtatgttcaaacaggaacttctttagctcttttgaccaaaatgacggttaaagatagtctctatggtcagacaaagacctatacaaacaaggcttatcaagttgatttcggcaatggctatgaaaccaaggaagtgaccaacacccttgtttcaccagaacccaagaaacaaaacctaaacaaggataaagtggatatcaacgggaagcccatgctagtgggaactcaaaatcactatactctttcatgggacttggaccaataccgagggattaaagcagacaactctcagattgcacaaggtttttactttgtggatgattatccagaagaagctttattgccagatgaagcagctattcagtttgtcacatctgatggcaaaacagtttcaggaatcacggtgaagtcttattctcaattattagaagctcctaaaacgctacaagcagccttttccaaacaaaaaattcagcctaaaggagcttttcaagttttcatgcctgaggacccacaagccttttttgaatcttatgtgaccaagggggagaatattaccattgtcactccaatgacggttttggaaaccatgcttaattcagggaagtcttatgaaaacgtggcttatcaggtggactttgggcaagcctatgaaaccaatacggtgaccaattttgtccctaaagtaactccacataagtctaataccaatcaagaaggtatttcaattgatggaaagactgttcttccgaatacggtcaattattacaaaattgtcttggattacagtcaatacaaggatatggtcgtgacggatgatgttcttgccaagggattttacatggtagacgattacccagaagaagcccttaccctaaatcctgatggcattcaagttttggataaggatggcaatcgtgtatctggtatctctgtcagcacctacgctagtttgtcagaagctccgaaagttgttcaagatgccatggctaaacgtcagtttacacctaaaggagccattcaagttcttagtagcgatgatccaaaagtcttttatgatacctatgtgaagactggtcaaaccttagttgtcacgcttccgatgacggtaaaaaatgagttgaccaaaacaggtggtcagtatgaaaatacagcctatcaaattgattttggcttggcctatgtcacggaaacagtggttaataatgttccaaaattagacccacaaaaagatgtggtgatcgacttgtctcataaagatgccagccttgacgggaaagaagtggccttgcatcaaacctttaactatcgcttggttggagcgatgattccaagcaatcgtgcgactgatttatttgaatatggttttgaagataactatgatgaaaagcatgatgagtataatggtgtttatcgcagctatctgatgacggatgtcatcctcaaagacggttctgtcttaaaagaggggacagaagtcacgaaatacaccttgcaacaggtagatacagaaaatggcctcgtgtcaatttcatttgataaatccttcttagagactgtctctgatgattcagcctttcaggcagatgtttaccttcaaatgaaacggattgcggctggtcaggtggagaatacctatctccatacagtgaatggctatgtcattagctcaaatacagttgtaacacatacacctcaacctgaagaaccaagtccaaatcaacccactccacctcaaccaccaattgagactattgaaccgcctgttccagcaagtattttgccaaatacaggggaacaggaatcccttttgggcttgattggagctggtattctacttggtacggcttatggactgaagaaaaaggaggagaag

SEQ ID NO: 5862 - protein, 1631 aa, Streptococcus agalactiae
MTKTCNHHFLVNQEKGEKHVFRKSKKYRTLCSVALGTMVTAVVAWGGTVAHADEVTTSVDTTIQRTENPATNLPEAQPNPVSEQTESMASTGQSNGAIAVTVPHDTVTQAVEEAKAEGVSTVEDSPMDLGNTRSAVETNQQISKADADTQKQVETINEVTKTYKADKATYESNKARIEQENKELSQAYEGANQTGKETNAWVDTKVNDLKARYADADVTVKEQVVSSGNGTSVLDYTNYGKAVETIQSTNEQAVADYLTKKTKADDIVAKNQAIQKENEAGLANAKADNEAIERRNQAGQAAVDAENRAGQAAVDQANQEKQQLVSDRAAEIEAITKRNKEKEAAARKENEAIDAYNTKEMERYQRDLAEISKGEEGYISEALAQALNLNNGEPQAQHGAITRNPDQIISTGDALLGGYSRILDSTGFFVYDMFKTGETLSFNYQNLQHARFDGKKISRVTYDITNLVSPAGTNAVKLVVPNDPTEGFIAYRNDGNGDWRTDKMEFRVVAKYYLEDGSQVTFSKEKPGVFTHSSLNHNDIGLEYVKDSSGKFVPINGSTVQVTNEGLARSLGSNRASDLNLPEEWDTTSSRYAYKGAIVSTVTSGNTYTVTFGQGDMPQNVGLSYWFALNTLPVARTVTPYSPKPHVTVELEPIPEPITVTPDIYTPKTFTPEKPVTFTPKPLDEVVQPSLTLTKVTLPVKPIPKELPTPPQVPTVHYHAYRLTTTSEIMKEVVNSDQANLHEKTVAKDSTVIYPLTVDALSPNRAQTTSLIFEDYLPAGYLFDKETTQKENGNYVLSFDETKNFVTLTAKENLLQEVNKDLTQVYQLTAPKLYGSVQNDGATYSNSYKLLLNKGTTNAYTVTSNVVTVRTPGDGETTTLITPDKNNENADGVLINDTVVALGTTNHYRLTWDLDQYKGDRSAKETIARGFFFVDDYPEEVLDVVENGTAITTLDGQKVSGITVKNYASLNEAPKDLQDKLARAKITPTGAFQVFMPDDNQAFYDQYVQTGTSLALLTKMTVKDSLYGQTKTYTNKAYQVDFGNGYETKEVTNTLVSPEPKKQNLNKDKVDINGKPMLVGTQNHYTLSWDLDQYRGIKADNSQIAQGFYFVDDYPEEALLPDEAAIQFVTSDGKTVSGITVKSYSQLLEAPKTLQAAFSKQKIQPKGAFQVFMPEDPQAFFESYVTKGENITIVTPMTVLETMLNSGKSYENVAYQVDFGQAYETNTVTNFVPKVTPHKSNTNQEGISIDGKTVLPNTVNYYKIVLDYSQYKDMVVTDDVLAKGFYMVDDYPEEALTLNPDGIQVLDKDGNRVSGISVSTYASLSEAPKVVQDAMAKRQFTPKGAIQVLSSDDPKVFYDTYVKTGQTLVVTLPMTVKNELTKTGGQYENTAYQIDFGLAYVTETVVNNVPKLDPQKDVVIDLSHKDASLDGKEVALHQTFNYRLVGAMIPSNRATDLFEYGFEDNYDEKHDEYNGVYRSYLMTDVILKDGSVLKEGTEVTKYTLQQVDTENGLVSISFDKSFLETVSDDSAFQADVYLQMKRIAAGQVENTYLHTVNGYVISSNTVVTHTPQPEEPSPNQPTPPQPPIETIEPPVPASILPNTGEQESLLGLIGAGILLGTAYGLKKKEEK

SEQ ID NO: 5863 - DNA, 600 bp, Streptococcus agalactiae
gtggggggccgtatgtcaaaaaaagagattctactcgattttatagaaaagaacaatggcattgtcacaaacaaagattgtaaagcactaggtattccaacaatatatctgacaagactagagaaagaaggcattatcttccgagttgaaaaaggtattttcctaacccaaaacggagactatgatgaatactacttctttcaatatcgttttcctaaggctattttctcttatatttcggcactgtatctacaacagtttacagatgaaattccacaatattttgatgtgacagttcctagaggctaccgctttaatactcctccagctaatctaaacattcactttgtctctaaagaatacagcgagctgggaatgactactgtacctactcctatgggaaacaacgtaagggtatatgattttgaacgtattatttgtgattttgtaatacatcgagaaaagattgattccgaactctttgtcaagacacttcaatcttatgggaactatcctaaaaaaaatctagcaaaactctatgaatatgcgacaaaaatgaatactttagaaaaagttaaacaaactctggaggttctaata

SEQ ID NO: 5864 - protein, 200 aa, Streptococcus agalactiae
MGGRMSKKEILLDFIEKNNGIVTNKDCKALGIPTIYLTRLEKEGIIFRVEKGIFLTQNGDYDEYYFFQYRFPKAIFSYISALYLQQFTDEIPQYFDVTVPRGYRFNTPPANLNIHFVSKEYSELGMTTVPTPMGNNVRVYDFERIICDFVIHREKIDSELFVKTLQSYGNYPKKNLAKLYEYATKMNTLEKVKQTLEVLI

SEQ ID NO: 5865 - DNA, 843 bp, Streptococcus agalactiae
atgaacaaagctaaattaacagcactctgtcataaaatatcaaagaatactggtttaacctttaattccgtgatgacctattacttcctagaagtcattttgaaaaaattaagtcaaagttcttattcaaatcactatatcttcaaaggaggattcctactgtcgaatgtcatcggagttgaatctcgtagcactgttgatattgactttttattccatcaaataacactctcagaagaaactgttaaacagcaactcaaggaaattttagcagattccgaagaaggtatatcttttgtgattcaatcaatcacaactattaaagaaagtgatgactatggtggctatcgagcaacaatttcgtgccaacttgagaatattaaacaagttatccatttggatattgcgacaggtgatgttgtaactcctcagccgataacatacgactataaagctatttttgatgaagacaattttccaatcattgcttatacaattgaaacaattctagctgaaaaactccaaaccatctattcacgaaacttcttgaacagcagaagcaaagacttttacgatgtttatattctttcaaaattgaagaaaaaagatattgatttcaatcagttaaaaaatgcttgccaaagaactttttcctatcgcgaaactgagctcgatttcgaaaaaattattgaactactcgagagattcaaatctgatcctactcagaatcaacaatggcaaaattattcaaaaaaatatagttatacaaaaggaatttcacttgcaaatgtgcttgatgagatgattagtcttattacaattattatttctactgactctgat

SEQ ID NO: 5866 - protein, 281 aa, Streptococcus agalactiae
MNKAKLTALCHKISKNTGLTFNSVMTYYFLEVILKKLSQSSYSNHYIFKGGFLLSNVIGVESRSTVDIDFLFHQITLSEETVKQQLKEILADSEEGISFVIQSITTIKESDDYGGYRATISCQLENIKQVIHLDIATGDVVTPQPITYDYKAIFDEDNFPIIAYTIETILAEKLQTIYSRNFLNSRSKDFYDVYILSKLKKKDIDFNQLKNACQRTFSYRETELDFEKIIELLERFKSDPTQNQQWQNYSKKYSYTKGISLANVLDEMISLITIIISTDSD

SEQ ID NO: 5867 - DNA, 105 bp, Streptococcus agalactiae
atgccaaacaaggttagtttagtcttattcactcccttaccagatgtcaaaacaacgttctctccatcaagagataccttgccatccatcggagctacaatgact

SEQ ID NO: 5868 - protein, 35 aa, Streptococcus agalactiae
MPNKVSLVLFTPLPDVKTTFSPSRDTLPSIGATMT

SEQ ID NO: 5869 - DNA, 174 bp, Streptococcus agalactiae
atgacactactacctgaaacactcatgaaaaagctcatcatcaaaaggagtatcaagagaatgcctgagacaatccaagtcaaaggatttcccgcaaggacagaaaagaaagtcatacttcccttaatggcttggacgattcctttaaaacctgcgacactttgttttctgaca

SEQ ID NO: 5870 - protein, 58 aa, Streptococcus agalactiae
MTLLPETLMKKLIIKRSIKRMPETIQVKGFPARTEKKVILPLMAWTIPLKPATLCFLT

SEQ ID NO: 5871 - DNA, 2799 bp, Streptococcus agalactiae
atgaaagaggataaaaagctagtcaaacaggctaggcaaaactttcgaagcaacttaaaatcagctcgtatgcattatcggaaagaagttaggaccttaaaacagactgttcctaaaaaaggaagatttcgaaaatcagccaaaaattctctgtttcaggaaaagaaaacagagttaaaaggaaatctactcagtagccaaaaggaagcagaagagaagttcataaaggaaattacctatgtttctcctagactgttgaaggcaaaggaaatcaagaactatcgacttccgcaagctcaagaacgtttgcggacggcaagaaaacatctgtcagaagtgaaactaagtgagaaacagcaggtagttaatcccaagtttactttccaaaaagaaaatccttccctgaagtctcgctttcagtttcaccaagaaaaatcatttgatcggctaagtgcagaaaaagacgtaagttctgccaagcgtgaggttaaacaactcaagaaagtccaaaagactaagaaaaactctaccaaagtcaaagctggattaggcttggctgcatctgaatcccttgacctgatagcacaggaggatgatttagatggtctaagaaccatgaaggatactagtttgaaagccagacgctatggcaggtttacttatcaagcaggtaaggtggcagtaaaaagtggacagactggtgtgcggtttaccaaaacaaaattttctcatggaaaggaacgattccagaacttcaaaaagggaaaaggattcacacgccagaaacctcttaaaccaagaagacgctaccaaacctttttaaatcatgtcagaaaacaaagtgtcgcaggttttaaaggaatcgtccaagccattaagggaagtatgactttcttttctgtccttgcgggaaatcctttgacttggattgtctcaggcattctcttgatactccttttgatgatgagctttttcatgagtgtttcaggtagtagtgtcatacaacaagatgaaatagaattgagtaagagttatacccacatgacgtgggaagatgcggaacatacaagaaccaacgataagggaattaccttttacactaagattgatgaggtcatggtttacatgaatcatcaataccaagactacaagttagatgatttcatagagacaagcggaacaacctacaaagaatttctcagtcaactgtggtcggacttaaacggtggagattctattaaatccatgtctgacttatataaagaacctgcttacaagctgtctgatgaggaccaagaagaactaaacgaattgaccgaagaaggcaactatttagcccttcaagaattggacaatccctttcagggacagaccgatgaggatagtttaagcatgacctaccgatatggttatgaggtcattgatgagaaaccaacgcttcatcatcatatcatcttagaagcaaaagaaggtcaagtcattgtagctccgatggatggcaaggtatctcttgatggagagaacgttgttttgacatctggtaagggagtgaataagactaaactaaccttgtttggcattcattcaggccgagtgagtgaaaatcaacaagtcttggcaggagatattattggtcagaccaaagacggaacgggtctaaaagtcacctatcaaaaggttgatgatgacacggataagttggtctatgtcaatccagcattctactttccaaaagtgattcaggttcagaccaccattcttccaactatcggtcagtttggcggcgatgagttcgagagagccaaggcaatttatgactatcttaaaagcaaaggtgcgaccaatcaagctatcgcagccattctaggtaactggtcggtagaatcctccattaatccaaaacgagctgaaggcgactatttatctccacctgttggtgcgacagatagttcgtgggatgatgagggctggctcacacttaatggtccaactatatacaatggacgttacccaaatattctcaaacgtggtttaggcttaggccaatggacagataccgcggatggttcacgcagacatactttattgttggaatatgccaaaggaaaacatcaaaaatggtatgacttaggcttacaactggatttcatgttgtatggggatagtccttattacaccaactggttaaaggacttcttcaaaaattcaggcagtccagctagtcttgcccagctctttctcatttactgggaaggaaatagtggtgataagctacttgaacgtcaaacacgagccagtgagtggtattaccaaattgaaaaaggctttagtcaacctaacggtgggacagcacaaagcgatccaaaagcacttgaagctgtacgagaagacctttttgaaaactctattccaggaggtggtgacggtatgggttacgcttacggccaatgtacttggggagtcgcagcccgtatcaatcaactgggtctaaaactcaaaggtaaaaacggtgagaagattccaattatcagtaccatgggcaatggccaagattgggtacgaacagccgcaagtctcggtggagagacagggacaagtccacaagaaggagctatcctttcctttgcgggaggaggacatggcaccccaacagaatacggacatgtggcttttgtggagaaagtctacccagacggttcattccttatctcagaaaccaactacaatggcaatccaaactataccttccgtaaattatctggagtggatagtagcttgagttttgcttatacgacgaaa

SEQ ID NO: 5872 - protein, 933 aa, Streptococcus agalactiae
MKEDKKLVKQARQNFRSNLKSARMHYRKEVRTLKQTVPKKGRFRKSAKNSLFQEKKTELKGNLLSSQKEAEEKFIKEITYVSPRLLKAKEIKNYRLPQAQERLRTARKHLSEVKLSEKQQVVNPKFTFQKENPSLKSRFQFHQEKSFDRLSAEKDVSSAKREVKQLKKVQKTKKNSTKVKAGLGLAASESLDLIAQEDDLDGLRTMKDTSLKARRYGRFTYQAGKVAVKSGQTGVRFTKTKFSHGKERFQNFKKGKGFTRQKPLKPRRRYQTFLNHVRKQSVAGFKGIVQAIKGSMTFFSVLAGNPLTWIVSGILLILLLMMSFFMSVSGSSVIQQDEIELSKSYTHMTWEDAEHTRTNDKGITFYTKIDEVMVYMNHQYQDYKLDDFIETSGTTYKEFLSQLWSDLNGGDSIKSMSDLYKEPAYKLSDEDQEELNELTEEGNYLALQELDNPFQGQTDEDSLSMTYRYGYEVIDEKPTLHHHIILEAKEGQVIVAPMDGKVSLDGENVVLTSGKGVNKTKLTLFGIHSGRVSENQQVLAGDIIGQTKDGTGLKVTYQKVDDDTDKLVYVNPAFYFPKVIQVQTTILPTIGQFGGDEFERAKAIYDYLKSKGATNQAIAAILGNWSVESSINPKRAEGDYLSPPVGATDSSWDDEGWLTLNGPTIYNGRYPNILKRGLGLGQWTDTADGSRRHTLLLEYAKGKHQKWYDLGLQLDFMLYGDSPYYTNWLKDFFKNSGSPASLAQLFLIYWEGNSGDKLLERQTRASEWYYQIEKGFSQPNGGTAQSDPKALEAVREDLFENSIPGGGDGMGYAYGQCTWGVAARINQLGLKLKGKNGEKIPIISTMGNGQDWVRTAASLGGETGTSPQEGAILSFAGGGHGTPTEYGHVAFVEKVYPDGSFLISETNYNGNPNYTFRKLSGVDSSLSFAYTTK

SEQ ID NO: 5873 - DNA, 2349 bp, Streptococcus agalactiae
gtgaaaaaattaaaacactcaatgaaatcaaagacctcttctaatgacaaaaagcaaaagacgaaaacacagaaacaggaaatcagcccttctaccgtaaatacgttagcctatcaaggactttttcagaatggccttatgcaggtcagtccaagctatttctcacaaacctatctcttaggagatgttaattaccaaacagttggcttagatgataagggagctatcgtggagaaatattccgatttaatcaattcactggatgataagaccaatttccaactgactattttcaatcaaaaagttaatttggaaaaatttcgtaagagtattctctatcccttgcaggaagatgggtttgatacttatcgtgatgaattgaatcgcatgatggatgccaacttagaggcgggtgagaacaacttttcagctgtcaagtttctttcatttggcaagagcgaccaaacaccaaaactagcttttcgttctctgtcacagattggggaatatttcaagagtggcttttcagagattgatgtatctcttggtttacttggtggagaggagcgagtgaatgtccttgcggatatgttacgaggtgaaaatcatttaccgttttcttataaggatttgactctctcaggtcaatccaccaaacactttattgccccaacctacctttcctttaaacacaagaatcatattgaattggacgatcgattattacagattgtttatgttcgcgactatggcatggagttaggggataaatttattcgagacctcatgcagtcagatttggaagtgatgattagcctacatgccaaaggctctactaagtctgaaaccatgaccaagctacgaaccaagaagaccttgatggaatcacaaaagattggtgaacaacaaaaaatggctcggactggaatctatttggagaaggtcggccatgttcttgagaacaacatcgatgaagctgaagctcttcttcaaaccatgacccaaacaggagataaactgtttgacaccgtatttctaattggcgtgctagcggatactgaagaccaactcaaacaatctcttgatattatcaagcaagtggcagggtctaatgatatgattattgataacttgacctatatgcaagaagctgcctttaatagtctcttgccatttgggaagaactatctcgaaggtgtttctcggtctctattgacttcaaatattgccgtgaatgcaccttggacttccgtagatattcatgacaagggtgggaaattttatggcatcaatcaaatctcaagtaatatcatcagtattgaccgtggcaagttaaatactccatcaggtttgattttagggacttctggagctggcaaagggatggcgacaaaacacgaaatcatctcaactaagctcaaggaagcagatagtgatactgaaattattattgttgacccagaaaatgagtacagtattatcggtcaagcctttggtggggagagtattgatattgccccagactctaccaccttcttaaatgtcttagaactatctgatgagaatatggatgaggacccagttaaggtcaaatccgaatttctcttgtcttggattggaaagctcttggaccgcaaaatggatggtcgtgaaaaatccttgatagatcgtgtgacacgcttgacatataagcattttgacacaccgtccttggtcgaatgggtctttgtcttatctcaacaacctgaacaggaagctaaggacttggcactggatatggaactctatgtggaagggtcgctggacatattttcacatcggaccaatattaaaacagacagtcatttcctgatttacaatgtcaaaaagctaggcgatgagttaaaacaaattgccctcatggttatctttgaccaaatttggaatcgggtggtcaaaaaccaaaagctagggaagaagacctggatttactttgatgaaatgcagctactcttattggacaagtatgcctctgatttctttttcaaactttggagtcgtgtccgtaagtatggggcgataccgacaggtattactcagaatgtagaaacgcttcttttggatgccaatggcagacgcattattgccaatagcgagttcatgattcttttaaaacaggctaagagcgatcgcgaagaattggtgcatatgcttgggctttctaaagagctggagaagtacttggtcaatcctgaaaaaggggcaggcttaattaaggccggttccaccgttgttccgttcaagaataagattccgcaacacaccaagctctttgacatcatgagtacggaccctgaaaaaatgaggaca

SEQ ID NO: 5874 - protein, 783 aa, Streptococcus agalactiae
MKKLKHSMKSKTSSNDKKQKTKTQKQEISPSTVNTLAYQGLFQNGLMQVSPSYFSQTYLLGDVNYQTVGLDDKGAIVEKYSDLINSLDDKTNFQLTIFNQKVNLEKFRKSILYPLQEDGFDTYRDELNRMMDANLEAGENNFSAVKFLSFGKSDQTPKLAFRSLSQIGEYFKSGFSEIDVSLGLLGGEERVNVLADMLRGENHLPFSYKDLTLSGQSTKHFIAPTYLSFKHKNHIELDDRLLQIVYVRDYGMELGDKFIRDLMQSDLEVMISLHAKGSTKSETMTKLRTKKTLMESQKIGEQQKMARTGIYLEKVGHVLENNIDEAEALLQTMTQTGDKLFDTVFLIGVLADTEDQLKQSLDIIKQVAGSNDMIIDNLTYMQEAAFNSLLPFGKNYLEGVSRSLLTSNIAVNAPWTSVDIHDKGGKFYGINQISSNIISIDRGKLNTPSGLILGTSGAGKGMATKHEIISTKLKEADSDTEIIIVDPENEYSIIGQAFGGESIDIAPDSTTFLNVLELSDENMDEDPVKVKSEFLLSWIGKLLDRKMDGREKSLIDRVTRLTYKHFDTPSLVEWVFVLSQQPEQEAKDLALDMELYVEGSLDIFSHRTNIKTDSHFLIYNVKKLGDELKQIALMVIFDQIWNRVVKNQKLGKKTWIYFDEMQLLLLDKYASDFFFKLWSRVRKYGAIPTGITQNVETLLLDANGRRIIANSEFMILLKQAKSDREELVHMLGLSKELEKYLVNPEKGAGLIKAGSTVVPFKNKIPQHTKLFDIMSTDPEKMRT

SEQ ID NO: 5875 - DNA, 141 bp, Streptococcus agalactiae
atgattaacaatatggcctgtaccaagccaccaaacataatggcgagtgattccatcactccagctccatttgatacggcaatctttccagccgattcaaacaagggaacaagagatacaattagaaaaatcaaaatacct

SEQ ID NO: 5876 - protein, 47 aa, Streptococcus agalactiae
MINNMACTKPPNIMASDSITPAPFDTAIFPADSNKGTRDTIRKIKIP

SEQ ID NO: 5877 - DNA, 234 bp, Streptococcus agalactiae
ttgaacggcatagaccatgatgtttttaaggtaaccaatcccaacacttctccagtcatcactaaggaaggtcggaatggtaacaggggcaaaaggaatcatcagatagagttggataaagcgaatggtaatcaagatattgacaaccataatactggccattcgtaccaaccaaatgagaatcgcaaaaaagccaataatcatttttcctacaattccagatcccttaatgcc

SEQ ID NO: 5878 - protein, 78 aa, Streptococcus agalactiae
MNGIDHDVFKVTNPNTSPVITKEGRNGNRGKRNHQIELDKANGNQDIDNHNTGHSYQPNENRKKANNHFSYNSRSLNA

SEQ ID NO: 5879 - DNA, 852 bp, Streptococcus agalactiae
atgatgatgaattttacgtcaccttttgtatttctagcctctgaaaaagtgtcaagcgatagcctttttgaagggtttcaggtcgatttagaatcaactgctaacttggttaagtcactggcggactttaatccgacggtttggtcttacatgacagccattaccaagggtattatgcagcccttgggagtagctattcttgcggtagttcttgtactcgaattttcaaaaatggccaagaaaatcgcaaactcaggcggtgcaatgacctttgaagccatagcacctatgattgtcagctacatcatggtcgcggtcgtgattaccaatacgacggttattgtggaagccattattgccattgcctcatatgttattgaacaagtggcaagtcttgtcacgaatggtggtgctaattatgataccatctcaggcattaagggatctggaattgtaggaaaaatgattattggcttttttgcgattctcatttggttggtacgaatggccagtattatggttgtcaatatcttgattaccattcgctttatccaactctatctgatgattccttttgcccctgttaccattccgaccttccttagtgatgactggagaagtgttgggattggttaccttaaaaacatcatggtctatgccgttcaaggtattttgatttttctaattgtatctcttgttcccttgtttgaatcggctggaaagattgccgtatcaaatggagctggagtgatggaatcactcgccattatgtttggtggcttggtacaggccatattgttaatcattgccttggttggcagtcaacgaaccgcccgaagtattttggggatg

SEQ ID NO: 5880 - protein, 284 aa, Streptococcus agalactiae
MMMNFTSPFVFLASEKVSSDSLFEGFQVDLESTANLVKSLADFNPTVWSYMTAITKGIMQPLGVAILAVVLVLEFSKMAKKIANSGGAMTFEAIAPMIVSYIMVAVVITNTTVIVEAIIAIASYVIEQVASLVTNGGANYDTISGIKGSGIVGKMIIGFFAILIWLVRMASIMVVNILITIRFIQLYLMIPFAPVTIPTFLSDDWRSVGIGYLKNIMVYAVQGILIFLIVSLVPLFESAGKIAVSNGAGVMESLAIMFGGLVQAILLIIALVGSQRTARSILGM

SEQ ID NO: 5881 - DNA, 252 bp, Streptococcus agalactiae
atgaggaaaaatatgaatcaaaaactaacaggctttgtttacggagtggacgccagctccatgttctcccaggccatgtctctattacaaaaaggcttgattgcagtaggagcctttcttgtagtcatgggcattatcaacctttcaaccaacattaaagatggtgggccaggcgtccgaaatgccattttagaaattgttggtggtgtcatggtgggagccgcaggtgcttttgtgacacagattaccatt

SEQ ID NO: 5882 - protein, 84 aa, Streptococcus agalactiae
MRKNMNQKLTGFVYGVDASSMFSQAMSLLQKGLIAVGAFLVVMGIINLSTNIKDGGPGVRNAILEIVGGVMVGAAGAFVTQITI

SEQ ID NO: 5883 - DNA, 1815 bp, Streptococcus agalactiae
atgtattccaggcaaaaagcatttgtctttggactcttgggtctcgcctttggctatttctgccatcgtctaaccctactctatgatagtttaactaatgccccacctatggaacgtattgcctacctcttaggagaggggttaaatcaggttttcaatcctttatggctattttcctttactcaaaaatcttttcttgcctttatccttggggttctaatgatgacgctagtctatctttatgtatcgacaggacagaaagtctatcgggaaggggaagaatatggttctgcacgatttggaaccagtaaggaaaagcggaacttttacagtaagaatcctttcaatgacacgattttggctcgtgatgttcgtctaaccttgttggaaaagaagaaaccccagtttgaccgaaataaaaatttgattgtcattgggggttctggggcaggtaagacctttcgctttgtgaaacccaaccttatccaacttaactgttccaatattgtcgtagatccgaaagaccatttggctgagaagacaggtaaactctttttagaaaacggttatcaggttaaggttttagacttggttaatatgaccaattcagacggttttaatccctttcgttatgtagaaacagagaatgatttgaaccgtatgttaacggtctattttaataataccaaaggaaatggttctcgcagtgatccgttttgggatgaggcttccatgacattggtgagagctattgcctcttacttggtggatttttacaatcctccaggaagttctaagcaagagcaggaagcaagacgtaagcgtggccgttatccagccttttctgagattgggaaactcatcaaactcttatcaaagggagacaatcaggacaaaagtatacttgaagtcctgtttgaagactatgctaagaaatatggtcatgagaactttaccatgagaaactgggcagattttcaaaactataaggataagaccttggattcggtgattgcggtcacaacagctaaatttgccctctttaatattcaatcggtgattgatttgacgcaaagagacactatggatttgaaaacgtggggcactcaaaagaccatggtctatcttgttattccagacaatgatacgacctttcgtttcctatctgctttatttttctctacggttttctccactttgaccagacaggctgatgttgactttaaagggcaactgcctattcatgttagaagctatctggatgagtttgcgaatgtcggagaaatcccagacttcgctgaacaaacctcaacagtccgctctaggaatatgagtcttgtgcctattctccaaaatatcgctcaactccaaggactttataaggaaaaagaagcttggaaaactatactggggaactgtgacagtctcctctatttgggtgggaatgacgaggaaactttcaaattcatgagtggacttttaggcaaacaaaccgttgatgtcagaagcaccagtcgttcttttgggcagacgggttcaagttctacctctcatcagaaaattgctcgtgacttgatgacggctgatgaagttggaactatgaaacgagatgagtgcctcgtacgcattgcaggggttcctgtttttcgaaccaagaaatattttcctctcaaacataaacattggaagttgctcgctgataaggaaaccgatgaccgttggtggaactatcacatcaatcccttggctaaagaggaagaattggacttgtcagactatcaaataagggatttaagcacagaaacgtcactacat

SEQ ID NO: 5884 - protein, 605 aa, Streptococcus agalactiae
MYSRQKAFVFGLLGLAFGYFCHRLTLLYDSLTNAPPMERIAYLLGEGLNQVFNPLWLFSFTQKSFLAFILGVLMMTLVYLYVSTGQKVYREGEEYGSARFGTSKEKRNFYSKNPFNDTILARDVRLTLLEKKKPQFDRNKNLIVIGGSGAGKTFRFVKPNLIQLNCSNIVVDPKDHLAEKTGKLFLENGYQVKVLDLVNMTNSDGFNPFRYVETENDLNRMLTVYFNNTKGNGSRSDPFWDEASMTLVRAIASYLVDFYNPPGSSKQEQEARRKRGRYPAFSEIGKLIKLLSKGDNQDKSILEVLFEDYAKKYGHENFTMRNWADFQNYKDKTLDSVIAVTTAKFALFNIQSVIDLTQRDTMDLKTWGTQKTMVYLVIPDNDTTFRFLSALFFSTVFSTLTRQADVDFKGQLPIHVRSYLDEFANVGEIPDFAEQTSTVRSRNMSLVPILQNIAQLQGLYKEKEAWKTILGNCDSLLYLGGNDEETFKFMSGLLGKQTVDVRSTSRSFGQTGSSSTSHQKIARDLMTADEVGTMKRDECLVRIAGVPVFRTKKYFPLKHKHWKLLADKETDDRWWNYHINPLAKEEELDLSDYQIRDLSTETSLH

SEQ ID NO: 5885 - DNA, 522 bp, Streptococcus agalactiae
atgtttgatagggaatcgaaaaaagaggaggccactatgtcatctgaacaacaagaacgtcaagcgatgcaatacgtagaaagaagtagtttattgacagtcagaaccctcttaaaactcttagaatggtcggctaggcaagccttagctcaagattcagcttataagattggggttcaaaaaatggaagaactccttcaaagtccttacgccattgaagcgattgatgttagtaaagacatactggataagccaatcgatgtggagaaatttaaggagttgatggagtcagaaaaactgccaatcgcaattagttggcaaaaagactatctctacttttatgccaaggataagaccttgctcgatcatcacttggatgaattgttgaagaaactgatgtctaatccagagaagctagaaggtttaacctttgataaaaccttggaccaagagatagaactggccaaagagaaaattagagtgacagaactttcggcagtaaaaaccaaggaggtgaccttg

SEQ ID NO: 5886 - protein, 174 aa, Streptococcus agalactiae
MFDRESKKEEATMSSEQQERQAMQYVERSSLLTVRTLLKLLEWSARQALAQDSAYKIGVQKMEELLQSPYAIEAIDVSKDILDKPIDVEKFKELMESEKLPIAISWQKDYLYFYAKDKTLLDHHLDELLKKLMSNPEKLEGLTFDKTLDQEIELAKEKIRVTELSAVKTKEVTL

SEQ ID NO: 5887 - DNA, 93 bp, Streptococcus agalactiae
atgaagactgcaaaagcaaccatagccacaaagccaagaagcaaccaacttaggcgattttgtacgcccacaatttttaatggaacagtttta

SEQ ID NO: 5888 - protein, 31 aa, Streptococcus agalactiae
MKTAKATIATKPRSNQLRRFCTPTIFNGTVL

SEQ ID NO: 5889 - DNA, 588 bp, Streptococcus agalactiae
gtgacaatgataaggatagtgttgttttatctagccatacagcttaacggtcttctggtgagtttattcctgaaagagtatctgacaatagagggtatagtcttgctacaattggtcctattaagtgtgacttgcttagagattgcccgtcataaaactgttccattaaaaattgtgggcgtacaaaatcgcctaagttggttgcttcttggctttgtggctatggttgcttttgcagtcttcatcagtttcctatttccagttcagactaggaatcaagcagtattggtacaagtaggaaaacaggttcctcctattatctttttattgtttctggtcaatgcaagtattcttgaagagattgtttacaggcaattgctgtgggaaaaattgacattcccttttgaacaaataggcgtgaccagttttctctttgttctatcccatggacctaatcagttagggagttggctcatctatagctgtcttggcttgaccttggctgttgttcgattgaaaactgattgtatgacggcaatcgccttacatttactttggaatagtttggcttatgtcgtaactttcttg

SEQ ID NO: 5890 - protein, 196 aa, Streptococcus agalactiae
MTMIRIVLFYLAIQLNGLLVSLFLKEYLTIEGIVLLQLVLLSVTCLEIARHKTVPLKIVGVQNRLSWLLLGFVAMVAFAVFISFLFPVQTRNQAVLVQVGKQVPPIIFLLFLVNASILEEIVYRQLLWEKLTFPFEQIGVTSFLFVLSHGPNQLGSWLIYSCLGLTLAVVRLKTDCMTAIALHLLWNSLAYVVTFL

SEQ ID NO: 5891 - DNA, 237 bp, Streptococcus agalactiae
gtgaagatgaatgaacgattttgggacaatttagaaatcattctggctgaaaaagacctcacttgggcagaactagctcgcaaagtattcaacggtcaatatgtttatccaagtgaatttaatcgcctctatcaaaaattacggcattacaaatctaatcgtctgatgccacaaataagatgggttgagcgtattgttctagtcttagatattgattatgaagatttatttaagagg

SEQ ID NO: 5892 - protein, 79 aa, Streptococcus agalactiae
MKMNERFWDNLEIILAEKDLTWAELARKVFNGQYVYPSEFNRLYQKLRHYKSNRLMPQIRWVERIVLVLDIDYEDLFKR

SEQ ID NO: 5893 - DNA, 426 bp, Streptococcus agalactiae
atgaacttactacataagaaaagtatcctagattgtactgaattagaagaacgtattcaccaagctgaaaccaatcagctattacaaaagatactgtcgctccccaattttgattgtgactttgaggtaacttttgaagatgattaccacaaagagatgaatgatcccctattctacgaatccaatcttcatcagatttcggattttatggaaactagggatattaaaaatggtgtagatacactattgacgaaagacaatcacctggcctttcgtgcctttggtgaaaattattctgctaggggaaaggagggcattttaacgactctagtgacggtcaagtgctttggtgaaggacggatgcccattgatatgagtcgctatttctcaactcctgaaccaacagttgaaaatagcctaacccta

SEQ ID NO: 5894 - protein, 142 aa, Streptococcus agalactiae
MNLLHKKSILDCTELEERIHQAETNQLLQKILSLPNFDCDFEVTFEDDYHKEMNDPLFYESNLHQISDFMETRDIKNGVDTLLTKDNHLAFRAFGENYSARGKEGILTTLVTVKCFGEGRMPIDMSRYFSTPEPTVENSLTL

SEQ ID NO: 5895 - DNA, 1353 bp, Streptococcus agalactiae
atgaaatttttagatttatttgctgggataggcggttttaggctagggatggaatcacagggtcataaatgcctgggcttttgtgaaattgataaattcgctagaacatcttataaagccatgtttaacacagaaggggaaatagaataccatgacattaaagaggtcacagaccatgactttagacaatttagagggcaagtggacatcatctgcgggggatttccttgccaagcattttcactcgcaggcagacgattgggatttgaagatactcgagggactctcttttttgagattgctcgagcggccaaacaaatccaaccacgttttctatttttggaaaacgtcaaaggcctactcaatcacgacgagggacggacgttcgccacaatcctctccacgctggatgaattggggtatgatgtcgaatggcaggtgcttaacagcaaggacttccaagtcccgcaaaacagagaacgggtctttattatcggacattctagaagataccgttccagattcatatttcctctcagaagagaagacagcccagctcatcttgaaaggctaggaaatatcaatccctctaaacatggtttgaatggtgaagtctatctgacgagtggacttgctcctacactaacaagaggtaaaggagagggtgcaaaaatcgccattccagtcttaacaccagatagactagaaaaacgccaacatggtcgtcgatttaaggacaatcaagaccctatgtttactttgaccagtcaagacaaacacggagttgttgtcgcaggaaatctgccgactagctttgaccagaccggtagagtatttgacatttctggcttgtcaccgaccttgaccaccatgcaaggtggagacaaggtgccaaagattttgctgagggaggagctgccatttctgaaaatcaaggaagccactaaaacagggtacgcaaaggcaactcttggagactctgtcaatctggcttatccagactcaaccaaacgtaggggacgtgtgggaaagggaatatccaatactctgacgacttcagacaatatgggagtagtagttgctgctctggaatatcgacaggataagtggtatgaagtcacaggcattgtcttagaggggaaactttatcgcctgagaataagacgactgacaccaagagagtgcttcagacttcaaggctttcctgattgggcttatgaaagagcagagagtgtttctagtaagagccaactatacaaacaggccggcaatagcgtgactgtcacagttattgaagccattgccagagaatttagaagaacggaagaggaagaaaaacatgaacttactaca

SEQ ID NO: 5896 - protein, 451 aa, Streptococcus agalactiae
MKFLDLFAGIGGFRLGMESQGHKCLGFCEIDKFARTSYKAMFNTEGEIEYHDIKEVTDHDFRQFRGQVDIICGGFPCQAFSLAGRRLGFEDTRGTLFFEIARAAKQIQPRFLFLENVKGLLNHDEGRTFATILSTLDELGYDVEWQVLNSKDFQVPQNRERVFIIGHSRRYRSRFIFPLRREDSPAHLERLGNINPSKHGLNGEVYLTSGLAPTLTRGKGEGAKIAIPVLTPDRLEKRQHGRRFKDNQDPMFTLTSQDKHGVVVAGNLPTSFDQTGRVFDISGLSPTLTTMQGGDKVPKILLREELPFLKIKEATKTGYAKATLGDSVNLAYPDSTKRRGRVGKGISNTLTTSDNMGVVVAALEYRQDKWYEVTGIVLEGKLYRLRIRRLTPRECFRLQGFPDWAYERAESVSSKSQLYKQAGNSVTVTVIEAIAREFRRTEEEEKHELTT

SEQ ID NO: 5897 - DNA, 102 bp, Streptococcus agalactiae
gtgaataagatgatttggtggatactaggtggaatctatctgatttctatcatcattttgattgttgaaatcatccgtgcaccagaaatggatgatcatata

SEQ ID NO: 5898 - protein, 34 aa, Streptococcus agalactiae
MNKMIWWILGGIYLISIIILIVEIIRAPEMDDHI

SEQ ID NO: 5899 - DNA, 135 bp, Streptococcus pyogenes
atggaccaagcaactaaggtgacaagaagcgaagtgagtaagatgttttggtggctattattaggtgtttggggactaaggacaatttggttgattattgaagttatcactgcaccagaaatggaagattatagt

SEQ ID NO: 5900 - protein, 45 aa, Streptococcus pyogenes
MDQATKVTRSEVSKMFWWLLLGVWGLRTIWLIIEVITAPEMEDYS

SEQ ID NO: 5901 - DNA, 816 bp, Streptococcus agalactiae
atgaaacgtattaccgctaatcaatatcagacatcagagcgttattataaactccctaaaattttgtttgagagtgaacgttataaggatatgaagctggaagttaaggtagcctacgcggttttaaaagatcggttggagttgtctttgagtaaaggctggattgatgaggatggggctatttatttgatttattccaattcaaatctgatggcactattaggctgttcaaagtcaaaactactctctatcaagaaaaccttacgtgaatatggcttaattgatgaagtccaacagtcctctagtgaaagaggtcgaatggcaaataaaatttacttgggggaattagaacatgaacctaccccagtcttacatacagacggggctagtgttaaaaaaacactaggggagtctcaaagaaagacggggccggtcttatattcagcccctagtgagactgaaggaagtgagactaaatatagtgaaactgaagggagtgacttagttatgaaggacgaggaggagaggcagctagtagatgagaaaaaagaagaaaactttacttcaaaagtcgatggcgtgaccaagtacgatcgagactatatttggggtttggttcatgaccagttaagacagacaggtctatctcagtctgctagtgactatgccatgatttattttagtgaccggtatcagtatgcattggaacaaatgcgatttgctcggtcagccgaagtaatagctgaatacgtatttaatggtgtgctgtcggagtggaccaagcaactgagacgacaagaagtaaaaggaggtgaa

SEQ ID NO: 5902 - protein, 272 aa, Streptococcus agalactiae
MKRITANQYQTSERYYKLPKILFESERYKDMKLEVKVAYAVLKDRLELSLSKGWIDEDGAIYLIYSNSNLMALLGCSKSKLLSIKKTLREYGLIDEVQQSSSERGRMANKIYLGELEHEPTPVLHTDGASVKKTLGESQRKTGPVLYSAPSETEGSETKYSETEGSDLVMKDEEERQLVDEKKEENFTSKVDGVTKYDRDYIWGLVHDQLRQTGLSQSASDYAMIYFSDRYQYALEQMRFARSAEVIAEYVFNGVLSEWTKQLRRQEVKGGE

SEQ ID NO: 5903 - DNA, 366 bp, Streptococcus pyogenes
gtgttaaattcagcccctagtgagactgaaaagagtgaaactgaaggtagtgaaactaaagagagtaatttagtgattgaggacgaggaggaaagaaaggagtgcactagtgtgaaaaagactgagggtcactttacccgtcaagttgatcaggtcaccaaatatgacaaagattatatttggagtttggttcattcccaattacgtgaaggtggtttatcacaagctgctagtgacttagtcatgagctattttgaagaacgctatgcttatgcgctggaacacatacggttcgcaagaacagctgaagctattgcggaatatgtctttaatggtgtcttatccgaatggaccaagcaactaagg

SEQ ID NO: 5904 - protein, 122 aa, Streptococcus pyogenes
VLNSAPSETEKSETEGSETKESNLVIEDEEERKECTSVKKTEGHFTRQVDQVTKYDKDYIWSLVHSQLREGGLSQAASDLVMSYFEERYAYALEHIRFARTAEAIAEYVFNGVLSEWTKQLR

SEQ ID NO: 5905 - DNA, 123 bp, Streptococcus agalactiae
atgaccatcatgggagttgataatctaaaagcaactcaactggtaaatgaaatggaacaaacaggtttaatccgatttgatgaattcgggaattttggacttttagtcttggagggacaatca

SEQ ID NO: 5906 - protein, 41 aa, Streptococcus agalactiae
MTIMGVDNLKATQLVNEMEQTGLIRFDEFGNFGLLVLEGQS

SEQ ID NO: 5907 - DNA, 99 bp, Streptococcus agalactiae
ttgtctaccccatttttgcgttttggaggtaattatgcaaaaggaagaacagtcatcacgtcatatcgtgaagagccatatcatgaccatcatgggagt

SEQ ID NO: 5908 - protein, 33 aa, Streptococcus agalactiae
MSTPFLRFGGNYAKGRTVITSYREEPYHDHHGS

SEQ ID NO: 5909 - DNA, 159 bp, Streptococcus agalactiae
gtgcttcagttactcttaaataagagtcatatcataattagattgcggaatccctatttaccagtctttgagagcgataagcgattgatagaaactgataaattgatttggtttcctgccaaaaatcctgccaaaaattctttggcaggatttttgttt

SEQ ID NO: 5910 - protein, 53 aa, Streptococcus agalactiae
MLQLLLNKSHIIIRLRNPYLPVFESDKRLIETDKLIWFPAKNPAKNSLAGFLF

SEQ ID NO: 5911 - DNA, 378 bp, Streptococcus agalactiae
ttggaggaaataacaatggcattaaacattgaaaatattattgctgaaattaaagaagctacaattcttgaacttaacgatcttgtaaaagctatcgaagaagaatttggtgtaactgctgctgctcctgtagctgctgccgctgctggtggtgaagctgctgctgctaaagactcatttgacgttgaattaacagctgctggagacaaaaaagttggcgttatcaaagttgttcgtgaaatcacaggcgaaggtcttaaagaagctaaagctatcgttgataacgcaccatcagttatcaaagaaggtgcttcagaagcagaagctaacgaaatcaaagaaaaacttgaagctgcaggtgcttcagttactcttaaa

SEQ ID NO: 5912 - protein, 126 aa, Streptococcus agalactiae
MEEITMALNIENIIAEIKEATILELNDLVKAIEEEFGVTAAAPVAAAAAGGEAAAAKDSFDVELTAAGDKKVGVIKVVREITGEGLKEAKAIVDNAPSVIKEGASEAEANEIKEKLEAAGASVTLK

SEQ ID NO: 5913 - DNA, 378 bp, Streptococcus pyogenes
ttggaggaaatcacaatggcattgaacattgaaaacattattgctgaaattaaagaagcttcaatccttgagcttaacgatcttgtaaaagctatcgaagaagaatttggtgtaactgcagctgctcctgtagctgctgcagctgctggtggtgctgaagaagctgctaaagattcattcgacgttgaattgacatctgctggcgacaaaaaagttggcgttatcaaagctgttcgtgaaatcacaggtcttggtcttaaagaagctaaaggtcttgttgatggagcacctgctaacgttaaagaaggcgttgctgctgcagaagctgaagaaatcaaagctaaacttgaagaagctggagcaacaatcactcttaaa

SEQ ID NO: 5914 - protein, 126 aa, Streptococcus pyogenes
LEEITMALNIENIIAEIKEASILELNDLVKAIEEEFGVTAAAPVAAAAAGGAEEAAKDSFDVELTSAGDKKVGVIKAVREITGLGLKEAKGLVDGAPANVKEGVAAAEAEEIKAKLEEAGATITLK

SEQ ID NO: 5915 - DNA, 537 bp, Streptococcus agalactiae
ttgtgcttatcccaaaaaataaaaacggaggtaaaactaatgagtgaagcaattattgcaaaaaaagctgaacaagttgaacttattgctgagaaaatgaaagcagcagcaagtatcgttgttgttgattcacgtggtcttactgttgagcaagatactaacttacgtcgttcacttcgtgaaagcgatgttgagtttaaagttatcaaaaactcaattttaactcgtgcagctgaaaaagcaggtcttgaagaccttaaagaactttttgttggtccatcagcagttgcgttttctaacgaagatgttattgcaccagctaaagttattagcgatttcgctaaagatgcagaagctcttgaaatcaaaggtggttcagtagacggtaaattcacttcagttgaagaaattaacgctcttgctaaattaccaaacaaagaaggtatgctttcaatgctcctttcagtacttcaagcgccagtacgcaacgttgcatatgctgtcaaagcagttgcagaaaaagacgaagaagtggca

SEQ ID NO: 5916 - protein, 179 aa, Streptococcus agalactiae
MCLSQKIKTEVKLMSEAIIAKKAEQVELIAEKMKAAASIVVVDSRGLTVEQDTNLRRSLRESDVEFKVIKNSILTRAAEKAGLEDLKELFVGPSAVAFSNEDVIAPAKVISDFAKDAEALEIKGGSVDGKFTSVEEINALAKLPNKEGMLSMLLSVLQAPVRNVAYAVKAVAEKDEEVA

SEQ ID NO: 5917 - DNA, 594 bp, Streptococcus pyogenes
gtgattaaagaaaataacgtatttgtactttcgtgtctaggtttaggtgcgattttttttgtacctagcccaaaaataaaaacggaggtaaaactaatgagtgaagcaattattgctaaaaaagctgaacaagtcgaacttattgctgagaaaatgaaagcagcagcaagtatcgttattgttgattcacgtggtcttacagttgatcaagatactgttcttcgtcgttcacttcgtgaaagtggcgttgagttcaaagttatcaaaaactcaattttgactcgtgcagctgaaaaagcaggtcttgatgagttgaaagatgtattcgtaggaccatctgcagtagcattttctaacgaagatgttatcgcaccagctaaagttatcaacgactttactaaaactgctgacgcacttgaaatcaaaggtggtgcaatcgaaggcgctgtttcttcaaaagaagaaatccaagcacttgcaacattgccaaaccgcgaaggaatgctttctatgcttctttctgtacttcaagctccagtccgtaacgttgcatacgctgtcaaagctgttgcagaaaacaaagaaggcgctgct

SEQ ID NO: 5918 - protein, 198 aa, Streptococcus pyogenes
VIKENNVFVLSCLGLGAIFFVPSPKIKTEVKLMSEAIIAKKAEQVELIAEKMKAAASIVIVDSRGLTVDQDTVLRRSLRESGVEFKVIKNSILTRAAEKAGLDELKDVFVGPSAVAFSNEDVIAPAKVINDFTKTADALEIKGGAIEGAVSSKEEIQALATLPNREGMLSMLLSVLQAPVRNVAYAVKAVAENKEGAA

SEQ ID NO: 5919 - DNA, 516 bp, Streptococcus agalactiae
ttgtttggtaatttagcaagagcgttaatttcttcaactgaagtgaatttaccgtctactgaaccacctttgatttcaagagcttctgcatctttagcgaaatcgctaataactttagctggtgcaataacatcttcgttagaaaacgcaactgctgatggaccaacaaaaagttctttaaggtcttcaagacctgctttttcagctgcacgagttaaaattgagtttttgataactttaaactcaacatcgctttcacgaagtgaacgacgtaagttagtatcttgctcaacagtaagaccacgtgaatcaacaacaacgatacttgctgctgctttcattttctcagcaataagttcaacttgttcagctttttttgcaataattgcttcactcattagttttacctccgtttttattttttgggataagcacaaaaaaatcgcacctaaacctagacacgaaagtacaatacgttattttataatgacgttttgtgcctcggtaggaatatta

SEQ ID NO: 5920 - protein, 172 aa, Streptococcus agalactiae
MFGNLARALISSTEVNLPSTEPPLISRASASLAKSLITLAGAITSSLENATADGPTKSSLRSSRPAFSAARVKIEFLITLNSTSLSRSERRKLVSCSTVRPRESTTTILAAAFIFSAISSTCSAFFAIIASLISFTSVFIFWDKHKKIAPKPRHESTIRYFIMTFCASVGIL

SEQ ID NO: 5921 - DNA, 2106 bp, Streptococcus agalactiae
atggcaaataataatttttataatcgtgacccttttggaaatatggatgatatttttaattctctaatgggaaatatggggggctataacagtgagaataagcgatacctaatcaatggacgggaagttactcctgaagaattcagtcaatatcgtcaaactggaaaactccccggtcaagagctaaataaccaaaacactcctacaaaccaagtctctgcagatagtgttttgactaaattaggaactaatttaaccgatcaagcacgtcagcatttgctagatccagttattggacgaaacaaagaaattcaggaaactgcagaaattctagctcgtcgtactaaaaataatcctgttctggttggtgatgcaggtgttggtaaaacagctgttattgaaggtttggcacaagcaattataaatggtgatgtccctgctgctatcaaaaataaagaaatcatttcgatagatatttctagccttgaagctggcacccaatataggggtagttttgaagaaaatattcaaaatatcataaaagaagttaaggaaacaggaaatattattctcttctttgatgaaatacaccaaatattaggagccggttcaactggtggtgatagtggctctaaggggctcgcagatatacttaagcctgcactttcacgtggtgagttaacggttataggtgcaactactcaagatgaatatcgtaacaccattctcaagaatgctgccttagcacgtcgctttaacgaagttaaagtcaatgcaccttctgcacaagatactttcaatatccttatggggataagaaacctctatgagcaacatcataatgttgttttacctgactctgttttgaaagcagctgtagatttatctattcaatacatcccacaaagaagtctccctgataaagcaattgaccttattgatatgactgctgcacacctagctgcgcaacatcccgtaactgaccttaaatccttagaaaaagaaatcgctgagcaaagagacaagcaagaaaaagctgtcaatactgaagattttgaagaagctcttaaggtcaagacacgcattgaagagttacaaaaccagattgataatcataccgaaggacaaaaagtcactgcaactatcaacgatatcgctatgtcaattgagcgtctaactggagttcctgtatcaaatatgggtgctagtgatattgaacgcttaaaagaacttggcaatcgtctaaaaggtaaagtcattggtcaaaatgatgctgttgaggcagttgcgagagctattcgccgaaatcgtgctggtttcgatgatggtaatcgtccgattggtagctttctatttgttggaccaactggagttggtaaaaccgagctagcaaagcaattagcttttgatatgttcggatcaaaggatgctatcgttagacttgatatgtctgaatataatgatcgtacagcagtttctaagctaattggagcgactgctggttacgttggttatgacgacaatagtaatacactaacagaacgtatccgtcgaaatccttattctattgttcttcttgatgaaatcgaaaaagctgacccgcaagttatcacgcttctccttcaagttctagatgatggccgtttaactgatggtcaaggaaacactattaactttaaaaatactgttatcattgcaacctcaaatgcaggttttggaaacgaagcatttacaggtgacagcgataaagacttgaaaattatggaacgaatttctccatatttccgtccagaatttctaaatcgtttcaatggtgttattgaattctctcacctaagcaaagatgacttaagcgaaattgtagatttgatgcttgatgaagttaaccaaacaattggcaaaaaaggaattgaccttgtggtagatgaaaatgttaaatcacacttaattgaactgggttatgacgaagcaatgggagtacgtccattgcgccgtgtcatcgagcaagaaattcgagatcgcatcacagactactatctcgatcatacagacgttaaacacctaaaagctaatttgcaagatggccaaatcgtcatttctgaaaga

SEQ ID NO: 5922 - protein, 702 aa, Streptococcus agalactiae
MANNNFYNRDPFGNMDDIFNSLMGNMGGYNSENKRYLINGREVTPEEFSQYRQTGKLPGQELNNQNTPTNQVSADSVLTKLGTNLTDQARQHLLDPVIGRNKEIQETAEILARRTKNNPVLVGDAGVGKTAVIEGLAQAIINGDVPAAIKNKEIISIDISSLEAGTQYRGSFEENIQNIIKEVKETGNIILFFDEIHQILGAGSTGGDSGSKGLADILKPALSRGELTVIGATTQDEYRNTILKNAALARRFNEVKVNAPSAQDTFNILMGIRNLYEQHHNVVLPDSVLKAAVDLSIQYIPQRSLPDKAIDLIDMTAAHLAAQHPVTDLKSLEKEIAEQRDKQEKAVNTEDFEEALKVKTRIEELQNQIDNHTEGQKVTATINDIAMSIERLTGVPVSNMGASDIERLKELGNRLKGKVIGQNDAVEAVARAIRRNRAGFDDGNRPIGSFLFVGPTGVGKTELAKQLAFDMFGSKDAIVRLDMSEYNDRTAVSKLIGATAGYVGYDDNSNTLTERIRRNPYSIVLLDEIEKADPQVITLLLQVLDDGRLTDGQGNTINFKNTVIIATSNAGFGNEAFTGDSDKDLKIMERISPYFRPEFLNRFNGVIEFSHLSKDDLSEIVDLMLDEVNQTIGKKGIDLVVDENVKSHLIELGYDEAMGVRPLRRVIEQEIRDRITDYYLDHTDVKHLKANLQDGQIVISER

SEQ ID NO: 5923 - DNA, 2097 bp, Streptococcus pyogenes
atgacacatttttctggtaaagatccttttgtaaatatggatgatattttcaatcaattaatggcaaacatgggtggttatcgtagcgaaaatccccgctatctcgttaacggtcgcgaaataactcccgaagaattccaacactatcgtcaaacaggacaactccctgtagcgacaaccaaagcaacaaattctcaaatgttaacacctaaagctgatagtgtattgactcaactcggaactaacttaacacaagaagctcgtcaagggcatcttgaccccgtcattggtcgtaacaaagaaattcaagataccgctgaaatcttggcacgacgaactaaaaataatcctgtccttgtcggagatgctggtgtcggtaaaactgcagtcattgaaggtttagctcaagccattgttaatggagatgtcccagctgctattaaaaacaaggaaatcgtatcaattgatatttctagtcttgaagctggtacacagtatcgtggttcctttgaagagaccattcaaaacttgattcaagaagtaaaagaagctgggaatatcatcttattttttgatgaaattcatcaaatagttggtgctggtgccacaagcagtgattcaggctcaaagggacttgcagatattcttaaaccagccttgtcacgaggagaattaacactgattggtgctactactcaagacgaataccgcaatactattttaaaaaatgctgctcttgctcgtcgctttaatgaagttaaagtgaatgcaccatcagctgaagatacttttcacattttaatgggtattcgtaatctttatgaacaacaccaccatattacccttcctgataatgttctaaaagctgctgttgattattctattcaatacatcccacagcgtagcctgccagataaagcaattgacttactggatatgacagctgctcatttagctgcgcaacacccggtcactgacttaaaaacactcgaaactgaaatagctaaacaaaaagagagtcaagaaaaagctgtcgccaaagaagactttgaaaaagctttagcagcaaaaacacggattgaaacattacaaaagcaaattgagcaacataaccaaagccaaaatgtcactgctacagtcaatgatatcgcagagtctgtagagcgcttaactggtattcctgtctctaacatggggactaatgatttagaaaggctcaaaggaattagcagccgcttaaaaagccatgtcatcggacaagatgaggctgtcgcagcagtagcacgtgctattcgacgaaatcgggcaggttttgatgatggtaaacgtccaataggttctttcctttttgtgggtccaactggtgttggtaaaacagagttagctaaacaattagcacttgatttatttggttccaaagatgctattattcgacttgatatgtccgaatataacgatcgcactgctgtgtcaaaattgattgggacaacggctggttatgttggctacgatgataataataataccctaactgagcgtgttcgtcgtaacccttatgctattgtcttactagatgaaattgaaaaagctgatcctcaaattattacacttcttctacaagtattagatgatggacgattgacagatggacaaggaaatactattaactttaaaaataccgttattattgctacatcaaatgccggttttggccaacaagatacggaaacttctgagtctaacattatggatcgcattgcaccttatttcagaccagagtttttgaaccgttttaatagtatcattaaatttaatcatctgcaaaaagaaagtttagaagaaattgttgatttaatgctagctgaagtaaatcaaaccaccgcaaaaaaaggtattagtttaacgattactgatgacgctaaagctcatttgatagatttagggtacaatcacgctatgggagctcgtccattacgacgtattatcgaacaggaaattcgtgaccgtataactgattattatcttgaccatccagaagtcaaaaaacttcaggcaatcctaaaagaaggacaactagtgattaggcaaaacgatcag

SEQ ID NO: 5924 - protein, 699 aa, Streptococcus pyogenes
MTHFSGKDPFVNMDDIFNQLMANMGGYRSENPRYLVNGREITPEEFQHYRQTGQLPVATTKATNSQMLTPKADSVLTQLGTNLTQEARQGHLDPVIGRNKEIQDTAEILARRTKNNPVLVGDAGVGKTAVIEGLAQAIVNGDVPAAIKNKEIVSIDISSLEAGTQYRGSFEETIQNLIQEVKEAGNIILFFDEIHQIVGAGATSSDSGSKGLADILKPALSRGELTLIGATTQDEYRNTILKNAALARRFNEVKVNAPSAEDTFHILMGIRNLYEQHHHITLPDNVLKAAVDYSIQYIPQRSLPDKAIDLLDMTAAHLAAQHPVTDLKTLETEIAKQKESQEKAVAKEDFEKALAAKTRIETLQKQIEQHNQSQNVTATVNDIAESVERLTGIPVSNMGTNDLERLKGISSRLKSHVIGQDEAVAAVARAIRRNRAGFDDGKRPIGSFLFVGPTGVGKTELAKQLALDLFGSKDAIIRLDMSEYNDRTAVSKLIGTTAGYVGYDDNNNTLTERVRRNPYAIVLLDEIEKADPQIITLLLQVLDDGRLTDGQGNTINFKNTVIIATSNAGFGQQDTETSESNIMDRIAPYFRPEFLNRFNSIIKFNHLQKESLEEIVDLMLAEVNQTTAKKGISLTITDDAKAHLIDLGYNHAMGARPLRRIIEQEIRDRITDYYLDHPEVKKLQAILKEGQLVIRQNDQ

SEQ ID NO: 5925 - DNA, 1044 bp, Streptococcus agalactiae
ttgcttgggatagctcacaacgtgctgggctttacttcggtgttccatttattattttctgctatatttatcacaaactacgttacaagaaatggtgatcttatgggaagatttaaagaacttttagagagtaaaaaaactctcatcctacatggtgccttggggaccgagcttgagagtagaggttgtgatgtttctgggaaactttggtcagccaaatatctgattgaggatccagcagctattcagaccattcatgaagattatattcgtgctggcgctgatattgtgacgacatcaacttatcaggcgactttacaaggactagctcaagttggtgtctctgaaagtcagacagaagatttgattcgcttgactgttcagttggcaaaagctgcgcgtgagcaagtttggaaaagtttgacaaaagaagaaaaatcagagagaatctatcctttgatttctggggatgttggtccctacgctgcctttttagcggatggctctgagtacactggactctacgatattgataagcaaggtcttaaaaacttccatcgccatcgtattgagcttcttttagatgagggtgttgacattctggcacttgaaaccattccaaacgctcaggaggctgaggctcttattgagctacttgccgaggatttccctcaggttgaggcttatatgtcattcacctctcaagatggtaagaccatctcagatggtagtgctgttgcagacttggcgaaagctattgatgttagcccacaggtcgtggcgctgggcattaactgttcaagtccatcgttagttgctgatttcttgcaagcaatagcagagcagactaacaagcctcttgtgacctatccaaactctggagaggtttatgatggggcaagccaatcttggcaatctagccctgatcattcacacaccctacttgaaaatacaagtgactggcaaaaacttggcgcccaagttgtcggaggttgttgccgaactagaccagctgatattgctgacctctctgcacatttaaaa

SEQ ID NO: 5926 - protein, 348 aa, Streptococcus agalactiae
MLGIAHNVLGFTSVFHLLFSAIFITNYVTRNGDLMGRFKELLESKKTLILHGALGTELESRGCDVSGKLWSAKYLIEDPAAIQTIHEDYIRAGADIVTTSTYQATLQGLAQVGVSESQTEDLIRLTVQLAKAAREQVWKSLTKEEKSERIYPLISGDVGPYAAFLADGSEYTGLYDIDKQGLKNFHRHRIELLLDEGVDILALETIPNAQEAEALIELLAEDFPQVEAYMSFTSQDGKTISDGSAVADLAKAIDVSPQVVALGINCSSPSLVADFLQAIAEQTNKPLVTYPNSGEVYDGASQSWQSSPDHSHTLLENTSDWQKLGAQVVGGCCRTRPADIADLSAHLK

SEQ ID NO: 5927 - DNA, 249 bp, Streptococcus agalactiae
atgatagcaataaccttaatacttgagaagaaagactctgcttctgcaaaaaagcgtacgctaagagcatttaaaccaaaaatcacaagggcaaaaaaggaagcaaatgcccaagccggcacatttgggaaccagcgctgcatcagcatggcagcacctaaaaattcagtccccaaggcgaccgtccaacaaatccaatatagccaagcaacagtaaaacctgttccaggactgataaacttagtggca

SEQ ID NO: 5928 - protein, 83 aa, Streptococcus agalactiae
MIAITLILEKKDSASAKKRTLRAFKPKITRAKKEANAQAGTFGNQRCISMAAPKNSVPKATVQQIQYSQATVKPVPGLINLVA

SEQ ID NO: 5929 - DNA, 1152 bp, Streptococcus agalactiae
  MISC_FEATURE (1)..(1152): n = a, c, g, or t
ntgccggtgacggggtcattccacacttatgccactaagtttatcagtcctggaacaggttttactgttgcttggctatattggatttgttggacggtcgccttggggactgaatttttaggtgctgccatgctgatgcagcgctggttcccaaatgtgccggcttgggcatttgcttccttttttgcccttgtgatttttggtttaaatgctcttagcgtacgcttttttgcagaagcagagtctttcttctcaagtattaaggttattgctatcattatctttattatcttgggcttaggtgctatgtttggtctagtttcctttgaaggtcagcacaaggctattctcttcactcatctgactgccaatggtgcctttccaaatggtatcgttgcagttgtctcagtcatgttggctgttaactatgccttctctggtactgagttaattggtattgcggctggtgaaacggataatcccaaagaagctgtaccaagggctattaaaacgacaatcggtcgcttggttgttttctttgtactgacaattgttgtcctagcttcgctattgccaatgaaagaggcaggcgtatccacagcaccattcgttgatgtctttgacaagatgggaatcccttttacggcggatatcatgaacttcgttatcttgacagccatcctgtctgctggtaactcaggtctctacgcatcaagccgtatgctctggtcccttgccaatgaaggtatgttgtcaaaatctgttgtgaaaatcaataaacacggtgtcccaatgcgtgctcttctcttgtcaatggcaggagcagtgctgtcgctcttttcaagtatttacgctgcagacacagtttatctagccttggtttcaatcgcgggctttgctgttgttgtcgtatggctagccattccagtcgcacaaatcaatttccgcaaggaattcttgaaagagaatcaactagaagatttgtcttacaaaacaccttttacaccagttctcccttatatcacaatcattttgctcttgatttcgattgtagggattgcttgggatagctcacaacgtgctgggctttacttcggtgttccatttattattttctgctatatttatcacaaactacgttacaagaaatgg

SEQ ID NO: 5930 - protein, 384 aa, Streptococcus agalactiae
  MISC_FEATURE (1)..(384): Xaa = Any Amino Acid
XPVTGSFHTYATKFISPGTGFTVAWLYWICWTVALGTEFLGAAMLMQRWFPNVPAWAFASFFALVIFGLNALSVRFFAEAESFFSSIKVIAIIIFIILGLGAMFGLVSFEGQHKAILFTHLTANGAFPNGIVAVVSVMLAVNYAFSGTELIGIAAGETDNPKEAVPRAIKTTIGRLVVFFVLTIVVLASLLPMKEAGVSTAPFVDVFDKMGIPFTADIMNFVILTAILSAGNSGLYASSRMLWSLANEGMLSKSVVKINKHGVPMRALLLSMAGAVLSLFSSIYAADTVYLALVSIAGFAVVVVWLAIPVAQINFRKEFLKENQLEDLSYKTPFTPVLPYITIILLLISIVGIAWDSSQRAGLYFGVPFIIFCYIYHKLRYKKW

SEQ ID NO: 5931 - DNA, 546 bp, Streptococcus agalactiae
atgactgaaagtgtgacagttaataaaaagagaataaaacaaatcactcaaacacaagaggatatcttaacagcttttggccaacttttggaagagtatccctatgagaaaattcagattagccaaattgccaagaaatctggctatgctagaaggaccttttaccgacactttgacagtcgagatgacctacttacccttttcatcgaaagactaacattaaatctctttaagcaacttggtcaattggagcaacctacttttagccaagttttccaaaatttttttagttattggtctgattataaatcccttcttctcattcttagaaagaatgacctactccctcaatttcaacaatcctggttccgacatattgatttgatagagttaggtcgtggtgatttatcttccaatacctatgctcagcgatttgcgattggtggtattttcagtgttctaattgagtggattcatcaggactgccaaacaagtatcgaagaattaactcaactttccttcgatattatcaatcatttaaaaaat

SEQ ID NO: 5932 - protein, 182 aa, Streptococcus agalactiae
MTESVTVNKKRIKQITQTQEDILTAFGQLLEEYPYEKIQISQIAKKSGYARRTFYRHFDSRDDLLTLFIERLTLNLFKQLGQLEQPTFSQVFQNFFSYWSDYKSLLLILRKNDLLPQFQQSWFRHIDLIELGRGDLSSNTYAQRFAIGGIFSVLIEWIHQDCQTSIEELTQLSFDIINHLKN

SEQ ID NO: 5933 - DNA, 96 bp, Streptococcus agalactiae
gtggattcatcaggactgccaaacaagtatcgaagaattaactcaactttccttcgatattatcaatcatttaaaaaattaaaaagagctttgcag

SEQ ID NO: 5934 - protein, 32 aa, Streptococcus agalactiae
MDSSGLPNKYRRINSTFLRYYQSFKKLKRALQ

SEQ ID NO: 5935 - DNA, 159 bp, Streptococcus agalactiae
ttgataaaaaggaccatttcatcgtcttttcatctgttgaccgcacaggtcttgatgaatcatgggatactattttatctgagttataatttgagagtttatgacaaaaagagctttgcagtagctgttgagactactgcaaagctctttttaattttt

SEQ ID NO: 5936 - protein, 53 aa, Streptococcus agalactiae
MIKRTISSSFHLLTAQVLMNHGILFYLSYNLRVYDKKSFAVAVETTAKLFLIF

SEQ ID NO: 5937 - DNA, 594 bp, Streptococcus agalactiae
atggcagaagaatttttaaatactcataatgcgtctattttattgagtgcagctaacaagtcacattatcctcaggatgatctcccagaagttgctctcgctggtcgttcaaatgttggtaaatcaagctttatcaacacgcttcttggtcgtaaaaacctagcgcgtacgtcgagtaagccaggtaagacacaactgctcaacttttataacattgatgacaaactgcgttttgtcgatgtccctggatatggctacgctaaggtgtctaaaactgagcgtgctaagtggggcaagatgattgaagagtaccttgtaacacgtgataaccttcgtgttgttgttagtttagttgattttcgtcatgatccaagtgcggacgatattcaaatgtatgaatttcttaagtactatgagattccagtaattattgtagcgacaaaggcagataaaatacctcgtggcaagtggaataaacatgagtcgtctattaagaagaaattaaactttgataaaaaggaccatttcatcgtcttttcatctgttgaccgcacaggtcttgatgaatcatgggatactattttatctgagtta

SEQ ID NO: 5938 - protein, 198 aa, Streptococcus agalactiae
MAEEFLNTHNASILLSAANKSHYPQDDLPEVALAGRSNVGKSSFINTLLGRKNLARTSSKPGKTQLLNFYNIDDKLRFVDVPGYGYAKVSKTERAKWGKMIEEYLVTRDNLRVVVSLVDFRHDPSADDIQMYEFLKYYEIPVIIVATKADKIPRGKWNKHESSIKKKLNFDKKDHFIVFSSVDRTGLDESWDTILSEL

SEQ ID NO: 5939 - DNA, 597 bp, Streptococcus pyogenes
atggctgaagaacaagtcttaaatacccataacgcatcaattttattgagcgctgccaataaatctcattacccccaagatgatttgccagaaattgccctcgctggacgttcaaatgttggtaaatcaagttttattaataccatattggggcgcaaaaatttggcaagaacctcaagcaagccaggaaaaacccaactattaaattttttcaatattgatgacaagcttagatttgtggatgtccctggttatggctatgccaaggtttctaaaagtgaacgggccaaatggggaaagatgatcgaagaatacttaaccagcagagacaatctgcgtgcagtcgtgagtttggtggatttacgtcatgccccttcaaaagaagatattcagatgtatgactttttgaagtactatgacattcctgttattgttgtggcaaccaaagcagataagattcctcgtggcaaatggaacaaacatgagtctgtggtcaagaaagctttgaattttgacaaatctgatacttttatagtattttcttcggtagaacgtattggtatcgatgattcttgggatgctattttagagcaggtc

SEQ ID NO: 5940 - protein, 199 aa, Streptococcus pyogenes
MAEEQVLNTHNASILLSAANKSHYPQDDLPEIALAGRSNVGKSSFINTILGRKNLARTSSKPGKTQLLNFFNIDDKLRFVDVPGYGYAKVSKSERAKWGKMIEEYLTSRDNLRAVVSLVDLRHAPSKEDIQMYDFLKYYDIPVIVVATKADKIPRGKWNKHESVVKKALNFDKSDTFIVFSSVERIGIDDSWDAILEQV

SEQ ID NO: 5941 - DNA, 1248 bp, Streptococcus agalactiae
atgaatagaaaagttgaggaaaaaatggctgggaatcgtaataacgatatgaatgtctattgttcattttgtggcaaaagccaagatgaagtaaaaaaaattattgcaggtaatggtgttttcatttgtaatgaatgtgtggccttatcacaagaaattattaaggaagaattagctgaggaagtactggctgatttagcagaagtaccaaaacctaaggaactattagaaatattaaatcaatatgttgtagggcaagatcgtgctaaacgtgctttagcagttgctgtctacaatcattacaagcgtgttagttataccgagagtagtgacgatgatgtagatttgcaaaaatccaacattttgatgattggtccaactggctcaggaaaaaccttcttagcacaaacactggctaaaagccttaatgtaccgtttgctattgcagatgcgacttcattgaccgaagcaggatacgttggagaagatgttgagaatattcttcttaaattgattcaagctgctgattataatgtcgaacgtgctgagcgtggtattatctacgttgatgaaatagataaaattgctaagaaaggcgaaaatgtttctatcacacgtgatgtgtctggtgaaggtgtacagcaagcccttcttaaaattattgagggtacggtagcaagtgttcccccacagggtgggcgtaaacatcctaaccaagaaatgattcaaattaataccaagaacatcctttttattgtcggtggtgcttttgatggtattgaagaccttgtgaagcaacgtttaggcgaaaaagttattggttttggacagacaagccgtaaaattgatgacaacgcttcttatatgcaagagataatttctgaggatattcaaaagtttggactgattccagagtttattggccgtttaccagtagttgcagcgttagaacttcttactgcagaagatctggttcgtattctgacagaaccacgcaatgctttggttaaacaataccaaaccttattatcttatgatggtgtagaattggaatttgaccaggatgctctattggctatcgctgataaggctatcgagcgcaagactggtgcacgtggtttacgttctattattgaagaaacgatgcttgatatcatgtttgaaattccaagccaagaagatgtaacaaaagttcgtatcacaaaggctgctgttgagggtactgacaagcctgttttagagacggct

SEQ ID NO: 5942 - protein, 416 aa, Streptococcus agalactiae
MNRKVEEKMAGNRNNDMNVYCSFCGKSQDEVKKIIAGNGVFICNECVALSQEIIKEELAEEVLADLAEVPKPKELLEILNQYVVGQDRAKRALAVAVYNHYKRVSYTESSDDDVDLQKSNILMIGPTGSGKTFLAQTLAKSLNVPFAIADATSLTEAGYVGEDVENILLKLIQAADYNVERAERGIIYVDEIDKIAKKGENVSITRDVSGEGVQQALLKIIEGTVASVPPQGGRKHPNQEMIQINTKNILFIVGGAFDGIEDLVKQRLGEKVIGFGQTSRKIDDNASYMQEIISEDIQKFGLIPEFIGRLPVVAALELLTAEDLVRILTEPRNALVKQYQTLLSYDGVELEFDQDALLAIADKAIERKTGARGLRSIIEETMLDIMFEIPSQEDVTKVRITKAAVEGTDKPVLETA

SEQ ID NO: 5943 - DNA, 1227 bp, Streptococcus pyogenes
atggcaggaagtagaactaacgatattaaagtatactgttcattttgtggtaaaagccaggatgacgttaaaaaaattatcgcaggaaataatgttttcatctgcaatgaatgcgtagctttatcacaagaaattataaaagaagaattggctgaagaagtccttgccgatttgacagaagttccaaaaccaaaagagctccttgatgttttaaatcaatatgtggttggtcaagatcgtgctaaacgtgctttatcagttgctgtgtacaatcattataagcgtgtctcgtttacagaaagtcgtgatgacgatgatgtggatttacaaaagtccaacattttgatgattggaccaacaggttcaggaaaaaccttcttagcacaaactctggctaaaagcctcaatgtaccatttgctattgcagatgcaacttctttgactgaagcagggtatgttggagaagatgtggaaaatattttactcaaactgattcaggctgctgactataatgtcgaacgagcagagcgtggtattatttatgttgatgaaatagataagattgctaaaaaaggtgagaacgtatctatcacacgtgatgtatctggtgaaggtgtacagcaagcccttcttaaaattattgaaggtacggtagcaagtgttcccccacaaggtgggcggaagcaccctaatcaagaaatgatccaaattgatacaaaaaatatcttgtttattgttggcggggcttttgatggcatcgaggagatcgttaaacaacgtttaggtgaaaaagttattggttttggtcaaaacagccgtaaaattgatgacaatgcttcttatatgcaagagattatttcagaagatattcaaaagtttgggcttattccagaatttattggccgcttaccagttgtggcagcccttgaacaactaaacacatcagatttgattcaaattttgacagaaccaagaaatgccctggtcaagcaatatcaggctcttctttcttacgatggcgtcgaattggcatttgataaggaagccttagaagccattgccaataaagccattgaacgtaagacaggagcacgtggtcttcgttctattatcgaagaaacgatgcttgacatcatgtttgaaattccaagccaagaagatgtcacaaaagtgcgtatcaccaaggctgctgtcgaaggcaagtcaaaacccgttttagagacagct

SEQ ID NO: 5944 - protein, 409 aa, Streptococcus pyogenes
MAGSRTNDIKVYCSFCGKSQDDVKKIIAGNNVFICNECVALSQEIIKEELAEEVLADLTEVPKPKELLDVLNQYVVGQDRAKRALSVAVYNHYKRVSFTESRDDDDVDLQKSNILMIGPTGSGKTFLAQTLAKSLNVPFAIADATSLTEAGYVGEDVENILLKLIQAADYNVERAERGIIYVDEIDKIAKKGENVSITRDVSGEGVQQALLKIIEGTVASVPPQGGRKHPNQEMIQIDTKNILFIVGGAFDGIEEIVKQRLGEKVIGFGQNSRKIDDNASYMQEIISEDIQKFGLIPEFIGRLPVVAALEQLNTSDLIQILTEPRNALVKQYQALLSYDGVELAFDKEALEAIANKAIERKTGARGLRSIIEETMLDIMFEIPSQEDVTKVRITKAAVEGKSKPVLETA

SEQ ID NO: 5945 - DNA, 144 bp, Streptococcus agalactiae
gtgttgacaaggttagtgaaagcattcatcaaaaaaactgttcctaatccatatctttttttctttatagcaggaattgcacataaaacacaaatcacagctaaaaatgcggtaaagaccccaaaaaggctacgttgcattgaa

SEQ ID NO: 5946 - protein, 48 aa, Streptococcus agalactiae
MLTRLVKAFIKKTVPNPYLFFFIAGIAHKTQITAKNAVKTPKRLRCIE

SEQ ID NO: 5947 - DNA, 564 bp, Streptococcus agalactiae
atgttttttaacaagcaatttgaggtaaaatttgttagaatatctagagataagttagtgaggaaaaaagtcatgacaaagcaaataattgccatttgggctgaagatgaagaccatttgattggagttaatggcggtttaccatggaggcttcctaaagagttacatcacttcaaagaaacgaccatggggcaggctttgcttatgggacgaaagacctttgatggaatgaaccgtcgtgttttacctggtagagagacaatcatcttaacaaaagatgaacaattccaagcagatggagtgacagtcctaaatagtgttgaacaagttataaaatggtttcaggaacataataagaccttatttattgtaggtggtgcaagtatttataaagcatttctgccttattgtgaagcaatcataaaaactaaagttcatggaaaatttaaaggtgatacctattttcctgatgttaatctatctgagtttaaagttatctctagagattattttgaaaaggatgagcagaatgctcatgcttttactgtgacatattttgaaaaa

SEQ ID NO: 5948 - protein, 188 aa, Streptococcus agalactiae
MFFNKQFEVKFVRISRDKLVRKKVMTKQIIAIWAEDEDHLIGVNGGLPWRLPKELHHFKETTMGQALLMGRKTFDGMNRRVLPGRETIILTKDEQFQADGVTVLNSVEQVIKWFQEHNKTLFIVGGASIYKAFLPYCEAIIKTKVHGKFKGDTYFPDVNLSEFKVISRDYFEKDEQNAHAFTVTYFEK

SEQ ID NO: 5949 - DNA, 495 bp, Streptococcus pyogenes
atgacaaaggaaattattgctatttgggcagaggatgaagcagggcttattggtattgcgggtaagttaccatggtatttaccaaaagagttagaacattttaaaaagacaacgctacatcaagcaatcttaatgggccgtgtgacttttgaaggaatgaattgcaaaagacttcctcaacgtcaaacccttgtcatgacaagaaatagagattatcaagtagatgaggtgttgacaatgactagtattgaaaaagtcttggagtggtaccatgcgcaggataaaacactttatatcattggtgggaataaggttttagaagcgtttaatggttatttcgatcgtatcataaaaacagttatccatcatcgttttaaaggagatacctaccgaccaaatctagattttagtcatttcacgcaagaaagccaaacgttctatgctcgagacgctaaaaatccttatgattttaccgttactgctttaaaacacaaa

SEQ ID NO: 5950 - protein, 165 aa, Streptococcus pyogenes
MTKEIIAIWAEDEAGLIGIAGKLPWYLPKELEHFKKTTLHQAILMGRVTFEGMNCKRLPQRQTLVMTRNRDYQVDEVLTMTSIEKVLEWYHAQDKTLYIIGGNKVLEAFNGYFDRIIKTVIHHRFKGDTYRPNLDFSHFTQESQTFYARDAKNPYDFTVTALKHK

SEQ ID NO: 5951 - DNA, 837 bp, Streptococcus agalactiae
atgacaaaagccgatttattatttaaagacaatatcacgaaaattatgtctgaaggtgtatttagcgagcaagccagacctagatataaaaatggggaaatggctaattctaagtatattacaggtgcctttgcagagtatgatttatcaaagggtgaatttcctattacaactctacgtccaattccaataaaatctgctattaaagaaattttctggatttatcaagatcagacaaatgatttagcagttttgaatgataaatatggtgtgacatactggaatgattgggaagttggccatactggcacgataggtcagcgctacggtgcagttgttaaaaaacataatattatatcaaaactcttaaaacagcttgaagataacccttggaatcgtcgtaatgttatttcattatgggactatgaagcatttgaagaaacagaaggcctactaccttgtgcttttcaaacgatgtttgatgtgagacgcgttaatggtgagctttatttggatgccacattaacacaacgttctaatgacatgttagttgcacatcatattaatgctatgcagtatgtagcacttcagatgatgattgcaaagcattttggttggagagttgggaagtttttctattttatcaataatcttcatatttatgataaccagtttgaacaagctcaggaactcttaaaacgccaaccgtctgagtgtaaccccaaactagtattgaatgttccagatggaacagacttttttgatattaaaccagatgattttgcgttagttgattatgacccaattaaacctcaattacgttttgatttagcaatc

SEQ ID NO: 5952 - protein, 279 aa, Streptococcus agalactiae
MTKADLLFKDNITKIMSEGVFSEQARPRYKNGEMANSKYITGAFAEYDLSKGEFPITTLRPIPIKSAIKEIFWIYQDQTNDLAVLNDKYGVTYWNDWEVGHTGTIGQRYGAVVKKHNIISKLLKQLEDNPWNRRNVISLWDYEAFEETEGLLPCAFQTMFDVRRVNGELYLDATLTQRSNDMLVAHHINAMQYVALQMMIAKHFGWRVGKFFYFINNLHIYDNQFEQAQELLKRQPSECNPKLVLNVPDGTDFFDIKPDDFALVDYDPIKPQLRFDLAI

SEQ ID NO: 5953 - DNA, 861 bp, Streptococcus pyogenes
atgcttacagaaaggttattagagatgacaaaagctgaccagatttttaaagctaatattcaaaaaattataaacgaaggatcattgagtgagcaagcacgtcctaaatataaagatggtcgaacagctcattctaagtatattactggggcgtttgctgaatatgatttagctaaaggagagtttcccatcacaactttacgacccattccaattaaatctgctataaaggaattattttggatatatcaagatcagtctaacagtttagatgtgctagaagctaaatataatgttcattattggaatgaatgggaagttgaccagacacgtactattgggcaacgttatggtgctgtagtcaaaaaacatgatatcatctcaaaaatactaaagcaattagcagaaaatccttggaatcgtcgtaatgtcatttctctctgggactatgaagcatttgaggagacaaaagggttgttgccatgtgcctttcaaatcatgtttgatgttagacgtgtaggggaagatctttatttagatgctagtttgacgcaacgttctaatgacatattagttgctcatcacatcaatgccatgcaatacgttgccttgcagatgatgattgctaaacattttggatggaaaataggtaagttcttttattttgttaacaatttacatatttatgacaaccaatttgatcaggctcaagaattgctaaaacgacagccagttgctagtcagcctaagcttgttttaaatgttccagataggactaatttctttgatattaaaccagatgattttgaattacaaaattatgatccagtgaagcctcagttgcactttgaccttgctatt

SEQ ID NO: 5954 - protein, 287 aa, Streptococcus pyogenes
MLTERLLEMTKADQIFKANIQKIINEGSLSEQARPKYKDGRTAHSKYITGAFAEYDLAKGEFPITTLRPIPIKSAIKELFWIYQDQSNSLDVLEAKYNVHYWNEWEVDQTRTIGQRYGAVVKKHDIISKILKQLAENPWNRRNVISLWDYEAFEETKGLLPCAFQIMFDVRRVGEDLYLDASLTQRSNDILVAHHINAMQYVALQMMIAKHFGWKIGKFFYFVNNLHIYDNQFDQAQELLKRQPVASQPKLVLNVPDRTNFFDIKPDDFELQNYDPVKPQLHFDLAI

SEQ ID NO: 5955 - DNA, 1275 bp, Streptococcus agalactiae
gtgagaaacaagactttgaaggttaaagctttttttcatatttttagcttctttatggtaaaatggaatttagcaaaaatgacttttattcagaaaggtttaccaatgaaaataggaattgataagattggttttgcaaccagtcaatatgtccttgaaatgactgatttggctattgctcgccaagttgaccctgaaaaattcagcaagggattattgttagattcacttagtattacgccagttacagaagatatcgttacacttgcagcttctgcagctaatgatattttatctgatgaggacaaagaaactattgatatggtgattgtcgctacagaatcaagtatcgatcagagtaaggcggcttctgtctatgtacatcaacttttagagattcaacctttcgcaaggtcattcgagatgaaagaagcatgctatagcgcaactgctgctcttgattacgctaaattacatgtagaaaaacatccagattctaaagtattagtgatagcttcagatattgctaaatatggcattaaatctactggagaatccactcaaggtgcaggcagtatcgctatgcttattagtcaaaatccatccattctagagctaaaagaggaccatctagcgcaaacccgtgatattatggacttttggcgaccaaattattctgatgttccttatgttaatggcatgttttcaacaaaacaatatctagatatgctaaaaactacttggaaagtatatcaaaaacgttttaatactagtctaagtgactatgctgctttttgtttccatattccttttccaaaattagctttaaagggctttaataaaattctagataataacttagatgaacaaaagaaagctgaactacaagaaaattttgagcactctattacctatagtaagaaaattggaaattgctatactggctcattgtatctaggacttctatcgttactagaaaatagtcaaaatttaaaagcaggtgatcaaattgccttcttttcatacggtagcggagctgttgctgaaatttttaccggtcagttagtagacggctaccaaaataaacttcagagcgatcgtatggatcaactcaataaacgtcaaaaaattacagtaactgagtatgagaaactcttctttgaaaaaacaatcctagacgaaaatggaaatgctaacttcaacacctaccggactggcactttttctctagactctatttgcgaacatcaacgtatctacaagaaaattaataat

SEQ ID NO: 5956 - protein, 425 aa, Streptococcus agalactiae
MRNKTLKVKAFFHIFSFFMVKWNLAKMTFIQKGLPMKIGIDKIGFATSQYVLEMTDLAIARQVDPEKFSKGLLLDSLSITPVTEDIVTLAASAANDILSDEDKETIDMVIVATESSIDQSKAASVYVHQLLEIQPFARSFEMKEACYSATAALDYAKLHVEKHPDSKVLVIASDIAKYGIKSTGESTQGAGSIAMLISQNPSILELKEDHLAQTRDIMDFWRPNYSDVPYVNGMFSTKQYLDMLKTTWKVYQKRFNTSLSDYAAFCFHIPFPKLALKGFNKILDNNLDEQKKAELQENFEHSITYSKKIGNCYTGSLYLGLLSLLENSQNLKAGDQIAFFSYGSGAVAEIFTGQLVDGYQNKLQSDRMDQLNKRQKITVTEYEKLFFEKTILDENGNANFNTYRTGTFSLDSICEHQRIYKKINN

SEQ ID NO: 5957 - DNA, 1212 bp, Streptococcus pyogenes
atgggtaagactataaaaataactaaaagaaggacaaatatgacaattggaattgataagattggttttgcaaccagtcaatatgtcttgaaattggaagatttagcgcttgcacgccaagtggatccagcaaaatttagtcaagggctactcattgagtcttttagtgtggcaccaatcactgaagacattattactttagctgcttctgcagcagatcaaattttaaccgacgaagatcgagctaagattgatatggttattttggcaactgaatcgagtactgatcagtcaaaggcatcagctatctatgtacatcacttagttggtatccagccttttgcacgttcctttgaagtaaaacaagcctgctatagcgcaactgctgctctagactatgctaaactgcatgtggcttctaagccagattctcgtgtccttgttattgctagtgatattgctagatacggtgtaggatctcctggggaatcgactcaaggctctggtagtattgctcttttggtaactgctaaccctcgtattcttgctctaaatgaagataatgtggctcaaactagggatattatggacttttggaggcctaactatagtttcacaccttatgttgatggtatttactctaccaagcaatatctcaattgcttagaaaccacgtggcaagcttatcagaaaagagaaaaccttcagttatctgatcttgctgcagtttgtttccatattccatttcccaagttagccctaaaaggtctaaataacattatggataacacagtacctcctgaacacagggaaaaactaatagaagcctttcaagcttctattagttatagcaaacaaattggaaatatttatactggctcactttatctaggattgttatctttacttgaaaatagtaaagtattacaatctggagataaaattggtttttttagctatggttccggtgccgtaagtgaattttattccggtcagttagttgctgggtacgataaaatgttaatgactaatcgacaagctttactggatcaacgaacacgtctttctgtttctaaatacgaagaccttttctacgaacaagtccaattagatgataatggtaatgccaattttgacatttacttaactggaaaatttgctctaacagccatcaaggagcatcgaaggatctatcataccaatgacaaaaac

SEQ ID NO: 5958 - protein, 404 aa, Streptococcus pyogenes
MGKTIKITKRRTNMTIGIDKIGFATSQYVLKLEDLALARQVDPAKFSQGLLIESFSVAPITEDIITLAASAADQILTDEDRAKIDMVILATESSTDQSKASAIYVHHLVGIQPFARSFEVKQACYSATAALDYAKLHVASKPDSRVLVIASDIARYGVGSPGESTQGSGSIALLVTANPRILALNEDNVAQTRDIMDFWRPNYSFTPYVDGIYSTKQYLNCLETTWQAYQKRENLQLSDLAAVCFHIPFPKLALKGLNNIMDNTVPPEHREKLIEAFQASISYSKQIGNIYTGSLYLGLLSLLENSKVLQSGDKIGFFSYGSGAVSEFYSGQLVAGYDKMLMTNRQALLDQRTRLSVSKYEDLFYEQVQLDDNGNANFDIYLTGKFALTAIKEHRRIYHTNDKN

SEQ ID NO: 5959 - DNA, 1281 bp, Streptococcus agalactiae
atgacaaaaatttcctggacaggattttcaaaaaaatcccctgaagaacgtattcattaccttgaagaacaagattttttagctgattcttccctagaaatagtgacgaatcaggacttactctctttatcactagccaatcaaatggctgaaaatgtcatcggtcgaatagccttaccattttcacttgtcccagatgttttggttaacggtaaagtctatcaagtcccatatgtcactgaagaaccgtcagttgttgctgctgcaagttttgctgctaaaattataaaacgatctggtggttttctgacaaccgtccataatcgtaaaatgattggacaagtagccctttatgatgtacaagatagtcaacacactaaagaatctatattaaatcaaaaacagcaattattagaaatagccaacgctgctcatccatcaatagtcaagcgtggaggcggtgcttgcgacctaactattgagattaaagaagactttttgattgtttaccttatggttgatacaaaagaagccatgggtgctaatatggttaacaccatgatggaagcattatcttcgccattagaagacatttcaaaaggcaaaagcttaatgtcaattttatctaactatgctaccgaatctttagtgactgctacatgccgagttgatttaagatttctaagtcgccaaaaagaggaggccatcaagttagctcaaaaaatgacgatggcaagtcaattagctcaagtagacccttatcgtgctagcacacataataaaggtatttttaatggcattgatgctatcgtcttagctactggaaatgattggcgagctattgaagctggagcgcatacctatgctgtcaaagatgggcaatatcgaggattatctagatggtcttataaggttgatgataattgcctagaaggtactctgacgctaccgatgcctgttgcaacaaaaggtggatccattggtattaaccctagtgtccacctagctcacgatctactaggtcgtcctaatgctaaagagttggcaagtattattctttcgattggactagctcaaaattttgcggctcttaaggcattggttagcacaggaattcaagctggtcacatgaaacttcaagcaaagtcgttggcactacttgctggagctaaagaagaacaaatttcagaagtcgttaaacagcttctagactctaaacacatgaatctagagacagcacaaaaaattgtcaataaacttactaaaagtaaaaaaagaatt

SEQ ID NO: 5960 - protein, 427 aa, Streptococcus agalactiae
MTKISWTGFSKKSPEERIHYLEEQDFLADSSLEIVTNQDLLSLSLANQMAENVIGRIALPFSLVPDVLVNGKVYQVPYVTEEPSVVAAASFAAKIIKRSGGFLTTVHNRKMIGQVALYDVQDSQHTKESILNQKQQLLEIANAAHPSIVKRGGGACDLTIEIKEDFLIVYLMVDTKEAMGANMVNTMMEALSSPLEDISKGKSLMSILSNYATESLVTATCRVDLRFLSRQKEEAIKLAQKMTMASQLAQVDPYRASTHNKGIFNGIDAIVLATGNDWRAIEAGAHTYAVKDGQYRGLSRWSYKVDDNCLEGTLTLPMPVATKGGSIGINPSVHLAHDLLGRPNAKELASIILSIGLAQNFAALKALVSTGIQAGHMKLQAKSLALLAGAKEEQISEVVKQLLDSKHMNLETAQKIVNKLTKSKKRI

SEQ ID NO: 5961 - DNA, 1275 bp, Streptococcus pyogenes
atgacaaaaactaatcttaactggagcggtttttcaaagaaaacattcgaagaacgcctccaacttatcgaaaaatttaaactacttaatgctgaaaacttaaatcaactcaaaacagacgttcttttgcctatccaaacagctaatcaaatgactgaaaatgtcttaggacgattggctttgccctttagcatagctcctgattttcttgtcaacggttcaacttatcagatgccttttgtcacggaagaaccttctgttgttgctgcagcatctttcgcagcaaaactaatcaaacgctcaggtggttttaaagctcaaaccctaaaccgacaaatgattggtcaaattgttctttacgatatcgaccaaatagataacgctaaagccgccatccttcataaaacaaaaaagctaattgcattggcaaataaagcttatccttccattgttaaaagaggtggaggcgctagaaccattcatttggaagaaaaaggagaatttttgattttctatctgactgttgatacccaagaagctatgggagcaaatatggtcaatactatgatggaagctcttgttcctgatttaacaagactgtctaaggggcattgtctaatggcgattttatctaattacgcaacagagtcgcttgttactactagttgtgagattcccgtgcgccttttagatcacgataaaacaaaatccctacagttagctcaaaaaatagagctagccagccgactagctcaagtagatccttaccgggctactactcataataaaggtatttttaatggcattgatgcagtggtaatagccacaggaaatgactggcgtgctattgaagcaggggcccatgcttatgcctcaagaaatggtagctatcaaggacttagtcagtggcattttgaccaagataaacaagttctgcttggccaaatgaccctccctatgcctattgctagtaaggggggatctatcgggcttaaccctactgtttctatcgcacatgatcttcttaatcaacctgatgccaaaacattagcccaattgattgcatctgtggggttagctcaaaactttgctgcactaaaagctctgacctcatctggcatccaagctggtcacatgaaactacatgcgaaatcattagctcttttggcgggggcaacccaagacgaaattgctcctttagttaatgctttactagctgataaaccaataaatctagaaaaagcacatttttacttatcccagctaagacagtct

SEQ ID NO: 5962 - protein, 425 aa, Streptococcus pyogenes
MTKTNLNWSGFSKKTFEERLQLIEKFKLLNAENLNQLKTDVLLPIQTANQMTENVLGRLALPFSIAPDFLVNGSTYQMPFVTEEPSVVAAASFAAKLIKRSGGFKAQTLNRQMIGQIVLYDIDQIDNAKAAILHKTKKLIALANKAYPSIVKRGGGARTIHLEEKGEFLIFYLTVDTQEAMGANMVNTMMEALVPDLTRLSKGHCLMAILSNYATESLVTTSCEIPVRLLDHDKTKSLQLAQKIELASRLAQVDPYRATTHNKGIFNGIDAVVIATGNDWRAIEAGAHAYASRNGSYQGLSQWHFDQDKQVLLGQMTLPMPIASKGGSIGLNPTVSIAHDLLNQPDAKTLAQLIASVGLAQNFAALKALTSSGIQAGHMKLHAKSLALLAGATQDEIAPLVNALLADKPINLEKAHFYLSQLRQS

SEQ ID NO: 5963 - DNA, 447 bp, Streptococcus agalactiae
atgaataaaaatcaatacccaaaatgggaagaattacctgaactagatttgtatcttgaccaagtacttctctatgtgaatcaattaattaatcctaaaacaataactaacgataaactactcaccgcttcgatgatcaacaattatgtcaaacataattatatatccaaacctataaaaaaaaaatacaatcgccgtcaagtagcacgattgattgttattacagcttttaaacaagtttttgctattcaagaaatcagtcaaacattagaacttctgacagctgacaatcattctgaagaagcatataacggatttgctgcttgtatgaacaaagaagaggttcacgatttaccaccagttgtcattagtgcctgtcagacgttgaacctttatcaagaaacacaaaaattagttttagaactaggaggaaaaaataaaaatgct

SEQ ID NO: 5964 - protein, 149 aa, Streptococcus agalactiae
MNKNQYPKWEELPELDLYLDQVLLYVNQLINPKTITNDKLLTASMINNYVKHNYISKPIKKKYNRRQVARLIVITAFKQVFAIQEISQTLELLTADNHSEEAYNGFAACMNKEEVHDLPPVVISACQTLNLYQETQKLVLELGGKNKNA

SEQ ID NO: 5965 - DNA, 438 bp, Streptococcus pyogenes
atgatttttccatcattaccttattggaaggacctccctgatttagacttatatttggatcaagtgttactttatgtcaaccagtgcactgatttttcagaagtgtcagataataaatcactaacggcatctatgattaataattacgtcaagcatgggtatgtgactaaacctatcaagaaaaaataccaaaagcaacaactagcgcgcttaattgccatcagtttgtttaaaacggtatttcctattcaagatattagtcgcgtattggaggaacttcaggcacaggctgattctgaaagtctttacaatacttttgtaacctgttggaatcagaaggctcccattgaggaggacattccaccgattgtgcaggttgcctgtcaaacggtcaaagattaccacaaaactatttatttattacaggaggtgacccaa

SEQ ID NO: 5966 - protein, 146 aa, Streptococcus pyogenes
MIFPSLPYWKDLPDLDLYLDQVLLYVNQCTDFSEVSDNKSLTASMINNYVKHGYVTKPIKKKYQKQQLARLIAISLFKTVFPIQDISRVLEELQAQADSESLYNTFVTCWNQKAPIEEDIPPIVQVACQTVKDYHKTIYLLQEVTQ

SEQ ID NO: 5967 - DNA, 654 bp, Streptococcus agalactiae
atgcttaaagaaatgtctatcaaattaagtcctcaactttcctttggcgaagagcttgcaaatagtatcactcacgctgtaggagctttgcttatgctaatcctattaccaatcaccgctgtctatagtcacaaccacttcggattacaagcagcacttggtacctcaatattcgtcacttctttatttttgatgtttttatcatcaagtatttaccactccatgacttataacagtcttcaaaaatatgttctacgcatgattgatcactctatgatttatattgctattgcaggtagttatactcctgtcgcattgtcacttattggcggctggttaggatatctcatcatttttttacaatgggggattacattatttggtatcctttataaaatcttcgctcccaaaatcaatgataaatttagccttgtactttacctcattatgggatggctggttatctttattttccctgctattatcacaaaaactggaccagctttttggggattactcttggctggtggtatttgctatactatcggtgcactcttttatgctcgcaaacgtccttatgatcacatgatttggcacctttttattctattagcttctattttacaatacattggaattgtctacttcatgcta

SEQ ID NO: 5968 - protein, 218 aa, Streptococcus agalactiae
MLKEMSIKLSPQLSFGEELANSITHAVGALLMLILLPITAVYSHNHFGLQAALGTSIFVTSLFLMFLSSSIYHSMTYNSLQKYVLRMIDHSMIYIAIAGSYTPVALSLIGGWLGYLIIFLQWGITLFGILYKIFAPKINDKFSLVLYLIMGWLVIFIFPAIITKTGPAFWGLLLAGGICYTIGALFYARKRPYDHMIWHLFILLASILQYIGIVYFML

SEQ ID NO: 5969 - DNA, 648 bp, Streptococcus pyogenes
atgaaccaaacctttaaacaaagtttacccttatcttttagtgaggaagtagcaaacagcgtgacacacgctatcggagcatttgctatgctcattctacttcctatttcagccagctatgcttatcaaacttatgaccttaaagccgctattggtatctccatctttgtcatcagtctctttttgatgtttttgtcctctacgatttaccactccatggcttatggttcggttcacaaatacattctacgcattattgatcacagtatgatttatattgctatcgcaggaagttatacacctgttgccttatcccttgtttctggttggctaggctatatcattattgttttgcagtggggcattacgctttttgggattttatacaaaatttttgccaaacgtatcaatgaaaaattcagtttgatgctttatatcgttatgggctggctcgttgtgtttatcttgccagtcatcattcaaaaaactagtcttgcttttggtcttctcatgttatttggtggcttgtcttataccattggagcggtattttatgccaaaaaaagaccctacttccacatgatttggcatctctttattttattggcctctgccctccaatttatcgctatcactttctttatgctt

SEQ ID NO: 5970 - protein, 216 aa, Streptococcus pyogenes
MNQTFKQSLPLSFSEEVANSVTHAIGAFAMLILLPISASYAYQTYDLKAAIGISIFVISLFLMFLSSTIYHSMAYGSVHKYILRIIDHSMIYIAIAGSYTPVALSLVSGWLGYIIIVLQWGITLFGILYKIFAKRINEKFSLMLYIVMGWLVVFILPVIIQKTSLAFGLLMLFGGLSYTIGAVFYAKKRPYFHMIWHLFILLASALQFIAITFFML

SEQ ID NO: 5971 - DNA, 912 bp, Streptococcus agalactiae
atgaaaagtgcttatatcttttttaatccaaaatctggtaaagatgaacaagcattggcaaaagaagtaaaatcttatttaatagaacatgattttcaagacgattatgttcgtattattacaccttcatctgttgaggaagctgtcgccttagcaaaaaaagcatctgaagaccatatcgacttggttattcctttagggggagatggcactattaataaaatctgtggtggtgtctacgctggtggtgcttatcctactatcggactagtacctgccgggaccgtcaataacttttcaaaagctttgaacatcccgcaagagaggaatctcgctcttgaaaaccttctaaacggtcatgtaaagtccgtagatatctgtaaagttaatgacgattacatgattagcagtttaacacttggtctccttgctgatattgctgctaatgtcacttctgaaatgaagcgtaaattaggcccttttgctttcttaggtgatgcctaccgtatattaaagcgtaatcgatcatattctatcactcttgcttacgataataatgtacggtctttacgcacgcggttactccttattaccatgaccaattcgattgccggtatgccagccttctctccagaagcaacaattgatgatggactttttagagtctacactatggaacatattcacttcttcaaattattgttgcatctaagacaatttcgtaagggagattttagtcaagcaaaggagataaaacattttcataccaataatctgactatttcaacttttaaacgtaaaaaatcagctatccctaaagttcgtattgatggcgatccaggtgaccaattacctgtaaaagttgaagtcatccctaaagccttaaagtttatcattcctaactcattacca

SEQ ID NO: 5972 - protein, 304 aa, Streptococcus agalactiae
MKSAYIFFNPKSGKDEQALAKEVKSYLIEHDFQDDYVRIITPSSVEEAVALAKKASEDHIDLVIPLGGDGTINKICGGVYAGGAYPTIGLVPAGTVNNFSKALNIPQERNLALENLLNGHVKSVDICKVNDDYMISSLTLGLLADIAANVTSEMKRKLGPFAFLGDAYRILKRNRSYSITLAYDNNVRSLRTRLLLITMTNSIAGMPAFSPEATIDDGLFRVYTMEHIHFFKLLLHLRQFRKGDFSQAKEIKHFHTNNLTISTFKRKKSAIPKVRIDGDPGDQLPVKVEVIPKALKFIIPNSLP

SEQ ID NO: 5973 - DNA, 852 bp, Streptococcus agalactiae
atgacaacatttactgctaaatttattgaccaagagtgggaagtcccagtagaatcaggtcgctaccatatgattgttggggaattttgtccttatgcacaacgtccgcagattgcgcgccaactgcttggtttggataaacatatttctatcagttttgtggatgatgttccaagtgatataggacttatttttagccaaccagaacaggttactggtgctaagtcgcttcgtgatatttatcatttgactgacccgacctaccaaggtccttatactatcccaattttaattgacaagaccgataatcgtattgtctgtaaggaatctgcagatttgcttcgactttttactacagatttctctgatttgcatcaagaggatgctcctgtccttttcagccaagaaactgcttcacttattgataatgacattaaagacattaataagaacttccaaagcttaatgtataagttagcttttcttgataaacaagcagattatgatacttatagtaaggaattcttcacttttctagatcaaaaagaacacttactaggacaacgtcctttcttgctcggagataatctaagtgaggttgatattcatttctttacaccattagtccgatgggatattgctgggcgtgatcttctactacttaatcagaaagcgctagaagactacccaaatattttttcttgggctaaaactttatacaatgactttaatttaaaaacattaaccaatccacaatccataaaaaataactattacttaggcaaatttggaagagctgttcgtcatcataccatcgtcccaacaggtccaaatatggcaaaatgggaaaaa

SEQ ID NO: 5974 - protein, 284 aa, Streptococcus agalactiae
MTTFTAKFIDQEWEVPVESGRYHMIVGEFCPYAQRPQIARQLLGLDKHISISFVDDVPSDIGLIFSQPEQVTGAKSLRDIYHLTDPTYQGPYTIPILIDKTDNRIVCKESADLLRLFTTDFSDLHQEDAPVLFSQETASLIDNDIKDINKNFQSLMYKLAFLDKQADYDTYSKEFFTFLDQKEHLLGQRPFLLGDNLSEVDIHFFTPLVRWDIAGRDLLLLNQKALEDYPNIFSWAKTLYNDFNLKTLTNPQSIKNNYYLGKFGRAVRHHTIVPTGPNMAKWEK

SEQ ID NO: 5975 - DNA, 993 bp, Streptococcus agalactiae
atgacaaatcgaaaagatgatcacataaaatatgctcttaaatatcagtcgcattataatagttttgacgatattgagttaatacattcatccttaccaaaatataatgtcaacgatatcgatttatcaacacattttgctggtcaaagctttgaatttcctttttatatcaatgctatgacaggcggtagtgaaaaagggaaagcagtcaatcataaattggcacaggttgctcaagctacagggattgttatggtgacaggttcatattcggcagctctcaaaaacgatgaagatgattcctacccaacaacagacttgtatcctgatttaaaactggcgacaaatatagggttagacaagcctgtaccagcagcagagtcaaccgttaaggctatgaaccccatttttttacaagttcatgttaatgtgatgcaagaacttttgatgcctgaaggagagcgtgaatttcacatgtggcgttctcacttaaaagaatacgtcgacaatatccaatgcccacttattttaaaagaggttggttttgggatggatttacaatcaataaaggatgcttacgatataggtatcacaactgtagatatttcggggcgtggggggactagttttgcttacatcgaaaatcaacgtggacgcgaccgttcgtatctcaatacctgggggcaaacaacagctcaatccttaataaacgctcaatctatgatggacaaaatggatatcctagcatctggtggcattcgtcatcctttagatatggtaaaatgtttagtgttgggtgctaaagctgttggactttctagaacagttttagaattagttgagcgttatcctgtagatgatgttattgcaattctcaattcttggaaagaagatttaagaatgataatgtgtgcactgaattgtaaaaaaataactgatttacgacaagtcaattatatattgtatggtcaattgaaggaagccaatgctaaa

SEQ ID NO: 5976 - protein, 331 aa, Streptococcus agalactiae
MTNRKDDHIKYALKYQSHYNSFDDIELIHSSLPKYNVNDIDLSTHFAGQSFEFPFYINAMTGGSEKGKAVNHKLAQVAQATGIVMVTGSYSAALKNDEDDSYPTTDLYPDLKLATNIGLDKPVPAAESTVKAMNPIFLQVHVNVMQELLMPEGEREFHMWRSHLKEYVDNIQCPLILKEVGFGMDLQSIKDAYDIGITTVDISGRGGTSFAYIENQRGRDRSYLNTWGQTTAQSLINAQSMMDKMDILASGGIRHPLDMVKCLVLGAKAVGLSRTVLELVERYPVDDVIAILNSWKEDLRMIMCALNCKKITDLRQVNYILYGQLKEANAK

SEQ ID NO: 5977 - DNA, 1077 bp, Streptococcus pyogenes
ttgcctttaatcaggatgctagagatacccttatttccaaatggcaagaagctgatatcgcattactttatcaagaaaggtggggagagaatgactaaccgtaaagatgatcacatcaaatatgctctcaagtaccaatcgccttataatgcttttgatgacatagaactcatacaccattccttacctagctatgatttgtctgatattgatctcagtactcattttgctgggcaagacttcgactttcccttttacatcaatgccatgacaggaggaagtcaaaaaggcaaagctgtcaatgaaaaattggccaaagtagcagcagcaacagggattgtcatggtgacagggtcttatagcgctgctttaaaaaatcctaacgacgattcctatcgtttacatgaggtggcagataacttgaaactagccacgaatattggtctagataaacctgtggcgctaggacaacaaacggttcaagaaatgcagcccctctttttacaggttcatgtgaatgtgatgcaagagttgctgatgccagagggtgagcgcgtctttcatacctggaaaaaacacctcgctgaatacgctagtcaaataccagttcctgtcattctcaaagaagttggttttggcatggatgtcaatagtatcaagctagcacatgacctaggcattcaaacctttgatatttcaggtagaggaggaacttcatttgcttacattgaaaatcaaagagggggagaccgctcttacttaaacgattggggacaaaccactgttcagtgcttactgaatgcacaaggactgatggaccaagtggaaatcttagcttcgggtggtgtcagacaccccttggacatgattaagtgttttgtcttaggagcacgtgcagtgggactctcacgcaccgttttagaattggtcgaaaaatacccaaccgagcgtgtgattgctatcgttaatggctggaaagaagaattaaaaatcattatgtgtgctcttgactgtaaaactattaaagaattaaagggagtcgactacttactatatggacgcttgcagcaggtcaat

SEQ ID NO: 5978 - protein, 359 aa, Streptococcus pyogenes
LPLIRMLEIPLFPNGKKLISHYFIKKGGERMTNRKDDHIKYALKYQSPYNAFDDIELIHHSLPSYDLSDIDLSTHFAGQDFDFPFYINAMTGGSQKGKAVNEKLAKVAAATGIVMVTGSYSAALKNPNDDSYRLHEVADNLKLATNIGLDKPVALGQQTVQEMQPLFLQVHVNVMQELLMPEGERVFHTWKKHLAEYASQIPVPVILKEVGFGMDVNSIKLAHDLGIQTFDISGRGGTSFAYIENQRGGDRSYLNDWGQTTVQCLLNAQGLMDQVEILASGGVRHPLDMIKCFVLGARAVGLSRTVLELVEKYPTERVIAIVNGWKEELKIIMCALDCKTIKELKGVDYLLYGRLQQVN

SEQ ID NO: 5979 - DNA, 990 bp, Streptococcus agalactiae
atggttaaggtgcaaacaggtggcaaattatatattgcaggtgaatacgcgatactgtatcctgggcaagtagctattttaaagaacgttcctatttatatgactgcattagctacttttgcagataactacagcctttattctgatatgtttaactatacggcaagcttacagccagataagcaatatagtctcattcaggaaacgatattgcttatggaagaatggttgattaattttggcaaaaatataaaaccgattcacctcgaaattacgggaaaattagagcgctatggacttaaatttggtataggctctagcggaagtgttgtcgttttgactattaaagctatggctgcgctttatgagatagagatgccaagcgacttgctttttaaattatctgcctatgttctcttaaaaagaggtgataatggctcaatgggagatattgcttgtattgcttatgagcatttaatttcttattcagcttttgatcgtagggctgtttcaaaaatgattgaaacaaaacctttggaacaagtattggaagctgaatggggttatcgtattaccaaaatacaagctttattggagatggattttttagtgggatggacaatgcaaccgtccatttcaaaagaaatgataaatatagttaaatcaactattacgcagcgttttttagatgatacaaagtatcaagttgtccagttactttcagcctttaaagaaggagataaagaagcgattaagagatgtttagaagaaattagcttgctattatttaatcttcatccatctatttacaccgataaacttcaaaagcttaaagaggcaagcaaaggcctagatatagtcacaaaatcttcaggatctggaggaggcgattgtggtatagccatatcctttaataaaaatgataatcaaactctaatcaagcgttgggagagtgctggtattgaactacttagtaaggagacactgtca

SEQ ID NO: 5980 - protein, 330 aa, Streptococcus agalactiae
MVKVQTGGKLYIAGEYAILYPGQVAILKNVPIYMTALATFADNYSLYSDMFNYTASLQPDKQYSLIQETILLMEEWLINFGKNIKPIHLEITGKLERYGLKFGIGSSGSVVVLTIKAMAALYEIEMPSDLLFKLSAYVLLKRGDNGSMGDIACIAYEHLISYSAFDRRAVSKMIETKPLEQVLEAEWGYRITKIQALLEMDFLVGWTMQPSISKEMINIVKSTITQRFLDDTKYQVVQLLSAFKEGDKEAIKRCLEEISLLLFNLHPSIYTDKLQKLKEASKGLDIVTKSSGSGGGDCGIAISFNKNDNQTLIKRWESAGIELLSKETLS

SEQ ID NO: 5981 - DNA, 1053 bp, Streptococcus pyogenes
ttggcaagaactaccgtattatcgtttcaaaaacaaaggatttaccagatgtctaattattgtgtgcaaacaggtgggaaactatacctcacaggcgaatatgctatcttaacaccaggacaaaaagccttaattcactttattccattgatgatgacagcagaaattagcccagcagcccatattcaattagcttcagatatgttttcccataaagcgggcatgacacccgatgcctcttatgcactgattcaagcaacggttaaaacctttgctgattatctaggacagtcaattgaccaactggagccattttccctaattataacgggaaaaatggagcgcgatggcaaaaaatttggcattggttcaagtggtagcgtcaccctcttaaccttaaaggccttatcggcctattatcagattactttaaccccagagttactctttaaactagcggcttataccttgcttaagcaaggagataatgggtctatgggggatattgcctgtatcgcttatcagactttagtcgcctatacctcctttgaccgagaacaggtcagtaattggctgcagaccatgcccttaaaaaaacttctcgtcaaagattggggttaccatatccaagtcattcaaccagccctgccttgtgactttttggttggctggactaaaatacctgctatttcaaggcagatgattcaacaagtgacagcgagcattaccccagctttcttaagaacaagttaccagctaacgcaatcagctatggtagctttgcaagaaggtcataaggaagaactcaagaaaagtttagcaggagcaagtcatctcctaaaagagcttcatccagctatctaccatcctaagctagtaaccttggtagctgcttgtcagaagcaagatgctgttgctaaatcttcaggttctggtggtggagattgtggcatcgcgcttgcctttaatcaggatgctagagatacccttatttccaaatggcaagaagctgatatcgcattactttatcaagaaaggtggggagagaatgac

SEQ ID NO: 5982 - protein, 351 aa, Streptococcus pyogenes
LARTTVLSFQKQRIYQMSNYCVQTGGKLYLTGEYAILTPGQKALIHFIPLMMTAEISPAAHIQLASDMFSHKAGMTPDASYALIQATVKTFADYLGQSIDQLEPFSLIITGKMERDGKKFGIGSSGSVTLLTLKALSAYYQITLTPELLFKLAAYTLLKQGDNGSMGDIACIAYQTLVAYTSFDREQVSNWLQTMPLKKLLVKDWGYHIQVIQPALPCDFLVGWTKIPAISRQMIQQVTASITPAFLRTSYQLTQSAMVALQEGHKEELKKSLAGASHLLKELHPAIYHPKLVTLVAACQKQDAVAKSSGSGGGDCGIALAFNQDARDTLISKWQEADIALLYQERWGEND

SEQ ID NO: 5983 - DNA, 147 bp, Streptococcus agalactiae
ttgcaggcctttactaaggctgataaaccacttgatgacgatgataagcctgcagctgttggcatattattagttgtttcaatctttacaaagccggacctattttgtcgaaagcgatccaagatagctgacattttgtcatgttca

SEQ ID NO: 5984 - protein, 49 aa, Streptococcus agalactiae
MQAFTKADKPLDDDDKPAAVGILLVVSIFTKPDLFCRKRSKIADILSCS

SEQ ID NO: 5985 - DNA, 942 bp, Streptococcus agalactiae
atggacggaaaaagtataagtgttaagtcttatgctaacattgctattatcaaatattggggaaaagcagatgctgaaaaaatgattccagctaccagtagtatttctctaacacttgaaaacatgtacactgaaacacgtttgactgcccttgggaaggatgctaagaaagatgaattttacatctctggtgttcttcaaaatgatcatgaacatgacaaaatgtcagctatcttggatcgctttcgacaaaataggtccggctttgtaaagattgaaacaactaataatatgccaacagctgcaggcttatcatcgtcatcaagtggtttatcagccttagtaaaggcctgcaatgatttttttggtactaaccttagccaatcacagctagctcaagaagccaagtttgcttcaggctcctcttcacgctctttttttggacctgttgctgcttgggataaagatagtggtgatatctataaagttcacactaatttagatttagctatgattatgctggtcttaaatgacaaaagaaagccgatttcaagccgtgaaggtatgaaaatctgcaccgaaacttcaactacttttaatgaatgggtaaggcaatctgaacaagattatcaagatatgttagtatacctaaaaaataatgattttcaaaaggtaggtcaactgacagagcgtaatgcacttgcaatgcactcaacaactaaaacagcaactccagccttttcatatttgacagaagagacatataaagctatggatgttgtgaagaaacttcgcgaaaaaggtcatgaatgttattatacgatggatgcgggtccaaatgttaaagtactttgcttacgtcaagaccttgaggcattagctgctatcttggagaaagattatcgtattattgtttcaacgacaaaggaattagcagatggt

SEQ ID NO: 5986 - protein, 314 aa, Streptococcus agalactiae
MDGKSISVKSYANIAIIKYWGKADAEKMIPATSSISLTLENMYTETRLTALGKDAKKDEFYISGVLQNDHEHDKMSAILDRFRQNRSGFVKIETTNNMPTAAGLSSSSSGLSALVKACNDFFGTNLSQSQLAQEAKFASGSSSRSFFGPVAAWDKDSGDIYKVHTNLDLAMIMLVLNDKRKPISSREGMKICTETSTTFNEWVRQSEQDYQDMLVYLKNNDFQKVGQLTERNALAMHSTTKTATPAFSYLTEETYKAMDVVKKLREKGHECYYTMDAGPNVKVLCLRQDLEALAAILEKDYRIIVSTTKELADG

SEQ ID NO: 5987 - DNA, 942 bp, Streptococcus pyogenes
gtggatccaaatgttataaccgtaacatcctatgctaacattgctattatcaaatattggggaaaagagaatcaagctaagatgattccttcgacctctagcatttctttgactttggaaaacatgttcaccacaaccagcgtttccttcttaccagatactgcaaccagtgatcagttttacattaacggtatcttgcaaaatgacgaagaacataccaaaatttctgctatcattgaccaatttcgccaacctggtcaggcttttgtaaagatggaaactcaaaataatatgccaacagctgcaggtttatcatcaagttccagtggcttatcagccttggttaaagcctgtgaccaattatttgacacccagctagatcagaaagctttagctcaaaaggctaagttcgcctcaggatcatcttctcgttctttttttggcccagtcgctgcttgggacaaagatagtggtgctatttacaaggttgagactgacttgaaaatggccatgattatgctggtcttaaatgctgcgaaaaagccaatttctagccgagagggcatgaagttatgccgcgatacctcaactacatttgatcaatgggtagaacaatcggcaatcgattaccaacatatgcttacctatctcaaaactaataattttgagaaagttggtcagttaacagaagctaatgccttggccatgcatgccacgacaaagacagccaatcctcctttttcttacctaacaaaagagtcttaccaggctatggaggctgtgaaagaactgcgtcaagaaggttttgcttgttattttaccatggacgcaggtccaaatgtgaaggtcctatgtttagaaaaagacttggctcaactagcagaacgacttggcaagaactaccgtattatcgtttcaaaaacaaaggatttaccagatgtc

SEQ ID NO: 5988 - protein, 314 aa, Streptococcus pyogenes
VDPNVITVTSYANIAIIKYWGKENQAKMIPSTSSISLTLENMFTTTSVSFLPDTATSDQFYINGILQNDEEHTKISAIIDQFRQPGQAFVKMETQNNMPTAAGLSSSSSGLSALVKACDQLFDTQLDQKALAQKAKFASGSSSRSFFGPVAAWDKDSGAIYKVETDLKMAMIMLVLNAAKKPISSREGMKLCRDTSTTFDQWVEQSAIDYQHMLTYLKTNNFEKVGQLTEANALAMHATTKTANPPFSYLTKESYQAMEAVKELRQEGFACYFTMDAGPNVKVLCLEKDLAQLAERLGKNYRIIVSKTKDLPDV

SEQ ID NO: 5989 - DNA, 876 bp, Streptococcus agalactiae
atgaaagaaaagtttggtataggaaaggctcatagcaagattatcttgatgggtgagcactcagtagtatatggttatccagccattgctattcctttaaaaaatattgaagtaacttgccttattgaagaggctcctcaattaatagcattagatatgactgatcctttgtcgacagccatttttgctgccttggactatttaggtaaaacttcttctaaaattgcatatcatattgagtcacaagtcccagaaagacgtggtatgggatcatcagctgcagttgctattgcagctattcgtgcagtttttgattattttgatgaagatttggaggcagatttgttagaatgccttgttaatcgagcagaaatgatagcacattcaaatccgagtggattagatgcaaaaacttgtcttagtgaaaatactattaaatttatccgcaatattggtttttcaacagtacccatgcatttgaatgcttatttagttattgctgatacaggaattcatgggcatactaaagaagcagtggataaggtgaaatcatctggcgaggcagtactaccctttttaaaagaattaggttatttagcagaggcatcagaggatgctattcataaaagtgattccaaacaacttggtagcttgatgactaaagcacatcaaagtttaaaacaattgggtgtctcaagtttagaagctgatcatctggtagaggtagctattagttgtggtgctctaggcgctaaaatgagtggcggcggattaggtggttgtattatcgcacttgtaaaagaaaaaagagaagctgagcgcttaagtcagcaattagaaagagaaggagctgtcaacacatggacggaaaaagta

SEQ ID NO: 5990 - protein, 292 aa, Streptococcus agalactiae
MKEKFGIGKAHSKIILMGEHSVVYGYPAIAIPLKNIEVTCLIEEAPQLIALDMTDPLSTAIFAALDYLGKTSSKIAYHIESQVPERRGMGSSAAVAIAAIRAVFDYFDEDLEADLLECLVNRAEMIAHSNPSGLDAKTCLSENTIKFIRNIGFSTVPMHLNAYLVIADTGIHGHTKEAVDKVKSSGEAVLPFLKELGYLAEASEDAIHKSDSKQLGSLMTKAHQSLKQLGVSSLEADHLVEVAISCGALGAKMSGGGLGGCIIALVKEKREAERLSQQLEREGAVNTWTEKV

SEQ ID NO: 5991 - DNA, 891 bp, Streptococcus pyogenes
atgaaaagacaaaaaatgaacgaaaacattggatatggtaaggcacacagtaagatcattttgataggtgagcatgctgttgtgtatggctacccagctattgctttgcctttaacagatattgaggtggtttgtcatatttttccagctgataagccattggtctttgatttttatgatactctatcaacagccatttatgcttccttggattatttgcagcgactacaagaaccaattgcttatgagattgtttcacaagtgccacaaaagcgtggtatggggtcttcggcagccgtttctattgcagctattagagccgttttttcttattgtcaagaacccctctcggatgatttgttggaaattttagtcaacaaggcagaaattattgcccacaccaatcctagtggtttagatgccaagacatgccttagtgaccatgccattaagtttatccgaaacattggctttgaaactatcgaaatcgccttaaatggttatcttatcattgcagatacagggattcacggtcatacacgtgaggccgtcaataaggtagcacagtttgaggaaacgaatttgccctatctggctaaactaggagctttgacacaagcccttgaaagagcgattaaccaaaaaaataaggtggctatcggtcagctcatgacacaagcgcactctgctttaaaggccattggcgttagcatcagtaaagctgaccaacttgtggaggctgccctaagagcaggtgctttaggcgctaagatgacaggcggtggcttgggtggctgtatgattgccctagcagataccaaagacatggccgaaaaaatcagtcacagattaaaagaagaaggagccgtaaacacgtggatccaaatgtta

SEQ ID NO: 5992 - protein, 297 aa, Streptococcus pyogenes
MKRQKMNENIGYGKAHSKIILIGEHAVVYGYPAIALPLTDIEVVCHIFPADKPLVFDFYDTLSTAIYASLDYLQRLQEPIAYEIVSQVPQKRGMGSSAAVSIAAIRAVFSYCQEPLSDDLLEILVNKAEIIAHTNPSGLDAKTCLSDHAIKFIRNIGFETIEIALNGYLIIADTGIHGHTREAVNKVAQFEETNLPYLAKLGALTQALERAINQKNKVAIGQLMTQAHSALKAIGVSISKADQLVEAALRAGALGAKMTGGGLGGCMIALADTKDMAEKISHRLKEEGAVNTWIQML

SEQ ID NO: 5993 - DNA, 1227 bp, Streptococcus agalactiae
atgtttagaaatttacgacttcgttttatcggaatagctgcgctagctattcttgttgtcttattttcagtagtcggtgtcctcaactctgctaatcactatcaaacgaagaatgaaatttatcgtgtgttaactatccttgcagacaacaatggacgtataccgaataaacttgaatttagtaaagaattaggtgatgacctatcaacggacgctattttccaattccgttatttcagtgcgcgaacagatgcaaaaggtaacgtgactagttttgattctagaaatatctttgaagtaagcgataggcaaataaaaaattatgccaagcgtatcgtatcacaaaatagtcattcaggtcatatcacctataattttagtacttattcttatctactaaaaaaggttggtaaaaatgattatttagtggtatttttagatacaaccaaccaatatcttgataatcaaagattattgcaactttcaatatggatgtccttggtaagttttatcgtcttcatggtaattgtttcagttttatcagggagagttatcttaccatttgttgctaactatgaaaagcaaaggcgttttattaccaatgcaggacatgaactaaaaactccacttgctatcatctccgctaataatgaattggtggaaatgatgagtggtgaatcagagtggactaaatctacaaatgatcaaatccaacgtttaacgggtctaattaatggcatggtcagtcttgcccgctttgaagaacagcctgatataagtatggttgacttagacttttcacatattacaaaagatgctgcagaagattttaaaggtccaatcattaaagatggtaaagactttataatgagtatccaaccaggtattcatgtcaaagctgaagaaaaatcattatttgaattggttacattattggttgataatgctaataagtattgtgatcctatggggactgtgacagttaagttatcacgttcaagtcgtttgagacgagctaagcttgaagtttcaaatacttataagaatggtaaagacatagactatagcaagttttttgaacgattttatcgagaggatgagtcacataataacaaaaaatcgggatatggtattggtctttctatcgtaactagtttggtgcatctatttaaaggaagtatcgatgtgaattataaacatgataccattacctttgtcatttacatt

SEQ ID NO: 5994 - protein, 409 aa, Streptococcus agalactiae
MFRNLRLRFIGIAALAILVVLFSVVGVLNSANHYQTKNEIYRVLTILADNNGRIPNKLEFSKELGDDLSTDAIFQFRYFSARTDAKGNVTSFDSRNIFEVSDRQIKNYAKRIVSQNSHSGHITYNFSTYSYLLKKVGKNDYLVVFLDTTNQYLDNQRLLQLSIWMSLVSFIVFMVIVSVLSGRVILPFVANYEKQRRFITNAGHELKTPLAIISANNELVEMMSGESEWTKSTNDQIQRLTGLINGMVSLARFEEQPDISMVDLDFSHITKDAAEDFKGPIIKDGKDFIMSIQPGIHVKAEEKSLFELVTLLVDNANKYCDPMGTVTVKLSRSSRLRRAKLEVSNTYKNGKDIDYSKFFERFYREDESHNNKKSGYGIGLSIVTSLVHLFKGSIDVNYKHDTITFVIYI

SEQ ID NO: 5995 - DNA, 90 bp, Streptococcus agalactiae
ttgagacaaaaattgcaggcaattggtgctaacttggagattattggtcaagaaggtagtagctataaattaagtgaaataaatggtggc

SEQ ID NO: 5996 - protein, 30 aa, Streptococcus agalactiae
MRQKLQAIGANLEIIGQEGSSYKLSEINGG

SEQ ID NO: 5997 - DNA, 585 bp, Streptococcus agalactiae
  misc_feature (1)..(585): n = a, c, g, or t
gtggaacaaagaaggaataaaatgagagtattaattgcagaagatgaagaacagatgtcacgtgtccttagtacggcaattagtcaccaaggttatgttgttgatgtcgcctacgatggtcagactgctattgatttagctaatcaaaatgcatatgatgtcatggttatggatgtcatgatgcctgttaaaacaggtattgaggctgtcaaagaaattagacaatcaggaaataaatctcacattattatgctaacagccatggcagaaattgatgatagagtaacaggtctagatgctggtgcagatgattatttaacaaaacccttctctctaaaagaattattagcaaggcttcgctctatgtcccgaagattggaagatttcacacctaatgtattgtcattgggaagagtaaccttatcagtcggtgaacaagagttgcaatgtgaaaacactattcgtctagcgggtaaagaagctaaaatgttagcatttttcatgttgaaccatgataaagaattatctacacaacaacttttcgaacatgtctggggagcagataaggaccaagaagantgtaga

SEQ ID NO: 5998 - protein, 195 aa, Streptococcus agalactiae
  MISC_FEATURE (1)..(195): Xaa = Any Amino Acid
MEQRRNKMRVLIAEDEEQMSRVLSTAISHQGYVVDVAYDGQTAIDLANQNAYDVMVMDVMMPVKTGIEAVKEIRQSGNKSHIIMLTAMAEIDDRVTGLDAGADDYLTKPFSLKELLARLRSMSRRLEDFTPNVLSLGRVTLSVGEQELQCENTIRLAGKEAKMLAFFMLNHDKELSTQQLFEHVWGADKDQEXCR

SEQ ID NO: 5999 - DNA, 666 bp, Streptococcus pyogenes
atgaaaattttgttagctgaagacgaatggcagatgtctaatgttttgacaactgccatgactcatcaaggttatgacgttgatgtggtttttaacggtcaagaggcaattgataaagccaaagacaatgcatatgatattatgattttagatatcatgatgccgattaagtctggcattgaggctttaaaggagattcgcgcttcaggaaattgctcacatattattatgctgacggctatggcagaaattaatgaccgtgttaccggactagatgcgggagctgatgattatctgactaaacctttctcattaaaagaacttttagctagattaaggtcgatggaaagacgagtagaaagttttactcctcaggtattacaatttgctggtgtcacattaaatattaatgagcaagaattgagtgccggtaatgctatacgattagcttctaaagaaggtaaattaatggcctttttaatgttaaatcaaggaaagtacttggatactaaaacgctttaccaacatgtttggtcagaccaagaagattatgatacttctattgtttgggtttatatttcttatcttcgtcaaaaattattagctattcaagcaaatgtcattattgcaggtgataaagatactagctattgtttattagaaaaa

SEQ ID NO: 6000 - protein, 222 aa, Streptococcus pyogenes
MKILLAEDEWQMSNVLTTAMTHQGYDVDVVFNGQEAIDKAKDNAYDIMILDIMMPIKSGIEALKEIRASGNCSHIIMLTAMAEINDRVTGLDAGADDYLTKPFSLKELLARLRSMERRVESFTPQVLQFAGVTLNINEQELSAGNAIRLASKEGKLMAFLMLNQGKYLDTKTLYQHVWSDQEDYDTSIVWVYISYLRQKLLAIQANVIIAGDKDTSYCLLEK

SEQ ID NO: 6001 - DNA, 624 bp, Streptococcus agalactiae
atggaaacaaatatttatggagattatggtcgatatctaccattaattttagaagatttcagccagcgtatccaattagaaaatgataaagctaaggttgaaacaggctataaattgtacgaacatatcattggtcgtattaaaacgtcagatagtatgatagagaaatgtcgtcgcaaacagttacctgtaacggtagattctgcactaaaaacgattagagatagcattggagtccgtattatttgcggttttgttaacgacatttatcaaattatagaacgtattaaggcattcgatgattgtcgtattgtggttgaaaaagattatatccagcatgttaagccaaatgggtatcgttcttatcatgtgattttagaaattgataccccctatccagactgtttgggtaattcagacggtaaatattacattgaaattcagttgcgtaccattgcgcaagattcttgggctagtttagaacatcaaatgaaatacaagcatgatattgaaaatcccgaacgaattgtaagggaattaaaacgttgtgctgatgaaatggcatccgttgatttaacgatgcaaacgattcgtcaattgatagagagtggaacaaagaaggaa

SEQ ID NO: 6002 - protein, 208 aa, Streptococcus agalactiae
METNIYGDYGRYLPLILEDFSQRIQLENDKAKVETGYKLYEHIIGRIKTSDSMIEKCRRKQLPVTVDSALKTIRDSIGVRIICGFVNDIYQIIERIKAFDDCRIVVEKDYIQHVKPNGYRSYHVILEIDTPYPDCLGNSDGKYYIEIQLRTIAQDSWASLEHQMKYKHDIENPERIVRELKRCADEMASVDLTMQTIRQLIESGTKKE

SEQ ID NO: 6003 - DNA, 648 bp, Streptococcus pyogenes
atgaaagaaagactagaacattattctaccagctctatatatagcggatttgaagtgtacttgccgttggtactacagacaataacagatgtgattattgctgagaatatcaaaagcaaaaaagaaacggggtttaaactatacgaacactttacatcccgtattaaatcggaagcttcgatgattgaaaaatgtcaacgcaaacagcttcctctaacaagcaaatctgcgttaaaaatcattaaagatagtatcggtattcgcattatttgtggttttattgatgatatttatcggatggtagacttgctcaaaagcattcctggtatgtcagttaacactgaaaaagattatattttaaatgccaagcctaatggctatagatcatatcatctcattttggaattagaaacacattttccagatattttaggggaaaaaaaaggatgttattttatagaagtgcagttgcgaaccattgctcaagactcttgggctagcttggaacatcaaatgaagtacaaacatcaagttgctaatgcagaaatgattacaagagagttaaagcgttgtgcagacgagttggcatcttgtgatgttaccatgcaaaccattcgtcaattgattcaagaaacgacggaggaagag

SEQ ID NO: 6004 - protein, 216 aa, Streptococcus pyogenes
MKERLEHYSTSSIYSGFEVYLPLVLQTITDVIIAENIKSKKETGFKLYEHFTSRIKSEASMIEKCQRKQLPLTSKSALKIIKDSIGIRIICGFIDDIYRMVDLLKSIPGMSVNTEKDYILNAKPNGYRSYHLILELETHFPDILGEKKGCYFIEVQLRTIAQDSWASLEHQMKYKHQVANAEMITRELKRCADELASCDVTMQTIRQLIQETTEEE

SEQ ID NO: 6005 - DNA, 204 bp, Streptococcus agalactiae
atggaattttattataagacattaaaaagaaagtttatcaatgatgccgataccatatttattgagcagtctcaatttgaaatttttatatacattgaaacagatcataattctagtagttctcatgtcgttttagattatcaatcacaaaaagaatttgaaaaaataattactaattatcttaactttataactgcctttgct

SEQ ID NO: 6006 - protein, 68 aa, Streptococcus agalactiae
MEFYYKTLKRKFINDADTIFIEQSQFEIFIYIETDHNSSSSHVVLDYQSQKEFEKIITNYLNFITAFA

SEQ ID NO: 6007 - DNA, 213 bp, Streptococcus pyogenes
atgagtcgaaaaggtaatccatacgataatgcactcatggaggccttttataaaacattaaaaagagagcttgtcaatgatgctcatttcgcaactattaagcaagctcagcttgagatttttaaatatagtgagacttactataaccctaaacgtctgcattcagctttagggtatctctcacctgtagaatttgaaaaaatagttactcat

SEQ ID NO: 6008 - protein, 71 aa, Streptococcus pyogenes
MSRKGNPYDNALMEAFYKTLKRELVNDAHFATIKQAQLEIFKYSETYYNPKRLHSALGYLSPVEFEKIVTH

SEQ ID NO: 6009 - DNA, 2973 bp, Streptococcus agalactiae
gtgaaatataaaaactgttacagggaggttgatattatgtttcgtaaatataattttgaaaaaggtttaaagttttccattcgtaaattttcggttggagtagcttcagttgctataggatcattattattcatttctcctcaggtacttgcagatgagacaactagtgttacatctgcaacaactccaacaggtgtaacggccacagatgcaaacttggtcacttctaacaattcaactcctacttccactaataggagtgcaactagcactcaaggaagtaatttgagtaatacttcagaaatcattaagcctgcaactttagcagcaacatcaccaacaactgataatgtagccccatcagtagacaagaggacgtatgctactagtggcgattggacgttacaaaatccatatgctgacagtgttcgaaataaaaatatttctccaagtgttcgtgatgaatcatttaaaagtgctgaaacaacggtggttcgtgacgataactcaaccgtcaaagtgactgcgacaattactcctgtaccagggaatgatgaaggttctggtgttttaacaaatggtggtaatcagtcagaatataaagcaacatcagaaatgtttgttggaaatgtagatcctgcaaaaatacctgctttaggtgtctatacacaaccaggacgtactgaaggaggtagtaaactatctgataagctcaattttaatgggaaggcgccatcaactattttaacattgaaatttgacaaggcagttacagaccctattattgacttatctggtgttggaggtaatgcacatctatcatttacagaaactaccaatgaaaatggtaggattgttgaaaaaattgactatgcacgtggttcatataattcaacgttctttgagttaataactccaggtataagccttgaaaaagcaagttcaggagttaatttaacagttacagcgaatacggttgatgtaacagacaaaaacacctttaatgagtcagttgttaatccatctgacgcagactttgtcaatggtctagatagaacgcctgatgcagtcccagcgggaacaggttcaattcgtttaaaaggaacctttacagaggtttcatttaaattatatcatcaagctgttccatttacagcattttctaaagagaaatatcatacaggagatggatattataatagtactgcgaatattcgaccaactgtagttaaaccagatagtattaatggtttaaataagcacgcaagcgatgttattgatgataaaatttccgataataatgatatttcgaacgatgacttacttcgtttatctgttcgcttacaaaatccgcgtggatcagttgttgtaaattatattgatacagaaggcaatattattggtactgaatacaaagataccaccgatgcaattctaggaacacattacaatacggcagaatcatcaggagaccttagttcagacgcgacagttgagcgtcctttcactattactaaagatggtaaggtgtatgaattagtagcagaaaatattacagtaccagttggtaaggttaattcggatggtacgttggctacaaatggaggctcatttaattatggtactgatgcagcatctggagaagttgcagaaggtactaagtcagtaacttatgtttatagcattaaacaagaatcaaagggcaatgttcatgcccgctatgttattttagggacagagactgagcttgcaagtgttaaaacagttaaatcagaagctccaattgatgaagcatattcagatagagcacctgcaactcttgaaaaagatggtaagttgtatgaatttgtacatgtgcgtgataataagggcgatgctccagcagatggtaaggtgactgaacaagatcagaccattacatatgaatatgttgaagttcctaagggtcgtgtggttgtagattatgttatcgagggtactgctacaaaacttaaagatacctatgtcgataccccaacagcttatattcgtgataaagaaggccaagctactccttataatacagctgagaatgattctgagaaaccattgttacttgacaaagatggaataaaatatgaactagtttcaattcaagagggatcagcagcggagaaaggaacacttcgagaaggggaacaacatgttgtctatcaatatcgtaaagtggtagaggttccaagcgttaaagttggaaatgttcatgcccgctatgttattttagggacagagactgagcttgcaagtgttaaaacagttaaatcagaagctccaattgatgaagcatattcagatagagcacctgcaactcttgaaaaagatggtaagttgtatgaatttgtacatgtgcgtgataataagggcgatgctccagcagatggtaaggtgactgaacaagatcagaccattacatatgaatataagcttaagaaagatgaatcagaggctgtagggaatgtagtgattaactatgtggacgaaacaggtaatgttatcaaaaaaccaatactagatacacacgaatcaaaggttgggacaccatatgataccacagattataaattcgctgaaattaaatttaatggtaagatttataaactcgtttctgcaaaaactatgggaaatgaattcggaaaggtcactgaaggcacaacagaagtgacttatgtgtatcgagaatcagtaaaatctaccctaccaaaggaaatgggaatttctattccaagcgaatcagagtctcctaagtttatatctacccaaactacagaaaatagacctaacaaaggagtattaacttcatctaaaaaaccaaccaataaatctgttcttccaactacaggcgaggaaagtaatagaactctcggagttgttgggattactctagtagcaacaacagctactttggcagctagcagtttaaaacgacgtaaaaat

SEQ ID NO: 6010 - protein, 991 aa, Streptococcus agalactiae
MKYKNCYREVDIMFRKYNFEKGLKFSIRKFSVGVASVAIGSLLFISPQVLADETTSVTSATTPTGVTATDANLVTSNNSTPTSTNRSATSTQGSNLSNTSEIIKPATLAATSPTTDNVAPSVDKRTYATSGDWTLQNPYADSVRNKNISPSVRDESFKSAETTVVRDDNSTVKVTATITPVPGNDEGSGVLTNGGNQSEYKATSEMFVGNVDPAKIPALGVYTQPGRTEGGSKLSDKLNFNGKAPSTILTLKFDKAVTDPIIDLSGVGGNAHLSFTETTNENGRIVEKIDYARGSYNSTFFELITPGISLEKASSGVNLTVTANTVDVTDKNTFNESVVNPSDADFVNGLDRTPDAVPAGTGSIRLKGTFTEVSFKLYHQAVPFTAFSKEKYHTGDGYYNSTANIRPTVVKPDSINGLNKHASDVIDDKISDNNDISNDDLLRLSVRLQNPRGSVVVNYIDTEGNIIGTEYKDTTDAILGTHYNTAESSGDLSSDATVERPFTITKDGKVYELVAENITVPVGKVNSDGTLATNGGSFNYGTDAASGEVAEGTKSVTYVYSIKQESKGNVHARYVILGTETELASVKTVKSEAPIDEAYSDRAPATLEKDGKLYEFVHVRDNKGDAPADGKVTEQDQTITYEYVEVPKGRVVVDYVIEGTATKLKDTYVDTPTAYIRDKEGQATPYNTAENDSEKPLLLDKDGIKYELVSIQEGSAAEKGTLREGEQHVVYQYRKVVEVPSVKVGNVHARYVILGTETELASVKTVKSEAPIDEAYSDRAPATLEKDGKLYEFVHVRDNKGDAPADGKVTEQDQTITYEYKLKKDESEAVGNVVINYVDETGNVIKKPILDTHESKVGTPYDTTDYKFAEIKFNGKIYKLVSAKTMGNEFGKVTEGTTEVTYVYRESVKSTLPKEMGISIPSESESPKFISTQTTENRPNKGVLTSSKKPTNKSVLPTTGEESNRTLGVVGITLVATTATLAASSLKRRKN

SEQ ID NO: 6011 - DNA, 444 bp, Streptococcus agalactiae
atgattatggagaatcctcttcaaaaagcacgaatacttgttaatcaacttgaaaagtatttagatcattatgcaaaagaatatgatgttgaacatttagcgggtccacaaggacacctagtgatgtatctctataaacatcctgataaggatatgtctataaaagctgttgaagaaatcttacacatttctaagtctgtagcttctaatttggtaaaacggatggaaaaaaatggttttattgcgattgtaccatctaagacagataagcgtgtaaaatatctttatttgactcacttaggtaaaaaaaaggctacacaatttgaaattttcttagaaaaattgcatagtactatgttagcaggtattactaaagaagagattcgtaccaccaaaaaggttattaggacattagctaaaaatatggcaatggaaaatcttgat

SEQ ID NO: 6012 - protein, 148 aa, Streptococcus agalactiae
MIMENPLQKARILVNQLEKYLDHYAKEYDVEHLAGPQGHLVMYLYKHPDKDMSIKAVEEILHISKSVASNLVKRMEKNGFIAIVPSKTDKRVKYLYLTHLGKKKATQFEIFLEKLHSTMLAGITKEEIRTTKKVIRTLAKNMAMENLD

SEQ ID NO: 6013 - DNA, 207 bp, Streptococcus pyogenes
atgtcacaagtgataggtgatttacgtgaattgatacatcaaatcgaacaaattagtgatgagattgcaaaaaaatatgatgtagagcatctagcaggtcctcaaggttatgttcttgtttttttagctaaacaccaaaatcaagaaatatttgtcaaagatattgaaaaacaacttcgtatctttcaaagtcagttgctagtcatt

SEQ ID NO: 6014 - protein, 69 aa, Streptococcus pyogenes
MSQVIGDLRELIHQIEQISDEIAKKYDVEHLAGPQGYVLVFLAKHQNQEIFVKDIEKQLRIFQSQLLVI

SEQ ID NO: 6015 - DNA, 2070 bp, Streptococcus agalactiae
atgaaaaagaaaattattttgaaaagtagtgttcttggtttagtcgctgggacttctattatgttctcaagcgtgttcgcggaccaagtcggtgtccaagttataggcgtcaatgactttcatggtgcacttgacaatactggaacagcaaatatgcctgatggaaaagttgctaatgctggtactgctgctcaattagatgcttatatggatgacgctcaaaaagatttcaaacaaactaaccctaatggtgaaagcattagggttcaagcaggcgatatggttggagcaagtccagccaactctgggcttcttcaagatgaaccaactgtcaaaaattttaatgcaatgaatgttgagtatggcacattgggtaaccatgaatttgatgaagggttggcagaatataatcgtatcgttactggtaaagcccctgctccagattctaatattaataatattacgaaatcatacccacatgaagctgcaaaacaagaaattgtagtggcaaatgttattgataaagttaacaaacaaattccttacaattggaagccttacgctattaaaaatattcctgtaaataacaaaagtgtgaacgttggctttatcgggattgtcaccaaagacatcccaaaccttgtcttacgtaaaaattatgaacaatatgaatttttagatgaagctgaaacaatcgttaaatacgccaaagaattacaagctaaaaatgtcaaagctattgtagttctcgcacatgtacctgcaacaagtaaaaatgatattgctgaaggtgaagcagcagaaatgatgaaaaaagtcaatcaactcttccctgaaaatagcgtagatattgtctttgctggacacaatcatcaatatacaaatggtcttgttggtaaaactcgtattgtacaagcgctctctcaaggaaaagcctatgctgatgtacgtggtgtcttagatactgatacacaagatttcattgagaccccttcagctaaagtaattgcagttgctcctggtaaaaaaacaggtagtgccgatattcaagccattgttgaccaagctaatactatcgttaaacaagtaacagaagctaaaattggtactgccgaggtaagtgtcatgattacgcgttctgttgatcaagataatgttagtccggtaggcagcctcatcacagaggctcaactagcaattgctcgaaaaagctggccagatatcgattttgccatgacaaataatggtggcattcgtgctgacttactcatcaaaccagatggaacaatcacctggggagctgcacaagcagttcaaccttttggtaatatcttacaagtcgtcgaaattactggtagagatctttataaagcactcaacgaacaatacgaccaaaaacaaaatttcttccttcaaatagctggtctgcgatacacttacacagataataaagagggcggggaagaaacaccatttaaagttgtaaaagcttataaatcaaatggtgaggaaatcaatcctgatgcaaaatacaaattagttatcaatgactttttattcggtggtggtgatggctttgcaagcttcagaaatgccaaacttctaggagccattaaccccgatacagaggtatttatggcctatatcactgatttagaaaaagctggtaaaaaagtgagcgttccaaataataaacctaaaatctatgtcactatgaagatggttaatgaaactattacacaaaatgatggtacacatagcattattaagaaactttatttagatcgacaaggaaatattgtagcacaagagattgtatcagacactttaaaccaaacaaaatcaaaatctacaaaaatcaaccctgtaactacaattcacaaaaaacaattacaccaatttacagctattaaccctatgagaaattatggcaaaccatcaaactccactactgtaaaatcaaaacaattaccaaaaacaaactctgaatatggacaatcattccttatgtctgtctttggtgttggacttataggaattgctttaaatacaaagaaaaaacatatgaaa

SEQ ID NO: 6016 - protein, 690 aa, Streptococcus agalactiae
MKKKIILKSSVLGLVAGTSIMFSSVFADQVGVQVIGVNDFHGALDNTGTANMPDGKVANAGTAAQLDAYMDDAQKDFKQTNPNGESIRVQAGDMVGASPANSGLLQDEPTVKNFNAMNVEYGTLGNHEFDEGLAEYNRIVTGKAPAPDSNINNITKSYPHEAAKQEIVVANVIDKVNKQIPYNWKPYAIKNIPVNNKSVNVGFIGIVTKDIPNLVLRKNYEQYEFLDEAETIVKYAKELQAKNVKAIVVLAHVPATSKNDIAEGEAAEMMKKVNQLFPENSVDIVFAGHNHQYTNGLVGKTRIVQALSQGKAYADVRGVLDTDTQDFIETPSAKVIAVAPGKKTGSADIQAIVDQANTIVKQVTEAKIGTAEVSVMITRSVDQDNVSPVGSLITEAQLAIARKSWPDIDFAMTNNGGIRADLLIKPDGTITWGAAQAVQPFGNILQVVEITGRDLYKALNEQYDQKQNFFLQIAGLRYTYTDNKEGGEETPFKVVKAYKSNGEEINPDAKYKLVINDFLFGGGDGFASFRNAKLLGAINPDTEVFMAYITDLEKAGKKVSVPNNKPKIYVTMKMVNETITQNDGTHSIIKKLYLDRQGNIVAQEIVSDTLNQTKSKSTKINPVTTIHKKQLHQFTAINPMRNYGKPSNSTTVKSKQLPKTNSEYGQSFLMSVFGVGLIGIALNTKKKHMK

SEQ ID NO: 6017 - DNA, 408 bp, Streptococcus agalactiae
atgataaaaccaattgttagagatactttctttttacaacaaaaatcacaaatggctagtagagcagatgtgagcttagcaaaagatttacaggagactttgcatgctaatcaaaattattgtgtaggtatggcagcaaatatgattggtagtctgaagcgtgtcattatcatcaatgtgggtattacaaatttagtaatgtttaaccctgtagtagttgcaaaatcggatccatatgagacagaagaatcttgcctttctctcgtaggttgcagaagtacacaacgatattgtcacattacgatttcttatcgtgatatcaattggaaggaacagcaaatcaagttgacagattttccagctcaaatttgtcaacacgagttagatcatttggaaggcatattaata

SEQ ID NO: 6018 - protein, 136 aa, Streptococcus agalactiae
MIKPIVRDTFFLQQKSQMASRADVSLAKDLQETLHANQNYCVGMAANMIGSLKRVIIINVGITNLVMFNPVVVAKSDPYETEESCLSLVGCRSTQRYCHITISYRDINWKEQQIKLTDFPAQICQHELDHLEGILI

SEQ ID NO: 6019 - DNA, 408 bp, Streptococcus pyogenes
atgattagagaaatcataacagatcattttttattacagcaaaaagcgcaagtcgccaagaaagaagatctatggattggccaagatttacaagataccttagccttttatagacaggaatgtcttgggatggctgccaatatgattggtgaacaaaagcgcattgttattgtgagtatgggatttattgatttggttatgtttaatcctgtgatggtttctaaaaagggaatttaccaaactaaagaatcttgtttgtcgttatctggctatcgcaaaacacagcggtatgataagattactgttgagtatttggaccataattggcgaccaaagcgattaagcttaacaggcttaactgctcaaatatgccagcacgaattagatcatctagaaggtattttaatt

SEQ ID NO: 6020 - protein, 136 aa, Streptococcus pyogenes
MIREIITDHFLLQQKAQVAKKEDLWIGQDLQDTLAFYRQECLGMAANMIGEQKRIVIVSMGFIDLVMFNPVMVSKKGIYQTKESCLSLSGYRKTQRYDKITVEYLDHNWRPKRLSLTGLTAQICQHELDHLEGILI

SEQ ID NO: 6021 - DNA, 1347 bp, Streptococcus agalactiae
atgacaagcggaaagacatatgtagcaagtgttttagagaaagtgaagaagcaaaatgagcatgaggaagaatttctacaagcggttgaagaggtttttgagtcactagtaccagtttttgataaataccctcagtacattgaagaaaatcttttagaacgtttggttgagcctgagcgcgtgatttcttttagagttccatgggtagatgataaaggccaggttcaagttaaccgaggatatcgtgtacaattttcatcagctattggtccttataaaggtggtttacgttttcaccctacagtaacacaatctattgtcaaatttttaggatttgaacaaatttttaagaattcactgacaggtctaccaattggtggtggcaaaggagggtcaaactttgatccaaaagggaaatcagataatgaagtgatgcgtttcacacaaagttttatgactgaacttcaaaaatacattggaccagatttagatgtgccagctggcgatattggagtaggtggacgtgaaattggttatctttatggtcaatataagcgtttaaatggttatcaaaatggggttttaaccggaaaaggactgacttatggtggctctttggctcgtacagaagcaactggttatggggcagtctattttgctaaagaaatgctagcagcgcgtggtcaagatttaactggcaaagttgcactggtttcgggatctggtaacgtggctatttatgctactgaaaaattacaagagttgggtgcaactgttgtagctgtatcagattcttcaggttatgtttatgatccagacggtattgaccttgaaacattgaaacagataaaagaggttgaaagagcacgtattgttaaatatacggagaaacatccaaaagctaatttcacaccagcagatcaaggtagtatctggtctattaaagctgatttagctttcccgtgtgctactcaaaacgaattagacgaagaagacgctaagttattagttgaaaatggtgtcttggcagtaacagaaggagcaaatatgccatctaccttgggtgctattaaagttttccaaaaggcaggggttgcttttggtcctgctaaagctgccaatgcagggggagtagctgtttcagcgcttgaaatggcacaaaattctagtcgtagggcatggacttttgaagaagttgatcaagaattgcaacgtattatgaaaactatttttgtgaatgcttccgaagcggctgatgaatttggcgatagtggtaacctggttctaggtgctaacattgcaggctttttaaaagttgctcaagctatgtctgcacaaggtattgtt

SEQ ID NO: 6022 - protein, 449 aa, Streptococcus agalactiae
MTSGKTYVASVLEKVKKQNEHEEEFLQAVEEVFESLVPVFDKYPQYIEENLLERLVEPERVISFRVPWVDDKGQVQVNRGYRVQFSSAIGPYKGGLRFHPTVTQSIVKFLGFEQIFKNSLTGLPIGGGKGGSNFDPKGKSDNEVMRFTQSFMTELQKYIGPDLDVPAGDIGVGGREIGYLYGQYKRLNGYQNGVLTGKGLTYGGSLARTEATGYGAVYFAKEMLAARGQDLTGKVALVSGSGNVAIYATEKLQELGATVVAVSDSSGYVYDPDGIDLETLKQIKEVERARIVKYTEKHPKANFTPADQGSIWSIKADLAFPCATQNELDEEDAKLLVENGVLAVTEGANMPSTLGAIKVFQKAGVAFGPAKAANAGGVAVSALEMAQNSSRRAWTFEEVDQELQRIMKTIFVNASEAADEFGDSGNLVLGANIAGFLKVAQAMSAQGIV

SEQ ID NO: 6023 - DNA, 618 bp, Streptococcus agalactiae
ttgtcaactatttgctatggtatcattattaggagcaattttaaaggtaattatttgacttttactgactttcgttctataatgagacaaatatttgattggagtatctatatgaaatggttcccacttgttggaggtataattgccttattagctggcttctatctctttataaatcctgtaacggttgttgcaactctgggttggttcattgctttatttatctttatttatggcatttcaaatttagtacgctacttgcaagctgattcttatcaccgtagcccttggtatctggttcagagtatccttgctattatttttggtatcattttactatccagctcagcaatgtcactttcaaatactgtcatgactattttagcatactggctactggtatctggtattttacgacttttgggtggtttccaaatgcaaaaaattaatttcccaggtgccaaatcctataaacgttcggcttatattgcactcattttaggtattattttactggttcaacctaccttatcagcagccatcattggaagatttgtagcctttatattaatagcaattggagcttcggctatttacacttttactcgtattaattat

SEQ ID NO: 6024 - protein, 206 aa, Streptococcus agalactiae
MSTICYGIIIRSNFKGNYLTFTDFRSIMRQIFDWSIYMKWFPLVGGIIALLAGFYLFINPVTVVATLGWFIALFIFIYGISNLVRYLQADSYHRSPWYLVQSILAIIFGIILLSSSAMSLSNTVMTILAYWLLVSGILRLLGGFQMQKINFPGAKSYKRSAYIALILGIILLVQPTLSAAIIGRFVAFILIAIGASAIYTFTRINY

SEQ ID NO: 6025 - DNA, 1767 bp, Streptococcus agalactiae
atgagaaaaaaatctatttttttgagattatggtcttacctaactcgctacaaagctactcttttcttagcgatttttttgaaagttttatctagttttatgagtattctggagccttttattttagggttagcgataacagagttgactgctaaccttgttgatatggctaagggagtttctggggcagaattgaacgttccttatattgctggtattctgattatttattttttcagaggtgttttctatgaattaggttcttatggctcaaattattttatgactactgtcgttcaaaaaagtatccgtgatatccgtcatgatttgaatcgtaaaatcaataaagttcctgtatcgtattttgataagcaccaatttggagatatgttgggacgttttacaagtgatgttgaaacggtctcaaatgctttacaacagagctttttacagattatcaatgcttttttaagtattattctagtagtcgttatggtactttatctaaatgtaccattagccatgattatcattgcttgtattcctgtaacttattttagtgcacaagcgatactaaaaagatcccaaccttactttaaagaacaggcaaagattctgggagaactgaatggttttgtacaagagaaattaactggtttcaatatcataaaattatatggtagagaagaggcgtctagtcaagaatttcgtgatataacggataatctacgtcatgtaggtttcaaagctagcttcatttcaggaattatgatgccagtattgaatagtatctctgattttatttatcttatcattgcatttgttggcggtttacaagttattgctggtaccttaacaattggtaacatgcaggcatttgtgcagtatgtttggcaaattagtcaacccgttcaaaccattacacaattagcaggtgttttgcaaagtgcaaaatcttccttagaacgtatttttgaagtcttagatgaagaagaggaagccaatcaagtcactgaaaaattgagccatgacttaaccggtcaagtcagctttcatggtgtcgattttcactattctccggataagccacttatccgcgactttaacttagatgtagaaccagggcaaatgattgcaattgtagggccaacaggtgcaggtaagacaacacttataaacttactcatgagattctacgatgttagtgaaggtgctatcaccgtagatggtcacgatattagacacctatcacgccaagatttccggcaacaatttggcatggtgttgcaagatgcttggttatatgaaggtacaataaaagaaaatcttagattcggtaatcttgaagccagtgatgaggatatagttgctgctgccaaagctgcgaatgttgaccactttattcgaacgttacctggtggctacaatatggtgatgaatcaagaatcaagcaatatctccttaggacaaaagcaactgttgactattgcacgtgctttattagcagatcctaaaattttaattttagatgaagcgacttcatctgttgatacaaggttggaattgcttattcaaaaagctatgaaaaaattgatggaaggaagaactagttttgtcattgcacaccgtctatcaacgattcaagaggcagacaacattttagttctaaaggatggtcaaatcatcgaacaaggtaatcaccagaaactcctagcagataaaggattttattacgaattatataatagccaattttcaaatagtaaa

SEQ ID NO: 6026 - protein, 589 aa, Streptococcus agalactiae
MRKKSIFLRLWSYLTRYKATLFLAIFLKVLSSFMSILEPFILGLAITELTANLVDMAKGVSGAELNVPYIAGILIIYFFRGVFYELGSYGSNYFMTTVVQKSIRDIRHDLNRKINKVPVSYFDKHQFGDMLGRFTSDVETVSNALQQSFLQIINAFLSIILVVVMVLYLNVPLAMIIIACIPVTYFSAQAILKRSQPYFKEQAKILGELNGFVQEKLTGFNIIKLYGREEASSQEFRDITDNLRHVGFKASFISGIMMPVLNSISDFIYLIIAFVGGLQVIAGTLTIGNMQAFVQYVWQISQPVQTITQLAGVLQSAKSSLERIFEVLDEEEEANQVTEKLSHDLTGQVSFHGVDFHYSPDKPLIRDFNLDVEPGQMIAIVGPTGAGKTTLINLLMRFYDVSEGAITVDGHDIRHLSRQDFRQQFGMVLQDAWLYEGTIKENLRFGNLEASDEDIVAAAKAANVDHFIRTLPGGYNMVMNQESSNISLGQKQLLTIARALLADPKILILDEATSSVDTRLELLIQKAMKKLMEGRTSFVIAHRLSTIQEADNILVLKDGQIIEQGNHQKLLADKGFYYELYNSQFSNSK

SEQ ID NO: 6027 - DNA, 1737 bp, Streptococcus agalactiae
atggcatatatttggtcttatttgaaaaggtaccccaattggttatggcttgatttactaggagctatgctttttgtgacggttatcctaggaatgcccacagccttagcgggtatgattgataatggcgttacaaaaggtgatcggactggagtttatctgtggacgttcatcatgtttatatttgttgtactaggtattattgggcgtattacgatggcttacgcatctagtcgcttaacgacaacaatgattagagatatgcgtaatgatatgtatgctaagcttcaagaatactcccatcatgaatatgaacagataggtgtatcttcactagtgacacgtatgacaagcgatacttttgttttgatgcaatttgctgaaatgtctttacgtttaggcctagtaactcctatggtaatgatttttagcgtggttatgatactaattacgagtccatctttagcttggcttgtagcggttgcgatgcctcttttggtaggagttattttatatgtagctataaaaacaaaacctttatctgaaagacaacagactatgcttgataaaatcaatcaatatgttcgtgaaaatttaacagggttacgcgttgttagggcctttgcaagagagaattttcaatcacaaaaatttcaagtcgctaaccaacgttacacagatacttcaactggtctttttaaattaacagggctaacagaaccacttttcgttcaaattattattgcaatgattgtggctatcgtttggtttgctttggatcccttacaaagaggtgctattaaaataggggatttagttgcttttatcgaatatagcttccatgctctcttttcatttttgctatttgccaatctttttactatgtatcctcgtatggtggtatctagccatcgtattagagaggtaatggatatgccgatttctattaatcctaataccgaaggtgttacggatacgaaacttaaagggcatttagaatttgataatgtaacattcgcttatccaggagaaacagagagtcccgttttgcatgatatttcttttaaagctaagcctggagaaacaattgcttttattggttcaacaggttcaggaaaatcttctcttgttaatttgattccacgtttttatgatgtgacacttggaaaaatcttagtagatggagttgatgtaagagattataaccttaaatcacttcgccaaaagattggatttatcccccaaaaagctcttttatttacagggacaataggagagaatttaaaatatggaaaagctgatgctactattgatgatcttagacaagcggttgatatttctcaagctaaagagtttattgagagtcaccaagaagcctttgaaacgcatttagctgaaggtgggagcaatctttctgggggtcaaaaacaacggttatccattgctagggctgttgttaaagatccagatttatatatttttgatgattcattttctgctctcgattataagacagacgctactttaagagcgcgtctaaaagaagtaaccggtgattctacggttttgatagttgctcaaagggtgggtacgattatggatgctgatcagattattgtccttgatgaaggcgaaattgtcggtcgtggtacccacgctcaattaatagaaaataatgctatttatcgtgaaatcgctgagtcacaactgaagaaccaaaacttatcagaaggagag

SEQ ID NO: 6028 - protein, 579 aa, Streptococcus agalactiae
MAYIWSYLKRYPNWLWLDLLGAMLFVTVILGMPTALAGMIDNGVTKGDRTGVYLWTFIMFIFVVLGIIGRITMAYASSRLTTTMIRDMRNDMYAKLQEYSHHEYEQIGVSSLVTRMTSDTFVLMQFAEMSLRLGLVTPMVMIFSVVMILITSPSLAWLVAVAMPLLVGVILYVAIKTKPLSERQQTMLDKINQYVRENLTGLRVVRAFARENFQSQKFQVANQRYTDTSTGLFKLTGLTEPLFVQIIIAMIVAIVWFALDPLQRGAIKIGDLVAFIEYSFHALFSFLLFANLFTMYPRMVVSSHRIREVMDMPISINPNTEGVTDTKLKGHLEFDNVTFAYPGETESPVLHDISFKAKPGETIAFIGSTGSGKSSLVNLIPRFYDVTLGKILVDGVDVRDYNLKSLRQKIGFIPQKALLFTGTIGENLKYGKADATIDDLRQAVDISQAKEFIESHQEAFETHLAEGGSNLSGGQKQRLSIARAVVKDPDLYIFDDSFSALDYKTDATLRARLKEVTGDSTVLIVAQRVGTIMDADQIIVLDEGEIVGRGTHAQLIENNAIYREIAESQLKNQNLSEGE

SEQ ID NO: 6029 - DNA, 471 bp, Streptococcus agalactiae
atgattatccgtccgattattaaaaatgatgaccaagcagttgcacaattaattcgacaaagtttacgcgcctatgatttagataaacctgatacagcatattcagaccctcacttagatcatttgacctcatactacgaaaaaatagagaagtcaggattctttgtcattgaggagagagatgagattattggctgtggcggctttggtccgctgaaaaatctaattgcagagatgcagaaggtgtacattgcagaacgtttccgtggtaaggggcttgctactgatttagtgaaaatgattgaagtagaagctcgaaaaattgggtatagacaactttatttagagacagccagtactttgagtagggcaactgcggtttataagcatatgggatattgtgccttatcgcaaccaatagcaaatgatcaaggtcatacagctatggatatttggatgattaaagattta

SEQ ID NO: 6030 - protein, 157 aa, Streptococcus agalactiae
MIIRPIIKNDDQAVAQLIRQSLRAYDLDKPDTAYSDPHLDHLTSYYEKIEKSGFFVIEERDEIIGCGGFGPLKNLIAEMQKVYIAERFRGKGLATDLVKMIEVEARKIGYRQLYLETASTLSRATAVYKHMGYCALSQPIANDQGHTAMDIWMIKDL

SEQ ID NO: 6031 - DNA, 1866 bp, Streptococcus agalactiae
atgagcgattttttagtagatggattgactaagtcggttggtgataagacggtctttagtaatgtttcatttatcatccatagtttagaccgtattgggattattggtgtcaatggaactggaaagacaacactattagatgttatttcgggtgaattaggttttgatggtgatcgttcccctttttcatcagctaatgattataagattgcttatttaaaacaagaaccagactttgatgattctcagacaattttggacaccgtactttcttctgacttaagagagatggctttaattaaagaatatgaattattgcttaatcactacgaagaaagtaagcaatcacgtctagagaaagtaatggcagaaatggattctttagatgcttggtctattgagagcgaagtcaaaacagtattatccaaattaggtattactgatttgcagttgtcggttggtgaattatcaggaggattacgaagacgtgttcaattagcgcaagtattattaaatgatgcagatttattgctcttagacgaacctactaaccacttagatattgacactattgcatggttaacgaattttttgaaaaatagtaaaaagacagtgctttttataactcatgatcgttattttctagacaatgttgcaacacgtatttttgaattagataaggcacagattacagaatatcaaggcaattatcaggattatgtccgacttcgtgcagaacaagacgagcgtgatgctgctagtttacataaaaagaaacagctttataaacaggaactagcttggatgcgtactcagccacaagctcgtgcaacgaaacaacaggctcgtattaatcgttttcaaaatctaaaaaacgatttacaccaaacaagcgatacaagcgatttggaaatgacatttgaaacaagtcgaattgggaaaaaggttattaattttgaaaatgtctctttttcttacccagataaatctatcttgaaagactttaatttgttaattcaaaataaagaccgtattggcatcgttggagataatggtgttggaaagtcaaccttacttaatttaattgttcaagatttacagccggattcgggtaatgtctctattggtgaaacgatacgtgtaggttacttttcacaacaacttcataatatggatggctcaaaacgtgttattaattatttgcaagaggttgcagatgaggttaaaactagtgtcggtacaacaagtgtgacagaactattggaacaatttctctttccacgttcgacacatggaacacaaattgcaaaattatcaggtggtgagaaaaaaagactttaccttttaaaaatcctgattgaaaagcctaatgtgttactacttgatgagccgacaaatgacttagatattgctacattaactgttcttgaaaattttttacaaggctttggtggtcctgtgattacagttagtcacgatcgttactttttagataaagtggctaataaaattattgcgtttgaagataacgatatccgtgaattttttggtaattatactgattatttagatgaaaaagcatttaatgagcaaaataatgaagttatcagtaaaaaagagagtaccaagacaagtcgtgaaaagcaaagtcgtaaaagaatgtcttactttgaaaaacaagaatgggcgacaattgaagacgatattatgatattggaaaatactatcactcgtatagaaaatgatatgcaaacatgtggtagtgattttacaaggttatctgatttacaaaaggaattagatgcaaaaaatgaagcacttctagaaaagtatgaccgttatgagtaccttagtgagttagacaca

SEQ ID NO: 6032 - protein, 622 aa, Streptococcus agalactiae
MSDFLVDGLTKSVGDKTVFSNVSFIIHSLDRIGIIGVNGTGKTTLLDVISGELGFDGDRSPFSSANDYKIAYLKQEPDFDDSQTILDTVLSSDLREMALIKEYELLLNHYEESKQSRLEKVMAEMDSLDAWSIESEVKTVLSKLGITDLQLSVGELSGGLRRRVQLAQVLLNDADLLLLDEPTNHLDIDTIAWLTNFLKNSKKTVLFITHDRYFLDNVATRIFELDKAQITEYQGNYQDYVRLRAEQDERDAASLHKKKQLYKQELAWMRTQPQARATKQQARINRFQNLKNDLHQTSDTSDLEMTFETSRIGKKVINFENVSFSYPDKSILKDFNLLIQNKDRIGIVGDNGVGKSTLLNLIVQDLQPDSGNVSIGETIRVGYFSQQLHNMDGSKRVINYLQEVADEVKTSVGTTSVTELLEQFLFPRSTHGTQIAKLSGGEKKRLYLLKILIEKPNVLLLDEPTNDLDIATLTVLENFLQGFGGPVITVSHDRYFLDKVANKIIAFEDNDIREFFGNYTDYLDEKAFNEQNNEVISKKESTKTSREKQSRKRMSYFEKQEWATIEDDIMILENTITRIENDMQTCGSDFTRLSDLQKELDAKNEALLEKYDRYEYLSELDT

SEQ ID NO: 6033 - DNA, 1875 bp, Streptococcus pyogenes
atgagccattttttggtggagaaattaacaaaaacggtgggagataagaccgtctttcaagatatttcctttattattcatgactttgaccgtattgggattattggggttaatggaacaggaaaaacaactcttttagatgtgttgtcgggaaggcttggttttgacggagatcattcaccattttctaaagccaatgattacaaaatcgcttacttaacacaagaccctgaatttaacgatgcagcttctgttttagatacggtattatcagctgatgttaaagctattcaactgattcgtcagtacgaactattgatggcgaattatactgaggataaacaagaaagcttagagtccctcatgtctgaaatggatcgattagatgcttggtctattgaaagtgatgtcaaaacagtcctatcaaaattaggcatcacggatttggaacaaaaagtgggagacctatcaggtggtatgagaagacgtgtccagttagctcaagtgttgctaggagctgctgacttactcttgttggatgagccgaccaaccatctcgatattgacaccatcgcttggttaacaacctatctcaagacagctaaaaaaaccgtcctttttattacccatgaccgttatttccttgatcatgtggctacccgtatttttgaattggataaagcgggactgacagaatatcaaggcaattaccaagactatgtgcgcttaaaagcagaacaagacgaacgagatgctgctaatttacacaagaagaagcaactctataaacaagaattagcctggatgaggacgcaaccacaggcgcgtgcaaccaaacagcaggctagaatcaatcgtttcagtgacttgaaaaaagaagttcaccaagacagttctgcggataaattggagatgactttcgaaacgagccgaattgggaagaaggtgattcactttgaagacctttcttttgcttatggcgaccgacagttgattaaggattttaacttgattattcaaaataaagatcgtattggaattgttggagataacggcgtcggaaaatctaccctgttaaatatcattaacggtgatctcaaaccaacttctgggaagcttgatattggagatactattcgtgtaggttatttctctcagcagctcaaagatatggatgagaccaaacgggtcattaattaccttcaagaagtggctgatgaggttaaaacaagtgtgggaacaacgagtatcagtgagcttttagaacaatttctttttccgagatcaagtcatggcacgctgattgctaaattatctggtggggagaaaaaacggctctacttgctaaaactgctcattgaaaagccaaatgttcttctccttgatgagccaacaaatgatttagacattgccaccttgaaggtcttagaaaactttttagctaactttgcaggaccagtcattacggttagtcacgatcgttatttcctagacaaagtagctactaagattttagcctttgaagaaggcgatattcgtgttttttatggcaattacagtgattaccttgatgaaaaagtttttgaaaaagaaacagttgaggcagacttagctaaaacaacagtcactgaagaagtgccacttcctcaaaaagaggaaagaaagcgcatgtcctaccttgaaaaacaagaatgggctcagatagaagataaaatagcaactattgaggctaatattgaagaaattgaaaaccaaatgttaactgtagttagtgattatggccagttagctcaattacaaaaggaactcgatcagcgcaataatgatttattattggcgtatgaacggtttgagtatttgagtggactagacata

SEQ ID NO: 6034 - protein, 625 aa, Streptococcus pyogenes
MSHFLVEKLTKTVGDKTVFQDISFIIHDFDRIGIIGVNGTGKTTLLDVLSGRLGFDGDHSPFSKANDYKIAYLTQDPEFNDAASVLDTVLSADVKAIQLIRQYELLMANYTEDKQESLESLMSEMDRLDAWSIESDVKTVLSKLGITDLEQKVGDLSGGMRRRVQLAQVLLGAADLLLLDEPTNHLDIDTIAWLTTYLKTAKKTVLFITHDRYFLDHVATRIFELDKAGLTEYQGNYQDYVRLKAEQDERDAANLHKKKQLYKQELAWMRTQPQARATKQQARINRFSDLKKEVHQDSSADKLEMTFETSRIGKKVIHFEDLSFAYGDRQLIKDFNLIIQNKDRIGIVGDNGVGKSTLLNIINGDLKPTSGKLDIGDTIRVGYFSQQLKDMDETKRVINYLQEVADEVKTSVGTTSISELLEQFLFPRSSHGTLIAKLSGGEKKRLYLLKLLIEKPNVLLLDEPTNDLDIATLKVLENFLANFAGPVITVSHDRYFLDKVATKILAFEEGDIRVFYGNYSDYLDEKVFEKETVEADLAKTTVTEEVPLPQKEERKRMSYLEKQEWAQIEDKIATIEANIEEIENQMLTVVSDYGQLAQLQKELDQRNNDLLLAYERFEYLSGLDI

SEQ ID NO: 6035 - DNA, 1209 bp, Streptococcus agalactiae
atgatgagattaaattatttgccttctgagtttcagaaggctttaccaatattaaaaaagataaaaaaagccggttatgaagcatactttgtaggtggtagtgttcgggatgttttacttgaccgtccaattcatgatgttgatatagcaacgtcatcttatccagaagaaacaaagcagatttttaaaaggacagttgatgttggtattgaacatggaacagtcttagtattggaaaaaggtggtgaatatgagattaccacttttaggactgaggaggtttatgttgattataggcgtccgagtcaggtcaattttgttaggtcgctagaagaagatctaaaacgtcgagatttcacagttaatgcctttgctttaaatgaagatggagaagttattgatctctttcatggattggatgatttagataatcaccttcttagagcagtaggactcgccagtgagcgttttaatgaagatgctcttcgaattatgcgtggtttgcgtttttctgctagtctaaattttgatatcgaaacaacaacttttgaggcaatgaaaaagcacgcgtcattattggagaaaatatctgttgagcgttcttttattgaatttgataaacttctattagcaccttattggcgtaaaggaatgctggcactaatagatagtcatgcttttaattatctaccatgcttaaaaaatagggaattacaattaagcgcctttttgtcccagttagataaagattttttatttgagacatcagaacaagcttgggcatcactcatcttgagtatggaagttgaacacacaaagacttttttaaaaaaatggaagacatcaactcactttcaaaaagatgttgagcatatagtggatgtttatcgtattcgtgaacaaatgggattgactaaagaacatctttatcgttatggaaaaactataataaaacaagcggaaggtattcgcaaagcaagaggcttgatggttgatttcgaaaaaatagaacaactagatagtgagttagcaatccatgataggcatgagatagttgtcaatggtggcaccttaatcaagaaattaggaataaaacctggtccacagatgggagatattatctctcaaattgaattagccattgttttaggacaactgattaatgaagaagaggctattttacattttgttaagcagtacttgatggat

SEQ ID NO: 6036 - protein, 403 aa, Streptococcus agalactiae
MMRLNYLPSEFQKALPILKKIKKAGYEAYFVGGSVRDVLLDRPIHDVDIATSSYPEETKQIFKRTVDVGIEHGTVLVLEKGGEYEITTFRTEEVYVDYRRPSQVNFVRSLEEDLKRRDFTVNAFALNEDGEVIDLFHGLDDLDNHLLRAVGLASERFNEDALRIMRGLRFSASLNFDIETTTFEAMKKHASLLEKISVERSFIEFDKLLLAPYWRKGMLALIDSHAFNYLPCLKNRELQLSAFLSQLDKDFLFETSEQAWASLILSMEVEHTKTFLKKWKTSTHFQKDVEHIVDVYRIREQMGLTKEHLYRYGKTIIKQAEGIRKARGLMVDFEKIEQLDSELAIHDRHEIVVNGGTLIKKLGIKPGPQMGDIISQIELAIVLGQLINEEEAILHFVKQYLMD

SEQ ID NO: 6037 - DNA, 1206 bp, Streptococcus pyogenes
atgaaattaatgacaatgccttctgagtttcagaaggctttacccatattgactaaaataaaagaagctggttatgaagcctattttgtgggaggaagcgtcagagatgttttactcgagcgtcccattcatgatgtagatattgcaactagttcctatcctgaagagactaaagcgatttttaacagaactgtcgatgttggcattgaacatggtacagtgctcgtgcttgaaaatggcggtgagtatgaaattacaacctttaggacagaagatatctatgttgattatcgccgtcctagtcaggtttcttttgtgcgctctttagaggaagacttaaaacgaagagactttaccgtcaatgccttggccttggatgaaaatggtcaagttattgataaatttagaggactcattgatttaaagcaaaaacggttacgagcagtgggtaaagcagaggaacgttttgaagaagatgcactacgcattatgagaggctttcgatttgcggcgagtctggattttgacattgaagctataacttttgaagctatgaggagccattcacctctattggaaaagatttctgtggaacgttcttttactgaatttgataaattattgatggcaccgcactggcgaaaagggatttctgccatgattgcttgtcaggcttacgactatttaccaggcttgaagcagcaggaagcaggcttgaatcatctgatagtttctttgaaagataactttacctttagtgattatcaccaagcttgggcttatgtgatgattagtttagccattgaggatcctaaaagcttcctaaaagcatggaagacttcaaatgattttcagcgttatgtcacaaagttgattgctctttatagaattcgtcaggaaagatcttttgaaaaattggatatttaccagtacggcaagaaaatggcgagtctagtggaagacctccgaaaagctcaaagcttatccgttgacatggatcgtattaatactttagatcaggcactggttattcatgacaaacacgatatcgtccttaatggttctcacctgattaaggattttgggatgaaatcaggtcctcagctagggcttatgcttgagaaagttgaattagcgattgtagaggggcgcctagataatgatttcactacaattgaagcatttgttagagaggaattagcaaca

SEQ ID NO: 6038 - protein, 402 aa, Streptococcus pyogenes
MKLMTMPSEFQKALPILTKIKEAGYEAYFVGGSVRDVLLERPIHDVDIATSSYPEETKAIFNRTVDVGIEHGTVLVLENGGEYEITTFRTEDIYVDYRRPSQVSFVRSLEEDLKRRDFTVNALALDENGQVIDKFRGLIDLKQKRLRAVGKAEERFEEDALRIMRGFRFAASLDFDIEAITFEAMRSHSPLLEKISVERSFTEFDKLLMAPHWRKGISAMIACQAYDYLPGLKQQEAGLNHLIVSLKDNFTFSDYHQAWAYVMISLAIEDPKSFLKAWKTSNDFQRYVTKLIALYRIRQERSFEKLDIYQYGKKMASLVEDLRKAQSLSVDMDRINTLDQALVIHDKHDIVLNGSHLIKDFGMKSGPQLGLMLEKVELAIVEGRLDNDFTTIEAFVREELAT

SEQ ID NO: 6039 - DNA, 846 bp, Streptococcus agalactiae
atgaaattagcacttattacggatacctcagcttacttgcctgaggctatcgaaaatcatgaagatgtctatgttttagatattccaattatcattgatggtaaaacttatattgagggacaaaatctgacattagaccaatattatgataagctagcggcatcaaaagaattacctaaaacaagtcagcctagcttagctgaactagatgatctcttatgtcaattggagaaagaagggtatacacacgtccttggtttattcattgcagcggggatatcaggtttctggcagaatattcagtttcttattgaagaacatccaaatttgacaattgcttttccggatactaaaataacttcagcaccacagggcaatttagttagaaatgctttgatgtgttcacgtgaagggatggattttgatgtcatagttaacaagatacaatcacaaattgaaaaaattgaaggatttattgttgttaatgatttgaatcatctagtaaaaggtggtagattgtcaaacggttcagctatcattggtaaccttttaagtatcaagccggtcttacattttaatgaagaaggtaaaatcgttgtctatgagaaagtgcgtacagagaaaaaagccttaaaacgcttggctgagattgtcaaagaaatgacagcagatggtgaatatgatattgctattattcactctagagcacaagataaggcagaacaattatataatttgttagctaaagctggtcttaaagacgatttagaaattgtatcatttggtggcgttattgcaactcatcttggtgaaggtgcggttgcctttggtattacccccaaaaat

SEQ ID NO: 6040 - protein, 282 aa, Streptococcus agalactiae
MKLALITDTSAYLPEAIENHEDVYVLDIPIIIDGKTYIEGQNLTLDQYYDKLAASKELPKTSQPSLAELDDLLCQLEKEGYTHVLGLFIAAGISGFWQNIQFLIEEHPNLTIAFPDTKITSAPQGNLVRNALMCSREGMDFDVIVNKIQSQIEKIEGFIVVNDLNHLVKGGRLSNGSAIIGNLLSIKPVLHFNEEGKIVVYEKVRTEKKALKRLAEIVKEMTADGEYDIAIIHSRAQDKAEQLYNLLAKAGLKDDLEIVSFGGVIATHLGEGAVAFGITPKN

SEQ ID NO: 6041 - DNA, 846 bp, Streptococcus pyogenes
atgaaattagcagtaattactgacagtacagcaacactaccaacagatctgaaacaagataaagctatttttagccttgatataccagttatcattgacgatgagacctattttgaaggtcgaaatttgagtatagatgatttttatcaaaagatggctgactcccaaaatcttcccaagacaagtcagccaagtttatctgaactagataatcttttaggacttttatcttctaaaggttatacacatgttattggcttgttcttagctggaggaatctcaggcttttggcaaaatattcaatttttagctgaagaacatcctgagattgaaatggcatttccagacagtaagatcacatctgctcctttaggtagtatggtaaaaaatgtgctagattggtcacgtcaaggaatgacatttcaagctattttaaacaagctgcaagaacagattgatgggacgacagcctttattatggttgatgaccttaatcatctggttaaaggcggacgcctgtcaaatgggtctgctcttcttggaaatcttttgagtattaaacctattttacgctttgatgaagagggaaaaatcgttgtttatgaaaaagtgagaacagaaaagaaagccatgaaacgcttggttgagattttaaatgacttgatagcagacggtcagtataatgtgtttattattcactcaaaagcacaagacaaagctgattatttgaaacgactcttacaagacagtggttatcaatatgacattgaagaggttcattttggagcggtgattgctactcatttaggagaaggagccattgcatttggcgtaacaccgaggctt

SEQ ID NO: 6042 - protein, 282 aa, Streptococcus pyogenes
MKLAVITDSTATLPTDLKQDKAIFSLDIPVIIDDETYFEGRNLSIDDFYQKMADSQNLPKTSQPSLSELDNLLGLLSSKGYTHVIGLFLAGGISGFWQNIQFLAEEHPEIEMAFPDSKITSAPLGSMVKNVLDWSRQGMTFQAILNKLQEQIDGTTAFIMVDDLNHLVKGGRLSNGSALLGNLLSIKPILRFDEEGKIVVYEKVRTEKKAMKRLVEILNDLIADGQYNVFIIHSKAQDKADYLKRLLQDSGYQYDIEEVHFGAVIATHLGEGAIAFGVTPRL

SEQ ID NO: 6043 - DNA, 378 bp, Streptococcus agalactiae
atggaagtcattcgtgaacaagaatttgtcaatcaataccactatgatgcgcgcaatttagaatgggaagaggaaaatggtaccccaaaaacaaattttgaagttactttccaattagctaatagagatgaagcagcaaaagtaacgagcattgtagcagtgttacaatttgttattgtacgtgatgagtttgttatttctggtgtcatttcacaaatggctcatatccaagggcgccttatcaatgagcctagtgagtttagtcaagatgaagttgagaatctagcagctcctcttttagaaatcgttaaacgtctgacttatgaagttacagaaattgctttagatagaccaggagtaacattggagtttaatagt

SEQ ID NO: 6044 - protein, 126 aa, Streptococcus agalactiae
MEVIREQEFVNQYHYDARNLEWEEENGTPKTNFEVTFQLANRDEAAKVTSIVAVLQFVIVRDEFVISGVISQMAHIQGRLINEPSEFSQDEVENLAAPLLEIVKRLTYEVTEIALDRPGVTLEFNS

SEQ ID NO: 6045 - DNA, 378 bp, Streptococcus pyogenes
atgcaattagttcgtgaaaaagaatttgtcaaccagtaccattatgatgctagaaatttagagtgggaaaaagaaaacggaacaccagagaccaattttgaagtgacttttcagttgattgataaagatgagcagcaaaaagaaacagtaattgtatctgtattgcaatttgttattgtcaaagaagaatttgttattagtggggtcatctcacaaatggttcgtattttagatcgtttagtggataaaccaagcgaatttacgcaagaggaagttgaatccttagctgctcctttgctagatatggttaagcgattgacttatgaagtcacagaaattgccttggatcgtccaggtattcatttggagtttaaaaat

SEQ ID NO: 6046 - protein, 126 aa, Streptococcus pyogenes
MQLVREKEFVNQYHYDARNLEWEKENGTPETNFEVTFQLIDKDEQQKETVIVSVLQFVIVKEEFVISGVISQMVRILDRLVDKPSEFTQEEVESLAAPLLDMVKRLTYEVTEIALDRPGIHLEFKN

SEQ ID NO: 6047 - DNA, 531 bp, Streptococcus agalactiae
atgactatgaaaactattgaagaaatttacaaaaattatcctaatatcccctatatctcacctgaaagagacttggctgaaattaattttagtaaagttgttcctaggaaaaatatggaagaaactagtgaaggactcttgcctggagatattatcttattatggcgtatacagtttggaactttcacaactgaaacaagtttttcaaaatattttgaatacatttatggtataaatggaaaagaacacctagaatttttaataaaaaatggatttgtaagaatggagtcaccgcttgattctttagatcacttatctgctccacttttaaaactattcttaaaagaaaaaaacgtaaaaggcttgtcaaagatgaaacgctctgatttagatcaggcaatagctattgcttttacagaagaggaattagggaagttgtttgttgtcagagggttggcacttacagaaaaaggtttagcagccttgagtaacaatcaagaagtgattgatagacatcctaagaagaagttc

SEQ ID NO: 6048 - protein, 177 aa, Streptococcus agalactiae
MTMKTIEEIYKNYPNIPYISPERDLAEINFSKVVPRKNMEETSEGLLPGDIILLWRIQFGTFTTETSFSKYFEYIYGINGKEHLEFLIKNGFVRMESPLDSLDHLSAPLLKLFLKEKNVKGLSKMKRSDLDQAIAIAFTEEELGKLFVVRGLALTEKGLAALSNNQEVIDRHPKKKF

SEQ ID NO: 6049 - DNA, 333 bp, Streptococcus agalactiae
gtgttaagagctgtgttgatagctgccattggaatgtttacgagcaacatcaagaaacctgtaatcaaaacacctaacaatgggtatagaagaattgatttaataccttcaagcgattttgggagacctgaaagtaattttctaagtagtaggataactccaccagctaagaaaccacctactaaagcccctaagaaacctgatggcacacctgctaatgctaaggttgctttcccaccttctgcaaaaggtactttaccgaatgccagtccacttgatgcaattgaaccagctacgaagccagctactagtcctggtttttcagctattgaa

SEQ ID NO: 6050 - protein, 111 aa, Streptococcus agalactiae
MLRAVLIAAIGMFTSNIKKPVIKTPNNGYRRIDLIPSSDFGRPESNFLSSRITPPAKKPPTKAPKKPDGTPANAKVAFPPSAKGTLPNASPLDAIEPATKPATSPGFSAIE

SEQ ID NO: 6051 - DNA, 1962 bp, Streptococcus agalactiae
atgaaaatccaagacctactaaaaaaagaagttatgattatggatttaaaagcaaccagtaaagaggctgcaattgatgaaatgattacaaaattagttgacacaggtgttgtgacaaactttgctatttttaaagatggtatcatgaagcgtgaggcacaaacatcaactggattaggtgatggtatcgctatgccacatagtaaaaatgctgccgttaaagaagctactgtcctttttgcaaaatctgcatcaggtgttgattacgaagcacttgatggacagccaactgatttattctttatgattgctgcgccagatggtgctaatgatacgcatttagctgccttggcagaactatctaaatatcttttaaaagaagggttcgctgatcaattacgtcaagcaaaaacgccagatgacattattgctacttttgatagtaatagcatttctcaagaaacagtagctccacaaacagtacaatcaacaagtaaaggttcagattatattgttgcagtaacagcttgcactacgggaattgcccacacgtatatggcagaagaagctttaaagaaaaaagcagctgaaatgggtgtaggtattaaagttgaaacaaatggcgcttctggtgtaggaaataagttgacttcaagtgatattgcaagggctaagggtgttattattgcagcagataaggctgtagagatggatcgttttgatggcaaacctttggtatcacgtccggtagctgatggtattaaaaaaagtgaagacttaattaacattattctcgataataaggcacaaacctatcatgcaaaaaatcaaaatgataaacaatcaggtgaatctgatggaaaatcaggcttaggctctgctttttataaacaccttatgggtggtgtatcacaaatgttaccattcgttattggtggtggtattatgattgcgattgctttcctttttgataacatacttggtgtaccaaaagaccaattaagtaatttaggttcataccatgaaattgcagccttattcaaaaatatcggtggcgcagcatttgcatttatgttaccagtattggcaggttatatcgcttattcaatagctgaaaaaccaggactagtagctggcttcgtagctggttcaattgcatcaagtggactggcattcggtaaagtaccttttgcagaaggtgggaaagcaaccttagcattagcaggtgtgccatcaggtttcttaggggctttagtaggtggtttcttagctggtggagttatcctactacttagaaaattactttcaggtctcccaaaatcgcttgaaggtattaaatcaattcttctatacccattgttaggtgttttgattacaggtttcttgatgttgctcgtaaacattccaatggcagctatcaacacagctcttaacactttcttacaaggtttatctggtagttcagcagtcttgatgggcttactagttggtggtatgatggctgtagatatgggtgggcctgttaataaagcagcttatgtttttggtacaggtactcttgcagcaactgttgcaaatggcggctctgttgttatggcagctgtaatggctggaggaatggttccaccgttagcagtatttgtggcaactttattatttaaagataaatttaataatgaagaacgtcaatctggtctaacaaatatcgttatggggttatcttttatcactgaaggtgctattccgtttggtgctgctgacccagctcgtgcaatccctagctttattgtaggttcagccttaactggagcacttgttggtttagctggtatcaagttgatggctcctcatggagggatttttgtcatcgcattaacaagtaatcctttactttatattctatttattctaattggagcggtagtctcaggtgtactctttggcttgttccgtaaaataaaa

SEQ ID NO: 6052 - protein, 654 aa, Streptococcus agalactiae
MKIQDLLKKEVMIMDLKATSKEAAIDEMITKLVDTGVVTNFAIFKDGIMKREAQTSTGLGDGIAMPHSKNAAVKEATVLFAKSASGVDYEALDGQPTDLFFMIAAPDGANDTHLAALAELSKYLLKEGFADQLRQAKTPDDIIATFDSNSISQETVAPQTVQSTSKGSDYIVAVTACTTGIAHTYMAEEALKKKAAEMGVGIKVETNGASGVGNKLTSSDIARAKGVIIAADKAVEMDRFDGKPLVSRPVADGIKKSEDLINIILDNKAQTYHAKNQNDKQSGESDGKSGLGSAFYKHLMGGVSQMLPFVIGGGIMIAIAFLFDNILGVPKDQLSNLGSYHEIAALFKNIGGAAFAFMLPVLAGYIAYSIAEKPGLVAGFVAGSIASSGLAFGKVPFAEGGKATLALAGVPSGFLGALVGGFLAGGVILLLRKLLSGLPKSLEGIKSILLYPLLGVLITGFLMLLVNIPMAAINTALNTFLQGLSGSSAVLMGLLVGGMMAVDMGGPVNKAAYVFGTGTLAATVANGGSVVMAAVMAGGMVPPLAVFVATLLFKDKFNNEERQSGLTNIVMGLSFITEGAIPFGAADPARAIPSFIVGSALTGALVGLAGIKLMAPHGGIFVIALTSNPLLYILFILIGAVVSGVLFGLFRKIK

SEQ ID NO: 6053 - DNA, 1944 bp, Streptococcus pyogenes
atgaaaattcaagatttattgagaaaagatattatgattctcgatttacaggctatttctaaagaagttgccattgacgagatgattactaaattagttgaaaaagatattgtacatgattttgatgtctttaaaaagagtatcatgacacgtgaagaacaaacatcaacagggcttggtgatgggattgccatgcctcattctaaaaatattgtagtagataaaccagcggtcttgtttgcgaaatcaaataaaggtgtggattacaaggctttagatggtcaaccaacggatctcttctttatgattgctgcgcctcaaggagcaaatgatactcacttggctgcactagcagaattatcacaataccttttgaaagacggctttgctgataaacttcgtgctgcagcgacaccagaagcagtcattgctgtttttgatgaagcgtcaacagctaaagaagaagtggttgctccaacaagtggtcaagactttatcgttgctgttacagcttgtccgacaggaattgctcacacttatatggcagaagaggctttgaaaaaacaagctgcagaaatgggagtagctattaaagttgaaacaaacggtgcttctggtgtggctaatcgtttaaccgctgaagatattcagagagctaaaggagttattgttgcagctgataaagcggttgaaatggaccgttttgatggtaaacaattcattgctcgccctgttgcagatggtatcaagaaaagtcaggaattgatttctttgattttaaacaatgaaggaaacacttatcatgctaaaaatggaaaatctgaaacagcagtatcaactgagaaaacaagtttaggcggtgctttctataaacacttgatgggcggtgtctcacaaatgttgccatttgttattggtggcgggattatgattgctctagcatttttattggataacatgcttggtgtgccaaatgatcagcttggaagtcttggatcctatcatgaaatagcagctatttttatgaacattggtggagcagccttttccttcatgttaccagtactagcaggttatatcgcttattctattgctgaaaaaccgggcttagtagctggttttgtggcaggtgccattgcctcaaatggtcttgcttttggtaaggtaccatttgcagcaggaggagaagtgagcttgggcttaacgggcgtgccatcaggtttccttggggcgcttgtgggtggtttccttgccggtggtgttattcttgcccttcgtaaattgttggcaggcctaccacgttctctagaaggggttaaatctatcctcctttacccattacttggcgtccttgtcactggtttcttgatgctttttgtcaatattccaatggcagctattaacacagcccttaatgatttcttacaaggtctttcaggaagctctgctgtccttatgggacttcttgttggtggaatgatggctgttgacatgggtggtcctgttaataaggcagcttatgtttttggtacaggaactttagcagctactgtggcaaatggtggttcggtcgttatggccgctgttatggcaggtggtatggtacctcctcttgctgtttttgtagccactctcttgtttaaagataaatttaccaaagaagaacgtgaatcaggcttgacaaatattgttatgggactttcattcatcaccgaaggagcaattccgtttggtgcagctgacccagcacgtgcgattcctagctttatcgcaggttctgccttgacaggagctcttgttggtttggctggtattaaattaatggcgccacatggtggtatcttcgtaatcgctttaacaagcaatccaatcttatatcttgtctttgttgtgattggtgcccttgtatcaggtatcttatttggcgctcttcgcaaaaaagcc

SEQ ID NO: 6054 - protein, 648 aa, Streptococcus pyogenes
MKIQDLLRKDIMILDLQAISKEVAIDEMITKLVEKDIVHDFDVFKKSIMTREEQTSTGLGDGIAMPHSKNIVVDKPAVLFAKSNKGVDYKALDGQPTDLFFMIAAPQGANDTHLAALAELSQYLLKDGFADKLRAAATPEAVIAVFDEASTAKEEVVAPTSGQDFIVAVTACPTGIAHTYMAEEALKKQAAEMGVAIKVETNGASGVANRLTAEDIQRAKGVIVAADKAVEMDRFDGKQFIARPVADGIKKSQELISLILNNEGNTYHAKNGKSETAVSTEKTSLGGAFYKHLMGGVSQMLPFVIGGGIMIALAFLLDNMLGVPNDQLGSLGSYHEIAAIFMNIGGAAFSFMLPVLAGYIAYSIAEKPGLVAGFVAGAIASNGLAFGKVPFAAGGEVSLGLTGVPSGFLGALVGGFLAGGVILALRKLLAGLPRSLEGVKSILLYPLLGVLVTGFLMLFVNIPMAAINTALNDFLQGLSGSSAVLMGLLVGGMMAVDMGGPVNKAAYVFGTGTLAATVANGGSVVMAAVMAGGMVPPLAVFVATLLFKDKFTKEERESGLTNIVMGLSFITEGAIPFGAADPARAIPSFIAGSALTGALVGLAGIKLMAPHGGIFVIALTSNPILYLVFVVIGALVSGILFGALRKKA

SEQ ID NO: 6055 - DNA, 909 bp, Streptococcus agalactiae
atgatttatacagtaacattaaatccatcgattgattttattgttcgtctagatacactattgttgggtagtgttaaccgtatgactagcgatgataaatatgtaggtggtaaaggaattaatgttagtcgcatattaaaacgcttaaaaattgacaatactgctacaggttttatcggtggatttacaggacattttgttgaagatggacttgtattagaaggtatcaaaactgactttgtttctgttaatgaagatacacgtatcaacgttaaagtaaaagcaaaaattgaaactgaaatcaatggcgggggtcctaggataacaaatgaacaacttcatcgtctagagaaacttctttcgagactaacacctgaggacacagtagttttcgcaggttcagcaccagctagccttggaaataaggtctataatacattgattccaattgctaaaaagacaggagcggaagttgtttgcgattttgaaggtcagacacttttagacgctcttgcttatcagcctcttttagtaaaaccgaataaccatgaattagcagatatttttggcgtagagctagaaggtctgcctgatatcgaaaaatatgcacataagattctagataaaggagctaagaatgttatcgtttctatggcaggggatggtgcattgttagtaactccagaagcttcatattttgcaaaaccgattaagggtgaagtgaaaaattccgttggggctggtgattcaatggtagctggctttacaggagaatttgttaagtcaaaaaatccagtagaagcactaaaatggggcgtagcttgtggtacagcaaccactttctcagatgatttagcaacagctgagtttatccaagatatttataataaagttgaggtagaaaaatta

SEQ ID NO: 6056 - protein, 303 aa, Streptococcus agalactiae
MIYTVTLNPSIDFIVRLDTLLLGSVNRMTSDDKYVGGKGINVSRILKRLKIDNTATGFIGGFTGHFVEDGLVLEGIKTDFVSVNEDTRINVKVKAKIETEINGGGPRITNEQLHRLEKLLSRLTPEDTVVFAGSAPASLGNKVYNTLIPIAKKTGAEVVCDFEGQTLLDALAYQPLLVKPNNHELADIFGVELEGLPDIEKYAHKILDKGAKNVIVSMAGDGALLVTPEASYFAKPIKGEVKNSVGAGDSMVAGFTGEFVKSKNPVEALKWGVACGTATTFSDDLATAEFIQDIYNKVEVEKL

SEQ ID NO: 6057 - DNA, 909 bp, Streptococcus pyogenes
atgatttataccgtgaccttaaacccttctattgactttattgtcagaattgaccaaataaatcttgggtcagtgaatcgcatggcgagtgatgataagtttgctggaggtaaaggcattaatgtgagtcgcatcttgcaacgtttagacattgctagcacggcgacagggttcttgggtggttttacaggacgttttatcgaagaaagtttgagtgcagaaggcgttaaaactgattttgtaaaaggtgatcaagatactcgaatcaatgttaaaatcaagtcacaagaagagaccgaattaaatggtcaaggacctatcattagtcaggaacaactggaggatttgaaaactaagctttcccagctaacagcagaggatacagttgtctttgcaggttcagcgccagctaatcttggcaatgctgtttataaggaattacttcctttagttaggcaaagcggtgctcaggtggtttgtgattttgaaggacagactttaatagatgcgcttgcatataatcctctgttggttaaacctaataatcatgaactagaagctatttttggtacgattctgaccagtcttgatgatgttgaaacctatgcccgtcgtcttttagagatgggtgctcaaaacgtcatcatttcaatggctggtgatggtgctttgctggttactaaagaagcgacttattttgctaaaccgattaagggagaagttaaaaattctgtcggtgctggtgattcgatggttgctggctttacaggcgaatttatgaagagtcaaaatccaatagaagccttaaaatggggcgtggcttgtggtacagcgacggctttctctgatgacttggcgacaattgcatttattaaggaaacatatcataaagttgaggtagaaaaacga

SEQ ID NO: 6058 - protein, 303 aa, Streptococcus pyogenes
MIYTVTLNPSIDFIVRIDQINLGSVNRMASDDKFAGGKGINVSRILQRLDIASTATGFLGGFTGRFIEESLSAEGVKTDFVKGDQDTRINVKIKSQEETELNGQGPIISQEQLEDLKTKLSQLTAEDTVVFAGSAPANLGNAVYKELLPLVRQSGAQVVCDFEGQTLIDALAYNPLLVKPNNHELEAIFGTILTSLDDVETYARRLLEMGAQNVIISMAGDGALLVTKEATYFAKPIKGEVKNSVGAGDSMVAGFTGEFMKSQNPIEALKWGVACGTATAFSDDLATIAFIKETYHKVEVEKR

SEQ ID NO: 6059 - DNA, 807 bp, Streptococcus agalactiae
atgcttgacattgaaagaaaaagagatataattaaattgcaaacgatttcaattcaaggagggactatgctaaagtcaaagagaaaagaaattatcttatcacgacttgagcaaaataagagtgttactttagatgaattaacgtctatcttagagacttctgaatctacagttcgcagggatttagatgaacttgaatctgcaggttttttaaaaagggtgcatggtggtgctgaattaccatactcacttggccaggaattaagtaatcaagaaaaagctatcaaaaacgttcaaaaaaaattggatattgctagacaaactgcaaagctgatagcaaagcaagatgttatatttattgatgccggaactacgacagaattattaattgattttctccctcacgagcaattaacggtggtgacgaattctattcatcatgctgcaaagttagttgatagagggataaaaacaatcattatcggaggagcggttaaacattcaacagatgctagtattggccaggtagccattaatcagattaggcagataacggttgacaaagcttttctggggatgaatggtatagatgaagtttatttaactacaccagatttagaagaagctgctattaaagaagctattattaataatagtcaacaaacctttattctaatggattcatctaaaattggacaagttacatttgctaaagtgaaagagataaatgacattaatttagtaactaataagactgattcagaacttatgacaataataaaagagaaaatgaaggtgattcaagta

SEQ ID NO: 6060 - protein, 269 aa, Streptococcus agalactiae
MLDIERKRDIIKLQTISIQGGTMLKSKRKEIILSRLEQNKSVTLDELTSILETSESTVRRDLDELESAGFLKRVHGGAELPYSLGQELSNQEKAIKNVQKKLDIARQTAKLIAKQDVIFIDAGTTTELLIDFLPHEQLTVVTNSIHHAAKLVDRGIKTIIIGGAVKHSTDASIGQVAINQIRQITVDKAFLGMNGIDEVYLTTPDLEEAAIKEAIINNSQQTFILMDSSKIGQVTFAKVKEINDINLVTNKTDSELMTIIKEKMKVIQV

SEQ ID NO: 6061 - DNA, 711 bp, Streptococcus pyogenes
atggcaaagatcactgaagaaaactatgtttctttagaggatttaatgcaattactcaactcctctgagtctactatccgtagagatctaggagagttggagcaagaaggacggctacatcgtgttcatggaggtgctgaactttttcactctttacaagaggaactttcgaaccaagaaaagtctgtcaaaaacagtcatattaaaaaagctattgcgcaaagagcctctcagcttatctatgacaacgatgtgatctttattgatgctgggacaacgactgaatttttattaccttttttacaagctaaaaatttaactgtagttactaattctattcatcatgctgctagattagttgaactctctattgagacgattattgtagggggttatgtcaaacaaacgaccgatgccagtattggtaacgtagctttggaacagattaggcagatgaattttgacaaggcatttcttggaatgaatggtgttgatgattcttacctgacgactcctgatatggaagaagcagttattaaaaaagcggttctgtcaaatgcaaaattagcttacattttagtagatggcactaaaattggtcaggtatcgtttgtaaaagtagctcctattaatgatgtgactattattacattaggaggatcagcaagtattcttaaacaaataaaggaaaaggcaaaggtgattgaatta

SEQ ID NO: 6062 - protein, 237 aa, Streptococcus pyogenes
MAKITEENYVSLEDLMQLLNSSESTIRRDLGELEQEGRLHRVHGGAELFHSLQEELSNQEKSVKNSHIKKAIAQRASQLIYDNDVIFIDAGTTTEFLLPFLQAKNLTVVTNSIHHAARLVELSIETIIVGGYVKQTTDASIGNVALEQIRQMNFDKAFLGMNGVDDSYLTTPDMEEAVIKKAVLSNAKLAYILVDGTKIGQVSFVKVAPINDVTIITLGGSASILKQIKEKAKVIEL

SEQ ID NO: 6063 - DNA, 1233 bp, Streptococcus agalactiae
atgacgcttcgagaattaacaatagaagaatttaaagaacattcaggaaattatgattcacaatcatttttacaaacacctgagatggctaaacttttagaaaaacgcggctatgatgttaggtatttgggatatcaagtagaaaataaactagagataatcagtttatcttatattatgccagtcactggtggttttcaaatgaaaattgattcaggaccagttcattcaaattctaagtatctaaaacaattttataaagcattgcaaggctatgccaaatccaacggtgttctagaattaatagttgagccttatgatgattaccaattattcactagttcgggagttcctagtaatcagggaaatgataatctgattgaagattttaccagttcaggttatcaccatgatggtttaacaactggttttactggtaaatatttatcttggcactatgttaaaaatttagaaggtgtcacttctgaaacgttactatcttcattctctaagacaggacgagctttggttaagaaagcaatgtcttttggaatcaaggttcgcgttcttaaacgtgatgagctacatttatttaaagagataacaacttctacgtcaaatagacgtgattatatggataagtccttagattattatcaagatttttacgatagctttgaaggcaaggctgaatttgtgattgccactttaaattttagagaatacgaccataacttgcaaataaaagctgaagcattggaaaataagcttaaattgcttgatgaacgttttagggaaaatgcagactctcctaagtatcataggcaacgctctgaaataattaatcaactggctagttttgaaacacgacgacaagaagttcagtcatttattcaaaagtatgataaccaagacgttgttttagctggtagtctatttgtttatagtcttaaggagacagtttatttcttttcaggatcctacacagaatttaataaattttatgcaccagcagttcttcaggaatatgttatgcaagaggctctcaaaagaggttctactttctataacctcctaggtattcagggaacttttgatggttcagatagtattcttcgctttaaacagaattttaatggttgtatcattcgtaaaatgggaacttttaactattatccaagtccttttaaatacaaaggaattcagcttcttaaaaaggttttgaagagaaat

SEQ ID NO: 6064 - protein, 411 aa, Streptococcus agalactiae
MTLRELTIEEFKEHSGNYDSQSFLQTPEMAKLLEKRGYDVRYLGYQVENKLEIISLSYIMPVTGGFQMKIDSGPVHSNSKYLKQFYKALQGYAKSNGVLELIVEPYDDYQLFTSSGVPSNQGNDNLIEDFTSSGYHHDGLTTGFTGKYLSWHYVKNLEGVTSETLLSSFSKTGRALVKKAMSFGIKVRVLKRDELHLFKEITTSTSNRRDYMDKSLDYYQDFYDSFEGKAEFVIATLNFREYDHNLQIKAEALENKLKLLDERFRENADSPKYHRQRSEIINQLASFETRRQEVQSFIQKYDNQDVVLAGSLFVYSLKETVYFFSGSYTEFNKFYAPAVLQEYVMQEALKRGSTFYNLLGIQGTFDGSDSILRFKQNFNGCIIRKMGTFNYYPSPFKYKGIQLLKKVLKRN

SEQ ID NO: 6065 - DNA, 1638 bp, Streptococcus agalactiae
gtgtttatgatgaaaaaaggacaagtaaatgatactaagcaatcttactctctacgtaaatataaatttggtttagcatcagtaattttagggtcattcataatggtcacaagtcctgtttttgcggatcaaactacatcggttcaagttaataatcagacaggcactagtgtggatgctaataattcttccaatgagacaagtgcgtcaagtgtgattacttccaataatgatagtgttcaagcgtctgataaagttgtaaatagtcaaaatacggcaacaaaggacattactactcctttagtagagacaaagccaatggtggaaaaaacattacctgaacaagggaattatgtttatagcaaagaaaccgaggtgaaaaatacaccttcaaaatcagccccagtagctttctatgcaaagaaaggtgataaagttttctatgaccaagtatttaataaagataatgtgaaatggatttcatataagtctttttgtggcgtacgtcgatacgcagctattgagtcactagatccatcaggaggttcagagactaaagcacctactcctgtaacaaattcaggaagcaataatcaagagaaaatagcaacgcaaggaaattatacattttcacataaagtagaagtaaaaaatgaagctaaggtagcgagtccaactcaatttacattggacaaaggagacagaattttttacgaccaaatactaactattgaaggaaatcagtggttatcttataaatcattcaatggtgttcgtcgttttgttttgctaggtaaagcatcttcagtagaaaaaactgaagataaagaaaaagtgtctcctcaaccacaagcccgtattactaaaactggtagactgactatttctaacgaaacaactacaggttttgatattttaattacgaatattaaagatgataacggtatcgctgctgttaaggtaccggtttggactgaacaaggagggcaagatgatattaaatggtatacagctgtaactactggggatggcaactacaaagtagctgtatcatttgctgaccataagaatgagaagggtctttataatattcatttatactaccaagaagctagtgggacacttgtaggtgtaacaggaactaaagtgacagtagctggaactaattcttctcaagaacctattgaaaatggtttagcaaagactggtgtttataatattatcggaagtactgaagtaaaaaatgaagctaaaatatcaagtcagacccaatttactttagaaaaaggtgacaaaataaattatgatcaagtattgacagcagatggttaccagtggatttcttacaaatcttatagtggtgttcgtcgctatattcctgtgaaaaagctaactacaagtagtgaaaaagcgaaagatgaggcgactaaaccgactagttatcccaacttacctaaaacaggtacctatacatttactaaaactgtagatgtgaaaagtcaacctaaagtatcaagtccagtggaatttaattttcaaaagggtgaaaaaatacattatgatcaagtgttagtagtagatggtcatcagtggatttcatacaagagttattccggtattcgtcgctatattgaaatt

SEQ ID NO: 6066 - protein, 546 aa, Streptococcus agalactiae
MFMMKKGQVNDTKQSYSLRKYKFGLASVILGSFIMVTSPVFADQTTSVQVNNQTGTSVDANNSSNETSASSVITSNNDSVQASDKVVNSQNTATKDITTPLVETKPMVEKTLPEQGNYVYSKETEVKNTPSKSAPVAFYAKKGDKVFYDQVFNKDNVKWISYKSFCGVRRYAAIESLDPSGGSETKAPTPVTNSGSNNQEKIATQGNYTFSHKVEVKNEAKVASPTQFTLDKGDRIFYDQILTIEGNQWLSYKSFNGVRRFVLLGKASSVEKTEDKEKVSPQPQARITKTGRLTISNETTTGFDILITNIKDDNGIAAVKVPVWTEQGGQDDIKWYTAVTTGDGNYKVAVSFADHKNEKGLYNIHLYYQEASGTLVGVTGTKVTVAGTNSSQEPIENGLAKTGVYNIIGSTEVKNEAKISSQTQFTLEKGDKINYDQVLTADGYQWISYKSYSGVRRYIPVKKLTTSSEKAKDEATKPTSYPNLPKTGTYTFTKTVDVKSQPKVSSPVEFNFQKGEKIHYDQVLVVDGHQWISYKSYSGIRRYIEI

SEQ ID NO: 6067 - DNA, 1122 bp, Streptococcus pyogenes
atgaaaaaatttcatcgttttttggtctcaggagtaatccttttaggttttaatggtctagtacctactatgccatctacacttatttcgcaacaggaaaatcttgttcatgcagctgttttaggcgataactatccgagtaagtggaaaaaaggcaatggaatcgattcgtggaacatgtatatccgccaatgcacttcttttgcagcttttcgtttaagctctgctaatggttttcagttacctaaaggctacggtaatgcctgcacgtggggacatatcgcgaaaaatcagggttatcctgtgaataagacaccaagcataggggctatcgcttggtttgataaaaacgcttatcagtcaaatgctgcttacggtcatgtagcatgggtagctgatatccgtggagacactgtcactatcgaagagtataattacaacgctggacaaggccctgaaagataccataagcgtcaaattccaaaatctcaggtaagtggttatatccattttaaagacttatcatctcagacaagtcattcctacccaagacaactaaaacacatttctcaagcttcatttgacccctctggaacttatcactttacaaccagattaccagtcaaaggacaaaccagtatcgatagccctgatcttgcttactatgaagcaggtcaatctgtttattacgataaagtcgtgactgctggaggttatacatggcttagctacctcagtttttctggaaaccgacgctatattcccattaaagagcccgcacagtctgtggttcaaaatgacaatacaaaaccttccattaaggtcggtgatactgttaccttccctggcgtttttcgtgtagatcagcttgttaataatttgatcgttaataaagaattagccggaggagacccaactccactaaactggattgatcccacaccattagatgaaacagataaccaaggaaaagttttaggagatcaaattctccgtgtgggtgaatattttatcgtcactggtagttataaagtattaaaaattgatcaaccaagtaatggtatttatgttcaaatcggatctcgtggaacatgggtaaatgctgataaagctaacaaatta

SEQ ID NO: 6068 - protein, 374 aa, Streptococcus pyogenes
MKKFHRFLVSGVILLGFNGLVPTMPSTLISQQENLVHAAVLGDNYPSKWKKGNGIDSWNMYIRQCTSFAAFRLSSANGFQLPKGYGNACTWGHIAKNQGYPVNKTPSIGAIAWFDKNAYQSNAAYGHVAWVADIRGDTVTIEEYNYNAGQGPERYHKRQIPKSQVSGYIHFKDLSSQTSHSYPRQLKHISQASFDPSGTYHFTTRLPVKGQTSIDSPDLAYYEAGQSVYYDKVVTAGGYTWLSYLSFSGNRRYIPIKEPAQSVVQNDNTKPSIKVGDTVTFPGVFRVDQLVNNLIVNKELAGGDPTPLNWIDPTPLDETDNQGKVLGDQILRVGEYFIVTGSYKVLKIDQPSNGIYVQIGSRGTWVNADKANKL

SEQ ID NO: 6069 - DNA, 921 bp, Streptococcus agalactiae
atgttagtttatattgctggttcaggcgctatgggatgtcgttttggatatcaaatttctaaaacaaatcatgatgttattttacttgataattgggcagaccatattatggctattaaagaaaatggcttgaaggtaacaggtgatacagaggaccttgttaaacttcctatcatgaagccaactgatgcgacagaagaagcagatttaattattttgtttactaaagcaatgcagttgccaaatatgcttcaagatattaaaaaaattattggtaagaaaacaaaggtcttatgtcttttaaatggattaggacatgaagatgtcattcgtcaatatatccctgaacacaatattttgatgggagtaacagtttggactgcagggttgaaaggaccagggcatgctcatctggaaggagttggttctgtaaatcttcaaagtatcgatcctaacaatcaagaagcaggtcatcgcgttactgaattgcttaatgaagcaaaattacaggctacttatgacgaaaatgttttgccaaatatttggagaaaagcttgtgttaacggaacgatgaattcaacttgcgccttgctagattgtacaattggtcaactctttgctagtgaagacggcgtaaatatggtacatgaaattatccatgaatttgttactgttggaaaagcagaaggtgtagagcttgatgaagaagaaataacaaagtacgttatggatacatctgttaaagcagcccatcattacccttcaatgcatcaagacttagttcaaaatcagcgcttaactgaaattgatttcttaaatggcgcagtgaataaaaaaggtgaaaacctaggcattgatacaccttactgtcgattaatcacacaattaattcacactaaagaaaatgtacttagcataaaa

SEQ ID NO: 6070 - protein, 307 aa, Streptococcus agalactiae
MLVYIAGSGAMGCRFGYQISKTNHDVILLDNWADHIMAIKENGLKVTGDTEDLVKLPIMKPTDATEEADLIILFTKAMQLPNMLQDIKKIIGKKTKVLCLLNGLGHEDVIRQYIPEHNILMGVTVWTAGLKGPGHAHLEGVGSVNLQSIDPNNQEAGHRVTELLNEAKLQATYDENVLPNIWRKACVNGTMNSTCALLDCTIGQLFASEDGVNMVHEIIHEFVTVGKAEGVELDEEEITKYVMDTSVKAAHHYPSMHQDLVQNQRLTEIDFLNGAVNKKGENLGIDTPYCRLITQLIHTKENVLSIK

SEQ ID NO: 6071 - DNA, 921 bp, Streptococcus pyogenes
atgttagtttatattgctggctcaggagccatggggtgccgttttggttaccaaatttcaaaaacaaataacgatgtgattttgttagataactgggaagatcatatcaatgccattaaagaaaacggtttagtggtgacaggggatgtggaagaaacagttaagcttcctattatgaaaccgactgaagccactcaagaagccgatttgattatcttgtttacaaaagcaatgcagttgccacaaatgcttcaagacattaaaggcattattggaaaagaaaccaaagtgctttgccttttaaatggtcttggacacgaagacgttattcgtcagtacattccagagcacaacattttgatgggggtcactgtctggactgctggtctagaaggtcctggtcgtgctcatcttcaaggtgtgggagcacttaacttacaaagcatggatccaagcaatcaagaagctggacaccaagtggctgatttgttaaatgaagctaacttgaatgcgacttatgatgagaatgttgtgccaaacatctggcgaaaagcttgcgtgaatggtaccatgaactcaacttgtgcccttctagattgtacaattggtgaattatttgccagtgaagacggtctcaaaatggtaaaagaaatcatccatgagtttgttatcgttggtcaagcagaaggtgtcgaactaaacgaagaagaaatcacacaatatgtaatggatacatctgttaaagctgctcaccattacccatcaatgcaccaagaccttgtgcaaaatcaccgattgactgaaattgattttatcaatggtgcagtcaataccaaaggtgaaaagcttggtatcaatactccatactgccgtatgattacagagctagttcacgctaaagaagcagtgttgaacatccaa

SEQ ID NO: 6072 - protein, 307 aa, Streptococcus pyogenes
MLVYIAGSGAMGCRFGYQISKTNNDVILLDNWEDHINAIKENGLVVTGDVEETVKLPIMKPTEATQEADLIILFTKAMQLPQMLQDIKGIIGKETKVLCLLNGLGHEDVIRQYIPEHNILMGVTVWTAGLEGPGRAHLQGVGALNLQSMDPSNQEAGHQVADLLNEANLNATYDENVVPNIWRKACVNGTMNSTCALLDCTIGELFASEDGLKMVKEIIHEFVIVGQAEGVELNEEEITQYVMDTSVKAAHHYPSMHQDLVQNHRLTEIDFINGAVNTKGEKLGINTPYCRMITELVHAKEAVLNIQ

SEQ ID NO: 6073 - DNA, 495 bp, Streptococcus agalactiae
atgtctttacaaattttgtgtgatacaaaacctactgcaaaaggaataacgagccaagataagataacaatcaacatacttgctcctgcttcaaatgaagcaatcggacctactgcaccaacaagcccaaaaccagacgaagctggtgtccccaccaatttaaacaatgggactgttagagaacttactgtagcagtcataagcattggaatcgccattactggatgctttaggaaatttggcatcatcatcttcattgcacctaaagcaatagcaattggaactccagacttattagccttcatcgttgcccaaactagcactgctgttgttgaagcaactcccattgaagctgcacttgctgacataccattaagaccaatcgctagaccaatcgctactgttgaaataggacttacaataagcattgaaaaagccatcgcaattagaattgacatcgcaattggttgtaaagtagtaaaagaattaattcct

SEQ ID NO: 6074 - protein, 165 aa, Streptococcus agalactiae
MSLQILCDTKPTAKGITSQDKITINILAPASNEAIGPTAPTSPKPDEAGVPTNLNNGTVRELTVAVISIGIAITGCFRKFGIIIFIAPKAIAIGTPDLLAFIVAQTSTAVVEATPIEAALADIPLRPIARPIATVEIGLTISIEKAIAIRIDIAIGCKVVKELIP

SEQ ID NO: 6075 - DNA, 1068 bp, Streptococcus agalactiae
atgacaaatacggtaacaccaaaagagacggctggttcttttatcaataaagtgttaggtgggacagcaactgcaatcgttgtagcactcatcccaaatgctatcctagccacttttttgaaaccatttttatcttacggacttgctgcagagttcttacacatcgtgcaggtattccaatttttcacaccaattatggcaggatttttgattggtcaacagtttaaattcaccccaatgcaacagcttgctgttggaggtgctgcatatattggttctggtgcgtgggcttacacagaagttattcaaaaaggagttgctactggtagtttccaattgcgtgggattggtgatctcatcaatatgatgctaacagcagctttagcagttttagcagttaagtggtttggtaataaatttggttccctaaccattatcttgttacctattatcataggtacaggcgtaggctatttaggatggaaattactcccttacgtttcatatgtgacaacacttattggtcaaggaattaattcttttactactttacaaccaattgcgatgtcaattctaattgcgatggctttttcaatgcttattgtaagtcctatttcaacagtagcgattggtctagcgattggtcttaatggtatgtcagcaagtgcagcttcaatgggagttgcttcaacaacagcagtgctagtttgggcaacgatgaaggctaataagtctggagttccaattgctattgctttaggtgcaatgaagatgatgatgccaaatttcctaaagcatccagtaatggcgattccaatgcttatgactgctacagtaagttctctaacagtcccattgtttaaattggtggggacaccagcttcgtctggttttgggcttgttggtgcagtaggtccgattgcttcatttgaagcaggagcaagtatgttgattgttatcttatcttggctcgttattccttttgcagtaggttttgtatcacacaaaatttgtaaagacattctgaaactttataaagacgatattttcgtttttgaaggtcaaaat

SEQ ID NO: 6076 - protein, 356 aa, Streptococcus agalactiae
MTNTVTPKETAGSFINKVLGGTATAIVVALIPNAILATFLKPFLSYGLAAEFLHIVQVFQFFTPIMAGFLIGQQFKFTPMQQLAVGGAAYIGSGAWAYTEVIQKGVATGSFQLRGIGDLINMMLTAALAVLAVKWFGNKFGSLTIILLPIIIGTGVGYLGWKLLPYVSYVTTLIGQGINSFTTLQPIAMSILIAMAFSMLIVSPISTVAIGLAIGLNGMSASAASMGVASTTAVLVWATMKANKSGVPIAIALGAMKMMMPNFLKHPVMAIPMLMTATVSSLTVPLFKLVGTPASSGFGLVGAVGPIASFEAGASMLIVILSWLVIPFAVGFVSHKICKDILKLYKDDIFVFEGQN

SEQ ID NO: 6077 - DNA, 990 bp, Streptococcus agalactiae
atgaacaaaacaatttatgatatcactattgtaggaggcggaccagtaggtctctttgctgctttttatgctggactacgcggagtatccgttaaaattattgaaagcctttcggaattaggaggccagccagctatcctttatcctgagaaaaaaatctatgatattcctggttatccggtgattactggacgtgaattaattgataaacatattgaacaattagagagatttaaagattctattgaaatctgtttaaaagaagaagttttatcatttgaaaaagtagatgatgttttcacaattcaaacagataaagatcaacatttgtcacgtgctattgtttttgcttgtggcaacggtgcttttgctccgcgtttactaggtttggaaaatgaagaaaattatgcagataataatttattctataacgttacaaagttagaacagtttgcaggtaaacatgttgttatttgtggtggaggcgactcagctgttgattgggccaatgaattagataagattgcagctagtgtagcgattgttcatcgtagagatgcttttagagcgcatgagcatagtgtggatatactaaaggcatcaggtgttagaattttaaccccttatgtcccaattggtttaaatggagatagtcagagagttagcagcttggtcgttcaaaaagttaaaggtgatgaagtaattgaattacctttagacaacttgattgttagttttggcttttctacttctaataaaaatttacgttattggaatttggattataaacggtctagtatcaatgtttcttcactttttgagacgactcaagaaggcgtgtatgctattggagatgctgctaattatccaggaaaggtagaattgattgcaacaggatatggggaagcaccagtcgctataaaccaagctatcaattatatttatcctgatcgagataaccgtgtagtccattcaacatcattgataaaa

SEQ ID NO: 6078 - protein, 330 aa, Streptococcus agalactiae
MNKTIYDITIVGGGPVGLFAAFYAGLRGVSVKIIESLSELGGQPAILYPEKKIYDIPGYPVITGRELIDKHIEQLERFKDSIEICLKEEVLSFEKVDDVFTIQTDKDQHLSRAIVFACGNGAFAPRLLGLENEENYADNNLFYNVTKLEQFAGKHVVICGGGDSAVDWANELDKIAASVAIVHRRDAFRAHEHSVDILKASGVRILTPYVPIGLNGDSQRVSSLVVQKVKGDEVIELPLDNLIVSFGFSTSNKNLRYWNLDYKRSSINVSSLFETTQEGVYAIGDAANYPGKVELIATGYGEAPVAINQAINYIYPDRDNRVVHSTSLIK

SEQ ID NO: 6079 - DNA, 990 bp, Streptococcus pyogenes
gtgaaagataaagcatatgatattacgattattggtggtggtccaataggtttatttgcagccttttatgcaggtcttaggggcgtaacagtaaagattattgagagtttgtcagaacttggtggacagcctgccattctttatcctgagaaaatgatttatgatattccagcttatccatctttaacaggtgttgagttgacagaaaatttaataaaacaattgagccgttttgaagatcgtacaaccatttgtttaaaagaagaagtattaacctttgacaaggttaaaggtggtttttcgattaggactaataaggcagagcatttttcaaaagccattatcattgcttgtggaaatggcgcttttgcaccaagaactttagggttagaaagtgaggaaaactttgctgatcataaccttttttataatgttcaccagttggaccagtttgcgggacaaaaagttgtgatttgtggtggtggagattcagcagttgattgggctttggctttagaagatattgctgagagtgtgacggttgtgcaccgtcgtgatgctttcagagcacatgaacacagtgtggaattattgaaagcatcaacggtcaacctcttaacaccttatgtgccaaaagcattgaaaggaattggaaacctggctgaaaaattagttattcaaaaagtgaaagaagatgaagtgttagaacttgaattggacagtcttattgttagttttggtttttcaacttctaataagaatttgaaaaattggaatctcgactataagcgttcaagtattactgtttcaccactttttcaaacaagtcaagaaggtatttttgccattggtgatgcagccgcttataatgggaaagtggatttgattgctactggttttggcgaagcaccaacagcagttaatcaggccattaactatatttatccagatcgagataaccgtgtggtgcattcaacctctttaattgac

SEQ ID NO: 6080 - protein, 330 aa, Streptococcus pyogenes
VKDKAYDITIIGGGPIGLFAAFYAGLRGVTVKIIESLSELGGQPAILYPEKMIYDIPAYPSLTGVELTENLIKQLSRFEDRTTICLKEEVLTFDKVKGGFSIRTNKAEHFSKAIIIACGNGAFAPRTLGLESEENFADHNLFYNVHQLDQFAGQKVVICGGGDSAVDWALALEDIAESVTVVHRRDAFRAHEHSVELLKASTVNLLTPYVPKALKGIGNLAEKLVIQKVKEDEVLELELDSLIVSFGFSTSNKNLKNWNLDYKRSSITVSPLFQTSQEGIFAIGDAAAYNGKVDLIATGFGEAPTAVNQAINYIYPDRDNRVVHSTSLID

SEQ ID NO: 6081 - DNA, 753 bp, Streptococcus agalactiae
atgatgaagattgatattttaactttatttcctgaaatgtttgcccctctggaacattctatagttggtaaggcaaaagaaagaggacttcttgaaattaattatcacaatttcagagaaaatgctgagaagtctcgacatgttgatgatgagccttacggtggggggcaagggatgcttttacgtgctcaacctatttttgatacaattgataaaatagatgctcaaaaagcacgtgttattttgctagacccagcgggcagaacatttgatcaggattttgcagaagaactatccaaagaagatgaattaatttttatttgtggtcactatgaaggttatgatgaacgtataaaatcattagtaacagacgaagtatctttgggagattttgttcttacgggaggagaattggcggctatgacaatggtcgatgctaccgttcgtctgattccagaagttataggtaaagaaacaagtcatcaggatgattcattttcatcgggcctattagaatatcctcagtatacgcgcccatatgattatttaggcatgacagttcctgatgttctcatgagtggtcatcatgaaaatatccgaaaatggcgtttagaacaaagtttgcgaaaaacactagaacgtcgaccagacttgttagaaaattatgcaatgacggatgaagagagacttatcttagagaaaattaaaacagaaatagaaagaacagatacagtaaatgaacaaaacaattta

SEQ ID NO: 6082 - protein, 251 aa, Streptococcus agalactiae
MMKIDILTLFPEMFAPLEHSIVGKAKERGLLEINYHNFRENAEKSRHVDDEPYGGGQGMLLRAQPIFDTIDKIDAQKARVILLDPAGRTFDQDFAEELSKEDELIFICGHYEGYDERIKSLVTDEVSLGDFVLTGGELAAMTMVDATVRLIPEVIGKETSHQDDSFSSGLLEYPQYTRPYDYLGMTVPDVLMSGHHENIRKWRLEQSLRKTLERRPDLLENYAMTDEERLILEKIKTEIERTDTVNEQNNL

SEQ ID NO: 6083 - DNA, 729 bp, Streptococcus pyogenes
atgaagattgatattttaaccctttttcctgaaatgtttgcccctctagagcattccattgtaggcaaggcaaaagaaaaaggtctgttagacattcactaccataactttcgagattatgctgaaaaagctcgtcatgtggatgacgaaccctatggtgggggccaaggcatgttattgagagcgcagcccatttttgacaccattgaacagattgaagccaaaaaaccaaggattattcttttagatccagcaggtaaaccctttactcaggcttatgctgaagaattagctcttgaggaagagttaatttttatttgtggtcattatgaaggttatgatgagcggattaagaccttggtgacggatgaaatttcattaggcgactttgtattaacaggaggtgagttggcggccatgactatggtggatgcgaccgtcaggttaattccacaggtacttgggaaagaaagtagccatcaggacgattctttttcatcaggacttttagaataccctcaatacacaagaccttatgattatcgtggtatgacagttccagatgttctaatgagtggtcatcacgaacgtattcgcttgtggcgtctagaagaaagtctcaaaaaaacttatttaaggcggccagatttacttgaacattacaatttttccgaggaagagcgcaagctattggataagattaaagaagcattggatcaaggagaagat

SEQ ID NO: 6084 - protein, 243 aa, Streptococcus pyogenes
MKIDILTLFPEMFAPLEHSIVGKAKEKGLLDIHYHNFRDYAEKARHVDDEPYGGGQGMLLRAQPIFDTIEQIEAKKPRIILLDPAGKPFTQAYAEELALEEELIFICGHYEGYDERIKTLVTDEISLGDFVLTGGELAAMTMVDATVRLIPQVLGKESSHQDDSFSSGLLEYPQYTRPYDYRGMTVPDVLMSGHHERIRLWRLEESLKKTYLRRPDLLEHYNFSEEERKLLDKIKEALDQGED

SEQ ID NO: 6085 - DNA, 681 bp, Streptococcus agalactiae
ttggttcgaatccagctaccccagtttacatggtccgttggtcaaggggttaagacaccgccttttcacggcggtaacacgggttcgaatcccgtacggactatcgtggccagttgcattttagcggctggtttttcttttattttcaaaaatatcggagttactatggaatactttaacgttggaaaaattgtcaatacacaaggattacaaggcgaaatgcgtgtattaagcgtgactgactttgtagaagaacgctttaaaaaaggtcaagtgttagctttattcgatgaaaagaatcagtttgttatggatattgaaattgctagtcatcgtaagcagaagaattttgacattataaaattcaaaggaatgtatcatattaatgatattgaaaaatataaaggtttcacactgaaggtggcagaggatcaactgagcgaccttaaagatggtgaattttattatcatgaaattattggcttagatgtctatgaaggggaagagctgattggaaaaatcaaagaaattttacaaccaggagcaaatgacgtttgggttgtggaacgtcatggaaaacgtgatcttttattaccctatatcccgccagtagtattagaagtggacctttctaatcagcgtgttcaagttgaattgatggaaggtttagatgatgaagat

SEQ ID NO: 6086 - protein, 227 aa, Streptococcus agalactiae
MVRIQLPQFTWSVGQGVKTPPFHGGNTGSNPVRTIVASCILAAGFSFIFKNIGVTMEYFNVGKIVNTQGLQGEMRVLSVTDFVEERFKKGQVLALFDEKNQFVMDIEIASHRKQKNFDIIKFKGMYHINDIEKYKGFTLKVAEDQLSDLKDGEFYYHEIIGLDVYEGEELIGKIKEILQPGANDVWVVERHGKRDLLLPYIPPVVLEVDLSNQRVQVELMEGLDDED

SEQ ID NO: 6087 - DNA, 516 bp, Streptococcus pyogenes
atggaatattttaatgttggaaaaattgtcaacacgcaaggcctgcaaggagagatgcgcgtgttgtctgtcagtgattttgctgaggaacgctttaaaaaaggctcacaattagctttatttgatgataaagatcggtttgttcaagaagtgacaattgttagtcaccgtaaacaaaagcattttgatattatcaaatttaaagacatgtatcatattaatgctattgaaaagtacaagggatacactttaaaggtctcaaaagacaatcaaggggatttacaagaaggagaattttattaccatcagattattggcatggctgtttatgaaaaggatgtccttattggacatgttaaggaaatcttgcagccaggtgctaatgatgtttggatagtgaaacgccaaggaaaacgagacttgctcttaccatatattcccccagtagttcttaacgtagatgttcctaacaagcgcgtggatgttgaattgatggaaggcttagacgatgaagat

SEQ ID NO: 6088 - protein, 172 aa, Streptococcus pyogenes
MEYFNVGKIVNTQGLQGEMRVLSVSDFAEERFKKGSQLALFDDKDRFVQEVTIVSHRKQKHFDIIKFKDMYHINAIEKYKGYTLKVSKDNQGDLQEGEFYYHQIIGMAVYEKDVLIGHVKEILQPGANDVWIVKRQGKRDLLLPYIPPVVLNVDVPNKRVDVELMEGLDDED

SEQ ID NO: 6089 - DNA, 1308 bp, Streptococcus agalactiae
atgcagacaacgaaaaaagaaaggaatacgcacatgtcagaattgctagataagatattatctcggaacaatatgctcgaagcttacaagcaagtgaaatcaaacaaaggttctgctggtatcaatggggtcactatcgagcagatggatgactatcttcaccaaaattggcgagaaaccaagcaactcatcaaagagaggagctataaacctcaaccggttctcagggttgaaatcccaaaaccaaacggaggagttcgtaacctaggtatcccgacggctatggatagaatgattcagcaggccatcgttcaagttttgagtccactctgcgaaaaacatttttcagagtatagctatgggttcagacccaatcgctcctgcgaaacagccattgttcagctacttgagtatttaaacgatggctacgagtggattgtggacattgacttggaaaagttcttcgatactgttccgcaagacagattgatgtccctggttcataatatcattcaagatggcgatacggagtcactgattcgtaagtacctccattcgggagttgttattaacggacagcgacataagactttagtcgggacacctcaaggcgggaatctatcacccctcctatctaatattatgcttaatgagttagacaaagggttggaaaagcgaggtcttcgctttgtccgttacgccgatgactgtgtcatcactgtcggaagcgaagcagctgctaagcgggtcatgcattcggtcagtagctatattgagaagcgattagggttgaaagtcaacatgactaagaccaagattgtcagaccgaacaaactcaaatacctcggatttggtttctggaaatctccaaaaggttggaagtgtcgtcctcaccaagacagcgttcagagctttaagcgaaaactgaagcaactgacgatgaggaaatggagcattgacctgataactcgcattgaacgattgaactgggtcattcgaggatggataaactatttctcgcttggcaatatgaagagtatcatgacacaaatagatgagcgtctgcgaacccgtattcgagtgattatctggaagcaatggaagaagaaagcaaagcgcctatggggactcttaaaactaggagttgctagatggatagccgataaagtttctggatggggtgaccactatcagttggtagctcagaagtcggtactcaaacgtgctatatcaaaaccagccctcgcaaagcgaggactggtcagttgcttagattactatcttgaacgacatgcgttaaaagttagt

SEQ ID NO: 6090 - protein, 436 aa, Streptococcus agalactiae
MQTTKKERNTHMSELLDKILSRNNMLEAYKQVKSNKGSAGINGVTIEQMDDYLHQNWRETKQLIKERSYKPQPVLRVEIPKPNGGVRNLGIPTAMDRMIQQAIVQVLSPLCEKHFSEYSYGFRPNRSCETAIVQLLEYLNDGYEWIVDIDLEKFFDTVPQDRLMSLVHNIIQDGDTESLIRKYLHSGVVINGQRHKTLVGTPQGGNLSPLLSNIMLNELDKGLEKRGLRFVRYADDCVITVGSEAAAKRVMHSVSSYIEKRLGLKVNMTKTKIVRPNKLKYLGFGFWKSPKGWKCRPHQDSVQSFKRKLKQLTMRKWSIDLITRIERLNWVIRGWINYFSLGNMKSIMTQIDERLRTRIRVIIWKQWKKKAKRLWGLLKLGVARWIADKVSGWGDHYQLVAQKSVLKRAISKPALAKRGLVSCLDYYLERHALKVS

SEQ ID NO: 6091 - DNA, 3270 bp, Streptococcus agalactiae
ttgcgtaaaaaacaaaaactaccatttgataaacttgccattgcgcttatatctacgagcatcttgctcaatgcacaatcagacattaaagcaaatactgtgacagaagacactcctgctaccgaacaagccgtagaacccccacaaccaatagcagtttctgaggaatcaccatcatcaaaggaaactaaaacctcacaaactcctagtgatgtaggagaaacagtagcagatgacgctaatgatctagcccctcaagctcctgctaaaactgctgatacaccagcaacctcaaaagcgactattagggatttgaacgacccttctcatgtcaaaaccctgcaggaaaaagcaggcaagggagttgggaccgttgttgcagtgattgatgctggttttgataaaaatcatgaagcgtggcgcttaacagacaaaactaaagcacgttaccaatcaaaagaaaatcttgaaaaagctaaaaaagagcacggtattacctatggcgagtgggtcaatgataaggttgcttattaccacgactatagtaaagatggtaaaaacgctgttgatcaagaacacggcacacacgtgtcagggatcttgtcaggaaatgctccatctgaaatgaaagaaccttaccgcctagaaggtgcgatgcctgaggctcaattgcttttgatgcgtgtcgaaattgtaaatggactagcagactatgctcgtaactacgctcaagctatcagagatgctgtcaacttgggagctaaggtgattaatatgagctttggtaatgctgcactagcttacgccaaccttccagacgaaaccaaaaaagcctttgactatgccaaatcaaaaggtgttagcattgtgacctcagctggtaatgatagtagctttgggggcaagccccgtctacctctagcagatcatcctgattatggggtggttgggacacctgcagcggcagattcaacattgacagttgcttcttacagcccagataaacagctcactgaaactgctacggtcaaaacagacgatcatcaagataaagaaatgcctgttctttcaacaaaccgttttgagccaaacaaggcttacgactatgcttatgctaatcgtggtacgaaagaggatgattttaaggatgtcgaaggtaagattgcccttattgaacgtggcgatattgatttcaaagataagattgcaaacgctaaaaaagctggtgctgtaggggtcttgatctatgacaatcaagacaagggcttcccgattgaattgccaaatgttgaccagatgcctgcggcctttatcagtcgaagagacggtctcttattaaaagacaatccccaaaaaaccattaccttcaatgcgacacctaaggtattgccaacagcaagtggcaccaaactaagccgcttctcaagctggggtctgacagctgacggcaatattaagccggatattgcagcacccggccaagatattttgtcatcagtggctaacaacaagtatgccaaactttctggaactagtatgtctgcaccattggtagcgggtatcatgggactgttgcaaaagcaatatgagacacagtatcctgatatgacaccatcagagcgtcttgatttagctaagaaagtattgatgagctcagcaactgccctatatgatgaagatgaaaaagcttatttttctcctcgccaacagggagcaggagcagtcgatgctaaaaaagcttcagcagcaacgatgtatgtaacagataaggacaatacctcaagcaaggttcacctgaacaatgtttctgataaatttgaagtaacagtaacagttcacaacaaatctgataaacctcaagagttgtattaccaagtaactgttcaaacagataaagtagatggaaaacactttgccttggctcctaaagcattgtatgagacatcatggcaaaaaatcacaattccagccaatagcagcaaacaagtcaccgttccaatcgatgctagtcgatttagcaaggacttgcttgcccaaatgaaaaatggctatttcttagaaggttttgttcgtttcaaacaagatcctacaaaagaagagcttatgagcattccatatattggtttccgaggtgattttggcaatctgtcagccttagaaaaaccaatctatgatagcaaagacggtagcagctactatcatgaagcaaatagtgatgccaaagaccaattagatggtgatggattacagttttacgctctgaaaaataactttacagcacttaccacagagtctaacccatggacgattattaaagctgtcaaagaaggggttgaaaacatagaggatatcgaatcttcagagatcacagaaaccatttttgcaggtacttttgcaaaacaagacgatgatagccactactatatccaccgtcacgctaatggcaaaccatatgctgcgatctctccaaatggggacggtaacagagattatgtccaattccaaggtactttcttgcgtaatgctaaaaaccttgtggctgaagtcttggacaaagaaggaaatgttgtttggacaagtgaggtaaccgagcaagttgttaaaaactacaacaatgacttggcaagcacacttggttcaacccgttttgaaaaaacgcgttgggacggtaaaaataaagacggcaaagttgttgctaacggaacctacacctatcgtgttcgctacacgccgattagctcaggtgcaaaagaacaacacactgattttgatgtgattgtagacaatacgacacctgaagtcgcaacatcggcaacattctcaacagaagatagtcgtttgacacttgcatctaaaccaaaaaccagccaaccggtttaccgtgagcgtattgcttacacttatatggatgaggatctgccaacaacagagtatatttctccaaatgaagatggtacctttactcttcctgaagaggctgaaacaatggaaggcgctactgttccattgaaaatgtcagactttacttatgttgttgaagatatggctggtaacatcacttatacaccagtgactaagctattggagggccactctaataagccagaacaagacggttcagatcaagcaccagacaaaaaaccagaagctaaaccagaacaagacggttcaggtcaaacaccagataaaaaaaagaaactaaaccagaaaaagatagttcaggtcaaacaccaggtaaaactcctcaaaaaggtcaatcttctcgtactc

SEQ ID NO: 6092 - protein, 1090 aa, Streptococcus agalactiae
MRKKQKLPFDKLAIALISTSILLNAQSDIKANTVTEDTPATEQAVEPPQPIAVSEESPSSKETKTSQTPSDVGETVADDANDLAPQAPAKTADTPATSKATIRDLNDPSHVKTLQEKAGKGVGTVVAVIDAGFDKNHEAWRLTDKTKARYQSKENLEKAKKEHGITYGEWVNDKVAYYHDYSKDGKNAVDQEHGTHVSGILSGNAPSEMKEPYRLEGAMPEAQLLLMRVEIVNGLADYARNYAQAIRDAVNLGAKVINMSFGNAALAYANLPDETKKAFDYAKSKGVSIVTSAGNDSSFGGKPRLPLADHPDYGVVGTPAAADSTLTVASYSPDKQLTETATVKTDDHQDKEMPVLSTNRFEPNKAYDYAYANRGTKEDDFKDVEGKIALIERGDIDFKDKIANAKKAGAVGVLIYDNQDKGFPIELPNVDQMPAAFISRRDGLLLKDNPQKTITFNATPKVLPTASGTKLSRFSSWGLTADGNIKPDIAAPGQDILSSVANNKYAKLSGTSMSAPLVAGIMGLLQKQYETQYPDMTPSERLDLAKKVLMSSATALYDEDEKAYFSPRQQGAGAVDAKKASAATMYVTDKDNTSSKVHLNNVSDKFEVTVTVHNKSDKPQELYYQVTVQTDKVDGKHFALAPKALYETSWQKITIPANSSKQVTVPIDASRFSKDLLAQMKNGYFLEGFVRFKQDPTKEELMSIPYIGFRGDFGNLSALEKPIYDSKDGSSYYHEANSDAKDQLDGDGLQFYALKNNFTALTTESNPWTIIKAVKEGVENIEDIESSEITETIFAGTFAKQDDDSHYYIHRHANGKPYAAISPNGDGNRDYVQFQGTFLRNAKNLVAEVLDKEGNVVWTSEVTEQVVKNYNNDLASTLGSTRFEKTRWDGKNKDGKVVANGTYTYRVRYTPISSGAKEQHTDFDVIVDNTTPEVATSATFSTEDSRLTLASKPKTSQPVYRERIAYTYMDEDLPTTEYISPNEDGTFTLPEEAETMEGATVPLKMSDFTYVVEDMAGNITYTPVTKLLEGHSNKPEQDGSDQAPDKKPEAKPEQDGSGQTPDKKKKLNQKKIVQVKHQVKLLKKVNLLVL

SEQ ID NO: 6093 - DNA, 1332 bp, Streptococcus agalactiae
atggaagttaaaaaattctcggaaaaagattttgtaaatgaaataaataaaataaaacagaaacaatttttaagtcaaattgaacagtatgaaagctatatcgctcctcaaatgagaacgaaaggctataagaggatcaatcagtctgaacgtacggttgttttctcttttggagaaataacatttagtaggagtcgctggacaaatggctttgaaactagaataccagtagatgagtggttaggtcttgaaaaatataagagatattcaatagaattcttatatcatgttgcaaaattggctacaatgatgccttatcgtcaagtttgcaaagtaatagatagcactttgcaaacaatcataacaaaagactgtgttttaaaagcagtaaaatttgtagaaaaattgttaaaagaaaaagaacgctatcgtttttatttggaagagccacccgaacgtaaaaaagtgaaaaaactgtatgttgagggtgatggagtcatgattaaaagcacagattctagagaggaaagaaggtatttagatttaacacattttgttattcatacaggctcaaaaaaagtttctactaaaagatatgaattgcgggacaagcacgaaatattacagcttaattatgataaagctaaatataatcttttagattatatttataataactatgaagtagatgacgatactattttaatcactaactctgatatgggtaaaggctatactagtagagtttttaaggaattaggaaaagcacttaaggtaaagaaacatgagcatttttgggatatctatcatgttaaagaaaagttaagttcataccttagaaaatatccaattgaattaaccgattttgctttagatgcggtaaaaaaatataattctgataagcttgaattagtttttgatactgttgaatcactgatttgtgatgaacttgaagatcaagaatttcagaagtttaagaaaaaagtattaaataatttcaaatatataaaaccagctcatcttagaaatctttcaaatcgtggtattggtatcatggaatcacaacacagaaagataacgtatagaatgaagcgacgtggcatgtattggtcaaagtggggaatctccacaatggcaaatatgattatacttgaaagagctaacggtttacgagaattatttttcggttcttggagaaaggtatacagtgagtataaagaaggttcatttagtgcagggcgactttttaaaaagacagatgaattagataaattttctaagccccttctaaaaaatggcagaaaatggagtataacaggaatcaaaacaaaa

SEQ ID NO: 6094 - protein, 444 aa, Streptococcus agalactiae
MEVKKFSEKDFVNEINKIKQKQFLSQIEQYESYIAPQMRTKGYKRINQSERTVVFSFGEITFSRSRWTNGFETRIPVDEWLGLEKYKRYSIEFLYHVAKLATMMPYRQVCKVIDSTLQTIITKDCVLKAVKFVEKLLKEKERYRFYLEEPPERKKVKKLYVEGDGVMIKSTDSREERRYLDLTHFVIHTGSKKVSTKRYELRDKHEILQLNYDKAKYNLLDYIYNNYEVDDDTILITNSDMGKGYTSRVFKELGKALKVKKHEHFWDIYHVKEKLSSYLRKYPIELTDFALDAVKKYNSDKLELVFDTVESLICDELEDQEFQKFKKKVLNNFKYIKPAHLRNLSNRGIGIMESQHRKITYRMKRRGMYWSKWGISTMANMIILERANGLRELFFGSWRKVYSEYKEGSFSAGRLFKKTDELDKFSKPLLKNGRKWSITGIKTK

SEQ ID NO: 6095 - DNA, 615 bp, Streptococcus agalactiae
atgggaaaaatggttaagaaaaaagtaaagaaaaaaagtggttgtggtggatgtttaagtttaataatagtgataattattgttagtagtgttataaatttatttacaggttctgaaagcagtaatacttctaaaaagaataagacaaatcctagtggtgcgacaagtgcaaaagtcgttaaacacaaaaaaactgatgaagaacgagcagaagattatataaaaacgttaggattaaacccgagtgattatataaaagaaatggattattcaaaggttgattttaggggggatttatcatcagtatcaggtaattataataattttactgttgaaaacatcaatcaaacttttgaaaaaggtgataaatctttaaaagatattattgaaatttttggaaagcctgatacaatttgggttaattacgttgacaatcagtacaatactgatttgtactggaaaaaagatgacacagatgattctaattatattcatgcagaatggtctgagccaaaagatgaatatgatgttcaaagtttaagtggcacggcttcaaattcaggtactggcaagtttcagtcattcattggattagatggatttgagcctgcacag

SEQ ID NO: 6096 - protein, 205 aa, Streptococcus agalactiae
MGKMVKKKVKKKSGCGGCLSLIIVIIIVSSVINLFTGSESSNTSKKNKTNPSGATSAKVVKHKKTDEERAEDYIKTLGLNPSDYIKEMDYSKVDFRGDLSSVSGNYNNFTVENINQTFEKGDKSLKDIIEIFGKPDTIWVNYVDNQYNTDLYWKKDDTDDSNYIHAEWSEPKDEYDVQSLSGTASNSGTGKFQSFIGLDGFEPAQ

SEQ ID NO: 6097 - DNA, 258 bp, Streptococcus agalactiae
atgactatgtttataagaaagaggatgaatatggcatttgaaccaaaaaattcggaactaacaaaagttctaaaagaaagtttagatgaagaaaagaaagaaattttctcatctgaaatgaatattagggactttgaacgtacaaaacaatatcaatttacacttcaaccttcagtccgaaaaaaaattgataggctatcaaaagaaaaaggctatcgttcagcatcatcttttataaatgacttttttaaaaatttg

SEQ ID NO: 6098 - protein, 86 aa, Streptococcus agalactiae
MTMFIRKRMNMAFEPKNSELTKVLKESLDEEKKEIFSSEMNIRDFERTKQYQFTLQPSVRKKIDRLSKEKGYRSASSFINDFFKNL

SEQ ID NO: 6099 - DNA, 375 bp, Streptococcus agalactiae
ttgtgtcttttaaaacagattgtaacacacaaagttttgtctacttttatagtatacatccatctttctgaaagacttgaagaatttaaaacagaggcatttgactttaaaactcgagcaagttatgtcacagcaaaattattctttttaggtaatatgataaagcataataccaactcttcaaaagaattaataagatcactaaagaatgataaatcagttcttgcaatgattcctcataaagagttatttaaccgctcaacattggacaaaaagtctctatcttatatgatgtctgataaagaattatattcaagagatagtaaattcttcaaagaaattgattttacatttaggaaaattactgataaacta

SEQ ID NO: 6100 - protein, 125 aa, Streptococcus agalactiae
MCLLKQIVTHKVLSTFIVYIHLSERLEEFKTEAFDFKTRASYVTAKLFFLGNMIKHNTNSSKELIRSLKNDKSVLAMIPHKELFNRSTLDKKSLSYMMSDKELYSRDSKFFKEIDFTFRKITDKL

SEQ ID NO: 6101 - DNA, 288 bp, Streptococcus agalactiae
atgtctagaaaagtacgtcgtcacttcaccgatgattttaagcaacaaattgttgacctttacaatgttggtagaaagcgtagcagtctcatcaaggtatatgagctaaccccttccaccttcgataagtgggttagacaagccaaaacaactggttcattcaagtctattgataatctgacagatgaacagcgggagctaattgaactcagaaaacacaataaagaactcgaaatgcaattagatatcctaaagcaagcagtggtgattatggcacaaaaagggaaa

SEQ ID NO: 6102 - protein, 96 aa, Streptococcus agalactiae
MSRKVRRHFTDDFKQQIVDLYNVGRKRSSLIKVYELTPSTFDKWVRQAKTTGSFKSIDNLTDEQRELIELRKHNKELEMQLDILKQAVVIMAQKGK

SEQ ID NO: 6103 - DNA, 777 bp, Streptococcus agalactiae
atgtgtcgctggctgaatatgccacactcaagttattactatcaagccgtggagtcagtatctgaaacggagtttgaagaaactattaaaagaattttcctcgatagcgagtccagatacggatccagaaaaatcaaaatatgcttgaataacgaaggtatcacactttcacgtcgtcggattcgacgcattatgaagcgactcaatttggtttctgtttatcagaaagccaccttcaaaccacattctagaggcaagaatgaagcccctattcccaaccacttagacaggcaatttaagcaagaaagaccactacaggccttagtcactgacttaacctatgttcgtgtaggcaatcgttgggcttatgtttgcctcatcattgacctatacaaccgtgaaatcatcggcctgtctcttggttggcacaagaccgctgaactcgttaagcaagccatacaaagcatcccttacgccctgaccaaagtcaagatgttccattcagatcgtrgcaaagagtttgataatcagttaattgatgaaatattggaagcctttggaatcacacgttcgcttagtcaggctggttgtccttatgacaatgccgtagctgaaagtacgtatcgtgctttcaaaattgaatttgtttatcaagaaacctttcaattgctggaagaactagctcttaagactaaagactatgttcattggtggaattaccaccgcattcatggtagtctcaactaccaaacaccaatgactaaaagattaattgcc

SEQ ID NO: 6104 - protein, 259 aa, Streptococcus agalactiae
  MISC_FEATURE (1)..(259): Xaa = Any Amino Acid
MCRWLNMPHSSYYYQAVESVSETEFEETIKRIFLDSESRYGSRKIKICLNNEGITLSRRRIRRIMKRLNLVSVYQKATFKPHSRGKNEAPIPNHLDRQFKQERPLQALVTDLTYVRVGNRWAYVCLIIDLYNREIIGLSLGWHKTAELVKQAIQSIPYALTKVKMFHSDRXKEFDNQLIDEILEAFGITRSLSQAGCPYDNAVAESTYRAFKIEFVYQETFQLLEELALKTKDYVHWWNYHRIHGSLNYQTPMTKRLIA

SEQ ID NO: 6105 - DNA, 1167 bp, Streptococcus agalactiae
atggattttttcaattttagatttaaagattcagacagtactagtagtttttggtattatattttgagatcatgttataataaaaaattgtctagcgatttatggagtgatattgagaaattaatttcagtacatctaaaaaacattataacactatataataacgaaacaattttaagtggcaaagatattgagagtatatatatcgaaacattaagcactgattactcaagaaatgattactctaccagtgaggagctaacgcaaaaagcactccataattttttgtggaatcataatggtatacctattgttccagaactagataatttattattactaattcaaaaagatttaaaaatagtcgaagatgagttttgttcttatttaactaatcaaatagagatccaggaacaatcaaaagatgattattttaaagatataactaatttgggaaataattacttattaaaatctcgaattatttttgaactcttgtataaaagtaatatttctagtgcattcacatgtaattcttttgttgcactacatgattttcataacgaaaattgtttcaattcctatgaaggatttcttagctacatttatgacttagaaagtaataatgaatttaatgttgaaacatcaatattgaattttaattatacattacctagaatagataaattacaacgtaatattcatggaaccctgaatgataaaaatattatttttggaatagattatgattctttaattgatatacaaaaagataaaaatgttaccctgcctgttgaatttaccaaatcatacaggatattacagaacggaaatatatttcaatatccaattccctctgaactaacttttataaaattttatggtcatggtctgggtgaagcagactattcttattttcaatcaatttttgactcaattaatctttattccagtgacactgtactaattttctattggagttgttataacgagaatattagggaacaaattaaatctcaacaagttcatgcagtacataaattaattgaaaaatatggagatacttttaataataagaatcatggcagaaatttattcacaaaacttcaattagaaaatcgtttaattattcaagaaatactttataatgatattctaaatccatat

SEQ ID NO: 6106 - protein, 389 aa, Streptococcus agalactiae
MDFFNFRFKDSDSTSSFWYYILRSCYNKKLSSDLWSDIEKLISVHLKNIITLYNNETILSGKDIESIYIETLSTDYSRNDYSTSEELTQKALHNFLWNHNGIPIVPELDNLLLLIQKDLKIVEDEFCSYLTNQIEIQEQSKDDYFKDITNLGNNYLLKSRIIFELLYKSNISSAFTCNSFVALHDFHNENCFNSYEGFLSYIYDLESNNEFNVETSILNFNYTLPRIDKLQRNIHGTLNDKNIIFGIDYDSLIDIQKDKNVTLPVEFTKSYRILQNGNIFQYPIPSELTFIKFYGHGLGEADYSYFQSIFDSINLYSSDTVLIFYWSCYNENIREQIKSQQVHAVHKLIEKYGDTFNNKNHGRNLFTKLQLENRLIIQEILYNDILNPY

SEQ ID NO: 6107 - DNA, 1209 bp, Streptococcus agalactiae
gtgagaatccaaatggcaacaaaaagtagtaaaaaatacaaaggtgtttattgtgataataagggaaagatattttatcagattgatcttggaatcgacccagtaactggcaaaagggtacaaaagaaagctagaaaaaatcaatatggtaaaacctttgaaacaatgaaagaagcatatgacgaattagttcgtataaaatatgaatttgccaacaaagtcagtttagaaaattacaatatgacttttgaaaactatatgaacaaaatttatttaagagcatataagcaaaaggttcagtctgtgacatataagacggctcttcctcatcataaactttttattcaatattttggtttaaagccattaaaagcaataactcctagagattgcgaagcttttagattgcatatcatagagaattattctgaaaactatgcgaaaaatttatggtcaaggtttaaagcttgtatgggttatgcagaaagacttggctatatttcaaatatgccttgtaaagcattagataatcctagaggtaaacatccagaaactccattttggacctatgcggagtttcagacatttatcaaatcatttgacttacatgattatgaagaattgcaacgatttactgccatctggttatattatatgacaggtgtacgagtgagcgaaggtttatctttatgttgggaggatattgattttgataaaaaatttctaaaggtacatacaaccttagagaaagatgaaaatggtaattggtatcgtaaagaccaaacaaagactccagcaggtgaacgacttattgaattggatgatattactattgaagtacttcaagtttggcgaaaaaatcagtttgcaaatcaagatacagattttatcatttcaagatttggagatcctttttgcaaatcaaccatttgtcgcatcatcaaacggaaagctcaacaggtaggagttccagtaattacaggaaaaggtctcagacatagccatgcatcctatctaatcaatgtcttgaaaaaagatattttatatgtagccagacgtatgggacatgccgataaatcaacaactttgaatacttacagtcactggtttaatgctttagataaaacagtttctgaagaaatcacacaaaatatcaaaagtgcaggattggattcaattttatgccaaaattcctgccaaacttcaaat

SEQ ID NO: 6108 - protein, 403 aa, Streptococcus agalactiae
MRIQMATKSSKKYKGVYCDNKGKIFYQIDLGIDPVTGKRVQKKARKNQYGKTFETMKEAYDELVRIKYEFANKVSLENYNMTFENYMNKIYLRAYKQKVQSVTYKTALPHHKLFIQYFGLKPLKAITPRDCEAFRLHIIENYSENYAKNLWSRFKACMGYAERLGYISNMPCKALDNPRGKHPETPFWTYAEFQTFIKSFDLHDYEELQRFTAIWLYYMTGVRVSEGLSLCWEDIDFDKKFLKVHTTLEKDENGNWYRKDQTKTPAGERLIELDDITIEVLQVWRKNQFANQDTDFIISRFGDPFCKSTICRIIKRKAQQVGVPVITGKGLRHSHASYLINVLKKDILYVARRMGHADKSTTLNTYSHWFNALDKTVSEEITQNIKSAGLDSILCQNSCQTSN

SEQ ID NO: 6109 - DNA, 381 bp, Streptococcus pyogenes
ttgaaagttcatacaaccttggaaaaggatgaaaatggaaattggtatcgtaaagaccaaacaaaaacgccagcaggagaacgtcttattgagttagatgatgtgacaatagtagtattggaaaattggagaagaaatcaagtagtcaatactgacacagatttcattatttcacggtttggtgaaccattttgtaaatcaacgatttgtcgagttattaagcacaaagctcaaagtattggagttcccgtaataactggaaaaggattgcgacatagttatgcttcctatcttattaatgttttgaaaaaagacattctgtacgttgcaaagtgtatgggacatgctgataagtctacaactttgaatacatatagtcac

SEQ ID NO: 6110 - protein, 127 aa, Streptococcus pyogenes
LKVHTTLEKDENGNWYRKDQTKTPAGERLIELDDVTIVVLENWRRNQVVNTDTDFIISRFGEPFCKSTICRVIKHKAQSIGVPVITGKGLRHSYASYLINVLKKDILYVAKCMGHADKSTTLNTYSH

SEQ ID NO: 6111 - DNA, 225 bp, Streptococcus agalactiae
atgagaactgctacatataaagatttaatgaacttaggatttcctgaacatacctctagagacattattcgtgaagctaaaaaaattgctgtaaaaaagtttgaagaagctcgcaaagttgaccataatgcggtacaattaagtaaatcgccctttgacaatcgaagactaggtatcgcaccagcagaaattgtggaacaattaatagggattccactatctaaa

SEQ ID NO: 6112 - protein, 75 aa, Streptococcus agalactiae
MRTATYKDLMNLGFPEHTSRDIIREAKKIAVKKFEEARKVDHNAVQLSKSPFDNRRLGIAPAEIVEQLIGIPLSK

SEQ ID NO: 6113 - DNA, 225 bp, Streptococcus agalactiae
ttgatgtaccgacgtttaagggatttgagagaagacaatgatttcactcaaaaatacgttgccgaaaagctttcgtttacccactctgcttattcaaaaattgagagaggagaacgtattttatcggcagatgtaataataaaactttcaaatctatataacgttagtacagattatttgttggggcaaactgactttccccaccgaataaagaataatttaaaa

SEQ ID NO: 6114 - protein, 75 aa, Streptococcus agalactiae
MMYRRLRDLREDNDFTQKYVAEKLSFTHSAYSKIERGERILSADVIIKLSNLYNVSTDYLLGQTDFPHRIKNNLK

SEQ ID NO: 6115 - DNA, 1863 bp, Streptococcus agalactiae
atggtcatcactaagcattatgctgttcatgggaaaaaataccgccgtcaattgattaagtatattcttgatcctaagaaaaccaggaatttatcattgatttcagattttgggatgagtaattatcttgattttcctgactatgtggaactggtgaagatgtatcaaaataattttctttcaaatgaccaactctacgactcacggtttgatagacaagagaaaaagcaacagaaaatacatgctcatcatattattcagtctttctcacctgaagataaattaagcccagaggaaatcaatcgtattggctatgaaacgataaaagagttgataggtggtcaatataaattcattgttgccactcatgttgatcaggaccattgtcataatcacattattatcaactcaatcaatagccaatctcaaaaaaagttgaagtgggactacgctcttgaaagaaatttacaaatgatttcggatagaatttctaaagtagcgggtgctaaaatcattccacctaaacgttattctcatagagattatgaggtctatcgacgttctaatcacaaatacgaattgaagcagcggttattttttctcatggaacattcaattgatttcaatgattttatgcaaaaagctgagcaactaaatgtcaaaatagatttctcaaggaaacatagccgattttttatgacagatagaaatatgaagcaagtcatccaaggagataagctgaataagagagaaccctattcaaaagaatattttcaacgttactttgccaagaaaaagattgaactgattttagaatttttattgctaagatccaactcatttgatgatttagttgagaaagctcggttactgggattagaattgaagagcaagaaaaaaacgatagattttgttctttctgatggaaaaagctgcatttccataccaaataagtcattaagaaagaaaaatctttatgatactacgtattttgatagttatttcaaggaacatgatgtgtttgaagtgcttcataataatgaagtaaaaatagaatttgaaaagtttgagacacaacagctttcagaaatattgactgtagaagaaataaccgaagcttatgaaacgtataaaactaagagagatgctgtacatgagtttgaagttgagatcacggaggagcaaattgaaaaaattgtgctagatggtctatttgttaaagtttggatgggtattggacaagaaggactaatcttcattccaaatcatcaacttaatatcttagaacaagaaaataagaagcagtatcaggtgtttattcgagaaacatcttcttatttcatttatcataaagaggactcagaaatgaatcgatttatgaaaggaagggacttgattcgccaactaacgtttgacaataagtctttaccttataagagacgaataagtctggtcagtcttcaacaaaaaattgaagaaatcaatttattgatgacattaaacattcaaaataaatcctttctagaattaaaagatgaattggttggagacatcgcacagctagatattgaattgacaaatcttcaagacaaaaacaccaccttaaacaagatggcagaagtagttgttaacctacaaagtgataatcaagataccaagcaattagctaagtatgaatgttccaagatgaatttatcgcagaatgtaacaattggacagattgaatctgagattgaaatgatacagaatcagctagacaataaaatcgaagaatacgaaaatgcggttagaaagttggatgaatatgtaagagttttaaatatggataaatacaagacagacgatttttccattcatattgaa

SEQ ID NO: 6116 - protein, 621 aa, Streptococcus agalactiae
MVITKHYAVHGKKYRRQLIKYILDPKKTRNLSLISDFGMSNYLDFPDYVELVKMYQNNFLSNDQLYDSRFDRQEKKQQKIHAHHIIQSFSPEDKLSPEEINRIGYETIKELIGGQYKFIVATHVDQDHCHNHIIINSINSQSQKKLKWDYALERNLQMISDRISKVAGAKIIPPKRYSHRDYEVYRRSNHKYELKQRLFFLMEHSIDFNDFMQKAEQLNVKIDFSRKHSRFFMTDRNMKQVIQGDKLNKREPYSKEYFQRYFAKKKIELILEFLLLRSNSFDDLVEKARLLGLELKSKKKTIDFVLSDGKSCISIPNKSLRKKNLYDTTYFDSYFKEHDVFEVLHNNEVKIEFEKFETQQLSEILTVEEITEAYETYKTKRDAVHEFEVEITEEQIEKIVLDGLFVKVWMGIGQEGLIFIPNHQLNILEQENKKQYQVFIRETSSYFIYHKEDSEMNRFMKGRDLIRQLTFDNKSLPYKRRISLVSLQQKIEEINLLMTLNIQNKSFLELKDELVGDIAQLDIELTNLQDKNTTLNKMAEVVVNLQSDNQDTKQLAKYECSKMNLSQNVTIGQIESEIEMIQNQLDNKIEEYENAVRKLDEYVRVLNMDKYKTDDFSIHIE

SEQ ID NO: 6117 - DNA, 693 bp, Streptococcus pyogenes
gtggaacatcaaattgagaggttaattgctgaggacatttatatcaaggtgtcttttagtgtaaagcagagtggtcttattttcattcctaactatcaattggatattaggaaagaagaaaatcataaaaaatataaagtctatattcgtgagaccgcacaattcttcatttacaacaaggaggcgtctgaacttaatcgctatatgcgagggcatgagctcatttgccagttaaccaatgatagcaagagtattccaaaaagaagacgacaaaccattgatacacttaagaaaaagattgaagaaataagtctcctcattgagttagatacggagaataagccttatcaagatattaaagatgacattgttaaagatatggctcaattagatttgaccattacagagttgcaggaccatattgctcatctcaataaggttgcggaggtcttgcttaatctgaacaacaacgatatagagaaccgccgtttggccagatatgactatgccaagatgaacttgactgcagctataaaaatagaagaagttgagaaagagattgaaacttctcaaaatgaacttaatatatccatagatgagtatgaatatctagtaagaaggttggaaaagtttggagagatcttgagtgatagcaaaattatcgatacttctcgaaatgaaatacaatgggag

SEQ ID NO: 6118 - protein, 231 aa, Streptococcus pyogenes
VEHQIERLIAEDIYIKVSFSVKQSGLIFIPNYQLDIRKEENHKKYKVYIRETAQFFIYNKEASELNRYMRGHELICQLTNDSKSIPKRRRQTIDTLKKKIEEISLLIELDTENKPYQDIKDDIVKDMAQLDLTITELQDHIAHLNKVAEVLLNLNNNDIENRRLARYDYAKMNLTAAIKIEEVEKEIETSQNELNISIDEYEYLVRRLEKFGEILSDSKIIDTSRNEIQWE

SEQ ID NO: 6119 - DNA, 360 bp, Streptococcus agalactiae
atgggaaatctagttagagagatacgtaaggaagtcaatttctcaatagaagagtatcaacagatacaaaattttatggaacaggagggatatgaacaattttccccttttgctagaggtaaattattgaaaatagaccaccaaccatctcagcagcttgaagaatggataaaatatttacagcaccaaaaagtagaacagatttaccgggatgtacatgaaatacttgttctggcaaagttgtctcaatcagttactatggaacatcttgaaatcatcctgacttgtatcaaagacttgatgaaggaaattgaggtaactattccattaagctattcattcaaagacaagtacatgggg

SEQ ID NO: 6120 - protein, 120 aa, Streptococcus agalactiae
MGNLVREIRKEVNFSIEEYQQIQNFMEQEGYEQFSPFARGKLLKIDHQPSQQLEEWIKYLQHQKVEQIYRDVHEILVLAKLSQSVTMEHLEIILTCIKDLMKEIEVTIPLSYSFKDKYMG

SEQ ID NO: 6121 - DNA, 1314 bp, Streptococcus agalactiae
atgaataatatgtcagacttattatccctaccagacattaaaacaatagaaccgccacaagaaaatgaaaccgatatgatgtttaaagttgaagcagtcggaccacctgaacgttgtcctgaatgtggttttgacaagttgtacaaacacagttcaagaaatcaactaattatggatttgcccattcgtttaaagcgagtgggcttacatttgaaccgtagacgatacaagtgtcgtgaatgcggatctaccatatctgtagatgaaaagcgtagtatgaccaaaaggcttttaaagtccattcaagagcaatccatgtctaagacctttgtagaagtcgcagaaagcgttggtgttgacgagaaaaccattaggaacgtttttaaggactatgtggcactcaaagaacgtgaataccagtttgaaactcctaagtggcttgggatagacgagatacatattatccgtagacctcggcttgtattgactaatattgaacgcaggactatttatgacatcaagcctaaccgtaacaaggaaacagtcatccaacgtctttcagaaatcagtgacaggacttacattgagtacgtcacaatggatatgtggaagccctacaaagacgcagtgaacactatccttccacaagctaaagttgtcgtagataagtttcatgtagttagaatggctaatcaagccttagataacgtcagaaagtctttgaaagcccatatgagccaaaaagaaagacgtacccttatgcgtgaaaggtttatccttctaaagcgtaaacacgatctaaatgaacgtgaatcattcctcttagatacttggttaggtaatcttcctgctttaaaagaagcctatgaactcaaagaagagttttactggatatgggatactcctgatccagatgaaggtcatcttcgttatagtcaatggagacaccgttgtatgtccagcaactctaaagacgcatataaagacctcgtgagagccgtagacaactggcatgttgaaatattcaactactttgataaaaggctcactaatgcttatacggagtcaattaacagcattattaggcaggtagagcgaatgggtagaggttactcgtttgatgccttacgagccaaaatccttttcaatgagaagctccataaaaagcgtaagccacgatttaattcaagtgctttcaataaagctatgttatacgatactttcaattggtatgaagtgaatgatcacgacattacagacaacttaggtgtcgatttttccacacttattaagaatttggagaagggtgattta

SEQ ID NO: 6122 - protein, 438 aa, Streptococcus agalactiae
MNNMSDLLSLPDIKTIEPPQENETDMMFKVEAVGPPERCPECGFDKLYKHSSRNQLIMDLPIRLKRVGLHLNRRRYKCRECGSTISVDEKRSMTKRLLKSIQEQSMSKTFVEVAESVGVDEKTIRNVFKDYVALKEREYQFETPKWLGIDEIHIIRRPRLVLTNIERRTIYDIKPNRNKETVIQRLSEISDRTYIEYVTMDMWKPYKDAVNTILPQAKVVVDKFHVVRMANQALDNVRKSLKAHMSQKERRTLMRERFILLKRKHDLNERESFLLDTWLGNLPALKEAYELKEEFYWIWDTPDPDEGHLRYSQWRHRCMSSNSKDAYKDLVRAVDNWHVEIFNYFDKRLTNAYTESINSIIRQVERMGRGYSFDALRAKILFNEKLHKKRKPRFNSSAFNKAMLYDTFNWYEVNDHDITDNLGVDFSTLIKNLEKGDL

SEQ ID NO: 6123 - DNA, 1638 bp, Streptococcus agalactiae
atgaataaatttaaggtaaacatttcaggaatgacttgtacgggttgtgaaaaacacgtagaatcagcacttgaaaagataggtgctaaaaatattgagtctagttatcgtcgtggtgaagcagtatttgaactgcccgatgatattgaggttgaaagtgcaataaaggcgattgatgaagcaaattaccaagccggagaaattgaagaagtatcatcactagaaaacgtggcgttaattaatgaagacaattatgaccttcttattattggttctggtgctgctgccttttcttcggcaattaaagctatagaatacggtgcaaaagttggaatgattgagcgtggaacggttgggggaacctgtgtgaatattggctgtgttccgtcaaaaactcttcttagggcaggggaaatcaatcatttatcaaaagacaatccgtttataggtttacaaacatccgctggagaagtggatttagctagtttaatcacgcaaaaggataaattggtgagcgaacttcggaatcaaaaatatatggatttaattgatgaatataattttgatttaattaaaggtgaagcaaaattcgttgatgctagtacggttgaggtcaatgggacaaagttatctgcaaaacgctttttaattgcaacaggtgcatcgccttcgttgccccaaatttcaggacttgaaaaaatggactatttaactagtacaacacttcttgagttaaagaaaataccaaaacgattaactgtaattggttcaggatacattggaatggagcttggacaactatttcatcatttaggttcagaaataacgcttatgcaaagaagtgagcgacttttaaaggagtatgatcctgagatttcagagtcagttgaaaaagcgttaattgaacagggtataaaccttgtcaaaggggcaacttttgagcgtgttgaacaaagtggagagataaaaagggtttacgtaacagtaaatggcagtagagaagtcattgaatcagatcagttacttgttgccactggaagaaaaccaaatacggattctttaaatttaagtgcagcaggtgttgaaactggaaaaaataatgaaatcctgatcaatgattttggtcaaacaagtaatgaaaagatttatgcagcaggagatgtgactttaggaccacaatttgtatatgtagcagcctatgaaggtggaattattactgataatgctattggtggattaaacaaaaaaatagatttatcggtagttcctgctgttacgtttacgaatccgacggttgcaacggttggtttaacagaagaacaagcaaaagagaaagggtatgatgtgaagacatctgtattacctttagatgctgttccaagagcaattgtaaaccgtgaaacaaccggtgtatttaaactagtagcagatgcagaaacactaaaagtattaggggttcatattgtatctgaaaatgcaggagatgtcatctatgcagcatcattagctgttaaatttggcttaacgatagaagatttaacagaaaccctagcaccatatttaacaatggctgaagggctaaaattagttgcacttacgttcgataaagatatttcgaaattatcttgttgtgcaggc

SEQ ID NO: 6124 - protein, 546 aa, Streptococcus agalactiae
MNKFKVNISGMTCTGCEKHVESALEKIGAKNIESSYRRGEAVFELPDDIEVESAIKAIDEANYQAGEIEEVSSLENVALINEDNYDLLIIGSGAAAFSSAIKAIEYGAKVGMIERGTVGGTCVNIGCVPSKTLLRAGEINHLSKDNPFIGLQTSAGEVDLASLITQKDKLVSELRNQKYMDLIDEYNFDLIKGEAKFVDASTVEVNGTKLSAKRFLIATGASPSLPQISGLEKMDYLTSTTLLELKKIPKRLTVIGSGYIGMELGQLFHHLGSEITLMQRSERLLKEYDPEISESVEKALIEQGINLVKGATFERVEQSGEIKRVYVTVNGSREVIESDQLLVATGRKPNTDSLNLSAAGVETGKNNEILINDFGQTSNEKIYAAGDVTLGPQFVYVAAYEGGIITDNAIGGLNKKIDLSVVPAVTFTNPTVATVGLTEEQAKEKGYDVKTSVLPLDAVPRAIVNRETTGVFKLVADAETLKVLGVHIVSENAGDVIYAASLAVKFGLTIEDLTETLAPYLTMAEGLKLVALTFDKDISKLSCCAG

SEQ ID NO: 6125 - DNA, 390 bp, Streptococcus agalactiae
atgatttatcgcattagtgagtttgcagataaatgtggagttaataaagaaacgatcagatattacgagcgaaaaaatttattacaagaacctcaccgaacggaagctggttatcggatatattcatatgatgacgttaagcgtgttgggtttattaaacgaatacaggaatttggtttctctttaagcgagatttataaattacttggtgttgtagataaagatgaagttcgttgtcaagatatgttcgaatttgtttctaaaaaacaaaaggaagtgcaaaaacaaatagaggatttaaaacgaattgaaactatgttagacgacttaaaacaacgatgtccagatgaaaagaaattacattcgtgtccaataatagaaacattaaca

SEQ ID NO: 6126 - protein, 130 aa, Streptococcus agalactiae
MIYRISEFADKCGVNKETIRYYERKNLLQEPHRTEAGYRIYSYDDVKRVGFIKRIQEFGFSLSEIYKLLGVVDKDEVRCQDMFEFVSKKQKEVQKQIEDLKRIETMLDDLKQRCPDEKKLHSCPIIETLT

SEQ ID NO: 6127 - DNA, 480 bp, Streptococcus agalactiae
ttggagcgaattcctgttcagtttaaaggttgtgatgattattataacgaaaatgttggataccctctaagcaggattaatttggagcattatctaactgaaggtggtgtgctctactttgtagtgtactcgaaagacgttagtcctactgtcacttatgcttcactaacaccaaaagtcattaagaacgtattgccagctagtgacaagaaaaaaagaattaagaaaaaagaagatatctttctcctgttctggatggctataatagcgaaattattgattttaccttatcccgctctccaaacctcatacaagtcaagaccatgcttgagaaggtcttccctgaggaaacttacccaaataccattctccatagtgaccaaggttggcaataccaacatgaagtctatcaccgctttcttgcaagtaaaggcatacatccttccatgtctcgcaaagggaccagcacggataatggta

SEQ ID NO: 6128 - protein, 160 aa, Streptococcus agalactiae
MERIPVQFKGCDDYYNENVGYPLSRINLEHYLTEGGVLYFVVYSKDVSPTVTYASLTPKVIKNVLPASDKKKRIKKKEDIFLLFWMAIIAKLLILPYPALQTSYKSRPCLRRSSLRKLTQIPFSIVTKVGNTNMKSITAFLQVKAYILPCLAKGPARIMV

SEQ ID NO: 6129 - DNA, 93 bp, Streptococcus agalactiae
atgggtgtcaacaatcggatgcgatcattgaaaacaatgttatgcttcaaaagggatattaacaggaaatatacaactaaaggacgctttaac

SEQ ID NO: 6130 - protein, 31 aa, Streptococcus agalactiae
MGVNNRMRSLKTMLCFKRDINRKYTTKGRFN

SEQ ID NO: 6131 - DNA, 2127 bp, Streptococcus agalactiae
atgtctagagggaaagcaaaacagtctgaaaaagaaatgaaagcctatcgtgttcaaggatttacttgtactaactgtgcagccatttttgaaaataatgttaaagaacttcccggtgttcaggatgcgaaagtaaatttcggagcatctaaagtttatgttaaagggacgacaaccattgaagaattagaaaaagcaggagcatttgaaaatttaaaaattcgagatgaaaaagaacaaagggtaggaggagaacctttttggaagcagaaagaaaacattaaggtatatatatcagctcttttacttgtagttagctggttcttaggagagcagtatggtgaagagcatgttctaccgacaattggttatgcagcgtccattttaatcggtggatattcgttatttattaaaggtctcaaaaatttaagaagattaaatttcgatatgaatacgcttatgactattgccattataggagctgcaattattggtgaatggggtgaaggggcaaccgttgttatcctatttgcgattagtgaagcattagagcgttattcaatggataaagcacgtcaatctattgaatctttaatggatattgccccaaaagaagcgttaattcgacgaggcaatgaagaaatgatgattcatgttgatgagattcaagttggagacatcatgatagttaagcccggtcaaaagttagcaatggatggaatagtggttaaaggtacatcgacattaaatcaggctgcgattacaggtgaaagtgttccagtaacgaaaatcacaaatgatgaagtatttgcaggaaccttgaatgaagaagggttacttgaggttaaagtaacaaaacgagttgaagatactactctttcaaaaatcattcacttggtagaagaagcccaagcagaacgggccccctctcaagcgtttgtcgataaatttgcaaaatactatacaccagctattgtcatactagctcttttaattgcagtagttccaccattatttggcggagactggagccaatggatttatcaaggattagctgtattagtggttggttgtccttgtgccttagtagtctcaactccagttgctgtggttacagcaataggaaatgcagcgaaaaatggtgtattaattaaaggtggtatccatttagaagcagcaggacacttaaaagcgatagcatttgataaaacaggaacattaaccaaagggattccagctgtaacagacattgtgacatatggtagaaatgaaaatgaattaataaccataacatcagccattgaaaaaggatcgcagcaccctcttgcttcagcgattatgcgaaaagcagaagaaaatggattaaaattcaatgaagtaacagtagaggattttcaatccattacaggtaaaggcgttaaagccaaaataaataatgaaatgtattatgtgggaagtcaaaatctttttgaggaattacacggaagcatttcaagcgataaaaaagaaaaaattgccgatatgcaaactcaaggtaaaacggtgatggtgttaggaacagaaaaagaaattctttcgtttattgccgtagccgatgaaatgagggaatcgtctaaagaagttatcggcaagttgaacaatatgggaatcgaaacagtgatgctaacaggcgataaccaaagaacggcaacagccatcggaaaacaagttggtgtttcggatattaaagctgacttacttccagaagataagcttaattttattaaagaacttcgagaaaaacatcaaagtgtggggatggtcggagatggcgtgaatgatgctccagcccttgcggcatctaccgttggtgtagcaatgggtggtgctggaactgatacagctttagaaacggctgacatcgccttaatgtctgatgatttgagtaaattgccatatacaataaaattaagccgtaaggctttagcaatcatcaagcaaaacattaccttctctttggcgattaaattagtggcattacttttggtcatgcccggttggttaacactttggatagcgatatttgctgatatgggagcaactttacttgtaacattaaacagtttacgcttattgaaaatcaaagaa

SEQ ID NO: 6132 - protein, 709 aa, Streptococcus agalactiae
MSRGKAKQSEKEMKAYRVQGFTCTNCAAIFENNVKELPGVQDAKVNFGASKVYVKGTTTIEELEKAGAFENLKIRDEKEQRVGGEPFWKQKENIKVYISALLLVVSWFLGEQYGEEHVLPTIGYAASILIGGYSLFIKGLKNLRRLNFDMNTLMTIAIIGAAIIGEWGEGATVVILFAISEALERYSMDKARQSIESLMDIAPKEALIRRGNEEMMIHVDEIQVGDIMIVKPGQKLAMDGIVVKGTSTLNQAAITGESVPVTKITNDEVFAGTLNEEGLLEVKVTKRVEDTTLSKIIHLVEEAQAERAPSQAFVDKFAKYYTPAIVILALLIAVVPPLFGGDWSQWIYQGLAVLVVGCPCALVVSTPVAVVTAIGNAAKNGVLIKGGIHLEAAGHLKAIAFDKTGTLTKGIPAVTDIVTYGRNENELITITSAIEKGSQHPLASAIMRKAEENGLKFNEVTVEDFQSITGKGVKAKINNEMYYVGSQNLFEELHGSISSDKKEKIADMQTQGKTVMVLGTEKEILSFIAVADEMRESSKEVIGKLNNMGIETVMLTGDNQRTATAIGKQVGVSDIKADLLPEDKLNFIKELREKHQSVGMVGDGVNDAPALAASTVGVAMGGAGTDTALETADIALMSDDLSKLPYTIKLSRKALAIIKQNITFSLAIKLVALLLVMPGWLTLWIAIFADMGATLLVTLNSLRLLKIKE

SEQ ID NO: 6133 - DNA, 786 bp, Streptococcus agalactiae
atggggtattttaaatctattgaacaatttctattttcctatatctctttacataccatagaaaaggattctgtaaaccgtaaaatatttgcaggagctaaaccgttagatacactctctgacaaactccttaatgatagttcaaaagttaaaaatataaatcttaaatctattacaagtttttttggagattttaacagtcagaaattctatccacgtaatatggatttacttgctgatggtattgatgacgaaacgtattattatattgttgagtcattgtcaacttttgtaggattaagaaatggctattttcataagcataatttaaatgattggacaacaattgaagaaactagaaaccatgcattgttaattttttatctagtactaggagggtatagaatatcggagcaagataaactagatctcggtttgattaaaactgtagaaagtggctacttaaatctatgtgagtatattcataatagaaaaattgataatatgcttgagataccaatcttttattttgggagagatcgtaacgagtttgatttttacatttcgaataaagacccttttatcacaaatgacagtaatcaggagccaatttattctggagcatattttaaacgacttggaaactcaaaaagtttgtttaagctaacagatagtaatatccctgaggaaatctgggaaggaaaattaataattggtcggcagggacctagttttaaaccatctggtcctttggaaaaatattcgaagatggtaaatttttcaaaa

SEQ ID NO: 6134 - protein, 262 aa, Streptococcus agalactiae
MGYFKSIEQFLFSYISLHTIEKDSVNRKIFAGAKPLDTLSDKLLNDSSKVKNINLKSITSFFGDFNSQKFYPRNMDLLADGIDDETYYYIVESLSTFVGLRNGYFHKHNLNDWTTIEETRNHALLIFYLVLGGYRISEQDKLDLGLIKTVESGYLNLCEYIHNRKIDNMLEIPIFYFGRDRNEFDFYISNKDPFITNDSNQEPIYSGAYFKRLGNSKSLFKLTDSNIPEEIWEGKLIIGRQGPSFKPSGPLEKYSKMVNFSK

SEQ ID NO: 6135 - DNA, 597 bp, Streptococcus agalactiae
ttgatgttaaatcaatattttctgcattttgaagagagtaaaatagttactcccttatatgctttcgacattgattatctgaatattcctaaatatgtcggtctatcaaaggagcagattctggaaaactaccgcatcctcctgacctatttgaatatcccatggtttctcgcattggatatgccggatttccctagttcggctagtgggcttttccactttttcgaggtcaagaagctttttatgctggactacctgatcttgatcttttctggaatgggcacgctatggtttgtacgacatctaaataggagacgagaatcttggcggctcctaccctacttccgccagggaacccttattccccttgctatccttttggctctcctggttagcttcgacacgctgtttgtgcttttccataaagttttctttaacaatgacgcctggctcttcaatgccactactgatcctattatcttagctttacctgccgagttctttatgcacagtttcctcttggcctttggattaatcgaagtcttcctaatcctggggtacttcactactaaatatcgaatctctgccccaagccgt

SEQ ID NO: 6136 - protein, 199 aa, Streptococcus agalactiae
MMLNQYFLHFEESKIVTPLYAFDIDYLNIPKYVGLSKEQILENYRILLTYLNIPWFLALDMPDFPSSASGLFHFFEVKKLFMLDYLILIFSGMGTLWFVRHLNRRRESWRLLPYFRQGTLIPLAILLALLVSFDTLFVLFHKVFFNNDAWLFNATTDPIILALPAEFFMHSFLLAFGLIEVFLILGYFTTKYRISAPSR

SEQ ID NO: 6137 - DNA, 2085 bp, Streptococcus agalactiae
atgagaaataacaaaaaacattcgtcacatagtcatcataatcacggcgacattgatcactcaaaacacgaccataatgaaatggaacatagtcagatggatcacagcaatatggatcacagtgaaatggatcatggcgcaatgggagggcatgcccaccaccatcacggtagctttaaggagattttcttgaagtcactcccattaggaattgcaatcttactcattacgcctatgatggatattcagttgcctttccaaattatctttccttatgcagacgttgtagcagctgtattggcaacaattctatacatttttggcggaaaaccattctacatgggtgcgaaagatgagtttaattcaaaagctccaggcatgatgtccttgattactttgggaataacggtttcttatgcctatagtgtttacgcagtggccgctcgttatgtgaccggagagcatgtcatggacttcttctttgagtttacaaccttaattttaatcatgttattaggacactggattgaaatgaaggcattgggtgaagcaggggacgcgcaaaaagcattggctgagttggtgccgaaagatgctcatgttgttttagaagacgattcgattgagactcgccctgtgtctgaacttcagattggagatgttatccgtgttcaagcaggagaaaatgttccagctgatggtatcattatccgcggagaatctcgtgtaaacgaagcgcttgtgactggggaatcgaaaccaattgaaaaaaaaaccggagatgaggtcatcggtggatcaaccaatggtggcggagtcctctatgtggaaataaagcagacgggcgatcagtccttcatttctcaggttcagacattaatcagccaagcgcaaagccaaccttctcgagcagagaatgtggctcaaaaagtagctagctggttgttctacattgcggttgtagtagctttaatcgccctactaatctggacgatcattgcggatctgcctacagccgttatctttactgtgactgcgttagttattgcctgcccacatgctttgggtcttgctattcccttggtagtatcacgtagtactagtttgggtgcaagccgaggattactggttaaaaatagagaagctttggaattaactactaaagcggatgttatggtattggataaaacaggtactttaacaactggtgaatttaaagtgttggacgtcactgttttgagtgataaatattctgaagaagaaattacaggcttgttggcgggtatagaggcgggctccagtcacccgattgcccaatcgattgtgaaccacgctgaagcgaaaggcattaagtcagtttcctttgactccattgaaatcgtttcgggagcaggaatagaaggggaggcgaacggccaccactatcaattaatcagccaaaaggcatacggaaaagcattgcgtatggatattccgaaaggcgctactttaagtatccttgtagaaaataatgaagcaatcggcgctgtcgcattgggagatgaactgaaagaaaccagcagaaacttgatcgaggtgctgaaaaaatacggaattgaaccactcatggctactggtgataacgaggaagctgcacaaggagttgcagaagttctaggtattcaataccaagccaatcaatctccggaagataagtacaagctggtcgagtccatgaaaaaccaaaacaagacggttatcatggtaggagacggggtcaatgacgcaccttcccttgccttggcagacgtaggtattgcaatcggagctggaacgcaagtagctttggattctgcggatattatccttactcagtctgatccaggggatattgaatcctttatcgagttagcaaacaagacgacacgtaaaatgaaacaaaacttggtatggggagcaggctacaattttatcgcgattccaattgctgctggcctccttgctcctatcggcattaccttgggtccggccttcggcgccgtcctcatgtccttatcgaccgttattgttgccatcaatgctatgacattgaaattagagccgaaa

SEQ ID NO: 6138 - protein, 695 aa, Streptococcus agalactiae
MRNNKKHSSHSHHNHGDIDHSKHDHNEMEHSQMDHSNMDHSEMDHGAMGGHAHHHHGSFKEIFLKSLPLGIAILLITPMMDIQLPFQIIFPYADVVAAVLATILYIFGGKPFYMGAKDEFNSKAPGMMSLITLGITVSYAYSVYAVAARYVTGEHVMDFFFEFTTLILIMLLGHWIEMKALGEAGDAQKALAELVPKDAHVVLEDDSIETRPVSELQIGDVIRVQAGENVPADGIIIRGESRVNEALVTGESKPIEKKTGDEVIGGSTNGGGVLYVEIKQTGDQSFISQVQTLISQAQSQPSRAENVAQKVASWLFYIAVVVALIALLIWTIIADLPTAVIFTVTALVIACPHALGLAIPLVVSRSTSLGASRGLLVKNREALELTTKADVMVLDKTGTLTTGEFKVLDVTVLSDKYSEEEITGLLAGIEAGSSHPIAQSIVNHAEAKGIKSVSFDSIEIVSGAGIEGEANGHHYQLISQKAYGKALRMDIPKGATLSILVENNEAIGAVALGDELKETSRNLIEVLKKYGIEPLMATGDNEEAAQGVAEVLGIQYQANQSPEDKYKLVESMKNQNKTVIMVGDGVNDAPSLALADVGIAIGAGTQVALDSADIILTQSDPGDIESFIELANKTTRKMKQNLVWGAGYNFIAIPIAAGLLAPIGITLGPAFGAVLMSLSTVIVAINAMTLKLEPK

SEQ ID NO: 6139 - DNA, 204 bp, Streptococcus agalactiae
atgaaacaagaaatcttattagatggcgtaaaatgtgcaggttgtgcgaacacggtacaagaaagattttcagctattgaaggggttgaatctgtagaggttgatttagcgactaaaaaagcagtacttgaaagtcaaacagagattgataccgaaacgctcaatgctgctttagcagaaactaactattcagtattaagtgca

SEQ ID NO: 6140 - protein, 68 aa, Streptococcus agalactiae
MKQEILLDGVKCAGCANTVQERFSAIEGVESVEVDLATKKAVLESQTEIDTETLNAALAETNYSVLSA

SEQ ID NO: 6141 - DNA, 171 bp, Streptococcus agalactiae
ttgaatcgtcttaaccgtaaagcattgagcaagaccgatacggagctgaaactcacggcgactgccccgccaacattggactcatcaatagtccgccaaaaatatacaaaagacccatcgcaactggaatacctacaaggttgtaagcaaaagcccagaacaagttttgtt

SEQ ID NO: 6142 - protein, 57 aa, Streptococcus agalactiae
MNRLNRKALSKTDTELKLTATAPPTLDSSIVRQKYTKDPSQLEYLQGCKQKPRTSFV

SEQ ID NO: 6143 - DNA, 474 bp, Streptococcus agalactiae
atgaaggctgttaaagcacttagaagacgcggtgttgaagtaatcatgattactggagataacaaacgaacagccaaagcgattgctaagcaagtgggtatagacagtgtattaagtgaagtattacctgaagataaagcagaggaagtcaaaaaactacaagaggcaggcaagaaggtagcgatggttggagacggcattaacgatgcacccgcattagctcaagcaaatgtcggaattgcagttggatcaggtacagacgtggcgattgaatcggctgatattgtccttatgcgtaatgatttaaccgctgtattgactacgattgatttaagtcatgcaacgctacgaaacattaaacaaaacttgttctgggcttttgcttacaaccttgtaggtattccagttgcgatgggtcttttgtatatttttggcggactattgatgagtccaatgttggcggggcagtcgccg

SEQ ID NO: 6144 - protein, 158 aa, Streptococcus agalactiae
MKAVKALRRRGVEVIMITGDNKRTAKAIAKQVGIDSVLSEVLPEDKAEEVKKLQEAGKKVAMVGDGINDAPALAQANVGIAVGSGTDVAIESADIVLMRNDLTAVLTTIDLSHATLRNIKQNLFWAFAYNLVGIPVAMGLLYIFGGLLMSPMLAGQSP

SEQ ID NO: 6145 - DNA, 444 bp, Streptococcus agalactiae
atgagcacaatagaacttaatacttctatcacagatgctgaatgggaagtaatgcgtgtagtttgggcaaatgatttagtaactagtaaaacagtcatctctgtattgaaagaaaaaatggactggacagaatccactatcaaaacgatcttaggtcgattagttgaaaaaggcgtactaaatacagagcaagaaggtagaaagtttatttacactgccaatattgtagagaaagaagccgtaagggattttgcagaagatatttttaaccgtatttgcaaaaagaaagtcggaaatgtaataggaagcatcattgaagatcatgtcttaagcttcgatgatatagatcgactagagaaaatattagagataaaaaaatctttcgcagtagaagaagtggattgtcagtgtacagaagggcaatgcgattgccatgaaggctgt

SEQ ID NO: 6146 - protein, 148 aa, Streptococcus agalactiae
MSTIELNTSITDAEWEVMRVVWANDLVTSKTVISVLKEKMDWTESTIKTILGRLVEKGVLNTEQEGRKFIYTANIVEKEAVRDFAEDIFNRICKKKVGNVIGSIIEDHVLSFDDIDRLEKILEIKKSFAVEEVDCQCTEGQCDCHEGC

SEQ ID NO: 6147 - DNA, 111 bp, Streptococcus agalactiae
gtgtatcaggagtttttcttctctagaagaacaaaaaagattgaagaaaaattgtcccaaatggactttttcttcaatctgaaagccccatttaaggggcttttttatcta

SEQ ID NO: 6148 - protein, 37 aa, Streptococcus agalactiae
MYQEFFFSRRTKKIEEKLSQMDFFFNLKAPFKGLFYL

SEQ ID NO: 6149 - DNA, 618 bp, Streptococcus agalactiae
atgggacagacaatcatatctgctattggtgtttatatttccaccagtatcgattatttaattgttttaattattttatttgcacagctatcacagaataaacagaaatggcatatttatgcggggcagtatctaggcactggcttacttgtaggggcgagtttagttgctgcttatgtcgtcaatttcgtgcctgaagcatggatggttggattgcttggtttaatccctatctatttagggattcgctttgcaattgttggagaaggtgaggaagaagaagaggaagaaattattgaaagattagaacaaagcaaggcaaatcaactgttttggacagtaacattgctgacaattgcatctggcggagataatttaggtatctatataccttattttgcttcgttagattggtcacagaccctcgtggtgttgcttgtgtttgcaatcggcataattatcttttgcgagcttagttgggtgctatcttctattccgttaatatccgagacaattgaaaaataccagcgaatcattgtgccgttagtattcattccacttggactatacatcatgtatgaaagtggcacgattgagacttttctgaactttatttta

SEQ ID NO: 6150 - protein, 206 aa, Streptococcus agalactiae
MGQTIISAIGVYISTSIDYLIVLIILFAQLSQNKQKWHIYAGQYLGTGLLVGASLVAAYVVNFVPEAWMVGLLGLIPIYLGIRFAIVGEGEEEEEEEIIERLEQSKANQLFWTVTLLTIASGGDNLGIYIPYFASLDWSQTLVVLLVFAIGIIIFCELSWVLSSIPLISETIEKYQRIIVPLVFIPLGLYIMYESGTIETFLNFIL

SEQ ID NO: 6151 - DNA, 624 bp, Streptococcus pyogenes
atgaggtgttttatgattcaaaatgttgttacttcaataatcctgtattctgggacagccgtagacttacttattatcctaatgttattttttgccaaaagaaaaagcagaaaagacatcattaacatctatttaggacaatttctaggctctgttagtctaatattgctaagtttgctttttgcatttgtcttagattatattcctagtaaagagattttaggtttgctcggtttgattccaattttcctaggcctcaaagttttgcttttaggagattctgatggagaagctattgccaaagaaggtttgagcaaagataataaaaacctgatttttctagtcgctatgattacttttgcaagttgtggtgctgacaatattggtgtctttgtcccatattttactaccttaaatttagcgaatttgatagtggctttacttacctttctagtcatgatttatctcttggttttttctgcccaaaaattggcacaagtcccttctgttggagaaactttggaaaaatatagcagatggtttattgccgttgtttatttaggattggggatgtatatcctgattgaaaacaacagctttgacatgctatgggctgtgttaggc

SEQ ID NO: 6152 - protein, 208 aa, Streptococcus pyogenes
MRCFMIQNVVTSIILYSGTAVDLLIILMLFFAKRKSRKDIINIYLGQFLGSVSLILLSLLFAFVLDYIPSKEILGLLGLIPIFLGLKVLLLGDSDGEAIAKEGLSKDNKNLIFLVAMITFASCGADNIGVFVPYFTTLNLANLIVALLTFLVMIYLLVFSAQKLAQVPSVGETLEKYSRWFIAVVYLGLGMYILIENNSFDMLWAVLG

SEQ ID NO: 6153 - DNA, 240 bp, Streptococcus agalactiae
  misc_feature (1)..(240): n = a, c, g, or t
atgacttacacagaaaatcttcaaaaatggttagattttgagcagcttcctgactatcttcgtcaagaattactatcaatggatgaaaaaacaaaagaagatgctttttacacaaacttagaatttggtactgctggtatgcgtggttatattggtgctggtacaaatcgtattaatatttatgttgtccgtcaagcaaccgaaggattggcaaaattaatcgaaactaannnnnttaat

SEQ ID NO: 6154 - protein, 80 aa, Streptococcus agalactiae
  MISC_FEATURE (1)..(80): Xaa = Any Amino Acid
MTYTENLQKWLDFEQLPDYLRQELLSMDEKTKEDAFYTNLEFGTAGMRGYIGAGTNRINIYVVRQATEGLAKLIETXXXN

SEQ ID NO: 6155 - DNA, 1716 bp, Streptococcus pyogenes
atgacttacacagaaaattttcaaaaatggttagattttgagcagcttcctgactatcttcgtcaagaattactatcaatggatgaaaaaacaaaagaagatgctttttacacaaacttagaatttggtactgctggtatgcgtggttatattggtgctggtacaaatcgtattaatatttatgttgtccgtcaagcaaccgaaggattagcaaaattaatcgaaactaagggagaggaagctaaaaaacgtggtgtagctatcgcttatgattcgcgccacttctctccagaatttgcttttgagtctgcacaggtcttggcacagcatggaattaaatcttacgtatttgaagctcttcgtccaacaccagaactctcttttgctgttcgccatttaaatgcctatgctggtattatggttactgcaagccacaatccagcacctttcaatggttataaagtctatggacaagacggaggtcaactaccaccagctgatgctgatgcactaacagactttatccgcgctattgaaaatccatttgcagttgaacttgctgatttagatgaaaacaaatcatcaggtcttattcaagttatcggtgaagatgttgatatggaataccttagagaggttaaagatgttaatatcaatcaagatttaatcaataactttggaaaagacatgaaaattgtctatactcctctccacggaactggtgagatgttgacacgccgtgcccttgctcaagccggttttgaatctgttgttgtagtcgaatcacaagctaaggcagatccagacttttctactgttaaatcgcctaaccctgaaagccaagctgcctttgctcttgctgaagaactcggacgagaagttgaggcagatgtcttagtagctactgatcctgatgcagaccgcctaggcgttgaaattcgccaaccagatggttcttataaaaacctttctggaaatcaaattggagcgattattgcgaaatacatcctggaagctcataaaacagcaggaacacttccagaaaatgctgctctcgctaaatcaatcgtatcaacagaattagtaacaaaaattgccgaaagttatggcgctacaatgtttaacgttttaactggattcaaattcatcgctgagaaaattcaagagtttgaagaaaaacataaccacacctatatgtttggttttgaagaaagcttcggatatcttattaaaccatttgtccgtgataaagacgctattcaagcagttcttttggttgctgagatcgcagcttattaccgttcgcgtggtttaacacttgcagatggtattgatgaaatttacaaagaatatggctattttgctgaaaaaacgatttcagtaacactttcaggtgtggatggagctgctgaaattaagaagattatggacaaattccgtgaaaatggtccaaaacaatttaacaatactgatattgtattattagaagatttccaaaaacaaaccgctactaaaaatgatggaacaatatctaacttaacaactcctccaagtaatgttttgaagtacacgttagctgatgattcatggattgcagttcgcccttcaggaactgaaccaaaaatcaagttctatattgccacaataggtgatactcttgacatcgctcaagaaaaaattgctaacattgaaacagaaatcaatacctttgttggc

SEQ ID NO: 6156 - protein, 572 aa, Streptococcus pyogenes
MTYTENFQKWLDFEQLPDYLRQELLSMDEKTKEDAFYTNLEFGTAGMRGYIGAGTNRINIYVVRQATEGLAKLIETKGEEAKKRGVAIAYDSRHFSPEFAFESAQVLAQHGIKSYVFEALRPTPELSFAVRHLNAYAGIMVTASHNPAPFNGYKVYGQDGGQLPPADADALTDFIRAIENPFAVELADLDENKSSGLIQVIGEDVDMEYLREVKDVNINQDLINNFGKDMKIVYTPLHGTGEMLTRRALAQAGFESVVVVESQAKADPDFSTVKSPNPESQAAFALAEELGREVEADVLVATDPDADRLGVEIRQPDGSYKNLSGNQIGAIIAKYILEAHKTAGTLPENAALAKSIVSTELVTKIAESYGATMFNVLTGFKFIAEKIQEFEEKHNHTYMFGFEESFGYLIKPFVRDKDAIQAVLLVAEIAAYYRSRGLTLADGIDEIYKEYGYFAEKTISVTLSGVDGAAEIKKIMDKFRENGPKQFNNTDIVLLEDFQKQTATKNDGTISNLTTPPSNVLKYTLADDSWIAVRPSGTEPKIKFYIATIGDTLDIAQEKIANIETEINTFVG

SEQ ID NO: 6157 - DNA, 570 bp, Streptococcus agalactiae
atgaaaaagaaaaacaaatcctctaacattgctataattgcaatcttttttgctattatgcttgtcattcattttttgtcatcatttatttttagtttttggttagtccctattaaacctactttgatgcatatcccagttattattgcatctatagcctatggacctcgtattggtgcaactctaggcgccttaatgggggggatcagcgtagctaacagcagcattgttctattaccaacgagttacctcttctcaccttttgttgaaaatggtaatttttattcgctaattattgcacttgtaccacgtattctaatcgggattattccttatttcgtttacaaattactacacaaccgctttggtttggctatctcaggtgctataggctctctaacaaacacagtatttgttttatctggaatttttatctttttttcaagtacttataatgggaatatcaagctaatgctcgctgggattatttcatctaattcattagctgagatggtcattgcagctatcattgtatatctaactgttcctcgtattctcaatattaaacat

SEQ ID NO: 6158 - protein, 190 aa, Streptococcus agalactiae
MKKKNKSSNIAIIAIFFAIMLVIHFLSSFIFSFWLVPIKPTLMHIPVIIASIAYGPRIGATLGALMGGISVANSSIVLLPTSYLFSPFVENGNFYSLIIALVPRILIGIIPYFVYKLLHNRFGLAISGAIGSLTNTVFVLSGIFIFFSSTYNGNIKLMLAGIISSNSLAEMVIAAIIVYLTVPRILNIKH

SEQ ID NO: 6159 - DNA, 579 bp, Streptococcus pyogenes
ttggagagtaaaatgaatcaccgtaaatcagcagatatttctcgtattgctatcttttttgccatcatgttagtcattcattttgtgagcagtcttgtctttaatatttggcctattccaatcaaaccaacgcttgtccatatcccagttattattgcttctgtcttatatggcccaaggataggtgctattttaggaggattaatggggattataagtgtcattacaaataccatcattctactgcctacaaattatctcttttcaccttttgtcgatcatggaactttcgcttctttaataattgctattatcccacgtattctgattggtattaccccttattattgctataaattgattcctaatcagtttggtttaatagtatccggtatcattggttctctaacaaatactatatttgtattatctgggatatttatttttttcgcgacagtttttgatggaaatattaaagcactactaacagccatcatctcatcaaacgctattgttgagatgatcatctcagctattattacctttgtacttattccaacactatcaagactaaaaagg

SEQ ID NO: 6160 - protein, 193 aa, Streptococcus pyogenes
LESKMNHRKSADISRIAIFFAIMLVIHFVSSLVFNIWPIPIKPTLVHIPVIIASVLYGPRIGAILGGLMGIISVITNTIILLPTNYLFSPFVDHGTFASLIIAIIPRILIGITPYYCYKLIPNQFGLIVSGIIGSLTNTIFVLSGIFIFFATVFDGNIKALLTAIISSNAIVEMIISAIITFVLIPTLSRLKR

SEQ ID NO: 6161 - DNA, 540 bp, Streptococcus agalactiae
atgattaaacgtattacactagccgtcaccggttcaatttcggcctataaagcagcagaccttacaagtcaattaactaaaattggctatgatgttcatatcataatgacacaagctgccacagaatttattacaccgttaactctgcaagtattatcaaaaaatcctattcatttagatgttatggatgagcataacccaaaaatcatcaaccatatcgaattagcaaaacgcacagatttatttatcgttgcacctgcctctgctaatactattgctcatctagcatatggcttcgctgataacatcgtaacaagcgttgctcttgctatgcccgatgaaactccaaaacttatcgcaccagcaatgaatacaaagatgtatcataatacaatcacccaacgtaacattgatattttgaaaaaaataggttatcaggaaattgaacctcgtattagtttgcttgcctgtggtgataccggtcaaggagccctggctgatatctctactatacttaaatgtatacaagaagttgcaaat

SEQ ID NO: 6162 - protein, 180 aa, Streptococcus agalactiae
MIKRITLAVTGSISAYKAADLTSQLTKIGYDVHIIMTQAATEFITPLTLQVLSKNPIHLDVMDEHNPKIINHIELAKRTDLFIVAPASANTIAHLAYGFADNIVTSVALAMPDETPKLIAPAMNTKMYHNTITQRNIDILKKIGYQEIEPRISLLACGDTGQGALADISTILKCIQEVAN

SEQ ID NO: 6163 - DNA, 543 bp, Streptococcus pyogenes
atgactaaacatattaccttagctgtttctggtagtatatctgcctataaagcagcagatcttacgagtcaattaactaaaattggctatgatgttcacatcataatgactcaggctgctacacaatttattacaccattaaccctgcaagtgttatcaaaaaatgctattcatttagatgttatggatgagcatgacccaaaagttatcaaccatatcgaattagcaaaacgcacagatttatttattgttgcacctgcctctgctaatactattgctcatctagcatatggattcgctgataatcttgtaacaagtgttgctcttgccctaccagctaccacaccaaaattaatagccccagccatgaataccaaaatgtatcaaaaccctattactcaagaaaatattaaacgcttatcgacaatagggtttacagaaattcctccaaaatctagcttattagcctgtggagataaaggacctggtgctttggctgatattgatgttatcttagctactattgatacgatttggaaactt

SEQ ID NO: 6164 - protein, 181 aa, Streptococcus pyogenes
MTKHITLAVSGSISAYKAADLTSQLTKIGYDVHIIMTQAATQFITPLTLQVLSKNAIHLDVMDEHDPKVINHIELAKRTDLFIVAPASANTIAHLAYGFADNLVTSVALALPATTPKLIAPAMNTKMYQNPITQENIKRLSTIGFTEIPPKSSLLACGDKGPGALADIDVILATIDTIWKL

SEQ ID NO: 6165 - DNA, 699 bp, Streptococcus agalactiae
atgtacaatatggctatgaaaattttgattacatcaggtggaactaccgagaaaattgataccgttaggagtatcacgaatcacgcaacaggaactttaggaaaaataattgcagaaaaatatttacgagaaggacatcaggtgacactcgtgactactaaaaatgcagtcaaaccagaatctgctaccaacttatccacatttgagattgaggacgttgactcattaataaaaaccttgaagccattagtgaaagagcatgatattttaattcatagcatggcagtgtctgactatacccccgtctacatggctgatttcgaaaaggttaaatcaagcgatcatttagatacttttttgcgcaaagataaccacgaagggaaaatatcatctgaatcagaatatcaagtcctttttctcaaaaaaacaccaaaagttatcagccttgtgaaaaaatggaatcctcaaattactctagtaggttttaaactacttgtgaacgttactaaagaaaatctttttaaagttgctcgtcatagcttaatcaaaaataaagctacgtttattttagctaatgacctcattgatattacctcaaaacatcacatagcctacctacttgaccatgataatgtgtataaagctaccaccaaagaagatattgctcaattaatttacgaaaaggtaaaaaaatatgat

SEQ ID NO: 6166 - protein, 233 aa, Streptococcus agalactiae
MYNMAMKILITSGGTTEKIDTVRSITNHATGTLGKIIAEKYLREGHQVTLVTTKNAVKPESATNLSTFEIEDVDSLIKTLKPLVKEHDILIHSMAVSDYTPVYMADFEKVKSSDHLDTFLRKDNHEGKISSESEYQVLFLKKTPKVISLVKKWNPQITLVGFKLLVNVTKENLFKVARHSLIKNKATFILANDLIDITSKHHIAYLLDHDNVYKATTKEDIAQLIYEKVKKYD

SEQ ID NO: 6167 - DNA, 690 bp, Streptococcus pyogenes
atgactatgaaattaataataacatcaggtggaacaactgaacctatagatgcagtacgaggtatcactaatcactcaactgggcaacttggaaaattaatcacagagcgatttttacaatatcatcatgacgttaccctagtcactactaaaacagccactaaacccctgccaaataagcgcctaaggattattgaagtggaaacagttaacgacttaatggctgcactcaaagatcaggttcctcaccatgacattctaattcatagtatggctgtttctgactatactccagtctacatgactgatttggaacaagtctctcaagctgataaccttaattgttttctatgtgaacataacagtgagccgaaaatctcatctgcatctgattatcaggttctttttttgaaaaaaacacccaaagttatctcttatgttaaacagtggaatcctaatattaaactagtcggctttaaacttctagttaatgtgcctcaagaagagttaattaaagtagccagagcaagtctagctaaaaatcatgctgattatattctcgccaatgatttagttgatatccaaacaggtatgcacaaggctcttttgatatccaataacgaagttgcatctgcagataccaaagaggcaattgctgacttattatatgaaaggatgaccaaacatgac

SEQ ID NO: 6168 - protein, 230 aa, Streptococcus pyogenes
MTMKLIITSGGTTEPIDAVRGITNHSTGQLGKLITERFLQYHHDVTLVTTKTATKPLPNKRLRIIEVETVNDLMAALKDQVPHHDILIHSMAVSDYTPVYMTDLEQVSQADNLNCFLCEHNSEPKISSASDYQVLFLKKTPKVISYVKQWNPNIKLVGFKLLVNVPQEELIKVARASLAKNHADYILANDLVDIQTGMHKALLISNNEVASADTKEAIADLLYERMTKHD

SEQ ID NO: 6169 - DNA, 918 bp, Streptococcus agalactiae
ttgagggaaacttactggaaaatttcaagcgattgcgataaaataaatcttgcagagttttctagagaaaggatgtcagatttattggaatggcaagatctagcgcagttacctgtatctatttttaaagactatgttacagatgctcaagacgcggaaaaaccttttatatggacagaagtatttttaagggagattaatcgctcaaatcaagaaattattttgcatatttggccgatgactaagacagtcattctggggatgttagatcgagaattaccacatttagaattagctaaaaaagaaatcatcagtcgtggctatgaaccagttgttcggaattttggtggtctcgcagttgtagctgatgaaggaattttaaatttttcattggttattccagatgtttttgagagaaaattgtctatctcagatgggtatcttataatggtcgattttattagaagtatattttcagatttttatcaacctattgagcactttgaagtagagacctcctattgtcctggtaagtttgatcttagtataaatggcaaaaaatttgctggcttggctcagcgccgtataaagaatggtattgcggtatcaatttaccttagcgtttgtggcgatcaaaaagggcggagtcaaatgatttcagatttttataagattggtctaggtgatacgggtagtccaattgcttatccaaatgtagatcctgaaattatggctaatctatctgatctattagattgtcctatgacagtagaagatgttattgatcgtatgttgattagccttaaacaagtaggttttaatgatcgtttactgatgattagacccgatttagttgcagagtttaatagatttcaggctaagtctatggctaataaggggatggtgagcagagatgaa

SEQ ID NO: 6170 - protein, 306 aa, Streptococcus agalactiae
MRETYWKISSDCDKINLAEFSRERMSDLLEWQDLAQLPVSIFKDYVTDAQDAEKPFIWTEVFLREINRSNQEIILHIWPMTKTVILGMLDRELPHLELAKKEIISRGYEPVVRNFGGLAVVADEGILNFSLVIPDVFERKLSISDGYLIMVDFIRSIFSDFYQPIEHFEVETSYCPGKFDLSINGKKFAGLAQRRIKNGIAVSIYLSVCGDQKGRSQMISDFYKIGLGDTGSPIAYPNVDPEIMANLSDLLDCPMTVEDVIDRMLISLKQVGFNDRLLMIRPDLVAEFNRFQAKSMANKGMVSRDE

SEQ ID NO: 6171 - DNA, 849 bp, Streptococcus pyogenes
gtgaaaggaagaattgtgataactattagagatttagcgtcactgccgatttttgtttacggtgatggaaataaaaaagttccaggagctttgagtccttttgtgtggacagaggtgtttttaaaaactatcaatcaagaacctaatcaactgatcttacatatttggccgatgacaagaacagttatattaggaatgttagatagacagcttccctactttgagctggctaaaacagagattggcaataatggttatgttcctgttactcgtaatattggcggtttggctgttgtcgctgatgatgggattttgaatttttcgcttgttattccagaccatttttcggaatctatcagtattagtaatgcttatttaataatggttgatgtcattagagagagtttttcggattattatcagcgtattgaatatcacgaaattaaaaattcttattgccctggtaattttgatcttagtattgcaggccgcaagtttgcaggtatcgcccagcgtcgtatcaaaaagggaattgttgtgtctatttacttgagcgtttgtggggatcaagcagcgcgtggtcaactcatcaaggatttttatgaggccggaacacaaggagaagttaccaaggttaattaccctcaaattgatccagaatgcatggcaactctttcagaactccttgagacgccttttacagtggcagaagtccttgaacgtcttcgattgaccttgcgacagcttggcttttccctcacggaaaaaagtccagatcaagccttactgactaattttgatgctgtctatgaacggatgcagctagaagtcgtcagaaaggaaggcaaa

SEQ ID NO: 6172 - protein, 283 aa, Streptococcus pyogenes
VKGRIVITIRDLASLPIFVYGDGNKKVPGALSPFVWTEVFLKTINQEPNQLILHIWPMTRTVILGMLDRQLPYFELAKTEIGNNGYVPVTRNIGGLAVVADDGILNFSLVIPDHFSESISISNAYLIMVDVIRESFSDYYQRIEYHEIKNSYCPGNFDLSIAGRKFAGIAQRRIKKGIVVSIYLSVCGDQAARGQLIKDFYEAGTQGEVTKVNYPQIDPECMATLSELLETPFTVAEVLERLRLTLRQLGFSLTEKSPDQALLTNFDAVYERMQLEVVRKEGK

SEQ ID NO: 6173 - DNA, 1197 bp, Streptococcus agalactiae
atgaataatgtccaaggtaatttatttcgtccattaacacttcccaatggattgagcttagaaaatcgttttgttctatcacctatggtaactaattcttctacatcagaaggttttgtaactgatgacgacatagcatatgctgttcgtcgtgctaaatccgctccattacaaattactggagcagcatatatcacagaatatggtcagttatttgaatatggttttagcgtttcaaaggatgaggacattcctggtttgactaaattggctaaagcaatgaagtctaagggagcgaaagctgttttgcagctgacgcatgctggacgtttctcaagtcacactttggcaagacacggatatgtatatggtcccagccctatgcaattgcaatcgccatacccacatcaggttaaagaactaacacacaaagatatactaaggattattgatgaatatgtccaggctacaagacgagctatacaagctggatttgatggtgttgaaatatcttctgcacaacgattactaattcaaacttttttctcaaccttctcaaatcaaagaaaagatgaatatggtcctcaaactttgactaatcgctgtcgtttaggcttagaagtttttaaagcggtacaaaaagttatcagagaagaagcggagtcagattttatccttggttttagagcgacgcctgaagaaactcgcggttcacaaattggatatagcattgaagagtttatggaatttcttgaaaaaattttagcgattgctcaggtagattatcttgccattgcaagctgggggcatgatgtctttagaaatactatacgttctgagggagtttacaaagggcagctggttaatcaagttatatttgaacattttggtgatagagttccaattatggcaactggaggtattaatagtgcttcaaaggtgtttgaagccttacaacatgctcatatgataggagcttccacgcccttagtagttgatccggaatttttacaaaaaataaaagctaagtgttctgatcagattaatttaaggattaaagtgagtgatttagaaggtttggcgattccaaaagcctcctttaaagatattgttcctttgatggattatggagaatctttaccaaaggaagctcgagaagtttttagagaacttcgaagcaattatagggaggaaaga

SEQ ID NO: 6174 - protein, 399 aa, Streptococcus agalactiae
MNNVQGNLFRPLTLPNGLSLENRFVLSPMVTNSSTSEGFVTDDDIAYAVRRAKSAPLQITGAAYITEYGQLFEYGFSVSKDEDIPGLTKLAKAMKSKGAKAVLQLTHAGRFSSHTLARHGYVYGPSPMQLQSPYPHQVKELTHKDILRIIDEYVQATRRAIQAGFDGVEISSAQRLLIQTFFSTFSNQRKDEYGPQTLTNRCRLGLEVFKAVQKVIREEAESDFILGFRATPEETRGSQIGYSIEEFMEFLEKILAIAQVDYLAIASWGHDVFRNTIRSEGVYKGQLVNQVIFEHFGDRVPIMATGGINSASKVFEALQHAHMIGASTPLVVDPEFLQKIKAKCSDQINLRIKVSDLEGLAIPKASFKDIVPLMDYGESLPKEAREVFRELRSNYREER

SEQ ID NO: 6175 - DNA, 1197 bp, Streptococcus pyogenes
atgaaagaaagatttagtcctttatttgagcctttgactttgccaaatgggagtcaattggataatcgctttgttttgtctcctatggtgaccaactcatctacaaaagacggttatgtcacccaagatgatgtatcctatgctttgagacgagcagcttctgcccctctacaaattacaggagcggcctatgtggatccttatggtcaattgtttgaatatggttttagtgttacaaaagatgccgatatttctggcttgaaagagctagctcaagcgatgaaggcaaagggagctaaagctgtcttacaactgacccacgctggccggtttgctagccatgccttgactaaatatggctttgtctatgggcctagttacatgcagttgagatctccccaacctcatgaagtcaaacctttaacaggtcagcaaatagaggaattgattgcagcttacgctcaggccactcggcgggcaattcaagcaggctttgatggcgtggaagtatcttcggcgcagcgcttattgattcaaacgttcttttcgactttttcgaacaagaggacagatagttatggttgtcaaacactttttaatcgctctaagttaactctagctgttttgcaagctgttcaacaggtgattaaacaagaagctcctgatgggtttatttttggatttcgtgctacaccagaagaaactaggggaaatgatattggttatagtattgacgagtttttgcagttgatggattgggtacttaatgttgcaaaacttgattatttagcgatagcaagttggggccgtcatgtatttcgaaatactgttcgttctcctggcccttattatggaaggcgagttaatcaggtagttagagattatttaagaaataagctacctgttatggctacagggggaatgaacacacctgacaaagctattgaagcactagctcatgctgattttattggagtatctacaccttttgtcgtggatccagaatttgctcataaaatcaaagaagggtgtgaagagagtattcatttaaggattcgacctgctgatttgaaaagtttagcgattcctcaggcttctttcaaagatattgtacctttgatggactacggggaatcattgcctaaagaatcaagaactttatttcgtagtcttactcacaattataaggagattaaa

SEQ ID NO: 6176 - protein, 399 aa, Streptococcus pyogenes
MKERFSPLFEPLTLPNGSQLDNRFVLSPMVTNSSTKDGYVTQDDVSYALRRAASAPLQITGAAYVDPYGQLFEYGFSVTKDADISGLKELAQAMKAKGAKAVLQLTHAGRFASHALTKYGFVYGPSYMQLRSPQPHEVKPLTGQQIEELIAAYAQATRRAIQAGFDGVEVSSAQRLLIQTFFSTFSNKRTDSYGCQTLFNRSKLTLAVLQAVQQVIKQEAPDGFIFGFRATPEETRGNDIGYSIDEFLQLMDWVLNVAKLDYLAIASWGRHVFRNTVRSPGPYYGRRVNQVVRDYLRNKLPVMATGGMNTPDKAIEALAHADFIGVSTPFVVDPEFAHKIKEGCEESIHLRIRPADLKSLAIPQASFKDIVPLMDYGESLPKESRTLFRSLTHNYKEIK

SEQ ID NO: 6177 - DNA, 984 bp, Streptococcus agalactiae
atgaaattaagtgtccttgattatgggcttattgattatggaaaaactgcaagtgatgcaatacaagaaacgattcttttatcacaagaggcggagcgactaggctatcatcaattttgggtggctgaacatcacggtgttaaggcattcagtattagcaatccagaattaatgataatgcatttggctaaccagactaaatctatcaaaattggctctggaggtataatgcctctgcactatagtagttttaaactcgcggagactctcaagacattagagacatgtcatccgaatcgagtaagtattggtttaggaaattcactagggacagttaaagtttcaaatgcacttcgtagcttacataaagcacatgattacgaagaggtactggaggaattgaagtcatggcttattgatgaatcatccagtaaggaaccattagttcaaccgactctttctagcttcccagacttatatgtgttggggagtggtcaaaaatcagcttatttagcggctaaacttggcttaggctttaccttcggtgtttttccttttatggacaaagacccattgacagaagctaaaaagctttcatctctttattatcatcagtttgaagaatattatcctaataagtctcctaatttgatggtagctgcatttgtagttatagctgatacttcagaagaagctgaaaacatagcaaagactttagatatctggatgctaggaaataaagacttcaatgaatttgcaacatttcctactattgaagaagctaatcattaccaattgactcctgaacaaaaagcaaaaattaaatcaaatcgcgaccgtatgattgtaggtgatccaaaacaagttaaagaaagtcttgacgctttagttaatgctagtcaagcagaagaactacttttgattcctcttgttccaggacttgaccaacgaatcaaatccttaaaattattatcacagttatat

SEQ ID NO: 6178 - protein, 328 aa, Streptococcus agalactiae
MKLSVLDYGLIDYGKTASDAIQETILLSQEAERLGYHQFWVAEHHGVKAFSISNPELMIMHLANQTKSIKIGSGGIMPLHYSSFKLAETLKTLETCHPNRVSIGLGNSLGTVKVSNALRSLHKAHDYEEVLEELKSWLIDESSSKEPLVQPTLSSFPDLYVLGSGQKSAYLAAKLGLGFTFGVFPFMDKDPLTEAKKLSSLYYHQFEEYYPNKSPNLMVAAFVVIADTSEEAENIAKTLDIWMLGNKDFNEFATFPTIEEANHYQLTPEQKAKIKSNRDRMIVGDPKQVKESLDALVNASQAEELLLIPLVPGLDQRIKSLKLLSQLY

SEQ ID NO: 6179 - DNA, 996 bp, Streptococcus pyogenes
atgaaagtcagtattcttgattatggggtgattgataaagaaaaaacaccccaagaagctttattagaaacgcgctgcttagcacaagtagccgacaaacttggttttcatcgtttttgggtagcagagcatcataatatttatgcctttgcaataagcagtccagagctgttgatgatgcatttagcagatcataccaaacagattcggataggttcaggaggtattatgcctctacattatagtagctttaagattgcagaatggataatgactttagaggccttgcaccctaatcggattgatttaggtattggcaactctttaggaactacgttagttcaaagagctctatcaagtatccattgcaaagacagctatagtcaggttgtcacagaattataccagtatcttaatcctgatcatttgtcaccactaccgatttttgttaaccctaggggtaatacttaccctcagatttggacgctaagcaatagtttggagacagcagaactggctggtcaattaggtttaggctatacctttggtattttcccctatataccaaaagatcctataacagaagctaaaagagtatcggcacattatagaaaggcttttaggccttcaaagctattaaaaatccccaagttaatattagcagtttttattgtcctttctgataccgacgagaaagcagaagctttggctaaaccgttggacatttggatgcttggtcagcaagattttaatgaatttaagacctaccctgatgttgaggaggctagaaactatcacttaacagagaaacaaagagaagccattgcagcaaatcgtagtcgcatggttattggatcacctcacacagtcaagaaacaattggataggctgatagaagcttgtcaagctgacgaattattagccatccccttagttcctgaatttgccaatagacaacgaaccttagagctgctagcagacttatacgtgaccatt

SEQ ID NO: 6180 - protein, 332 aa, Streptococcus pyogenes
MKVSILDYGVIDKEKTPQEALLETRCLAQVADKLGFHRFWVAEHHNIYAFAISSPELLMMHLADHTKQIRIGSGGIMPLHYSSFKIAEWIMTLEALHPNRIDLGIGNSLGTTLVQRALSSIHCKDSYSQVVTELYQYLNPDHLSPLPIFVNPRGNTYPQIWTLSNSLETAELAGQLGLGYTFGIFPYIPKDPITEAKRVSAHYRKAFRPSKLLKIPKLILAVFIVLSDTDEKAEALAKPLDIWMLGQQDFNEFKTYPDVEEARNYHLTEKQREAIAANRSRMVIGSPHTVKKQLDRLIEACQADELLAIPLVPEFANRQRTLELLADLYVTI

SEQ ID NO: 6181 - DNA, 330 bp, Streptococcus agalactiae
atgaaaaaaattgcgaactacttattaattgaaaaaaatgaagaactttatactatcagcttaactcccgaacttcaagatgacttgggaactgttggatatgtggaattcacagatgatgcaaatttagaagttgatgatgttattttaaatattgaagcttcaaagacggttatggcaattttatctcctcttacaggtaaagttgttaaagttaatacagctgcaagtcaagaaccaactttgttaaattctgaaaaagctgacgaaaattggttggttgtgttaacagaagttgattatgctgcttttgaagctttagaaaatgcc

SEQ ID NO: 6182 - protein, 110 aa, Streptococcus agalactiae
MKKIANYLLIEKNEELYTISLTPELQDDLGTVGYVEFTDDANLEVDDVILNIEASKTVMAILSPLTGKVVKVNTAASQEPTLLNSEKADENWLVVLTEVDYAAFEALENA

SEQ ID NO: 6183 - DNA, 330 bp, Streptococcus pyogenes
atgaaaaaaattgcaaattacttattaattgagaaaacagatgaccgctataccattagcatgacaccagaattacaagacgatattggtactattggttacgctgaatttacggataacgaccaccttgccgttgatgacattatcttaaatctagaggcttctaagactgtcatgtctgtcttgtcaccattggctggggcagttgttgagcgcaatgaggcagccacactaacaccaacccttttgaattcagaaaaagctgaggaaaattggattgttgtgctaacagatgttgatcaagcagcttttgatgccctagaagatgcc

SEQ ID NO: 6184 - protein, 110 aa, Streptococcus pyogenes
MKKIANYLLIEKTDDRYTISMTPELQDDIGTIGYAEFTDNDHLAVDDIILNLEASKTVMSVLSPLAGAVVERNEAATLTPTLLNSEKAEENWIVVLTDVDQAAFDALEDA

SEQ ID NO: 6185 - DNA, 816 bp, Streptococcus agalactiae
atgcctaatcaaaaacaactattgctagccatgattgagtatcttcagtcagaaaaattaacagacgttgatgacttgaggaccaccgatttgcaaacggtttggcgtggtctagttaatcaacaagatcctcaaaacattagtcaagagtacctgtctttagaagataggtatttgtcacattggtggaatactcaaaaagtaaaaacgatagacgtctgtcatcaaacggtatattcaaatgtatttacctaccatggggatatttgcttattacaagtggatgctattgttaatgcagcaaatagtaaattgttaggttgttttattcctaaccaccattgtattgacaatcagattcatacgtttgcaggttcacgattacgtttagcatgtcatcaattgatgacacaacaaggacgaatggaagctgtaggacaagctaaacttaccgaatcctatcatcttccttgtaagtatgttattcatacagtcggaccttatgtaaaagttgatcaaaagccatctcgtataagagaggatttattaaagtcttcttataaatcttgcttacaattggcagttcgagctaatcttaaaacaattgtcttcccttgtatatcaacgggagaatttggttttcctaatcaaagagccgctgaattggcagttcaagcgatattagagtggcaacgcgaaaatcagcacaaactctatattattttcaatacattcacacctaaagaccaagatatttatcaaaaattattattaaaagaggaaatagatgacagtgtggaagactctagaaaaaac

SEQ ID NO: 6186 - protein, 272 aa, Streptococcus agalactiae
MPNQKQLLLAMIEYLQSEKLTDVDDLRTTDLQTVWRGLVNQQDPQNISQEYLSLEDRYLSHWWNTQKVKTIDVCHQTVYSNVFTYHGDICLLQVDAIVNAANSKLLGCFIPNHHCIDNQIHTFAGSRLRLACHQLMTQQGRMEAVGQAKLTESYHLPCKYVIHTVGPYVKVDQKPSRIREDLLKSSYKSCLQLAVRANLKTIVFPCISTGEFGFPNQRAAELAVQAILEWQRENQHKLYIIFNTFTPKDQDIYQKLLLKEEIDDSVEDSRKN

SEQ ID NO: 6187 - DNA, 810 bp, Streptococcus pyogenes
atgcctagttcatttgatttattaggggaaatgattggtctgttgcaaacagagcagcttactagttcttgggcctgtcccttgcctaatgctttaacaaagcgacaagacttgtggcgggcgctcattaaccagcgccctgctttgcccttatcaaaagattacttgaatctggaagatgcttatctagatgattggcgtgcttcttttgttcctgtatcagtcaaggattgccaaaaaactaattataccagtctttttctttaccatggggatattaggtatcttgctgtggatgctattgtcaacgctgctaatagtgagttattgggatgttttagtcctaaccatggctgtattgataatgcgattcatacgtttgccggaagtcgtttacgcttagcttgtcaggcaatcatgactgaacaaggccgtaaggaagccattggacaagcaaagcttaccagtgcttatcatctaccagcctcttatattattcataccgtagggccaagaattaccaaaggacaccacgtttctccgattcgagctgatttgttagcacgttgttatcgttctagtcttgatttggcggttaaagcaggattgactagcctagctttttgctctatttcaacaggagaatttggctttcctaaaaaagaagccgctcagattgctattaagacagttttaaaatggcaagcagaacatccagaatctaagaccttaactaccatttttaatacctttacatcagaagacaaggccttatacgacacttatttgcaaaaggagaataactgtgag

SEQ ID NO: 6188 - protein, 270 aa, Streptococcus pyogenes
MPSSFDLLGEMIGLLQTEQLTSSWACPLPNALTKRQDLWRALINQRPALPLSKDYLNLEDAYLDDWRASFVPVSVKDCQKTNYTSLFLYHGDIRYLAVDAIVNAANSELLGCFSPNHGCIDNAIHTFAGSRLRLACQAIMTEQGRKEAIGQAKLTSAYHLPASYIIHTVGPRITKGHHVSPIRADLLARCYRSSLDLAVKAGLTSLAFCSISTGEFGFPKKEAAQIAIKTVLKWQAEHPESKTLTTIFNTFTSEDKALYDTYLQKENNCE

SEQ ID NO: 6189 - DNA, 876 bp, Streptococcus agalactiae
atgacagtgtggaagactctagaaaaaactaatcattctcaatcagaaatactaagtcagttaatagaagaatcagatgctattgtagttggtattggtgcaggcatgtctgcagcggatggattcacctatattggccccagatttgaagaagcttttccggattttattgctaaatatcaactattagatatgttgcaagcaagtctttatgactttgaagattgggaagaatattgggccttccaaagtcgttttgtggcacttaattatttagatcaaccggtaggacaagcttatcttgatttaaaggatattttagcgaaaaaagaatatcatattattacaactaatgctgataatgccttcgctgtggctgattataatttagaaaaagtttttcatattcaaggtgaatatggcttatggcagtgtagtcaacattgtcatcaacaaacttatcgaaatgatcaggcaattcgtcaaatgattgcacaacaaaaggatatgaagattcctagtaacttaatccccaaatgcccaaagtgtgatcaaccgtttgaaattaataaacgtaacgaagaaaaaggtatggtggaagatgctgactttcatgctcaacgacaacgttatgaaaatttcttatcacaacatcaaaatgacaaagttctttatctagagattggagttggacataccacgccacaatttattaagcatccgttttggcgattcgtctctttaaatgaaaactctttatttgttactcttaatcacaagcattatcgcattcctcaaaagattcgctcaaggagtgtgcaactgacacagcatatcgctgaattaattgctgaagcgaaaaaagaaattattgga

SEQ ID NO: 6190 - protein, 292 aa, Streptococcus agalactiae
MTVWKTLEKTNHSQSEILSQLIEESDAIVVGIGAGMSAADGFTYIGPRFEEAFPDFIAKYQLLDMLQASLYDFEDWEEYWAFQSRFVALNYLDQPVGQAYLDLKDILAKKEYHIITTNADNAFAVADYNLEKVFHIQGEYGLWQCSQHCHQQTYRNDQAIRQMIAQQKDMKIPSNLIPKCPKCDQPFEINKRNEEKGMVEDADFHAQRQRYENFLSQHQNDKVLYLEIGVGHTTPQFIKHPFWRFVSLNENSLFVTLNHKHYRIPQKIRSRSVQLTQHIAELIAEAKKEIIG

SEQ ID NO: 6191 - DNA, 879 bp, Streptococcus pyogenes
gtgagtaattggacaacctatcctcagaaaaacctcacccaggcagaacaactggcccaattaatcaaagaagcagatgcacttgtagttggtattggagctggcatgtctgcagctgatggttttacttatatcgggtcgcgttttgagacggcattcccagattttattgctaagtatcagtttttggatatgctgcaagctagcctttttgattttgaagattggcaagaatattgggcttttcaaagtcgctttgtcgctttgaattatcttgatcagcccgtaggccagtcttatcttgatttaaaagagattttgggaaccaaagactatcatattattactactaatgctgataatgctttttgggtggctggttatgatcctcataacatttttcacattcaaggagaatatggtttgtggcaatgtagccagcactgccatcagcaaacttataaggacgatacggtcatccgtcaaatgatcgcagagcaaaaaaacatgaaagtcccaggtcaactgattcctcattgccctgaatgtgaggcgccttttgaaatcaataagcgtaatgaagaaaaaggaatggttgaagatgctgactttcatgcccaaaaagcacgttatgaggcttttttatcagaacataaagagggtaaagtgctttatctagaaattggtgtgggacatacgacgcctcagtttatcaaacaccccttttggaaacgtgtctcagaaaatcctaatgccttattcgttaccttgaatcacaaacattaccgcatccctctgtcaataaggcgacaaagcctagaactgacagaacacattgcacaattgattagcgccacaaaaaccatttaccaaaaatcg

SEQ ID NO: 6192 - protein, 293 aa, Streptococcus pyogenes
VSNWTTYPQKNLTQAEQLAQLIKEADALVVGIGAGMSAADGFTYIGSRFETAFPDFIAKYQFLDMLQASLFDFEDWQEYWAFQSRFVALNYLDQPVGQSYLDLKEILGTKDYHIITTNADNAFWVAGYDPHNIFHIQGEYGLWQCSQHCHQQTYKDDTVIRQMIAEQKNMKVPGQLIPHCPECEAPFEINKRNEEKGMVEDADFHAQKARYEAFLSEHKEGKVLYLEIGVGHTTPQFIKHPFWKRVSENPNALFVTLNHKHYRIPLSIRRQSLELTEHIAQLISATKTIYQKS

SEQ ID NO: 6193 - DNA, 1017 bp, Streptococcus agalactiae
atgtatcttattgaaccaattagaaatggtaagcgtatcacagacggtgcgattgcacttgccatgcaagtttatattttacaaaatgtttttttagatgatgatattttatttccatactattgtgatcccaaagttgaaatcggaaaatttcagaatgcagttatagagacaaatcaagaatatttgaaagaacatgatattcctgttgttcgtcgagatactggtggaggggctgtttacgttgactcaggtgctgtaaatatttgctatctcatgaaagatcatggacaatttggtgatttcaaacgagcttatgagccagctattaaggccctaaaaactttaggtgcctctagtgttgaaatgagggaacgaaatgacttagttattgatggtaaaaaagtatcaggtgcagcaatgacgatagtaaacggtcgtatttacggtggttactctcttttattagatgttgattttgatgctatggaaaaagtgttaaatcctaatcggaaaaaaattgaatctaaagggataaaatctgtccgaagtcgagtaggagatattcgtagccacttgtcagaagattatcgtcatatcacaaccgatcaatttaaagatttaatggtttgtcaattattacatattgatcatattgatcaggcaaaacgctatcatctaaccgaaaaagattgggctgcgattgacgctctagctgatgaaaaatataagaattgggattggaattatggtaactcaccacagtattcgtatcacagagatgctcgttttccgtcaggaacttacgattttcacttagaaattgagaaaggtattattacgaattgccgtatttatggtgactttttcagttctaaagatatttcagatattgaaaaccttctcattggttgtcctatgaaagaagaattagtcttggaaaaattaagtactttatcattagaagattattttggtcagactagtccagaagaaataaaagcagttttattttca

SEQ ID NO: 6194 - protein, 339 aa, Streptococcus agalactiae
MYLIEPIRNGKRITDGAIALAMQVYILQNVFLDDDILFPYYCDPKVEIGKFQNAVIETNQEYLKEHDIPVVRRDTGGGAVYVDSGAVNICYLMKDHGQFGDFKRAYEPAIKALKTLGASSVEMRERNDLVIDGKKVSGAAMTIVNGRIYGGYSLLLDVDFDAMEKVLNPNRKKIESKGIKSVRSRVGDIRSHLSEDYRHITTDQFKDLMVCQLLHIDHIDQAKRYHLTEKDWAAIDALADEKYKNWDWNYGNSPQYSYHRDARFPSGTYDFHLEIEKGIITNCRIYGDFFSSKDISDIENLLIGCPMKEELVLEKLSTLSLEDYFGQTSPEEIKAVLFS

SEQ ID NO: 6195 - DNA, 1017 bp, Streptococcus pyogenes
atgtaccttattgaaccgattcgtaacggtaaacgtatcaccgatggagctgttgctctagccatgcaagtttatgttcaagaaaatctatttttagatgatgatattttatttccctactattgtgatcccaaagttgaaattggaaaattccagaatgcagttgtagaaactaatcaagagtatttaaaagagcatcatatccctgttgttcgcagagatactggcggtggtgccgtttatgtagattctggtgctgttaatatttgctacttgattaatgataatggtatttttggtgattttaaaagaacctatcagcccgctattgaagcccttcatcatttgggagcaacagaggttgaaatgtctggacggaatgacttggttattgatgggaaaaaggtatctggcgctgcgatgactattgctaatggccgtgtttatgggggatattcccttttgctagatgtggactttgaagccatggaaaaagcattaaaacctaatcgcaaaaaaattgaatcaaaaggcatcaggtcagttcgtagtcgcgttggaaacatcagagaacatttagcaccacaataccaaggtattacgattgaagagttcaaagatttaatggtttgccaattgttacagattgagacgattagccaagctaagcgttatgatttaacggaaaaagactggcaacaaattgatgctttaacagagcgcaaatatcacaattgggaatggaattatggcaacgcgcctcaataccgttaccatagagatggccgttttaccggtggaacagtagatattcatttagatattaaaaaaggctatattgcagcttgtcgcatttacggagatttttttggcaaggcagacattgcagaacttgaaggtcacttgataggaacacgaatggaaaaagaggatgtcttagctaccctcaatgcaattgatttagccccttatttaggtgcgattacagcagaagaattaggagatttgatattttct

SEQ ID NO: 6196 - protein, 339 aa, Streptococcus pyogenes
MYLIEPIRNGKRITDGAVALAMQVYVQENLFLDDDILFPYYCDPKVEIGKFQNAVVETNQEYLKEHHIPVVRRDTGGGAVYVDSGAVNICYLINDNGIFGDFKRTYQPAIEALHHLGATEVEMSGRNDLVIDGKKVSGAAMTIANGRVYGGYSLLLDVDFEAMEKALKPNRKKIESKGIRSVRSRVGNIREHLAPQYQGITIEEFKDLMVCQLLQIETISQAKRYDLTEKDWQQIDALTERKYHNWEWNYGNAPQYRYHRDGRFTGGTVDIHLDIKKGYIAACRIYGDFFGKADIAELEGHLIGTRMEKEDVLATLNAIDLAPYLGAITAEELGDLIFS

SEQ ID NO: 6197 - DNA, 1668 bp, Streptococcus agalactiae
atgaaaacagatattgaaatagcgcaaagcgtcgccctaaagcctattgctgagattgttgagcaagtaggaattggttttgatgatatagaattgtatggtaaatacaaagcaaaattatcttttgataagattgaagctgtaaaatctcaaaaagtaggaaagttaattttagtaactgctattaatccgacaccagcaggtgagggaaaatccactatgagcattggattagctgatgctttaaataaaattggtaaaaaaacgatgattgctcttcgcgaaccttctttaggtcctgtaatgggtattaaaggaggagctgctggaggtggatacgcacaagtactaccaatggaagatattaatttgcattttactggtgatatgcacgcaatcacaactgctaataatgctttatcagctctacttgataatcatattcatcaaggcaatgaattagatattgaccaacgtcgagtgatttggaagcgtgtagttgatcttaatgatcgtgctcttcgtcaggtgatcgttggcttaggaagccctgtcaatgggataccacgtgaagatggctttgatattactgttgcttctgaaataatggctattctatgtttagctactgacctatcagatttaaagaaacgcctgtcaaatattgttgtggcttactcaaggaaccgtaaaccaatctatgttaaagatttgaagattgaaggagctctcacacttatcctaaaagatactatcaaacctaatttggttcaaaccatttatgggacaccggctcttgtccatgggggaccatttgctaatattgcacatggatgtaattctgtcttagcgacttcaacagctctacgcttagcagattacgttgttactgaagcgggttttggagcagacttgggcgctgaaaagtttcttgatataaaaacgccaaaccttccgacttctcccgatgcgattgttattgttgctacattgcgtgcattgaaaatgcatggaggtgtttcaaaagaagatctctcacaagagaacgtcgaagcagttaaaagaggttttacaaatctcgagcgtcacgttaacaatatgcgtcaatatggtgttccggtagttgtagctatcaatcagtttactgcagatacagaaagtgaaattgcaactcttaaaaccttatgtagtaatattgatgtggcagttgaattagcaagtgtgtgggaagatggagcagacggtggtcttgaacttgcacagactgttgctaatgtgattgaaacacaatcatccaattacaaacgcttatataatgatgaagacactattgaagaaaaaattaaaaaaattgttactaaaatatatggtggtaataaagttcattttggacctaaggcacaaatacaattaaaagagtttagtgacaatggctgggacaagatgcctatttgtatggcaaagacacaatatagcttttctgataatccaaatttacttggtgctccaactgactttgatataactgttcgtgaatttgttccaaaaacaggagctggttttatagttgctcttactggagacgtattgacaatgcctggtttacctaaaaaacctgcagctctcaatatggatgttttagaagacggtacagccattggattattt

SEQ ID NO: 6198 - protein, 556 aa, Streptococcus agalactiae
MKTDIEIAQSVALKPIAEIVEQVGIGFDDIELYGKYKAKLSFDKIEAVKSQKVGKLILVTAINPTPAGEGKSTMSIGLADALNKIGKKTMIALREPSLGPVMGIKGGAAGGGYAQVLPMEDINLHFTGDMHAITTANNALSALLDNHIHQGNELDIDQRRVIWKRVVDLNDRALRQVIVGLGSPVNGIPREDGFDITVASEIMAILCLATDLSDLKKRLSNIVVAYSRNRKPIYVKDLKIEGALTLILKDTIKPNLVQTIYGTPALVHGGPFANIAHGCNSVLATSTALRLADYVVTEAGFGADLGAEKFLDIKTPNLPTSPDAIVIVATLRALKMHGGVSKEDLSQENVEAVKRGFTNLERHVNNMRQYGVPVVVAINQFTADTESEIATLKTLCSNIDVAVELASVWEDGADGGLELAQTVANVIETQSSNYKRLYNDEDTIEEKIKKIVTKIYGGNKVHFGPKAQIQLKEFSDNGWDKMPICMAKTQYSFSDNPNLLGAPTDFDITVREFVPKTGAGFIVALTGDVLTMPGLPKKPAALNMDVLEDGTAIGLF

SEQ ID NO: 6199 - DNA, 1668 bp, Streptococcus pyogenes
atgaaatcagatatcgaaattgcccaaagtgtcgccttacaaccaatcactgacattgttaaaaaggttggaatagacggcgatgacattgagctttatggcaaatataaggctaaattgtcttttgagaaaatgaaagctgtcgaagctaatgagcctggaaaattaatcttggtaactgctattaaccctactccagcaggagaaggaaaatcaaccatgtctattggactggcagatgccttaaatcaaatgggaaaaaaaaccatgcttgccttacgtgaaccctcccttggtcctgttatggggattaaaggcggggcagcaggtggtggttatgcccaagtattgcctatggaagacattaatcttcactttactggtgacatgcatgccattacaaccgctaataatgcattatctgctttgattgacaatcatttgcagcaaggaaacgatttaggaattgatcctcgccgcattatttggaagcgcgtgttggaccttaatgatcgtgctcttcgtcaggtaattgttggcttaggtagtccagtgaatggtgtgccacgcgaagatgggttcgatatcacagtagcttctgaaatcatggcaattttatgtttggcaactgacttaaaagatctaaagaaacgtcttgctgatatcgttgtggcttatacctatgatcgtaagcctgtctatgtgcgtgacttgaaggttgaaggagccttgacattaattctaaaagatgctatcaagccaaacttggtgcagactatttatggaacaccagctcttattcatggggggccatttgctaatattgctcatggttgtaattctgtccttgctacctcaacagctttgcgattagcagattacactgttaccgaagcaggattcggggccgacctaggagctgaaaaattcctaaatatcaaagtacctaatcttcctaaagcaccagatgctatcgttattgttgcaaccttgcgcgcccttaaaatgcatggaggtgtcgccaaatcagatttagccgctgaaaattgtgaggctgttcgcttaggatttgccaacttaaaacgtcacgtggaaaacatgcgccaattcaaagttccagttgtggtggctatcaatgaatttgtagcagataccgaggctgaaattgctaccttaaaagcgctttgtgaagagattaaggttccagtagaattagccagtgtttgggcaaatggagctgagggaggcttagcattagctaaaacagtggttcgtgtgattgatcaagaagctgctgactacaaacgtctctattcagatgaggatactttggaagaaaaagtgatcaatatcgttacccagatttatggtggcaaagctgttcaatttggccccaaggccaaaacacaattgaagcagttcgcagaattcggttgggataaattgcctgtttgtatggctaagacccaatacagtttttcagataacccatccttgcttggagcgccaaccgattttgacattaccattcgtgaatttgttcctaaaacaggagcaggttttattgttggtttaacaggtgatgtgatgaccatgcctggtttgcctaaagttccagctgccatggcaatggatgtagcagaaaatggcacagccctcggtctcttt

SEQ ID NO: 6200 - protein, 556 aa, Streptococcus pyogenes
MKSDIEIAQSVALQPITDIVKKVGIDGDDIELYGKYKAKLSFEKMKAVEANEPGKLILVTAINPTPAGEGKSTMSIGLADALNQMGKKTMLALREPSLGPVMGIKGGAAGGGYAQVLPMEDINLHFTGDMHAITTANNALSALIDNHLQQGNDLGIDPRRIIWKRVLDLNDRALRQVIVGLGSPVNGVPREDGFDITVASEIMAILCLATDLKDLKKRLADIVVAYTYDRKPVYVRDLKVEGALTLILKDAIKPNLVQTIYGTPALIHGGPFANIAHGCNSVLATSTALRLADYTVTEAGFGADLGAEKFLNIKVPNLPKAPDAIVIVATLRALKMHGGVAKSDLAAENCEAVRLGFANLKRHVENMRQFKVPVVVAINEFVADTEAEIATLKALCEEIKVPVELASVWANGAEGGLALAKTVVRVIDQEAADYKRLYSDEDTLEEKVINIVTQIYGGKAVQFGPKAKTQLKQFAEFGWDKLPVCMAKTQYSFSDNPSLLGAPTDFDITIREFVPKTGAGFIVGLTGDVMTMPGLPKVPAAMAMDVAENGTALGLF

SEQ ID NO: 6201 - DNA, 1593 bp, Streptococcus agalactiae
ttgatttggaggggggaaaaacttatcagtaataaagtcaaaattgttcgtttacttaataagagtaagaaaagtttactaaggggtatatttagtcgaacaaccgttatcgctattttattgattttacaattattgtttttactagcctcttactcatggctagagcagtatcgtgtttggttagcaaccgttgagcatatcttaacaattggagcggtcttatatttagttaatagtgaaatggatgctttgtcccgagtaacttggttaatattggtaatgattgcccctttactaggggcgatgttcctaatgtacaccaaatttgactggggttatcgtggtttgaaacaaagattggagacattgattgatgagagtcagatttatctagaggatgatcctgaaactttgaatcagcttaagtcaagtacatccacaacatatcatttggttcaatattttgaaaaagcacatggaaatttcccagtttatcgaaatactgatgtgacatttctaccaacgggagaagcattctttgaaaaaatgaaagaagaactactaaaagctaaaaagtatatctttttagaattctttatcattgacgaaggaataatgtggggagaaatacttagtattttagaacaaaaggtggaagaaggtgttgaagtccgtatcttatatgatggtatgatagaaattacaaaattatcctttgattatacgaaacgacttgagaaaataggaataaaagcaaaagcattttctccgatttctccttttatttcaacttattataactatcgtgaccatcgaaaaattgttgttattgatggagtagtaggcatgactggtggtgtaaacttagccgatgagtatattaatcacattgagttatttgggcattggaaagattcaggtattatgttaaaggggaaagcagtggatagtttcctcctacttttcttacagatgtggtccattactgaggaaaaaatgttagtagcgccttacctcggtgtacacgatgatttagttgaaaatgaaggctatgttattccttatggagattctcctttagacactgataaagtaggggaaaatgtttatatagatattcttaatcatgctagagaatatgtttacatcatgacaccttatttaatattagacagtgaattggaacatgccattcagtttgctgcggaacgtggtgtagatgtacgtattattatgccgggtatcccagataagccaatcccttatgctcttgctaaaacttactatcaagctttaacaaaatcaggtgttaaaatatatgaatacacccttggatttgttcattcaaaaatattccttagtgataatacaaaggctgttgtaggtacgataaatcttgattaccgtagcctgtatcaccattttgaatgtgctgtttatctttataaggtagatgcaatccaagacatttatcgagattatatggatacattaaataaatcaaggttagttagcttgaaagatataaataatattccaaaattccaaaaagtaattggcatagtgacaaaaactattgctcccctgctt

SEQ ID NO: 6202 - protein, 531 aa, Streptococcus agalactiae
MIWRGEKLISNKVKIVRLLNKSKKSLLRGIFSRTTVIAILLILQLLFLLASYSWLEQYRVWLATVEHILTIGAVLYLVNSEMDALSRVTWLILVMIAPLLGAMFLMYTKFDWGYRGLKQRLETLIDESQIYLEDDPETLNQLKSSTSTTYHLVQYFEKAHGNFPVYRNTDVTFLPTGEAFFEKMKEELLKAKKYIFLEFFIIDEGIMWGEILSILEQKVEEGVEVRILYDGMIEITKLSFDYTKRLEKIGIKAKAFSPISPFISTYYNYRDHRKIVVIDGVVGMTGGVNLADEYINHIELFGHWKDSGIMLKGKAVDSFLLLFLQMWSITEEKMLVAPYLGVHDDLVENEGYVIPYGDSPLDTDKVGENVYIDILNHAREYVYIMTPYLILDSELEHAIQFAAERGVDVRIIMPGIPDKPIPYALAKTYYQALTKSGVKIYEYTLGFVHSKIFLSDNTKAVVGTINLDYRSLYHHFECAVYLYKVDAIQDIYRDYMDTLNKSRLVSLKDINNIPKFQKVIGIVTKTIAPLL

SEQ ID NO: 6203 - DNA, 1575 bp, Streptococcus pyogenes
atgattatcaaaaagaaagcaaaagtaaaatatttgctccataaagggaaacatggatttttaagaggaatttttagtagaacaacaatcattgtattattaattattttgcaattagttttcttatttcaatcttatgcctggatggagcagtaccgtgtttggataacgattcttgaaagtgtctttgctattactattgttttatatttagttaatagtgatatggatgctatttcaagaatgacgtggttaattttgattatgattgctccattactagggtcactgtttttaatttatacaaaattggattggggttacagagggctaaaacaaagaataaatcatcttgtagatctgtctgcaccttaccttagcgatgatgacgctatattagaggtattaaaggatagcacatcaaccacatatcatttagtacagtacttagaaagaagtcgtggcaactttccgatttataataatacaagggtaacttacttcccaacaggtgaaactttttttgatagtttaaaagaacagttattcttagctaaaaagtacatttttcttgaattttttattattgcagaaggccaaatgtggggagaaatccttagtattctagaaaaaaaagtcagtgaaggtgtagaagttagggtgttgtttgatggcatgaacgaactatcaacgctatcatcagattacgccaagagattagaacaaatagggattaaagctaaatcatttttaccgatttcaccctttatctctacctattacaattatcgagatcaccgaaaaattgtcgttattgatggggaggtatcattcactggaggtattaatctagcagatgagtacattaatgaagtagagcgttttggccactggaaagatgctggtttaatgcttgagggtgaagcaacagacagctttttaattttgtttttacaaatgtggtctatcacagaaaaagaactgattattgatccttatctttcagatcattctttaaaacttccttcagatggctatgttattccctacggtgattccccgcttgatactgataaaataggtaaaaatgtttatatagacattttaaatcatgctaaagagtacgtttatatcatgacaccttaccttattttagatagcgagatggaacacgctttacggtttgcatcagaacgtggagtagatatccgaattattatgccaggagtgccagataagggggtaccatatgccttagctaaaacctattataaagctttgatgtcttctggagtaaaaatttatgagtatcaaccagggttcgttcattcaaaggtatttatctctgataatacaaaagcagttgtcggaacaattaacttagactatcgtagcctttatcatcattttgaatgcgcgacttatttatatcgtgtgtcagttattgctgatattgtgaatgactttaatgaagctcaaaagcaatcactattgatgacatcagatcatttgacgcaacgtccttggtatcaaaaattgataggattattagtacgaataattgcccctctcttg

SEQ ID NO: 6204 - protein, 525 aa, Streptococcus pyogenes
MIIKKKAKVKYLLHKGKHGFLRGIFSRTTIIVLLIILQLVFLFQSYAWMEQYRVWITILESVFAITIVLYLVNSDMDAISRMTWLILIMIAPLLGSLFLIYTKLDWGYRGLKQRINHLVDLSAPYLSDDDAILEVLKDSTSTTYHLVQYLERSRGNFPIYNNTRVTYFPTGETFFDSLKEQLFLAKKYIFLEFFIIAEGQMWGEILSILEKKVSEGVEVRVLFDGMNELSTLSSDYAKRLEQIGIKAKSFLPISPFISTYYNYRDHRKIVVIDGEVSFTGGINLADEYINEVERFGHWKDAGLMLEGEATDSFLILFLQMWSITEKELIIDPYLSDHSLKLPSDGYVIPYGDSPLDTDKIGKNVYIDILNHAKEYVYIMTPYLILDSEMEHALRFASERGVDIRIIMPGVPDKGVPYALAKTYYKALMSSGVKIYEYQPGFVHSKVFISDNTKAVVGTINLDYRSLYHHFECATYLYRVSVIADIVNDFNEAQKQSLLMTSDHLTQRPWYQKLIGLLVRIIAPLL

SEQ ID NO: 6205 - DNA, 1074 bp, Streptococcus agalactiae
atgggatataccgttgctatcgtaggtgctacaggtgccgtaggaacacaaatgattcgtcaattagaacaatcgaatttaccaatagaacaagtgaaacttttatcatcaagtcgctcagcaggtaaaattttacattttaaagatgaggctatacgtgttgaagagacaacaaaagaatcattttacgatgttgatattgccttgttttcagctggtggatctatttcagcaaagttcgctccttatgcagtaaagtctggagcagttgtagtagataacacgtcatattttcgtcagaatcctgatgttccactagttgttcctgaagtaaatgctcatgccatgattggtcataatggtatcatagcttgccccaattgttctactattcaaatgatgattgctttagagcccattcgtcaaaaatgggggatagagcgtgttatagtttccacctatcaagctgtttcgggttcaggtgcacgtgctgttgaagaaactaaggaacagttgagacaagttttaaatgataacctttcacctgatcaattaattgcaacagtcttgccatgttctagcgatcaaaaacattatcctatcgcattcaatgcattacctcaaattgatatttttactgataatgattatacgtacgaagaaatgaaaatgactttggagacaaagaaaattatggaagatgctactattaaggtttcagctacctgcgtccgtattcccgttttatcggggcattctgagtccatttatattgagacgaaagaattagcctcaatctctgaaattaaaaaggctattgcaaattttcctggtgccgtcctacaagaccttccatctcagcaaatttaccctcaagcgattaatgctgtaggccatagggagacctttgttggtcgtattcgaaaagaccttgatcaagaaaatggtgttcatatgtgggtagtttcagataatctactgaagggggcagcttggaattctgttcaaattgcagaaacattgcataagaatgggctggttaaaccagcaaaagagttaaaatttgaattaata

SEQ ID NO: 6206 - protein, 358 aa, Streptococcus agalactiae
MGYTVAIVGATGAVGTQMIRQLEQSNLPIEQVKLLSSSRSAGKILHFKDEAIRVEETTKESFYDVDIALFSAGGSISAKFAPYAVKSGAVVVDNTSYFRQNPDVPLVVPEVNAHAMIGHNGIIACPNCSTIQMMIALEPIRQKWGIERVIVSTYQAVSGSGARAVEETKEQLRQVLNDNLSPDQLIATVLPCSSDQKHYPIAFNALPQIDIFTDNDYTYEEMKMTLETKKIMEDATIKVSATCVRIPVLSGHSESIYIETKELASISEIKKAIANFPGAVLQDLPSQQIYPQAINAVGHRETFVGRIRKDLDQENGVHMWVVSDNLLKGAAWNSVQIAETLHKNGLVKPAKELKFELI

SEQ ID NO: 6207 - DNA, 147 bp, Streptococcus agalactiae
ttggagaaagaggctaagcagatcattgatttaaaaaggaatcttttcaaaattgatgtccgggcacaaaaggatgaagagaaagttttcatgcgtacggcgtggttgagtttaccaactctttttttatttgttggaattatgtta

SEQ ID NO: 6208 - protein, 49 aa, Streptococcus agalactiae
MEKEAKQIIDLKRNLFKIDVRAQKDEEKVFMRTAWLSLPTLFLFVGIML

SEQ ID NO: 6209 - DNA, 102 bp, Streptococcus agalactiae
atgctattatggaaaataataatttacaataatagatttaaaagagttgagtttacacgccaaacgcatgaagaaacttttgttttcagaaaactagattca

SEQ ID NO: 6210 - protein, 34 aa, Streptococcus agalactiae
MLLWKIIIYNNRFKRVEFTRQTHEETFVFRKLDS

SEQ ID NO: 6211 - DNA, 600 bp, Streptococcus agalactiae
atggagaaagatatgattccagtagttattgaacaaacaagtcgtggtgaacgttcttatgatatttactcacgtcttttaaaagatcgtattattatgttgacaggccaagttgaggataatatggccaatagtatcattgcacagttattgtttctcgatgcacaagataatacaaaggatatttacctttatgtcaatacaccaggtggttcagtatcggctggacttgctattgtggacaccatgaacttcattaaatcggacgtacagacgattgttatggggatggctgcttcgatgggaaccattattgcttcaagtggtgctaaaggaaaacgttttatgttaccgaatgcagaatatatgatccaccaaccaatgggcggaacaggcggaggtacacagcaatctgatatggctatcgctgctgagcatcttttaaaaacgcgtcatactttagaaaaaatcttagctgataattctggtcaatctattgaaaaagtccatgatgatgcagagcgtgatcgttggatgagtgctcaagaaacacttgattatggctttattgatgctattatggaaaataataatttacaa

SEQ ID NO: 6212 - protein, 200 aa, Streptococcus agalactiae
MEKDMIPVVIEQTSRGERSYDIYSRLLKDRIIMLTGQVEDNMANSIIAQLLFLDAQDNTKDIYLYVNTPGGSVSAGLAIVDTMNFIKSDVQTIVMGMAASMGTIIASSGAKGKRFMLPNAEYMIHQPMGGTGGGTQQSDMAIAAEHLLKTRHTLEKILADNSGQSIEKVHDDAERDRWMSAQETLDYGFIDAIMENNNLQ

SEQ ID NO: 6213 - DNA, 588 bp, Streptococcus pyogenes
atgattcctgttgttattgaacaaactagccgtggagaacgttcttatgacatttattcacgtttattaaaagaccgtattatcatgttaacagggcctgtcgaagacaacatggccaactctgtcatagcgcagctcttattccttgacgcgcaagacaacactaaagatatctacctatatgtcaacacaccaggtggctctgtctcagcaggcttggctattgtcgataccatgaactttatcaaggccgatgtgcaaactattgtcatgggtatggcagcttctatggggacagtcattgcttcatcaggaacaaaaggcaaacgctttatgttaccaaatgcagagtatatgatccaccagccaatgggtggtacaggtggtggcacgcaacaaacggatatggctatcgcagcagaacatctcttaaaaacacgtcaccgtttagaaaaaatcttagcgcaaaatgctggaaaaacgattaaacaaatccataaagatgctgagcgtgattattggatgagtgctgaagaaaccttggcttacggtttcattgatgaaatcatggaaaacaacgaactaaaa

SEQ ID NO: 6214 - protein, 196 aa, Streptococcus pyogenes
MIPVVIEQTSRGERSYDIYSRLLKDRIIMLTGPVEDNMANSVIAQLLFLDAQDNTKDIYLYVNTPGGSVSAGLAIVDTMNFIKADVQTIVMGMAASMGTVIASSGTKGKRFMLPNAEYMIHQPMGGTGGGTQQTDMAIAAEHLLKTRHRLEKILAQNAGKTIKQIHKDAERDYWMSAEETLAYGFIDEIMENNELK

SEQ ID NO: 6215 - DNA, 627 bp, Streptococcus agalactiae
atgggaaaatttcaagtcatttcacatccacttattcaacataaactgtcaatcttacgtcgcactacaacatctactaaagattttcgtgagttagttgatgagattgcgatgttaatgggctatgaagtgtctcgtgatttgcctttagaagatgttgaaatccaaacaccagtagcgacaactgtacaaaaacaattagctgggaaaaagttagcaattgttccaattttacgtgcaggtattggtatggttgatggtttcttaagccttgtgccagctgctaaagttggtcatatcggtatgtatcgtgatgaagagactttccaaccagtcgaatatttagttaagttacctgaagatattgatcaacgtcagatttttgtagttgatccaatgcttgctacaggtgggtctgctattttagcagtagattctctaaaaaaacgtggcgcagctagtatcaaattcgtttgtttagtagcagctccagaaggagtggcagcacttcaagaagcacatccagatgtagatatttataccgctgctttggatgaaaaactcaacgaacatggctacattgttcctggactcggagatgctggggatcgcttatttggtacaaaa

SEQ ID NO: 6216 - protein, 209 aa, Streptococcus agalactiae
MGKFQVISHPLIQHKLSILRRTTTSTKDFRELVDEIAMLMGYEVSRDLPLEDVEIQTPVATTVQKQLAGKKLAIVPILRAGIGMVDGFLSLVPAAKVGHIGMYRDEETFQPVEYLVKLPEDIDQRQIFVVDPMLATGGSAILAVDSLKKRGAASIKFVCLVAAPEGVAALQEAHPDVDIYTAALDEKLNEHGYIVPGLGDAGDRLFGTK

SEQ ID NO: 6217 - DNA, 627 bp, Streptococcus pyogenes
atgggaaaatgtcaagttatttcgcatccgcttatccaacacaaactttcaatcttacgtcgtcaaaccacatcaactaaagattttcgtgagttggttaatgaaattgcgatgctgatgggatatgaagtgtcacgcgaccttcccttagaagatgtcgacatccaaacgccagtctcaaaaacggtccaaaaacagttagctggtaaaaaattagctattgttccgattcttcgtgctggtattgggatggttgatggcttgttaagtttggtaccagctgcaaaagttggccatatcggcatgtaccgtaatgaagaaacccttgaacctgttgaatacctcgttaaactaccagaagatattaaccaacgacaaattttccttgttgatccaatgttggcaacaggtggctcggctatcttagcagtggattcgttgaaaaaacgtggcgcagcaaatattaagtttgtctgtttagttgcagcaccagaaggggtgaaaaaacttcaagaagctcatccagatattgatatcttcacagcagcacttgatgatcatttaaatgaacatggctatatcgtgccaggattgggcgatgctggtgatcgtttatttgggacaaaa

SEQ ID NO: 6218 - protein, 209 aa, Streptococcus pyogenes
MGKCQVISHPLIQHKLSILRRQTTSTKDFRELVNEIAMLMGYEVSRDLPLEDVDIQTPVSKTVQKQLAGKKLAIVPILRAGIGMVDGLLSLVPAAKVGHIGMYRNEETLEPVEYLVKLPEDINQRQIFLVDPMLATGGSAILAVDSLKKRGAANIKFVCLVAAPEGVKKLQEAHPDIDIFTAALDDHLNEHGYIVPGLGDAGDRLFGTK

SEQ ID NO: 6219 - DNA, 1167 bp, Streptococcus agalactiae
atgattacatatgatttcacaagtttaccagaacgtttttcaagtaataccataaaatggaaggcggttcaaaaagatcaagaaatccttcccctttggattgcggatatggattttcctatctttccagaaatgtcggaggctattgaagatttttcacaccaaatggtttttggctatgatagtcctaaagacagtttataccaagctatctctaattgggaagtgcaagaacatggttatcaatttgataaaaaatcattattattaattgatggggttgtaccagcgatttcagttgctatacaagccttcacaaaggagggagatgctgttctaattaataccccagtctatccgccctttgctagaactataaaatacaataatcgtcatttagtttcaaatagtttacttaataataatcagtattttgagattgactttaaacaattagaaaaagatatcattgaaaataatgtaaagctttatattttttgtagtccacacaatcccggtgggcgtgtctggacaaaaggagaaattcaaaaaataggagatatctgtaaacgatataatgttatcctcgtttctgacgaaatacatcaagatttggtattatttgataatgtacaccatagctttaatactgttgattctagttttaaagaattgagtgttattttatctagtgcaactaaaacgtttaatattgcagggactaaaaatagttttgcaataattgaaaatgaaaagttacgctcggattttaagaagaggcaaatagctaacaatcaacaagaaatttcttcattggggttattagctacagaagttgcctttacaaaagagaaacaatggttaaaggccctaaaaatggagttagaaggatcaatagaatacctttatgagcaattaacgcaaaaaactcatatcaaagtgatgaaaccagagggaacttatcttgtttggttagatttttctgcttataatttaacgcatttagaaattcaagaaaaacttcgatatgatgccaaattaatattaaatgatggtttaacttttggaaaagaagggaaaaaacatgctagaatcaatgtcgcagctcctaggtctgttattgaggaggcagttttgcgattagtgacaaactttagaaaaaatgac

SEQ ID NO: 6220 - protein, 389 aa, Streptococcus agalactiae
MITYDFTSLPERFSSNTIKWKAVQKDQEILPLWIADMDFPIFPEMSEAIEDFSHQMVFGYDSPKDSLYQAISNWEVQEHGYQFDKKSLLLIDGVVPAISVAIQAFTKEGDAVLINTPVYPPFARTIKYNNRHLVSNSLLNNNQYFEIDFKQLEKDIIENNVKLYIFCSPHNPGGRVWTKGEIQKIGDICKRYNVILVSDEIHQDLVLFDNVHHSFNTVDSSFKELSVILSSATKTFNIAGTKNSFAIIENEKLRSDFKKRQIANNQQEISSLGLLATEVAFTKEKQWLKALKMELEGSIEYLYEQLTQKTHIKVMKPEGTYLVWLDFSAYNLTHLEIQEKLRYDAKLILNDGLTFGKEGKKHARINVAAPRSVIEEAVLRLVTNFRKND

SEQ ID NO: 6221 - DNA, 546 bp, Streptococcus agalactiae
atgaatattgaaacactaacgcagaaaaatcatcgttccgatagcggacgaaatcatattgttttatttgaaccacagattccagcaaatactggtaatattgctagaacttgtgcggcaacaaatgctcctttgcacatcatacgaccgatgggatttcctattgatgataaaaaaatgaaacgagcgggactggattactgggataagctagatgttagtttctatgatggtttggaagaatttatgttgtcatgtcgagggaaagttcacctaattagcaaatttgctgacaaggtttactcagatgaaaattacaatgatgatcaagaccattattttatgtttggtcgtgaagataaaggattgccagaaacttttatgcgcgagcatgccgaaaaggccttacgaattcccatgaacgatgagcatgtgcgtagcttgaatgtttcaaacactgtttgtatgattgtttatgaagcccttaggcagcaaagctttcctaatttagaattaagccatacttatgaaaatgataaattaaaa

SEQ ID NO: 6222 - protein, 182 aa, Streptococcus agalactiae
MNIETLTQKNHRSDSGRNHIVLFEPQIPANTGNIARTCAATNAPLHIIRPMGFPIDDKKMKRAGLDYWDKLDVSFYDGLEEFMLSCRGKVHLISKFADKVYSDENYNDDQDHYFMFGREDKGLPETFMREHAEKALRIPMNDEHVRSLNVSNTVCMIVYEALRQQSFPNLELSHTYENDKLK

SEQ ID NO: 6223 - DNA, 582 bp, Streptococcus pyogenes
gtgtggttttttaaattaaaaagagtaaatgagattatgacgacaaaagaacttatcaacaaaaacgacaaagtaaaaaaggctcgcaatcatattgtcctgtttcaaccccaaattccacaaaatactggtaatattgctagaacatgtgctgcaactaatgcacctttacatattattaaacccatgggatttcctattgatgaccgcaaaatgaagcgtgcaggcttggattactgggacaagttagaactgcatttttatgatcatttagaacagtttatcaatcaatgtcacggacagcttcacctgattagcaagtttgcagttaataattattctcaagctacttatgctgatggcgattcccattatttcttgtttggacgagaagatacaggcctgccagaagattttatgcgagaacatgctgaaaaagcacttcgtattccgatgaatgatgagcatgtacggagtttaaatgtctcaaatacggtttgtatggtgatttatgaagcccttagacaacagggctttcaagggttagagttaaagcatacttacgaacacgataaactaaaa

SEQ ID NO: 6224 - protein, 194 aa, Streptococcus pyogenes
VWFFKLKRVNEIMTTKELINKNDKVKKARNHIVLFQPQIPQNTGNIARTCAATNAPLHIIKPMGFPIDDRKMKRAGLDYWDKLELHFYDHLEQFINQCHGQLHLISKFAVNNYSQATYADGDSHYFLFGREDTGLPEDFMREHAEKALRIPMNDEHVRSLNVSNTVCMVIYEALRQQGFQGLELKHTYEHDKLK

SEQ ID NO: 6225 - DNA, 567 bp, Streptococcus agalactiae
ttgtattttgcatatgatggttggacaatttttgttaatattgcaccagaagtcaagaatcccaagaagaatttaccacttgcctttgtcattggtccagcgcttatcttattatcatatttggcatttttctatggtttgacacaaattttaggtgctagctttattatgacaaccggtaatgatgctattaattatgcagctaatattattttcggtcctagtgttgggcgtttattatctttcattgttattctatctgtattaggtgttgccaatggacttttacttgggacgatgcgtctacctcaagcttttgcggaacgcggatggatcaaaagtgagaggatggctaacataaatttgaagtatcaaatgtcattgccagctagtttgacggtgacggctgtagctattttttggctttttgttcattttatggttacaaaatttaacttattgccgggtagtgatattagtgaaattgctgtggtgtttaataataccagtttaatcattctttatgttttagtactcagcctttatctcaaaaaagatattaaaaat

SEQ ID NO: 6226 - protein, 189 aa, Streptococcus agalactiae
MYFAYDGWTIFVNIAPEVKNPKKNLPLAFVIGPALILLSYLAFFYGLTQILGASFIMTTGNDAINYAANIIFGPSVGRLLSFIVILSVLGVANGLLLGTMRLPQAFAERGWIKSERMANINLKYQMSLPASLTVTAVAIFWLFVHFMVTKFNLLPGSDISEIAVVFNNTSLIILYVLVLSLYLKKDIKN

SEQ ID NO: 6227 - DNA, 159 bp, Streptococcus agalactiae
gtgggtgacggtattcgtaccttaacaggggaattagttgcaccgagcgttgcagagggtgatactgttttagtcgaaaatggtgctggtctggaagttaaagacggtaacgaaaaagtgacagttgttcgcgaaagtgacattgttgctgtcgttaaa

SEQ ID NO: 6228 - protein, 53 aa, Streptococcus agalactiae
MGDGIRTLTGELVAPSVAEGDTVLVENGAGLEVKDGNEKVTVVRESDIVAVVK

SEQ ID NO: 6229 - DNA, 330 bp, Streptococcus pyogenes
gtgctaactttactaaagattcttttattggaggaaaatttcatgttaaaaccattaggtgaccgtgtggtcgtaagatttgatgatgaaaaagagcagacagtcggtggttttgtccttgcaggcactcataaagagtcaacacgaaaagcgacagtcctcgctgtcagtgaaacgggtgttcgcactattacaggtgatagcgtgctaccttcagtttcagtgggtcaagaggttttagttgaaaatgggcatgatttagaagtaaccgtagatgatgagaaagtttctatcatccgtgaatctgacatcattgctattgttacaaaa

SEQ ID NO: 6230 - protein, 110 aa, Streptococcus pyogenes
VLTLLKILLLEENFMLKPLGDRVVVRFDDEKEQTVGGFVLAGTHKESTRKATVLAVSETGVRTITGDSVLPSVSVGQEVLVENGHDLEVTVDDEKVSIIRESDIIAIVTK

SEQ ID NO: 6231 - DNA, 1620 bp, Streptococcus agalactiae
atggcaaaagatattaaattttcagcagatgcccgctcagcaatggtgcgtggtgttgatattttagctgatacagtcaaagtaacattaggtcctaaaggccgtaatgttgttcttgaaaaagcatttggttctcctttaattacaaatgatggtgtgacaattgctaaagaaattgagctagaagatcactttgaaaatatgggagctaaacttgtgtcagaagtggcttcaaaaactaatgatattgcaggggatggcactacaactgctactgttttgacccaagctattgtacgggaaggtcttaaaaatgtaactgcaggggcaaatccgattggcattcgtcgtggtattgaaacagctgtttcagcagcagttgaagagctaaaagagattgcacaaccagtttcaggcaaagaagctattgctcaagttgcggctgtgtcttcacgttctgaaaaagttggggaatacatttctgaagctatggagcgcgtgggtaatgatggtgttatcactattgaagaatcgcgaggtatggaaacagagcttgaagttgtggaaggaatgcagtttgaccgtgggtacttgtcacagtatatggtaactgataacgagaaaatggtctctgaacttgagaatccgtatatccttattacagataagaaaatttcaaatatccaagaaattttaccattattagaagaggttcttaaaacaaatcgtccgttgctaatcatcgctgatgatgttgatggagaagctctcccaacgcttgttcttaacaaaattcgtggaactttcaatgtcgtagctgttaaagcgcctggatttggtgatcgtcgtaaagccatgctggaagatattgctatcctaacaggaggaactgtcgttactgaagaccttggtttagacttaaaagatgctactatgcaagttttaggacagtctgctaaagtaacagtagataaagattctactgttattgtcgaaggtgccggtgactcatcagcaattgctaatcgcgtagctatcattaagtcacagatggaggctacaacttctgattttgatcgtgaaaaattacaagaacgacttgctaagttagccggtggtgtagcagtaattaaagttggtgcagcgactgaaacagaattaaaagagatgaaacttcgcatcgaagatgcgttaaatgcaacgcgtgctgcagttgaagaaggtattgtttcaggtggaggtacggctcttgtgaacgttattgaaaaagtagcggcactgaaacttaatggtgatgaggagactggacgtaatattgttcttcgtgctctcgaagagcctgttcgtcaaattgcttacaatgctggatatgaaggttcagttattattgaacgtttaaaacagtctgaaattggtacaggatttaatgcggccaatggagaatgggtagatatggttaccacaggtatcattgaccctgtcaaagtaacacgttctgcacttcaaaatgcggcatctgtagcaagtcttatcttgactacagaagcagtagtagcaaataaacctgaaccagaagctcctacagctcctgcaatggatccatctatgatgggtggcttc

SEQ ID NO: 6232 - protein, 540 aa, Streptococcus agalactiae
MAKDIKFSADARSAMVRGVDILADTVKVTLGPKGRNVVLEKAFGSPLITNDGVTIAKEIELEDHFENMGAKLVSEVASKTNDIAGDGTTTATVLTQAIVREGLKNVTAGANPIGIRRGIETAVSAAVEELKEIAQPVSGKEAIAQVAAVSSRSEKVGEYISEAMERVGNDGVITIEESRGMETELEVVEGMQFDRGYLSQYMVTDNEKMVSELENPYILITDKKISNIQEILPLLEEVLKTNRPLLIIADDVDGEALPTLVLNKIRGTFNVVAVKAPGFGDRRKAMLEDIAILTGGTVVTEDLGLDLKDATMQVLGQSAKVTVDKDSTVIVEGAGDSSAIANRVAIIKSQMEATTSDFDREKLQERLAKLAGGVAVIKVGAATETELKEMKLRIEDALNATRAAVEEGIVSGGGTALVNVIEKVAALKLNGDEETGRNIVLRALEEPVRQIAYNAGYEGSVIIERLKQSEIGTGFNAANGEWVDMVTTGIIDPVKVTRSALQNAASVASLILTTEAVVANKPEPEAPTAPAMDPSMMGGF

SEQ ID NO: 6233 - DNA, 1635 bp, Streptococcus pyogenes
ttgaatatggcaaaagatattaaattttcagcagatgcgcgtgctgccatggtgcgcggagttgatatgttagcagataccgtcaaagtaacgcttggtcctaaagggcgcaatgttgttcttgaaaaagcttttggttctcccttaattactaatgacggggtaaccattgctaaagagatcgaattagaagatcattttgaaaacatgggagcaaaattggtgtctgaagtggcttctaaaaccaatgatattgctggtgatgggacgactactgcaacagttttgacacaagccattgttcatgaaggactaaaaaatgtgacagcaggtgctaatccaattggtatccgtcgaggcattgaaacagcaacagcaacagctgttgaagccttgaaagccattgctcaacctgtatctggcaaggaagctattgctcaggtcgctgcagtatcatcacgctctgaaaaagttggagagtatatctcagaagctatggagcgtgtgggcaacgatggtgtgattaccatcgaagaatctcgaggtatggaaacagaacttgaagtggttgaaggcatgcaatttgaccgtggttacctgtctcaatacatggtcacagacaatgaaaaaatggttgcagaccttgaaaacccatttatcttaatcacggataaaaaagtgtcaaacatccaagacattttgccactacttgaggaagttcttaaaaccaaccgtccattactcattattgcagatgatgtggatggtgaagcacttccaacccttgtcttgaacaagattcgtggtactttcaatgtggttgctgtcaaagcgccaggatttggtgatcgtcgtaaagctatgcttgaagacattgctatcttgacaggtggtacagtgattacagaggatctaggacttgaattaaaagatgctacaatgacagcccttggacaggctgctaagattacagttgataaagatagcacagtaattgttgaaggttcaggaagttcagaagctattgctaaccgtattgcactgattaaatcgcaattagaaacaacaacttctgactttgaccgtgaaaaactacaagaacgtttggcgaaattagctggtggtgtagctgttatcaaagtaggagctccaacagagacagctttaaaagaaatgaaacttcgcattgaggatgctctaaatgctacacgtgcagccgttgaagaaggtatcgttgctggtggtggaacagcacttattacggttattgaaaaagtagcagctcttgagcttgagggcgatgatgctactggacgtaacattgtgcttcgtgctctagaagagcctgtacgtcaaattgctttaaatgctgggtacgaaggctccgtagttattgacaagttgaaaaacagccctgcaggaacaggatttaatgctgcaacaggtgagtgggttgatatgattaaaacaggaatcattgaccctgtcaaagtaacacgatcagcgcttcaaaatgcagcttctgtagctagtcttattttgacaacagaagcagttgttgctaataaacctgaaccagctacgccagcgccagcaatgccagcaggtatggatccaggaatgatgggcggcttc

SEQ ID NO: 6234 - protein, 545 aa, Streptococcus pyogenes
LNMAKDIKFSADARAAMVRGVDMLADTVKVTLGPKGRNVVLEKAFGSPLITNDGVTIAKEIELEDHFENMGAKLVSEVASKTNDIAGDGTTTATVLTQAIVHEGLKNVTAGANPIGIRRGIETATATAVEALKAIAQPVSGKEAIAQVAAVSSRSEKVGEYISEAMERVGNDGVITIEESRGMETELEVVEGMQFDRGYLSQYMVTDNEKMVADLENPFILITDKKVSNIQDILPLLEEVLKTNRPLLIIADDVDGEALPTLVLNKIRGTFNVVAVKAPGFGDRRKAMLEDIAILTGGTVITEDLGLELKDATMTALGQAAKITVDKDSTVIVEGSGSSEAIANRIALIKSQLETTTSDFDREKLQERLAKLAGGVAVIKVGAPTETALKEMKLRIEDALNATRAAVEEGIVAGGGTALITVIEKVAALELEGDDATGRNIVLRALEEPVRQIALNAGYEGSVVIDKLKNSPAGTGFNAATGEWVDMIKTGIIDPVKVTRSALQNAASVASLILTTEAVVANKPEPATPAPAMPAGMDPGMMGGF

SEQ ID NO: 6235 - DNA, 753 bp, Streptococcus agalactiae
ttgtatacggaggttacaatgcctaaaaatgaactaaataataaactaaataaactaaagcatgtacaagtctacaataagatttttaacatgattcaagacggtacttattctcctggaatgcaattaccttctgaacccgaattagcagggcaacttaatgttagtcgagctactttacgaaagtcattagcactattacaagaagaccatttggttaaaaatatcagaggaaaaggtaatttcattagagaaaattctagcaacttgtctgaaaacggttacgaaaatagacaacaccctattaaaacttgtctaacttccaaaattacagaagtagaattagaatttcgtgtagaggttcctgcagaagctatcacagcttcacttaaacaagaaacccctgtagttgttattgctgatcgttggtaccacaccgatgatggaccattagcttacacactttcttttatccctatcgaacttatttcagatgctgagatttctttacatgatactaaacagttgttaaacttcattgaagaaggtatctatcaagaaggcatatcaagccactcacaaagccatttgggatatgcgacatctggcaatttttcagcaactaaatataccctatccgatcatggacaattcatattaatacaagaaacaatttttaagcaagagaaaatactaatgtgtaataagcattacgttcccattgagcactttgaattgtccattacctctcat

SEQ ID NO: 6236 - protein, 251 aa, Streptococcus agalactiae
MYTEVTMPKNELNNKLNKLKHVQVYNKIFNMIQDGTYSPGMQLPSEPELAGQLNVSRATLRKSLALLQEDHLVKNIRGKGNFIRENSSNLSENGYENRQHPIKTCLTSKITEVELEFRVEVPAEAITASLKQETPVVVIADRWYHTDDGPLAYTLSFIPIELISDAEISLHDTKQLLNFIEEGIYQEGISSHSQSHLGYATSGNFSATKYTLSDHGQFILIQETIFKQEKILMCNKHYVPIEHFELSITSH

SEQ ID NO: 6237 - DNA, 741 bp, Streptococcus pyogenes
atgtctactaacgacttaaccaaaaaactcaaaaaacttaaacatgtgcaagtatataatactatttttcaacttattcaagatggtacatatagtcctggcatgcaactgccatcagaacctgaacttgctagacagctcaatgtcagtcggatgacactacgtaaatccctagccctcctccaagaggatcatctcataaaaaatatcagaggaaagggaaattttatactcaagactcctgaaactaaatatcaccaaggtttcgaatatcttcaacaccccatatatgcaagcctatcatctgacatcacaaaggttgagttggaatatcggattgaagtgcccactgttgccattacagcatccctaaaacaagaaactcctgttgtgattattgttgatcgctggtatcatagccaaaataaagctattgcttatagtttatcttttatccctattgaggttatttctaaatatgctataaatctcaatcaagaagagccccttcttactttcttagaagagaaaatctatgaatctggtaaagcttctcattcctgcaaccaaatcggctataccaagactggcaattacacagcaactaagtatactctatcagaaaatagtgcttttattttaatccaagaaactctctacaatggtaaagacatcttggtctcaaccaaacactacgttcctgctgatttatttgacttaaaagttcaatctcaaagttgc

SEQ ID NO: 6238 - protein, 247 aa, Streptococcus pyogenes
MSTNDLTKKLKKLKHVQVYNTIFQLIQDGTYSPGMQLPSEPELARQLNVSRMTLRKSLALLQEDHLIKNIRGKGNFILKTPETKYHQGFEYLQHPIYASLSSDITKVELEYRIEVPTVAITASLKQETPVVIIVDRWYHSQNKAIAYSLSFIPIEVISKYAINLNQEEPLLTFLEEKIYESGKASHSCNQIGYTKTGNYTATKYTLSENSAFILIQETLYNGKDILVSTKHYVPADLFDLKVQSQSC

SEQ ID NO: 6239 - DNA, 777 bp, Streptococcus agalactiae
atgcagaattattcaggtgaagtcggattgcaatatcacctacagattcgtccaggtgatgtaggtcgttatgttatcatgccaggtgatccaaaacgttgtgcaaaaattgcagaacattttgataatgcagttcttgtagcagacagccgtgaatatgttacttatacaggtacattaaacggtgaaaaagtcagtgttacttcaactggtattggtggtccatcagcgtctattgcgatggaagaattgaaactctgtggcgctgatacctttatccgtgttggaacatgtggtggtattgaccttgatgttaaaggcggagacatcgttattgcaactggagctatccgtatggaaggtacaagtaaagaatatgctccgattgaatttcctgctgtagctgacttggaggtaacgaatgctctagttaatgcagctaaaaagcttggttacacaagtcacgcaggagtagttcaatgtaaagatgcattttatggacaacatgagccagaacgtatgccagttagttatgaattattaaataaatgggaagcatggaaacgtctgggaacaaaagcgtctgaaatggaatctgcagctctttttgtagcagcaagtcatctaggagttcgttgtggatcagatttccttgttgttggtaatcaagaacgcaacgctttgggtatggataacccaatggctcatgacacagaagcagctattcaagttgctgttgaagcactccgcacacttattgaaaatgataaatcacaa

SEQ ID NO: 6240 - protein, 259 aa, Streptococcus agalactiae
MQNYSGEVGLQYHLQIRPGDVGRYVIMPGDPKRCAKIAEHFDNAVLVADSREYVTYTGTLNGEKVSVTSTGIGGPSASIAMEELKLCGADTFIRVGTCGGIDLDVKGGDIVIATGAIRMEGTSKEYAPIEFPAVADLEVTNALVNAAKKLGYTSHAGVVQCKDAFYGQHEPERMPVSYELLNKWEAWKRLGTKASEMESAALFVAASHLGVRCGSDFLVVGNQERNALGMDNPMAHDTEAAIQVAVEALRTLIENDKSQ

SEQ ID NO: 6241 - DNA, 777 bp, Streptococcus pyogenes
atgcaaaattattcaggtgaagtcggattgcaatatcacctacagattcgtccaggtgatgtaggtcgttatgttatcatgccaggtgatccaaaacgttgtgcaaaaattgcagaacattttgataatgcagttcttgtagcagacagccgtgaatatgttacgtatacaggtacattaaacggtgaaaaagttagtgttacttcaactggtattggtggtccatcagcgtctattgcgatggaagaattgaaactttgtggcgctgatacctttatccgtgttggaacatgtggtggtattgaccttgatgttaaaggcggagacatcgttattgcaactggagctatccgtatggaaggtaccagtaaagaatatgctccgattgaatttcctgctgtagctgacttggaagtgacaaatgctctagttaatgcagctaaaaagcttggttatacaagtcacgcaggagtagttcaatgtaaagatgcattttacgggcaacatgagccagaacgtatgccagttagttatgaattattaaataaatgggaagcatggaaacgtctgggaacaaaagcgtctgaaatggaatctgcagctctttttgtagcagcaagtcatctaggagttcgttgtggatcagatttccttgttgttggtaatcaagaacgcaacgctttgggtatggataacccaatggctcatgatacagaagcagctattcaagttgctgttgaagcactccgcacacttattgaaaatgataaatcacaa

SEQ ID NO: 6242 - protein, 259 aa, Streptococcus pyogenes; identical to SEQ ID NO: 6240

SEQ ID NO: 6243 - DNA, 1212 bp, Streptococcus agalactiae
ttggaagtcatcatgcaatttatttatagtattattggtattttattggtattaggaattgtgtatgcaatttctttcaatcgtaagagtgtttctctaagtttaattggaaaagctcttatcgttcaattcattattgcgctaatcttagtacgtatcccactaggtcaacaagttgttagtgttgtttcaactggagttactaaagtaatcaactgtggtcaagctggattaaattttgtgtttggttcattagcagatagtggagcaaaaactggttttattttcgccattcaaacgcttggcaatattgttttcttatctgccctagttagtctactttattatgtaggaatccttggatttgtagtaaaatggataggtaagggcgttggtaaaattatgaaatcctcagaggttgagagttttgttgccgtagctaatatgtttcttggtcaaacagacagtccaattttggttagcaaatacctaggtcgtatgactgatagtgagataatggttgtgttggtatcaggtatgggaagtatgtcagtttctattcttggtggctacattgcattaggcattccaatggaatatctcttgattgcttcaacaatggttcctattggcagtattctcattgctaaaatcttattgcctcaaacagaacctgttcaaaaaattgatgacattaagatggataataaaggtaataacgccaatgtgattgatgcaatcgctgagggtgcaagcacaggtgcacaaatggctttctcaattggtgctagtttgattgcctttgttggtttagtttctttgattaatatgatgttaagtggattgggaatccgcttagaacaaatcttctcatatgtttttgctccatttggttttcttatgggatttgaccacaaaaacattcttctagaaggaaaccttcttggaagtaagttgattttaaatgagtttgtttcgttccaacaattgggtgacctaatcaaatctttagattatcgtacagcattggtagcaactatttcactttgtggttttgctaatttatcaagtttaggtatttgtgtttcaggtattgctgttctttgtccagagaaacgtggcaccctagctcgacttgttttccgtgcaatgattggtggtattgctgtaagtatgcttagcgcctttatcgtcggtattgtaactctattc

SEQ ID NO: 6244 - protein, 404 aa, Streptococcus agalactiae
MEVIMQFIYSIIGILLVLGIVYAISFNRKSVSLSLIGKALIVQFIIALILVRIPLGQQVVSVVSTGVTKVINCGQAGLNFVFGSLADSGAKTGFIFAIQTLGNIVFLSALVSLLYYVGILGFVVKWIGKGVGKIMKSSEVESFVAVANMFLGQTDSPILVSKYLGRMTDSEIMVVLVSGMGSMSVSILGGYIALGIPMEYLLIASTMVPIGSILIAKILLPQTEPVQKIDDIKMDNKGNNANVIDAIAEGASTGAQMAFSIGASLIAFVGLVSLINMMLSGLGIRLEQIFSYVFAPFGFLMGFDHKNILLEGNLLGSKLILNEFVSFQQLGDLIKSLDYRTALVATISLCGFANLSSLGICVSGIAVLCPEKRGTLARLVFRAMIGGIAVSMLSAFIVGIVTLF

SEQ ID NO: 6245 - DNA, 1212 bp, Streptococcus pyogenes
ttggaagtcatcatgcaatttatttatagtattattggtattttattggtattaggaattgtgtatgcaatttctttcaatcgtaagagtgtttctctaagtttaattggaaaagctcttatcgttcaattcattattgcgctaatcttagtacgtatcccactaggccaacaaattgttagtgttgtttcaactggagttactagcgtaatcaactgtggtcaagctggtttaaattttgtgtttgggtcattagcagatagtggcgcaaaaactggttttattttcgctattcaaacgcttggtaatattgttttcttatctgccctagttagtctactttattatgtaggaatccttggatttgtagtaaaatggataggtaagggcgttggtaaaattatgaaatcctcagaggttgagagttttgttgctgtagctaatatgtttcttggtcaaacagacagtccaatcttggttagcaaatacctaggtcgtatgactgatagtgagataatggttgtgttggtatcaggtatgggaagtatgtcagtttctattcttggtggctatattgcattaggcattccaatggaatatctcttgattgcttcaacaatggttcctattggcagtattctcattgctaaaatcttattgcctcaaacagaacctgttcaaaaaattgatgacattaagatggataataaaggtaataacgccaatgtgattgatgcaatcgctgagggtgcaagcacaggtgcacaaatggctttctcaattggtgctagtttgattgcctttgttggtttagtttctttgattaatatgatgttaagtggattgggaatccgcttagaacaaatcttttcatatgtttttgctccatttggttttcttatgggatttgaccacaaaaacattcttctagaaggaaaccttcttggaagtaagttgattttaaatgagtttgtttcgttccaacaattgggtcacctaatcaaatctttagattatcgtacagcattggtagcaactatttcactctgtggttttgctaatttatcaagtttaggtatttgtgtttcaggtattgctgttctttgcccggagaaacgtagcaccctagctcgacttgttttccgtgcaatgattggtggtattgctgtaagtatgcttagcgcctttatcgtcggtattgtaactctattc

SEQ ID NO: 6246 - protein, 404 aa, Streptococcus pyogenes
LEVIMQFIYSIIGILLVLGIVYAISFNRKSVSLSLIGKALIVQFIIALILVRIPLGQQIVSVVSTGVTSVINCGQAGLNFVFGSLADSGAKTGFIFAIQTLGNIVFLSALVSLLYYVGILGFVVKWIGKGVGKIMKSSEVESFVAVANMFLGQTDSPILVSKYLGRMTDSEIMVVLVSGMGSMSVSILGGYIALGIPMEYLLIASTMVPIGSILIAKILLPQTEPVQKIDDIKMDNKGNNANVIDAIAEGASTGAQMAFSIGASLIAFVGLVSLINMMLSGLGIRLEQIFSYVFAPFGFLMGFDHKNILLEGNLLGSKLILNEFVSFQQLGHLIKSLDYRTALVATISLCGFANLSSLGICVSGIAVLCPEKRSTLARLVFRAMIGGIAVSMLSAFIVGIVTLF

SEQ ID NO: 6247 - DNA, 669 bp, Streptococcus agalactiae
gtggaagtaaaagatattttaaaaacggtagaccatactttgctagcaacaacagcaacatggccagaaatccaaacaattttagatgatgcaatggcttatgaaacagcttcagcatgtattccagcctcttacgtcaaaaaagcagcagagtacgtttcaggtaaattagctatttgtactgttattgggttcccaaatggctatagtacaactgcagcgaaggtttttgaatgtcaagatgctattaaaaatggtgctgatgaaattgacatggtcattaatttgacagatgttaaaaatggggattttgatactgttgaagaagaaattcgtcaaatcaaggctgcatgtcaagaccatatcttaaaagttatcgttgagacatgtcaattaactaaagaagaacttatcgaactttgtggggttgtcacacgttcaggtgcagactttattaaaacctctactggtttttcgacagcaggtgctacatttgaagatgttgaagtgatggcaaaatatgtcggcgaaggtgttaaaattaaggcagcaggtggaatctcatcattggaagatgctgaaaaatttattgctttaggagcttcacgcttgggtactagccgtatcatcaagattgttaagaaccaaaaagttgaagaaggcacttat

SEQ ID NO: 6248 - protein, 223 aa, Streptococcus agalactiae
MEVKDILKTVDHTLLATTATWPEIQTILDDAMAYETASACIPASYVKKAAEYVSGKLAICTVIGFPNGYSTTAAKVFECQDAIKNGADEIDMVINLTDVKNGDFDTVEEEIRQIKAACQDHILKVIVETCQLTKEELIELCGVVTRSGADFIKTSTGFSTAGATFEDVEVMAKYVGEGVKIKAAGGISSLEDAEKFIALGASRLGTSRIIKIVKNQKVEEGTY

SEQ ID NO: 6249 - DNA, 669 bp, Streptococcus pyogenes
gtggaagtaaaagatattttaaaaacggtagaccatactttgctagcaacaacagcaacgtggccagaaatccaaacaattttagatgatgccatggcttatgaaacagcttcagcatgtattccagcttcttacgtcaaaaaagcagcagaatacgtttcaggtaaattagctatttgtactgttattgggttcccaaatggctatagtacaactgcggcgaaggtttttgaatgtcaagatgctattcaaaatggtgctgatgaaattgacatggtcattaatttgacagacgttaaaaatggggattttgatactgttgaagaagaaattcgtcaaatcaaagctaaatgtcaagaccatatcttaaaagttatcgttgagacatgtcaattaactaaagaagaacttatcgaactttgtggagttgtcacacgttcaggtgcagactttattaaaacctctactggtttttcgacagcaggtgctacatttgaagatgttgaagtgatggcaaaatatgtcggcgaaggtgttaaaattaaggcagcaggtggaatctcatcattggaagatgctaaaacatttattgctttaggagcttcacgcttgggtactagccgtatcatcaagattgttaagaacgaagctacaaaaaccgatagctat

SEQ ID NO: 6250 - protein, 223 aa, Streptococcus pyogenes
VEVKDILKTVDHTLLATTATWPEIQTILDDAMAYETASACIPASYVKKAAEYVSGKLAICTVIGFPNGYSTTAAKVFECQDAIQNGADEIDMVINLTDVKNGDFDTVEEEIRQIKAKCQDHILKVIVETCQLTKEELIELCGVVTRSGADFIKTSTGFSTAGATFEDVEVMAKYVGEGVKIKAAGGISSLEDAKTFIALGASRLGTSRIIKIVKNEATKTDSY

SEQ ID NO: 6251 - DNA, 1209 bp, Streptococcus agalactiae
atgtcacaatttgatcgcattcacttagttgtcttagattcagtgggtattggagcggcaccagatgccaatgattttgtcaatgcaggagttcctgatggtgcttcagacacgcttggccacatttcaaaaacagttggacttgcggtgccaaacatggctaaaattggacttggtaatattcctcgtccccaagcgcttaagaccgtccctgcagaagaaaatccaagtggctacgcgacgaagttacaagaagtatcacttggtaaagatacaatgacagggcattgggagatcatgggcttaaatattacagagccatttgatactttctggaatggttttccagaagatattatcacaaagattgaggatttttcaggacgtaaagttattcgtgaagcgaataaaccttattcagggacagctgttattgatgactttggaccacgccaaatggaaactggtgagctcattatctatacctcagctgacccagtcctacaaattgcagctcatgaggatatcatccctctagaagaactctaccggatttgtgaatatgctcgtagtatcacaatggagcgtccagctctccttggtcgtattatcgctcgtccatatgtaggtgaaccaggtaactttacgcgtacagccaaccgtcacgactatgcagtatcaccatttgaagataccgtattaaataaactagatcaagctggcatcgatacttatgctgttggtaaaatcaatgatattttcaatggttcaggcattaatcatgatatgggacataacaaatcaaatagtcatggtattgatactttgataaaaacaatggggttatcagagtttgaaaaaggcttctcctttactaatttggttgactttgatgctctctatggtcaccgtcgtgatcctcatggttatcgtgattgtcttcatgagtttgatgagcgtcttccagagatcatttcagcaatgcgtgacaaagacttacttttgatcactgccgatcatggtaatgacccaacttatgcaggtacagaccatacaagagaatacattcctctcttagcctatagcccatccttcacaggaaacggacttatcccagtagggcatttcgcagatatttcagcaacagttgcggataactttggtgttgatactgcgatgattggagaaagcttcttgcaggacttagta

SEQ ID NO: 6252 - protein, 403 aa, Streptococcus agalactiae; identical to SEQ ID NO: 2738

SEQ ID NO: 6253 - DNA, 1638 bp, Streptococcus agalactiae
atgtttgatttttttaagaaaaaagttgttaaagtgtgcttagttatttttggtatagttttagtatcacttctgagtctaggattcttttatttttcaaagggacaagtacttagtcgttttgtagcagcacgttctcgtacgtcaggtcaagcgtttgataatattaaagaatacatggtttggtcagatacgggagaatctatcacaaatgatgaggccaattacgctaattttgagcccttgtctaaaagtgaggcgcgtaaattagggcaggaaataaaagaaggaaacaaaaatgattcaatgtatctaaagcgtgtaggtagtcgcttaggtatattccctgattatcgtattgctaataagcctatgtctttgaccttgaaaaccaatgttcctaaattggatgttttgttgaatcaaaaaaaggtcgcgacaagcaattcagatcatttttcagtaacggtggaacgtttacctagaacccattatactgctagccttgaagggactagtgacggaaaagagattaaactcaaaaaagattatgatggtaaaaaccaaactattgatttatcggtcgcttttaaatcttttacagtaacaagtaatcttatggatggtaatctttattttggtgataatcgtattgctaaattaaaagatggtagccattccgtagagaattatccagtgactgatggttcaaaagcttatatcaaaaaagtttttaatgatggtgagataacctctcataaacaaaaattaatctctatcgctgataatcagacaatcaaattagatgttgatggtttattaaatgaaaaagaagctggacagaaattgataactgctttcaatcaattgatactttatgtatcaactgggcaagaccctcagactttaggaacagtttttgaaaaaggtgccgaaaatgatttttacaaaggattgaaagaaagtattaaagcaaaatttgtaactgataatcgtaaagcgagccatttcactattcctaatattgtccttaataaaatgacacaggttgggaaagaaagttatcaagttaattttgctgccgattatgattttaattatgataaatcaacagatcctgataagaaaacatatggccacattattcagaatttaactggtaattttattatgaaaaaatcgggaaatagttaccttatttctaatgatggtaaaaaagatatcacagtagctaaggaaactaataaagttaaggctgatcccgtttccatttttccagagaaccttgtaggaagttggaaaggtgaagttgaggacggtacagtaacgatgacttttgataaggatggtaaagttactcagaaaaaagtttacaaggatagtaaatctaaggaaagtaaccattctgctaaagttacgaagttggaggataagggaaatgggctctacctttatcaatatgaatcaggtactgatactacaacttttgtaacaggaggtatcggtggtcttaaagttaaatacgcctatggaataaaaattgaagggaataagatcatcccagtgatctggcagacatctagtgatggagaatttgattaccataaaccactactcagtaagccattaactaagcaa

SEQ ID NO: 6254 - protein, 546 aa, Streptococcus agalactiae
MFDFFKKKVVKVCLVIFGIVLVSLLSLGFFYFSKGQVLSRFVAARSRTSGQAFDNIKEYMVWSDTGESITNDEANYANFEPLSKSEARKLGQEIKEGNKNDSMYLKRVGSRLGIFPDYRIANKPMSLTLKTNVPKLDVLLNQKKVATSNSDHFSVTVERLPRTHYTASLEGTSDGKEIKLKKDYDGKNQTIDLSVAFKSFTVTSNLMDGNLYFGDNRIAKLKDGSHSVENYPVTDGSKAYIKKVFNDGEITSHKQKLISIADNQTIKLDVDGLLNEKEAGQKLITAFNQLILYVSTGQDPQTLGTVFEKGAENDFYKGLKESIKAKFVTDNRKASHFTIPNIVLNKMTQVGKESYQVNFAADYDFNYDKSTDPDKKTYGHIIQNLTGNFIMKKSGNSYLISNDGKKDITVAKETNKVKADPVSIFPENLVGSWKGEVEDGTVTMTFDKDGKVTQKKVYKDSKSKESNHSAKVTKLEDKGNGLYLYQYESGTDTTTFVTGGIGGLKVKYAYGIKIEGNKIIPVIWQTSSDGEFDYHKPLLSKPLTKQ

SEQ ID NO: 6255 - DNA, 1722 bp, Streptococcus pyogenes
gtgaactatctaggtttcttcgaaaatccattagccatttatgatataatagtaaagaaaaacatagaaagttggggtctgttgatgaccaaaccatttcatcataagaaactaaaacaaataactataatagctgcaactagcctttttttattcctgatcggtggtgccttttactactctaaaaatcattgtattaatgcctatcttaaagctcgatcggcccaatcaggaccagtttttgagaatatcaaagcatatctagtctgggatgatactaatgagcagatcacaaatgacgaggcgatgtatactaagtttagaaggtatagtcagaaagaattgaggcaaaaaaagcaggatttaaaagccgctagtcaagatagtgccgttcaagtaaagtctgttggtcgtcgtttttggatttttcctgattatcggattgccataaaacccatggatttaacgataaaaacgaatgtgcctcaagcagacgttcttttaaatcaaaaaaaagttgctgtttctgattcagaacagttctcagtcaagcttgatcggctaccaacggcagaatataccgcaagtatcagaggcaaacacaacgggcgaaacattaaagtcaacaaatcatatgatggtgataatcccgtgctagatttgagtgtgtcttttagaacttttttggtaacaagcaatgctaagcaaggagatctttacttcgatgataaccatattggcacattaaaagatggtcaattacaagtagaagattaccctgttacagaaaacgcacaagcttatatgaaaacaacattcccagatggtgagttaagatcacaaaaatatgctctagctgatgttgaagaaggagcaaccctggagattttagttacagatcttttagaagaggacaaggcaggggagctattagtatcagcttttgatcagctgatgcactacctcagtacaggtcaagactcatctaacttacgtagcgtctttgaggcagggtctagcaacgcattttataggggattgaaagagtccataaaagcgaaatttcagacagatacaagaaaagccagccgtctcaatattccatctatccttttgacaacaatgactcaagtgggtaaaacaacttacgtgcttgatttcacagctacctacgaatttttgtatgacaagtcaacagatcctgagcagcatacctctggacatattaatcaagacttgactggaaaagtgactgtaaaaaaagttggacagcattaccttatcagccagtccggctccaaaaatattactgttgttaaagaggacaatcaactcaaagcgccatctgtctttcctgagtctattttgggaacgtggacaggccaagccaatggtttgagcatccatatgtctctagcatcagatggaacaattacgactaaagttgaagatcaaaaaggcaaccgttctaaagaaactcggacagctaaaattagtaaagttgaagacaaaggcaatggtttttatctttatacgccagatcctggaagtgacataagcgccttagttccagaaggaggattggggggtgcaaatgtcaaatatgcttatggtttcaaaatatctggtaaaacagcctctccagtggtgtggcaggcagcattaacacatgaatttgattataccaagccactttcgggagtaactttgcaaaagcaacca

SEQ ID NO: 6256 - protein, 574 aa, Streptococcus pyogenes
VNYLGFFENPLAIYDIIVKKNIESWGLLMTKPFHHKKLKQITIIAATSLFLFLIGGAFYYSKNHCINAYLKARSAQSGPVFENIKAYLVWDDTNEQITNDEAMYTKFRRYSQKELRQKKQDLKAASQDSAVQVKSVGRRFWIFPDYRIAIKPMDLTIKTNVPQADVLLNQKKVAVSDSEQFSVKLDRLPTAEYTASIRGKHNGRNIKVNKSYDGDNPVLDLSVSFRTFLVTSNAKQGDLYFDDNHIGTLKDGQLQVEDYPVTENAQAYMKTTFPDGELRSQKYALADVEEGATLEILVTDLLEEDKAGELLVSAFDQLMHYLSTGQDSSNLRSVFEAGSSNAFYRGLKESIKAKFQTDTRKASRLNIPSILLTTMTQVGKTTYVLDFTATYEFLYDKSTDPEQHTSGHINQDLTGKVTVKKVGQHYLISQSGSKNITVVKEDNQLKAPSVFPESILGTWTGQANGLSIHMSLASDGTITTKVEDQKGNRSKETRTAKISKVEDKGNGFYLYTPDPGSDISALVPEGGLGGANVKYAYGFKISGKTASPVVWQAALTHEFDYTKPLSGVTLQKQP

SEQ ID NO: 6257 - DNA, 1026 bp, Streptococcus agalactiae
ttgctagtttcttctctagtttcttgttcattttttcttgtcatttcgtcgttgtcttcatcaacacgaaataagtctataaacttatcaaataatttcatagacttattatatcaattttcaataaaatgctataataaaaccatgtcattttcattaaaaattagaaatccatacggtgaacataccgttaaagaactccttgaagattattttttgattccacgtaagattagacattttttgcgtgttaaaaaacatgtacttataaacaatgaatttattaattggcaaactgtcgtccaagaaaacgatactattaccttaatctttgatgatgaggattaccctactaaaaaaattcctctgggcagagcagagcttattgattgtctttatgaggatgaacatcttattatcgttaataaacctgaaggtatgaaaactcacggtaaccaaccaaatgaaatagcactgttaaatcatgtatctgcctattctggacaaacatgctatgttgttcatcgcctagatatggagaccagtggagctgttttatttgctaaaaatccatttatacttccccttatcaatcaacgcttagaacgaaaagaaatttggcgtgaatattgggctttagttgaaggaaaattttcacctaagcatcaagttttgagagacaaaattggacggaaccgtcatgacagacgtaaacgaatcattgattctaaaaacggtcaacatgctatgacaatcattgacgttttgaagtatatccaaaatagtagtctcataaaatgccgactggaaaccggaagaacccatcaaattcgcgttcacttatctcatcatggacatcccttaataggagaccccctctacaacccttcttctaataatgaaaggttaatgctacacgctcaccgattgactctatctcatccattaacttgcgaaactattagcgtagaggccccttcatctactttcgagaagattttaaacaattataaaaaaggagttgga

SEQ ID NO: 6258 - protein, 342 aa, Streptococcus agalactiae
MLVSSLVSCSFFLVISSLSSSTRNKSINLSNNFIDLLYQFSIKCYNKTMSFSLKIRNPYGEHTVKELLEDYFLIPRKIRHFLRVKKHVLINNEFINWQTVVQENDTITLIFDDEDYPTKKIPLGRAELIDCLYEDEHLIIVNKPEGMKTHGNQPNEIALLNHVSAYSGQTCYVVHRLDMETSGAVLFAKNPFILPLINQRLERKEIWREYWALVEGKFSPKHQVLRDKIGRNRHDRRKRIIDSKNGQHAMTIIDVLKYIQNSSLIKCRLETGRTHQIRVHLSHHGHPLIGDPLYNPSSNNERLMLHAHRLTLSHPLTCETISVEAPSSTFEKILNNYKKGVG

SEQ ID NO: 6259 - DNA, 846 bp, Streptococcus pyogenes
ttgacggtcaaagcattattagaggaacaattgttaattccccgtaaaattaggcattttctgagaactaaaaaacatgttcttattaatggtcattctgttaactggcaaagttgtgttaaatacggtgatcaggtcaaacttttttttgatcacgaagattatcctgaaaagattatcgtgatggggcaggccgaaaaagtaacctgcctttatgaagatgagcacatcattattgttaacaaacctgaagggatgaaaacacacggcaatgatccaacagagttggcgctgctcaaccacgtgtctgcttacacgggacagacctgctatgtggttcatcgtctggataaggaaacaagtggggccattttatttgctaaaacaccttttatcttaccaatccttaatcgtcttttagaaaaacgagatatccatcgagaatatttggcactagttcacggatccttagacagtcctagggtaacttaccatcatccaattggtcgtcatcgacatgaccgcagaaaacgtgttgtcgatccgataaatggcaagaaagctattactgaggtaactctagtcaaaaacttccacaaaacggcaagcttactcacttgtcaattacaaactggacggactcatcaaattcgagtccatttagcccatcaaggtcatgttttatttggtgatcctttgtattccaatggaaaaaaagattgtgctcgactgatgctccatgcttatcaattacgtttgaaacaccctctaacccaagaagacatttgcgtgcaagctaaatcagctacatttgacgcagtcttaaacgctcaaaaggctaggaaa

SEQ ID NO: 6260 - protein, 282 aa, Streptococcus pyogenes
LTVKALLEEQLLIPRKIRHFLRTKKHVLINGHSVNWQSCVKYGDQVKLFFDHEDYPEKIIVMGQAEKVTCLYEDEHIIIVNKPEGMKTHGNDPTELALLNHVSAYTGQTCYVVHRLDKETSGAILFAKTPFILPILNRLLEKRDIHREYLALVHGSLDSPRVTYHHPIGRHRHDRRKRVVDPINGKKAITEVTLVKNFHKTASLLTCQLQTGRTHQIRVHLAHQGHVLFGDPLYSNGKKDCARLMLHAYQLRLKHPLTQEDICVQAKSATFDAVLNAQKARK

SEQ ID NO: 6261 - DNA, 2319 bp, Streptococcus agalactiae
atgaaattatttgataagtttatagacttatttcgtgttgatgaagacaacgacgaaatgacaagaaaaaatgaacaagaaactagagaagaaactagcaatttggatggcgaagaagtctatgatattgatgatattacccgacctagtaaatcccagtatcagcgaggcattcgtcaccaaaaggaaaatgctaaatctcgacctgaatggctacaaaaagttgatcgttacctcccttctcctaaaaatcctatccgtcgtttttggcggcgctatcgtattgggaagttgctttttatcgccttaatggcttttattcttatatttggtagctatcttttttatctttctaaaactgctacagttagtgatttacagagtgctctaaaaacaaccaccaccatttatgataagaataaagaatatgctggaaaactttcgggacaaaagggaacttatgtagagttaaatgctatttctgatcatctcaaaaatgctgttatagcaactgaagatagaactttttatgaaaataatggtgtaaactttaagcgattttttttggcagtagctacacttgggaaatttggcggaggctcaactattacccagcaattagcaaaaaatgcttacttgtcacaggaccaaacgattaaacgcaaggcgcgtgaattctttttagcgctagaattgactaagaaatatagcaaggctgagattctgaccatgtatcttaataactcttattttggtaatggtgtttggggtgtggaagatgctagtaggaaatattttggaaccagtgctgctaatttgacagtagatgaggctgctacacttgctggaatgcttaaaggaccagaagtttataatccttattattctgttgaaaatgcaactaaccgaagagatactgttttggcagcgatggttgatgcaggtaaactaaccaagtctcaagctaaagaagctgcttcaattggtatgaaaaatagattagcagatacctatgctggtaaaattaatgattacaggtacccatcctattttgatgctgttgtcaatgaagccattgatacttatggtatttcagaaaaagatattgtcaataatggctataagatttacactgcattagatcaaaattatcaatcaggaatgcaaaaaacatttgatgatactagcctcttccctgtatctgactatgatggtcaatctgcccaaggtgctagcgtagctttagatccaaaaactggtggtgtaagaggtttagttggacgtgttcaaagtactaaagatgcacagtttagaagttttaactacgcgactcaatcaaagagaagtccagcctcaaccataaaacctttagttgtttattcaccagctattgcttcaggatggtcaatagataaagaacttcctaataaagttcaagattttcatggttataaaccaagtaactatggtgggattgagactgaaagtatcccgatgtatcaagcactagctaattcttataatattcctgctgtttatactttagacaaactaggaatcaataaagcctttacttatggcaggaagtttggtctaaatatgtcatcagcaaacaaagagctaggagtggcgctaggtggaagtgtaaccactaatcctttagaaatggcacaagcttactcaacttttgcaaatgacggtataatgcatcgcgctcatttgattactcgaattgagacagctaatggaaaattagtaaagcaatttacagataagcctaagcgagttattagtcgctcagtggctagtaaaatgactagtatgatgttaggaacattctcaaatggtacagctattaatgccaatgtttatggttatacaatggcaggtaaaactggaacaaccgaaacagattttaaccccaatttatctggagaccagtgggtagtcggctatacgcctgatgtcgttattagtcaatgggttggctttaagaacacagataaacaccattatttgacagattctagtgcaggtacagcttcaaatatatttagcacgcaagcttcatatatactaccgtatactaaggggtctagttttactcatattgagaatgcttatttccaaaacggtattggttcagtttataatgcacaagatgctagtaatacaacgaaccaagaatcacgctcaattattaatgatttaaaagattcggcaagtaaggctgcacaagatatttctagagcggtggaagattcaaatttccaagagaaggtaaaagatgcttggaatagtctaaaggactactttaga

SEQ ID NO: 6262 - protein, 773 aa, Streptococcus agalactiae
MKLFDKFIDLFRVDEDNDEMTRKNEQETREETSNLDGEEVYDIDDITRPSKSQYQRGIRHQKENAKSRPEWLQKVDRYLPSPKNPIRRFWRRYRIGKLLFIALMAFILIFGSYLFYLSKTATVSDLQSALKTTTTIYDKNKEYAGKLSGQKGTYVELNAISDHLKNAVIATEDRTFYENNGVNFKRFFLAVATLGKFGGGSTITQQLAKNAYLSQDQTIKRKAREFFLALELTKKYSKAEILTMYLNNSYFGNGVWGVEDASRKYFGTSAANLTVDEAATLAGMLKGPEVYNPYYSVENATNRRDTVLAAMVDAGKLTKSQAKEAASIGMKNRLADTYAGKINDYRYPSYFDAVVNEAIDTYGISEKDIVNNGYKIYTALDQNYQSGMQKTFDDTSLFPVSDYDGQSAQGASVALDPKTGGVRGLVGRVQSTKDAQFRSFNYATQSKRSPASTIKPLVVYSPAIASGWSIDKELPNKVQDFHGYKPSNYGGIETESIPMYQALANSYNIPAVYTLDKLGINKAFTYGRKFGLNMSSANKELGVALGGSVTTNPLEMAQAYSTFANDGIMHRAHLITRIETANGKLVKQFTDKPKRVISRSVASKMTSMMLGTFSNGTAINANVYGYTMAGKTGTTETDFNPNLSGDQWVVGYTPDVVISQWVGFKNTDKHHYLTDSSAGTASNIFSTQASYILPYTKGSSFTHIENAYFQNGIGSVYNAQDASNTTNQESRSIINDLKDSASKAAQDISRAVEDSNFQEKVKDAWNSLKDYFR

SEQ ID NO: 6263 - DNA, 2334 bp, Streptococcus pyogenes
atgagatttctagaacttttacaaaagaaattttttcctaaagcatatcaggaaaaacaattcttaatgcatcaaaaaacgcgtttaacgccacaacacaatcaaaagcagtattcgccaaatgccaatcatttggactcatcagctaccaaaaactcagaacaagaccctgcaacagctctgcaacgcagtagagcctacgaaggaagccctaaaagtcggcccgcttggttgcaaaagctggaagctgttttgccgtctcctcaacgtccaattcggcgtttttggcgccgctatcacatcggaaaactgctaatgattctgattggaactcttgtcttactcttaggatcatacttgttttacttatcaaaaacagctaaagtatctgatttacaagatgccttgaaggctacaacggttatttatgatcacaaaggagagtatgcaggcagtttatctggtcaaaaagggagttatgttgagctcaacgctatttcagatgatcttgagaatgctgttattgccactgaggataggactttttacagtaatagcggtattaatcttaaacgcttcttattggcggtagttacggcgggccgctttggaggtggctcaacgattacacagcaactggctaaaaatgcttatctctcacaagatcagacaattaaacgaaaggcccgagagttttttttggcgttagagttgaccaaaaaatacagtaaaaaagatattcttactatgtaccttaacaactcctactttggaaatggagtttggggagttgaagatgccagtcaaaaatattttggaaccacagctgctaacttaacactggatgaagctgccacattagcaggtatgctcaaaggacctgaaatatataacccttaccattctctaaaaaatgctactcaccgtagagatactgttttaggagcgatggttgatgccaaaaagattacccaaacaaaagctcagcaagctagagcagtagggctaaaaaatcgcttagctgatacttatgttggtaagacagatgactacaaatacccatcctactttgatgctgttattagtgaagcaatagcaacttatggtctttcagaaaaagacattgttaataatggatacaaagtttacactgagctagatcaaaattaccaaactggcatgcagacgacttttaacaacgatgaactatttcctgtttcagcttatgacggtagctctgctcaagcagctagtgttgctttagatcctaaaacaggaggtgttagaggtctgattggtcgtgtgaatagtagtgaaaatccgactttcagaagttttaactatgcgactcaagcaaaacgtagtcccgcatcaacaatcaaaccactcgtggtttacgcgccagccgttgcttcaggatggtcaattgaaaaagaactaccaaataccgttcaagatttcgatggctatcagccacataattatggaaattatgaatcagaagatgttcctatgtatcaagcattagcaaactcttataatattccagcagtttctacattgaacgatatcggaatcgataaagcctttacctatggtaaaacatttgggttagatatgagctctgccaaaaaagagttgggggtagctttaggtggcagcgtgacaaccaatccattggagatggctcaggcatatgctgcctttgccaataatggagtaatccatcctgcgcacttgattaaccggattgaaaatgccaggggtgaagtgcttaaaacctttactgataaggctaaacgtgttgtcagccagtctgttgcagataagatgacagccatgatgctaggtaccttttcaaatggaacagcagtcaatgctaacgtatatggctatacactagctggtaaaacagggacgacagaaaccaacttcaatcccgacttagcaggcgatcagtgggttattggttatacgccagatgttgttattagtcaatgggtaggatttaatcagaccgatgaaaatcattatctaacggattcaagtgcaggcacggcctcagctatttttagcactcaggcatcttacattttgccttataccaagggcagccaatttcatgtagataatgcctacgctcaaaatggtatttcagctgtttatggagtcaatgaaacaggtaatcaatcaggagttgatactcaatctattattgatggtttaagaaaatcagcacaagaagcttcgcaatcactatcaaaagcagtcgatcagtcagggttacgtgataaagcccaatctatttggaaagagattgttgactattttaga

SEQ ID NO: 6264 - protein, 778 aa, Streptococcus pyogenes
MRFLELLQKKFFPKAYQEKQFLMHQKTRLTPQHNQKQYSPNANHLDSSATKNSEQDPATALQRSRAYEGSPKSRPAWLQKLEAVLPSPQRPIRRFWRRYHIGKLLMILIGTLVLLLGSYLFYLSKTAKVSDLQDALKATTVIYDHKGEYAGSLSGQKGSYVELNAISDDLENAVIATEDRTFYSNSGINLKRFLLAVVTAGRFGGGSTITQQLAKNAYLSQDQTIKRKAREFFLALELTKKYSKKDILTMYLNNSYFGNGVWGVEDASQKYFGTTAANLTLDEAATLAGMLKGPEIYNPYHSLKNATHRRDTVLGAMVDAKKITQTKAQQARAVGLKNRLADTYVGKTDDYKYPSYFDAVISEAIATYGLSEKDIVNNGYKVYTELDQNYQTGMQTTFNNDELFPVSAYDGSSAQAASVALDPKTGGVRGLIGRVNSSENPTFRSFNYATQAKRSPASTIKPLVVYAPAVASGWSIEKELPNTVQDFDGYQPHNYGNYESEDVPMYQALANSYNIPAVSTLNDIGIDKAFTYGKTFGLDMSSAKKELGVALGGSVTTNPLEMAQAYAAFANNGVIHPAHLINRIENARGEVLKTFTDKAKRVVSQSVADKMTAMMLGTFSNGTAVNANVYGYTLAGKTGTTETNFNPDLAGDQWVIGYTPDVVISQWVGFNQTDENHYLTDSSAGTASAIFSTQASYILPYTKGSQFHVDNAYAQNGISAVYGVNETGNQSGVDTQSIIDGLRKSAQEASQSLSKAVDQSGLRDKAQSIWKEIVDYFR

SEQ ID NO: 6265 - DNA, 1890 bp, Streptococcus agalactiae
atgaataataacgaaaaaaaagtaaaatactttttaagaaaaacagcttatggtttggcctcaatgtcagcagcgtttgctgtatgtagtggtattgtacacgcggatactagttcaggaatatcggcttcaattcctcataagaaacaagttaatttaggggcggttactctgaagaatttgatttctaaatatcgtggtaatgacaaagctattgctatacttttaagtagagtaaatgattttaatagagcatcacaggatacacttccacaattaattaatagtactgaagcagaaattagaaatattttatatcaaggacaaattggtaagcaaaataaaccaagtgtaactacacatgctaaagttagtgatcaagaactaggtaagcagtcaagacgttctcaagatatcattaagtcattaggtttcctttcatcagaccaaaaagatattttagttaaatctattagctcttcaaaagattcgcaacttattcttaaatttgtaactcaagccacgcaactgaataatgctgaatcaacaaaagctaagcaaatggctcaaaatgacgtggccttaataaaaaatataagccccgaagtcttagaagaatataaagaaaaaattcaaagagctagcactaagagtcaagttgatgagtttgtagcagaagctaaaaaagttgttaattccaataaagaaacgttggtaaatcaggccaatggtaaaaagcaagaaattgctaagttagaaaatttatctaacgatgaaatgttgagatataatactgcaattgataatgtagtgaaacagtataatgaaggtaagctcaatattactgctgcaatgaatgctttaaatagtattaagcaagcagcacaggaagttgcccagaaaaacttacaaaagcagtatgctaaaaaaattgaaagaataagttcaaaaggattagcgttatctaaaaaggctaaagaaatttatgaaaagcataaaagtattttgcctacacctggatattatgcagactctgtgggaacttatttgaataggtttagagataaacaaactttcggaaataggagtgtttggactggtcaaagtggacttgatgaagcaaaaaaaatgcttgatgaagtcaaaaagcttttaaaagaacttcaagaccttaccagaggtactaaagaagataaaaaaccagacgttaagccagaagccaaaccagaggccaaaccagacgttaagccagaggccaaaccagacgttaagccagaagctaagccagacgttaaaccagaagctaagccagacgttaaaccagaagctaagccagacgttaaaccagaagctaagccagacgttaaaccaaaggccaaaccagacgttaagccagaagctaagccagacgttaaaccagacgttaaaccagacgttaagccagaggccaaaccagaggataagccagacgttaaaccagacgttaagccagaagctaaaccagacgttaagccagaggccaaaccagaagctaagccagaagctaagccagaagctaagccagaggccaaaccagaagctaagccagacgttaagccagaagctaaaccagacgttaaaccagaggctaagccagaagctaaaccagaggctaagtcagaagctaaaccagaggctaagctagaagctaaaccagaggccaaaccagcaaccaaaaaatcggttaatactagcggaaacttggcggctaaaaaagctattgaaaacaaaaagtatagtaaaaaattaccatcaacgggtgaagccgcaagtccactcttagcaattgtatcactaattgttatgttaagtgcaggtcttattacgatagttttaaagcataaaaaaaat

SEQ ID NO: 6266 - protein, 630 aa, Streptococcus agalactiae
MNNNEKKVKYFLRKTAYGLASMSAAFAVCSGIVHADTSSGISASIPHKKQVNLGAVTLKNLISKYRGNDKAIAILLSRVNDFNRASQDTLPQLINSTEAEIRNILYQGQIGKQNKPSVTTHAKVSDQELGKQSRRSQDIIKSLGFLSSDQKDILVKSISSSKDSQLILKFVTQATQLNNAESTKAKQMAQNDVALIKNISPEVLEEYKEKIQRASTKSQVDEFVAEAKKVVNSNKETLVNQANGKKQEIAKLENLSNDEMLRYNTAIDNVVKQYNEGKLNITAAMNALNSIKQAAQEVAQKNLQKQYAKKIERISSKGLALSKKAKEIYEKHKSILPTPGYYADSVGTYLNRFRDKQTFGNRSVWTGQSGLDEAKKMLDEVKKLLKELQDLTRGTKEDKKPDVKPEAKPEAKPDVKPEAKPDVKPEAKPDVKPEAKPDVKPEAKPDVKPEAKPDVKPKAKPDVKPEAKPDVKPDVKPDVKPEAKPEDKPDVKPDVKPEAKPDVKPEAKPEAKPEAKPEAKPEAKPEAKPDVKPEAKPDVKPEAKPEAKPEAKSEAKPEAKLEAKPEAKPATKKSVNTSGNLAAKKAIENKKYSKKLPSTGEAASPLLAIVSLIVMLSAGLITIVLKHKKN

SEQ ID NO: 6267 - DNA, 537 bp, Streptococcus agalactiae
atgttagattcttttgataagggttggtttgtactccaaacctactcaggttatgaaaataaagtaaaggaaaatctcttgcaacgtgcgcaaacttataatatgttagacaacattttgcgtgtggaaatccctactcaaactgtaaatgttgagaaaaatgggaaaacaaaagaaattgaagaaaatcgcttcccgggttatgtacttgtggaaatggtaatgactgatgaagcctggtttgttgttcgtaatactccaaacgttactggatttgttggatcacacggcaatcgctctaaaccaacaccgttgttagaagaagagattcgttcaatactcatctcaatgggacaaaccgttgatgtctttgatactaatatcaaggaaggtgatgttgttcaaatcattgatggtgctttcatcggacaagaaggacgtgtagttgagattgagaataacaaagttaaattaatgatcaacatgttcggctcagaaacacaagcagaacttgagttgtaccaagttgcagaatta

SEQ ID NO: 6268 - protein, 179 aa, Streptococcus agalactiae
MLDSFDKGWFVLQTYSGYENKVKENLLQRAQTYNMLDNILRVEIPTQTVNVEKNGKTKEIEENRFPGYVLVEMVMTDEAWFVVRNTPNVTGFVGSHGNRSKPTPLLEEEIRSILISMGQTVDVFDTNIKEGDVVQIIDGAFIGQEGRVVEIENNKVKLMINMFGSETQAELELYQVAEL

SEQ ID NO: 6269 - DNA, 552 bp, Streptococcus pyogenes
atgaaaggaaacatcatgctagattcatttgataagggctggttcgtcctccaaacttactcaggctacgaaaacaaagtaaaagaaaacctcttgcaacgtgcccaaacctataacatgttggacaatattttgcgcgtcgaaattccgacacaaacggttaacgttgaaaaaaatgggcaaaccaaagaaatcgaagaaaatcgctttccagggtatgtcttggttgaaatggtcatgacagatgaagcttggtttgttgtgcgtaacacaccaaacgttacaggttttgtgggatcacacgggaaccgatcaaaaccaacaccacttcttgaagaagaaatccgtgctatcttgttgtctatgggtcaaaccattgatgtctttgataccaatatcaaagaaggcgatgtggttcagatcatagacggtgcctttatgggacaagaaggccgtgtggtagaaatcgaaaacaacaaagtgaaactgatgctcaacatgtttggctctgaaacagtagcagaagttgaactttatcaaattgcagaacta

SEQ ID NO: 6270 - protein, 184 aa, Streptococcus pyogenes
MKGNIMLDSFDKGWFVLQTYSGYENKVKENLLQRAQTYNMLDNILRVEIPTQTVNVEKNGQTKEIEENRFPGYVLVEMVMTDEAWFVVRNTPNVTGFVGSHGNRSKPTPLLEEEIRAILLSMGQTIDVFDTNIKEGDVVQIIDGAFMGQEGRVVEIENNKVKLMLNMFGSETVAEVELYQIAEL

SEQ ID NO: 6271 - DNA, 1203 bp, Streptococcus agalactiae
atggaaaaagcagttgcacttgcagttgattcaaactacttggataaagccttagtaacaataaagtctatttgtgtttataatagaaatataactttttatttattcaatcaagataccccagttgaatgggtacgtaatataaacaggaaactagagcctctaggatcaaaactgattaatgttaaaatatataactatgatattgctcatctaacgacttttctaactgttagtacatggtttagattatttttagcagattatatacctagttcacgtgtactttatttagattcagatattatcgttaacactaatcttgattacttatttgaactagattttaaaggttattacttagcagccgtcaaagatccccataaaaatgaagaaggagggtttaatgctggcatgcttttagctaatctagaactatggcgggaagatgggctcactaaaacattactaaaaacagctgaagaactccaccgagttgtcaaaacaggggatcaaagtatcttgaacattgtttgccataatcgttggttatctctgaacaaaacatggaactttcaaacttatgatgtcgttagccgctataatcatcgatcttatttatatctaaacatagaaaatagaactcctaatattatacattttttaactagtgacaaaccttggaatgaaaatagcgttgcaaggtttagagaactatggtggtattacttccaacttgatttttgccaattaaccggcaagcaaagaaaagtgatttcttacgaaaagtccatggaattgctttctgtttcagatattcatcttttcactcttacatcttccgataatttagaacacattgaatcgctaatttgtagatgtcctactgttcaattccatattggtgcctacacaacagtgtcaaataaacttagcaaactagaacaatatccaaatgtcctagtttaccctgaattaattgaggcaagaattgaaaaattaataacattagccactgcataccttgatattaatcatggtccagaagtaggtaatattttacaaagagttcatttgaaacaaaagccaatttattctttcaacaacacgtctcatcaagagaatataaccaaacatatcgttaatcataattctattgataatatggttgttttaattaacgaattaaacctaaatcaatta

SEQ ID NO: 6272 - protein, 401 aa, Streptococcus agalactiae
MEKAVALAVDSNYLDKALVTIKSICVYNRNITFYLFNQDTPVEWVRNINRKLEPLGSKLINVKIYNYDIAHLTTFLTVSTWFRLFLADYIPSSRVLYLDSDIIVNTNLDYLFELDFKGYYLAAVKDPHKNEEGGFNAGMLLANLELWREDGLTKTLLKTAEELHRVVKTGDQSILNIVCHNRWLSLNKTWNFQTYDVVSRYNHRSYLYLNIENRTPNIIHFLTSDKPWNENSVARFRELWWYYFQLDFCQLTGKQRKVISYEKSMELLSVSDIHLFTLTSSDNLEHIESLICRCPTVQFHIGAYTTVSNKLSKLEQYPNVLVYPELIEARIEKLITLATAYLDINHGPEVGNILQRVHLKQKPIYSFNNTSHQENITKHIVNHNSIDNMVVLINELNLNQL

SEQ ID NO: 6273 - DNA, 90 bp, Streptococcus agalactiae
ttgttaattaccattactccagcattaaacccatatccaagcccaaaaagagctggaactgcagctaaatatgcattgtctagtgaaatt

SEQ ID NO: 6274 - protein, 30 aa, Streptococcus agalactiae
MLITITPALNPYPSPKRAGTAAKYALSSEI

SEQ ID NO: 6275 - DNA, 1194 bp, Streptococcus agalactiae
atgacttatcaaaaaacagttgttttggctggtgattattcctacattagacaaattgaaaccacattaaaatctctctgtgtctatcatgagaatctctcaatttttatttttaatcaagatattcctcaagaatggtttttagctatgaaagatagggttggacaaactggaaatcaaattcaggatgtaaagctcttccatgatcacttatccccaaaatgggaaaataaaaagcttaatcatattaattatatgacctatgctcgttatttcatacctcagtacatctcagctgatacagttttatatcttgactctgacttagttgttactactaatttagataacctctttcaaatttcactagacaatgcatatttagctgcagttccagctctttttgggcttggatatgggtttaatgctggagtaatggtaattaacaaccaacgttggcgacaagaaaatatgactattaaattaattgaaaaaaatcaaaaggaaattgagaatgccaacgaaggggatcaaacaattcttaatcgcatgtttgaaaatcaggtaatttatttagatgatacctacaattttcaaattggttttgatatgggagctgctatcgatgggcataaatttatttttgacatcccaattaccccactcccaaaaattattcactacatttcgggaatcaaaccttggcaaacattatcaaatatgagactccgtgaggtatggtggcactataatttacttgaatggtcaagtatcatatctagtaaaaaagtatttggtttagaccacccaattaaaacacaaaattatcgtctcaatttccttattgttacaacttctgattgtataccatctatctcagaattagtcactgcccttccagattgtctatttcacattgcagcaccaacagttatgtctgacattcttataagcctattagcttttgaaaatatccgccttcataaaacttacactccacctattattgataaattattagcagaagctgatatttatcttgatattaatgtttttggaaaaatggagggcattctacagaaaatgtcacaatctgaaaaaccaattcttactacaagagaatgcaatagccagcttgttccagaaacagtttttgcatctatcgatgatttaattaattatcttcagtctata

SEQ ID NO: 6276 - protein, 398 aa, Streptococcus agalactiae
MTYQKTVVLAGDYSYIRQIETTLKSLCVYHENLSIFIFNQDIPQEWFLAMKDRVGQTGNQIQDVKLFHDHLSPKWENKKLNHINYMTYARYFIPQYISADTVLYLDSDLVVTTNLDNLFQISLDNAYLAAVPALFGLGYGFNAGVMVINNQRWRQENMTIKLIEKNQKEIENANEGDQTILNRMFENQVIYLDDTYNFQIGFDMGAAIDGHKFIFDIPITPLPKIIHYISGIKPWQTLSNMRLREVWWHYNLLEWSSIISSKKVFGLDHPIKTQNYRLNFLIVTTSDCIPSISELVTALPDCLFHIAAPTVMSDILISLLAFENIRLHKTYTPPIIDKLLAEADIYLDINVFGKMEGILQKMSQSEKPILTTRECNSQLVPETVFASIDDLINYLQSI

SEQ ID NO: 6277 - DNA, 210 bp, Streptococcus agalactiae
gtgaaatctttattaacaaaattccctgttcgaaaccatgaccttagactcatatatttagggtgggataaatactttttattgtatcgcaaagccctctctcgttgtctagatacaaaattaacaccaaacaatgcaccagcagagacagatacgataccatctatttttattcctgcatctagaaaagcatctaaaactccagcagta

SEQ ID NO: 6278 - protein, 70 aa, Streptococcus agalactiae
MKSLLTKFPVRNHDLRLIYLGWDKYFLLYRKALSRCLDTKLTPNNAPAETDTIPSIFIPASRKASKTPAV

SEQ ID NO: 6279 - DNA, 849 bp, Streptococcus agalactiae
ttgcctatgttgtctgttggtttagttttagagggtggcggaatgagaggtctttatactgctggagttttagatgcttttctagatgcaggaataaaaatagatggtatcgtatctgtctctgctggtgcattgtttggtgttaattttgtatctagacaacgagagagggctttgcgatacaataaaaagtatttatcccaccctaaatatatgagtctaaggtcatggtttcgaacagggaattttgttaataaagatttcacctattatgaagttcctatgaaattggatgtatttgacgatgaagcatttaaaaaatcaagtattgatttttacgtagttgctacagagatgacatctggtaaacctgaatattttaaaattgatagtgtttttgaacaaatggaaattttacgtgctagttcagcattaccagtagtctcaaagatggttgattggcaggggaaaaagtacttagatggtggtttatctgatagtattcccgttgattttgcccgtggtttaggatttgacaagttgattgttgtgatgactaggccgctcaattatcagaaaaagccttcaagtggacgattgtataaaactctgtataggaaatatcctaattttgtaaagacagcctcgaatcggtaccaacagtataataatagtcttgaaaaggtcatgagccttgaaaaaacaggcgatctatttgcaattagaccgagtaagagcttggttattggccgcttagagaagaatccggataaacttgatagtatttatcagcttggtatgaaagatgctaaaagtgtgatgcctgagctgaatagttatctaatgaaa

SEQ ID NO: 6280 - protein, 283 aa, Streptococcus agalactiae
MPMLSVGLVLEGGGMRGLYTAGVLDAFLDAGIKIDGIVSVSAGALFGVNFVSRQRERALRYNKKYLSHPKYMSLRSWFRTGNFVNKDFTYYEVPMKLDVFDDEAFKKSSIDFYVVATEMTSGKPEYFKIDSVFEQMEILRASSALPVVSKMVDWQGKKYLDGGLSDSIPVDFARGLGFDKLIVVMTRPLNYQKKPSSGRLYKTLYRKYPNFVKTASNRYQQYNNSLEKVMSLEKTGDLFAIRPSKSLVIGRLEKNPDKLDSIYQLGMKDAKSVMPELNSYLMK

SEQ ID NO: 6281 - DNA, 123 bp, Streptococcus agalactiae
atgccaaggcacattccaagaatggttgcaatcatccataatgatgaattcttgacagaaacgtttaagttggtttggataatagttggtaaccagttcatcatgccaaagtatccggcaatc

SEQ ID NO: 6282 - protein, 41 aa, Streptococcus agalactiae
MPRHIPRMVAIIHNDEFLTETFKLVWIIVGNQFIMPKYPAI

SEQ ID NO: 6283 - DNA, 1245 bp, Streptococcus agalactiae
atgtcaccattaaatatcaataagaataattggcgcgccctaatcgctgccattgtcgcatccggaaccgatgatttaaatatcatgttccttgcattttctatgtcaactatcattactgatcttcatttatctgcggcacaggctggttggattgggacaattaccaacttgggaatgctcgtgggaggactaatctttggtttattagctgatcgctacaataaatttaaagttttcaaatggacgattctaatcttttcaatcgcaactggtttagttttcttcactactaatttatcatatctctatatcatgcgcttcattgcaggaattggcgttggtggcgaatatggtatcgctattgccattatggcaggaattgtcccaactaataaaatgggccggatttcttcactaaatggtatcgctggtcaagttggatctattagctcagcactcttagcaggatggctagctccagcactcggttggcggggactttttctctttggccttctccctatagttctcgtcctatggatgcaatttgctgttgatgataaagatatcttagatcaatataatacagacgcagatgatgaacctctagatatcagtataaaagctttatttgatactcctgtattagccacacagagcctagcactaatggttatgacaactgttcagattgccggatactttggcatgatgaactggttaccaactattatccaaaccaacttaaacgtttctgtcaagaattcatcattatggatgattgcaaccattcttggaatgtgccttggcatgctagtatttggtcaattgttagataaatttggaccgcgtttagtatacgggtgtttccttctatcatctgcaatttgtgtctatctctttcaattcgcaacaacaatgccttctatgattataggcggggcagttgtcggattctttgttaatggtatgtttgcaggctatggtgccatgattacacgtctctatccacatcatattcgttcaacagctaacaatcttatcttaaatgttggtcgtgcaataggtggcttttcatctgttatcatcggaatgattctagacgtttcaaatgtctctatggtcatgcttttcttagcaagtctctatatcgttagttttttatcaatgctaagcattaagcaattaaaacgtcaaaaatatcacactaatttaacacaattagatgtcaaaccaactgac

SEQ ID NO: 6284 - protein, 415 aa, Streptococcus agalactiae
MSPLNINKNNWRALIAAIVASGTDDLNIMFLAFSMSTIITDLHLSAAQAGWIGTITNLGMLVGGLIFGLLADRYNKFKVFKWTILIFSIATGLVFFTTNLSYLYIMRFIAGIGVGGEYGIAIAIMAGIVPTNKMGRISSLNGIAGQVGSISSALLAGWLAPALGWRGLFLFGLLPIVLVLWMQFAVDDKDILDQYNTDADDEPLDISIKALFDTPVLATQSLALMVMTTVQIAGYFGMMNWLPTIIQTNLNVSVKNSSLWMIATILGMCLGMLVFGQLLDKFGPRLVYGCFLLSSAICVYLFQFATTMPSMIIGGAVVGFFVNGMFAGYGAMITRLYPHHIRSTANNLILNVGRAIGGFSSVIIGMILDVSNVSMVMLFLASLYIVSFLSMLSIKQLKRQKYHTNLTQLDVKPTD

SEQ ID NO: 6285 - DNA, 2517 bp, Streptococcus agalactiae
ttgacatggagaagtgcgatgacattctataatcacaaagaaatcgaacccaaatggcaagctttttgggcagataatcatacctttaaaacaggaacagacgcatcaaaacctaagttttatgccctagatatgttcccatacccatctggagctggtctccacgttggtcacccagaaggctatacagcaacggatattctcagccgtttcaaacgtgcccaaggtcacaatgtcctccacccaatgggttgggatgcttttggacttcctgctgagcagtacgctatggatactggtaatgacccagctgagtttacagctgaaaacatcgctaacttcaaacgccagattaatgctcttggtttctcatacgactgggatcgtgaagttaacacaactgaccctaactactacaagtggacacagtggatctttaccaagctttatgaaaaaggtctagcttacgaagctgaagttccagttaactgggttgaagaattgggaacagctatcgccaacgaagaggttcttccagatggtacatcagaacgtggtggctacccagttgtcagaaaaccaatgcgccaatggatgctcaaaatcactgcctatgcagagcgcttgctggaagacttggaagaagttgactggccagagtcaatcaaggacatgcaacgcaactggattggtaaatcaactggtgctaatgtaaccttcaaggttaaggatacagataaggacttcactgtctttacaacacgtcctgacaccctttttggtgcgacttacgcagttcttgctcctgagcatgccttggttgatgctattacaacagctgaccaagcagaagccgttgccgaatacaaacgtcaagcgagtctcaaatcagaccttgctcgtacagaccttgccaaagaaaaaactggtgtctggacaggtgcctatgccattaacccagttaatggtaaagaaattccagtttggattgcggactatgtccttgctagctacggtacaggtgctatcatggcagttccagctcacgatgaacgtgactgggaattcgcaaaacaattcaacctagacatcattccagttcttgaaggtgggaatgttgaagaggctgcctttacagaagacggtcttcacatcaactcagacttcctagatggtctcgacaaagcggcagctattgccaaaatggtcgagtggcttgaagcagaaggtgttggtaatgagaaagttacttaccgtcttcgtgactggctcttcagccgtcagcgttactggggtgagccaatcccaatcatccactgggaagatggaacatcaactgcggttcctgagagcgaattgccactagttcttccagttactaaggatatccgtccttcaggtactggtgagagcccacttgctaacttgacagactggttggaagtcactcgtgaagatggcgttaaaggtcgtcgtgagaccaacaccatgccacaatgggcaggttcaagctggtactatctccgctacatcgatccacacaacactgaaaaactagctgacgaggaactcctcaaacaatggttgccagttgatatctatgtcggtggtgcagagcatgccgtgcttcaccttctctatgctcgcttctggcacaaggttctttatgatctcggtgtcgtacctaccaaagagccattccaaaaactctttaaccaagggatgattttgggaacaagctaccgcgacagccgtggtgctcttgtggcaactgacaaggttgaaaaacgtgatggcagcttcttccatgtggaaactggtgaagagcttgaacaagcacctgctaagatgtctaaatcacttaagaacgttgtcaatccagatgatgttgttgagcagtacggtgctgacacccttcgtgtttacgagatgttcatgggaccactcgatgcttcaatcgcttggtctgaagaaggtcttgaaggctcacgtaagttcttggaccgtgtttaccgtttgatcacgactaaagagatcactgaggaaaatagcggagctcttgacaaggtttacaacgaaactgttaaggcagttactgagcaagttgaccaaatgaaattcaacacagctatcgctcaactcatggtctttgtcaatgcagccaacaaggaagacaaactctttagcgactatgccaaaggctttgttcaattgattgcaccattcgcaccgcacttaggtgaagaactctggcaagtcttgacagcctcaggacagtcaatctcttacgtgccatggccaagctatgacgaaagcaaattggttgaaaacgaaatcgaaatcgttgtccaaatcaaaggtaaggtcaaagctaaactcgtcgttgctaaagacctttcacgcgaagaattgcaagatcttgctcttgctaacgaaaaagtccaagccgaaatcgcaggcaaagacatcatcaaagtcatcgcagtaccaaacaaactcgttaatattgtggtgaaa

SEQ ID NO: 6286 - protein, 839 aa, Streptococcus agalactiae
MTWRSAMTFYNHKEIEPKWQAFWADNHTFKTGTDASKPKFYALDMFPYPSGAGLHVGHPEGYTATDILSRFKRAQGHNVLHPMGWDAFGLPAEQYAMDTGNDPAEFTAENIANFKRQINALGFSYDWDREVNTTDPNYYKWTQWIFTKLYEKGLAYEAEVPVNWVEELGTAIANEEVLPDGTSERGGYPVVRKPMRQWMLKITAYAERLLEDLEEVDWPESIKDMQRNWIGKSTGANVTFKVKDTDKDFTVFTTRPDTLFGATYAVLAPEHALVDAITTADQAEAVAEYKRQASLKSDLARTDLAKEKTGVWTGAYAINPVNGKEIPVWIADYVLASYGTGAIMAVPAHDERDWEFAKQFNLDIIPVLEGGNVEEAAFTEDGLHINSDFLDGLDKAAAIAKMVEWLEAEGVGNEKVTYRLRDWLFSRQRYWGEPIPIIHWEDGTSTAVPESELPLVLPVTKDIRPSGTGESPLANLTDWLEVTREDGVKGRRETNTMPQWAGSSWYYLRYIDPHNTEKLADEELLKQWLPVDIYVGGAEHAVLHLLYARFWHKVLYDLGVVPTKEPFQKLFNQGMILGTSYRDSRGALVATDKVEKRDGSFFHVETGEELEQAPAKMSKSLKNVVNPDDVVEQYGADTLRVYEMFMGPLDASIAWSEEGLEGSRKFLDRVYRLITTKEITEENSGALDKVYNETVKAVTEQVDQMKFNTAIAQLMVFVNAANKEDKLFSDYAKGFVQLIAPFAPHLGEELWQVLTASGQSISYVPWPSYDESKLVENEIEIVVQIKGKVKAKLVVAKDLSREELQDLALANEKVQAEIAGKDIIKVIAVPNKLVNIVVK

SEQ ID NO: 6287 - DNA, 2499 bp, Streptococcus pyogenes
atgacattttacgatcacaccgctattgaacccaaatggcaagccttttgggcagataatcatacttttaaaacaggaacagacgcatcaaaacctaagttttatgccctagatatgttcccatacccatctggagctggtctccacgttggtcacccagaaggctatacagcaactgatattctcagccgtttcaaacgtgcccaaggtcacaatattctccacccaatgggttgggatgcctttggacttcctgctgagcagtacgctatggatactggtaatgacccagccgagtttacagctgaaaacatcgctaacttcaaacgccagattaatgctcttggtttctcatacgactgggatcgtgaagttaacacaactgaccctaactactacaagtggacacagtggatctttaccaagctttatgaaaaaggcctagcctacgaagctgaagttcccgttaactgggttgaagaattgggaacagctatcgctaacgaagaggttctccctgatgggacatcagaacgtggcggctacccagttgtcagaaaacccatgcgccaatggatgctcaaaatcactgcctatgcagagcgcttgctagaagacttggaagaagttgactggccagaatcaatcaaggacatgcaacgcaactggattggtaaatcaactggtgctaatgtaaccttcaaggttaaggatacagataaggacttcactgtctttacaacacgtcctgacacgctttttggtgcaacttacgccgttcttgctcctgagcatgccttggttgatgctattacaacagctgaccaagcagaagccgttgccaaatacaaacgtcaagcaagtctcaaatcagaccttgctcgtacagatcttgccaaagaaaaaactggtgtgtggacaggtgcctatgcgattaacccagttaatggtaacgaaatgccagtttggattgcggactatgtccttgccagctacggtactggtgctatcatggctgttccagcccacgatgaacgtgactgggaattcgcaaaacaatttaagctagacatcatccctgttcttgaaggtggtaatgttgaagaggctgcctttacagaagacggtcttcacatcaactcaggcttcctagatggtcttgacaaagcgtcagctattgccaaaatggtcgaatggcttgaagcagaaggcgtcggtaatgagaaagtcacttaccgtcttcgtgactggctctttagccgtcaacgttattggggtgagccaatcccaatcatccactgggaagatgggacctcaacagcggttcctgagagtgagttgccactggttcttccagtaacgaaggatatccgtccttcaggtactggtgagagcccacttgctaacgtgacagactggttggaagtgactcgtgaagatggtgtgaaaggtcgtcgtgagactaacaccatgccacaatgggcaggttcaagctggtattatcttcgttacatcgatccacacaacactgaaaaactggctgacgaggaactcctcaaacaatggttgccagttgatatctatgtcggtggtgcagagcatgccgtgcttcaccttctctacgctcgcttctggcacaaggttctttacgatctcggtgttgtacctaccaaagagccattccaaaaactctttaaccaagggatgattttggggacaagctaccgcgatagccgtggtgctcttgtggcaactgacaaggttgaaaaacgtgatggtagcttcttccatgtggaaactggggaagagcttgaacaagcaccagctaagatgtctaaatcacttaagaacgttgtcaacccagatgatgttgttgagcagtacggtgctgacactcttcgtgtttacgagatgttcatgggaccacttgacgcttccatcgcctggtctgaagaaggtcttgaaggctcacgtaagttcttggaccgtgtttaccgtttgatcacaactaaagagatcactgaggaaaatagcggagcccttgacaaggtttacaacgaaaccgttaaggccgttactgagcaagttgaccaaatgaaattcaacacagctatcgctcaactcatggtatttgtcaatgcagccaacaaggaagacaaactctttagcgactatgccaaaggctttgttcaattgattgcaccatttgcaccgcacttaggtgaggaactctggcaagccttgacagcctcaggtgagtcaatctcttacgtgccatggccaagttatgatgaaagcaaattggttgaaaacgatgtggaaatcgttgtccaaatcaaaggtaaggtcaaagctaaacttgtagttgctaaagacctttcacgcgaagaattacaagaagttgctcttgctaacgaaaaagtccaagccgaaatcgcaggcaaagacatcatcaaagtcatcgcagtaccaaacaaactcgttaatattgttatcaaa

SEQ ID NO: 6288 - protein, 833 aa, Streptococcus pyogenes
MTFYDHTAIEPKWQAFWADNHTFKTGTDASKPKFYALDMFPYPSGAGLHVGHPEGYTATDILSRFKRAQGHNILHPMGWDAFGLPAEQYAMDTGNDPAEFTAENIANFKRQINALGFSYDWDREVNTTDPNYYKWTQWIFTKLYEKGLAYEAEVPVNWVEELGTAIANEEVLPDGTSERGGYPVVRKPMRQWMLKITAYAERLLEDLEEVDWPESIKDMQRNWIGKSTGANVTFKVKDTDKDFTVFTTRPDTLFGATYAVLAPEHALVDAITTADQAEAVAKYKRQASLKSDLARTDLAKEKTGVWTGAYAINPVNGNEMPVWIADYVLASYGTGAIMAVPAHDERDWEFAKQFKLDIIPVLEGGNVEEAAFTEDGLHINSGFLDGLDKASAIAKMVEWLEAEGVGNEKVTYRLRDWLFSRQRYWGEPIPIIHWEDGTSTAVPESELPLVLPVTKDIRPSGTGESPLANVTDWLEVTREDGVKGRRETNTMPQWAGSSWYYLRYIDPHNTEKLADEELLKQWLPVDIYVGGAEHAVLHLLYARFWHKVLYDLGVVPTKEPFQKLFNQGMILGTSYRDSRGALVATDKVEKRDGSFFHVETGEELEQAPAKMSKSLKNVVNPDDVVEQYGADTLRVYEMFMGPLDASIAWSEEGLEGSRKFLDRVYRLITTKEITEENSGALDKVYNETVKAVTEQVDQMKFNTAIAQLMVFVNAANKEDKLFSDYAKGFVQLIAPFAPHLGEELWQALTASGESISYVPWPSYDESKLVENDVEIVVQIKGKVKAKLVVAKDLSREELQEVALANEKVQAEIAGKDIIKVIAVPNKLVNIVIK

SEQ ID NO: 6289 - DNA, 618 bp, Streptococcus agalactiae
gtgagtttttatatgttacattctaaaaaaatacattccttatcgcttattgccgttctctctttagcaacatatacgagtttacaaccaaatcatgtaacggctgaacaatcacaaaaaacatcaactgttcatatgagtcaaaaaactattgaacataagttaaaagttgcagataaagaagctgctcctctctacgctaaaatcgaccatatccaacgacatattgaagtcaaaaaagcaaaagatttaaaagttattgaattgtatattaacaaagatatcaaccaactagagaagcaaaataaacgtctactaactaaattctatacttctattgataatcaaacatgggatagcacaagtgaagtcaaaaaattgattgataagacaaacctatccactaacgaaaaagatagattaaaattatattttgaacaacgtgcttaccttgagacaaggttgaacgaccgctatcaaaaatttgataactctattgaaaaccaaaataaagaactaaaaatattaacgtcaaaaatagaaaaaatctatcaaaaacatggtattacaaaagaggtattaaaaacttactatgctaaaaaaacagtacgagctgac

SEQ ID NO: 6290 - protein, 206 aa, Streptococcus agalactiae
MSFYMLHSKKIHSLSLIAVLSLATYTSLQPNHVTAEQSQKTSTVHMSQKTIEHKLKVADKEAAPLYAKIDHIQRHIEVKKAKDLKVIELYINKDINQLEKQNKRLLTKFYTSIDNQTWDSTSEVKKLIDKTNLSTNEKDRLKLYFEQRAYLETRLNDRYQKFDNSIENQNKELKILTSKIEKIYQKHGITKEVLKTYYAKKTVRAD

SEQ ID NO: 6291 - DNA, 1386 bp, Streptococcus agalactiae
atgaaaaagaaaagtttaattagcaatcttatccttattaatagcatcactctatttcttggtttttacctcatctatttttctgtcaactatgtcattaaagactatgtccatcaaatgacaaggaattccatgcaggcgaatttcaccattttagatagtatctataacaacaagaaaataccagatgaaaatatggttaaccaagatagcatctttgtttggtcttactatgctatttttgaccagcattatcgtatgaaatatggcactgataatcataaaaaagagagccatgatattattcgctatcttacccaaaaaagattgtggcaaatttctaaggaaaaagatggtatgtttgtaaccatcaagaaaaaaacctattatgtaatgaccaaagactactctggtatccttgttgatggtagcataaaaaaagttcctaaagcacagtcgcaactttttcatgtgattaacttttcagacattacttacacccagcatctaattactaaaattaatcattttcttatagttatcttagtactaacctatattcccatgctatttattatgaggaagactttcactggaattagagaatctattcaatcagtacaaacttatatttccagcctttggaaaaatcaaggcaatcatcaatctagtcaaaaagaaattgtcttttctgatttcgatcctcttctacttgagagccaagaaatggcaaatcgaatctaccaagcagaagagagccaaagaaacttctttcaaaatgcctcccacgagttacggacacctttaatgtccatccaaggatatactgagggagttcaagagggtattattgatgccgagctcgcacactctgttattctgcaagagagcaaaaaaatgaaacagctcgtagacgatattatcttactctctaaattagatagtaacttaagtgatcaaaaagatgaattttctttaaatgaattacttaatagtattattgcttatttcaaacccctagctaataaacaaaagattagtattacttatagaccagacaagcatgaaaagttactaaaaggtaacgaagagttgattcaacgagctatcaataatatccttagtaacgcactacgctatgctgtttctcatattgaaatctcttacacaaatcaaaaactaactatctcaaacgacggaccagccatttcaaaagaagacttgccttatattttcgatcgcttctataaaggacatggcggccaaacaggtattggacttgcaatgactaaagaaattatcaagcaacatcatggtaatatcatcgctgagagtgattcgacctcaacaacttttacgatttatttcaattgccacaaaattgcc

SEQ ID NO: 6292 - protein, 462 aa, Streptococcus agalactiae
MKKKSLISNLILINSITLFLGFYLIYFSVNYVIKDYVHQMTRNSMQANFTILDSIYNNKKIPDENMVNQDSIFVWSYYAIFDQHYRMKYGTDNHKKESHDIIRYLTQKRLWQISKEKDGMFVTIKKKTYYVMTKDYSGILVDGSIKKVPKAQSQLFHVINFSDITYTQHLITKINHFLIVILVLTYIPMLFIMRKTFTGIRESIQSVQTYISSLWKNQGNHQSSQKEIVFSDFDPLLLESQEMANRIYQAEESQRNFFQNASHELRTPLMSIQGYTEGVQEGIIDAELAHSVILQESKKMKQLVDDIILLSKLDSNLSDQKDEFSLNELLNSIIAYFKPLANKQKISITYRPDKHEKLLKGNEELIQRAINNILSNALRYAVSHIEISYTNQKLTISNDGPAISKEDLPYIFDRFYKGHGGQTGIGLAMTKEIIKQHHGNIIAESDSTSTTFTIYFNCHKIA

SEQ ID NO: 6293 - DNA, 702 bp, Streptococcus agalactiae
atgggtattgaggtatacatgacaaaaataatttatttcgctgatgatgaaaagaatattcgtgacttggtggttccttttttagaacatgatggtttcactgttcgagcatttgaaactggagaccttctcttagaagcctataaaaaccaaaaacccgatttagttatattagacataatgatgcctggaactaatggtttagatgttatgaaaagcatccgccaatatgataatattcctattatcatgttaacagctagagattctgatgttgatttcattacggcttttaatttaggaactgacgattacttcaccaagcctttttcacctataaaacttagtctacatgttaaagcattgttcaaacgccttgatgaaaaagcaatcaaaaatgacactcagtatcagttcctagatttaactctggataccgaaaagcgaatagccctattatcaaatgaagaaatgcccttaaccaagacagaatttgattttcttttagtattaattgaaaaacctgaaactgctttttctagggaaacactgcttaatcgtatttggggatttgatgatattgaaagcagagcagttgatgacactattaaacgattacgtaaaaaatttaagcaataccacagtcaggttagtatcaaaactgtctggggttacggcttcaaattaatcaaagaggacaaa

SEQ ID NO: 6294 - protein, 234 aa, Streptococcus agalactiae
MGIEVYMTKIIYFADDEKNIRDLVVPFLEHDGFTVRAFETGDLLLEAYKNQKPDLVILDIMMPGTNGLDVMKSIRQYDNIPIIMLTARDSDVDFITAFNLGTDDYFTKPFSPIKLSLHVKALFKRLDEKAIKNDTQYQFLDLTLDTEKRIALLSNEEMPLTKTEFDFLLVLIEKPETAFSRETLLNRIWGFDDIESRAVDDTIKRLRKKFKQYHSQVSIKTVWGYGFKLIKEDK

SEQ ID NO: 6295 - DNA, 4770 bp, Streptococcus agalactiae
ttgattttttatgttttaatagtttttgtaattattatgttacaagaaaaggagatttttatgaacacaaaacagcgtttttcaatccggaaatataagttaggtgccgtatctgtacttttgggaaccctattttttttaggtggtatcacaaatgtagctgctgattctgtcataaataagccatctgatattgcagttgaacagcaagtaaaagacagtccaacgagcatagcaaatgagacacctactaacaacacgtcatcagcccttgcgtcgacagctcaagacaatcttgttacaaaggctaataatagtccaacagaaacacaaccagtagctgagtctcactctcaagccaccgagacattttccccagtcgcaaatcaaccggttgaaagcactcaagaagtttctaaaactcctttaaccaaacaaaatttagcagtcaaatctacaccagctatttctaaagaaacccctcaaaacattgatagtaataaaattatcactgtccccaaagtatggaacacaggctacaaaggagagggaactgttgtagcaattattgactcaggactagatatcaatcacgatgctctccaattaaatgattcgacaaaagcaaaataccaaaacgaacagcaaatgaatgctgctaaagcaaaagctggtataaactatggaaaatggtataacaacaaagtaatctttggtcacaactatgttgatgtcaatacagagctaaaagaggtgaaaagcacttctcatggtatgcacgtaaccagtatcgcaacagctaatcctagcaagaaagatacaaatgaattaatctatggtgttgctcctgaagcacaagtaatgtttatgagagtcttctctgatgaaaaaagaggaactggaccagccctttatgttaaagctattgaagatgccgttaaactcggtgctgacagcattaatttaagtttaggtggagctaatgggtctttagttaatgccgatgaccgacttataaaagctttagagatggctagactcgctggcgtttctgttgttatagcagcaggtaacgacggtacatttgggagtggagcatcaaagccttctgctctttatcctgattatggtttagttggtagtccatcaacagctcgtgaggccatttctgtagcatcatataataatacaacactggttaataaagtcttcaacattatcggattagaaaacaacagaaatctcaacaacggattagctgcttatgcagatcctaaagttagtgataagacctttgaagtagggaaacaatatgattatgttttcgtaggaaaaggaaacgacaatgattataaggacaaaactttaaatggtaaaatcgccttaattgaacgtggagatattacttttacaaaaaaagtcgtcaatgctattaatcacggtgctgtgggagctattatctttaataacaaagctggggaagctaatctaacaatgagtttagatcctgaagcaagtgctattcctgctatttttacccaaaaagagtttggagatgttttagctaaaaacaactataaaattgtatttaacaatatcaaaaataaacaagccaaccctaatgcaggtgtcctatctgacttttcaagctgggggttaacagcagacggacaattaaaacctgacttatctgctcctggaggctctatttacgccgctatcaatgataatgaatatgatatgatgagtgggacaagtatggcttctccccatgtcgctggtgctactgctctagttaaacaatacttattgaaagaacatccagaacttaaaaaaggtgacattgaaagaactgtcaaataccttcttatgagtactgctaaagcacacctaaacaaagatacaggcgcttacacctcaccacgccaacaaggagcaggtattatcgatgtcgcagcagcagttcagacaggattatacctaactggtggggaaaacaactatggcagcgttacattaggaaatattaaagataaaatttcctttgatgttactgttcataatatcaataaagttgcaaaagatttacactatacaacctatttaaatactgatcaagttaaagatggctttgtcacattggctcctcaacaacttggtacatttacagggaaaacgatacggattgaaccagggcaaacccaaacgattacaattgatatagatgtttcgaaataccatgacatgttaaaaaaagtaatgccaaacggctatttcctagaaggctacgtacgttttacagaccctgttgatggtggggaagttcttagtattccttatgttggatttaagggagaattccaaaacttagaagttttagaaaaatccatttataagcttgttgctaacaaagaaaagggattttatttccaaccaaaacaaacaaacgaagttcctggttcagaagattatactgccttaatgactacaagttcagagcctatctactcaacagacggtactagtcctatccaattgaaagccttgggaagctataagtctatagatggaaaatggatcttacaactagatcaaaaaggccagcctcatctagccatttcacctaatgatgaccaaaatcaagatgccgttgcagtgaaaggtgttttcttacgtaatttcaataatttaagagccaaagtctatcgtgcagatgatgttaatttacaaaaaccactatgggtaagtgctccccaagcaggagataaaaattactacagcggaaatactgaaaatccaaaatctacatttttatatgacacagaatggaaaggaaccactactgatggtattcctttagaagatggaaaatacaaatacgttttaacttattactctgatgtccctggctctaagccacaacaaatggtgtttgatatcactttggatagacaagctcctacactaacaacagcaacttatgacaaagatagacgtatcttcaaagctcgtcctgcagtagaacacggggaatctggtatctttagagaacaagttttttacttaaaaaaagataaagatggtcattataatagcgtcttacgtcaacaaggagaagacggtatccttgttgaagataacaaagtatttatcaaacaagaaaaggatggtagctttattctacctaaagaggttaacgatttctctcatgtctactatactgttgaagattatgcaggcaatctagtatcagcaaaactcgaagatttgatcaatattggcaataaaaatggtttagtaaacgtcaaagtgtttagccctgagcttaacagtaatgtcgatattgatttctcttactctgtcaaagatgacaaaggtaatatcatcaaaaagcaacatcacgggaaagacctcaatttattgaaattgccttttggtacctatacgtttgatctattcttatacgatgaggaacgagcaaatctaatcagtcccaaaagtgtcactgtaactatttctgaaaaagatagccttaaagacgtcttatttaaagttaacttactcaagaaagcagccttactcgttgaatttgacaagcttttaccaaaaggagcaacagtccagttggttactaagacaaatactgttgttgatctaccaaaagcaacttattctcctactgactatggtaaaaacatacctgtaggagactatcgtttaaacgtaacgctgcctagtgggtatagcactttagagaacttagatgatttacttgtatccgtaaaagaagatcaggtaaacctaacaaaattgacgctgattaataaagctcctctgattaatgccctagcagaacaaactgatattattacccagcctgtgttttataatgctggaactcacttaaaaaataattacctagctaatcttgaaaaggcacaaactttaattaaaaatagagtggaacaaacaagtattgataatgctattgctgctttgagagaaagtcgccaagctcttaacggtaaagaaacagatacttctttactggcaaaagctattttagctgaaacagaaatcaagggaaactatcaatttgttaatgctagtccattaagccaatcaacttatatcaatcaagtccaattggcgaaaaaccttctacaaaaacctaacgtcactcaatcagaagtagacaaagccttagaaaatcttgatattgctaaaaatcaattaaatggtcatgaaactgattactctggtttacaccatatgataattaaagcaaacgttctgaaacaaacatcatctaaatatcagaacgccagtcaatttgctaaagaaaattataataaccttatcaagaaagcagaattgctgctttccaatagacaagctacacaagctcaagttgaagagttattaaaccaaataaaagcaaccgaacaagagcttgatggccgtgatagagtttcttccgcagagaattatagtcaatcactcaatgataatgactctctcaataccacacctatcaatccgccaaatcagccccaggcgttgatattcaaaaaaggcatgactaaagaaagtgaggttgctcagaagcgtgtcttaggggtgactagccaaaccgataatcaaaaggtaaagacaaacaagcttcctaaaacaggcgaaagcactcctaaaataacctatacaatattgctatttagtctctctatgctaggtctggcaacaatcaaactaaagtctatcaaaagagaa

SEQ ID NO: 6296 - protein, 1590 aa, Streptococcus agalactiae
MIFYVLIVFVIIMLQEKEIFMNTKQRFSIRKYKLGAVSVLLGTLFFLGGITNVAADSVINKPSDIAVEQQVKDSPTSIANETPTNNTSSALASTAQDNLVTKANNSPTETQPVAESHSQATETFSPVANQPVESTQEVSKTPLTKQNLAVKSTPAISKETPQNIDSNKIITVPKVWNTGYKGEGTVVAIIDSGLDINHDALQLNDSTKAKYQNEQQMNAAKAKAGINYGKWYNNKVIFGHNYVDVNTELKEVKSTSHGMHVTSIATANPSKKDTNELIYGVAPEAQVMFMRVFSDEKRGTGPALYVKAIEDAVKLGADSINLSLGGANGSLVNADDRLIKALEMARLAGVSVVIAAGNDGTFGSGASKPSALYPDYGLVGSPSTAREAISVASYNNTTLVNKVFNIIGLENNRNLNNGLAAYADPKVSDKTFEVGKQYDYVFVGKGNDNDYKDKTLNGKIALIERGDITFTKKVVNAINHGAVGAIIFNNKAGEANLTMSLDPEASAIPAIFTQKEFGDVLAKNNYKIVFNNIKNKQANPNAGVLSDFSSWGLTADGQLKPDLSAPGGSIYAAINDNEYDMMSGTSMASPHVAGATALVKQYLLKEHPELKKGDIERTVKYLLMSTAKAHLNKDTGAYTSPRQQGAGIIDVAAAVQTGLYLTGGENNYGSVTLGNIKDKISFDVTVHNINKVAKDLHYTTYLNTDQVKDGFVTLAPQQLGTFTGKTIRIEPGQTQTITIDIDVSKYHDMLKKVMPNGYFLEGYVRFTDPVDGGEVLSIPYVGFKGEFQNLEVLEKSIYKLVANKEKGFYFQPKQTNEVPGSEDYTALMTTSSEPIYSTDGTSPIQLKALGSYKSIDGKWILQLDQKGQPHLAISPNDDQNQDAVAVKGVFLRNFNNLRAKVYRADDVNLQKPLWVSAPQAGDKNYYSGNTENPKSTFLYDTEWKGTTTDGIPLEDGKYKYVLTYYSDVPGSKPQQMVFDITLDRQAPTLTTATYDKDRRIFKARPAVEHGESGIFREQVFYLKKDKDGHYNSVLRQQGEDGILVEDNKVFIKQEKDGSFILPKEVNDFSHVYYTVEDYAGNLVSAKLEDLINIGNKNGLVNVKVFSPELNSNVDIDFSYSVKDDKGNIIKKQHHGKDLNLLKLPFGTYTFDLFLYDEERANLISPKSVTVTISEKDSLKDVLFKVNLLKKAALLVEFDKLLPKGATVQLVTKTNTVVDLPKATYSPTDYGKNIPVGDYRLNVTLPSGYSTLENLDDLLVSVKEDQVNLTKLTLINKAPLINALAEQTDIITQPVFYNAGTHLKNNYLANLEKAQTLIKNRVEQTSIDNAIAALRESRQALNGKETDTSLLAKAILAETEIKGNYQFVNASPLSQSTYINQVQLAKNLLQKPNVTQSEVDKALENLDIAKNQLNGHETDYSGLHHMIIKANVLKQTSSKYQNASQFAKENYNNLIKKAELLLSNRQATQAQVEELLNQIKATEQELDGRDRVSSAENYSQSLNDNDSLNTTPINPPNQPQALIFKKGMTKESEVAQKRVLGVTSQTDNQKVKTNKLPKTGESTPKITYTILLFSLSMLGLATIKLKSIKRE

SEQ ID NO: 6297 - DNA, 4941 bp, Streptococcus pyogenes
gtggagaaaaagcaacgtttttcccttagaaaatacaaatcaggaacgttttcggtcttaataggaagcgttttcttggtgatgacaacaacagtagcagcagatgagctaagcacaatgagcgaaccaacaatcacgaatcacgctcaacaacaagcgcaacatctcaccaatacagagttgagctcagctgaatcaaaatctcaagacacatcacaaatcactctcaagacaaatcgtgaaaaagagcaatcacaagatctagtctctgagccaaccacaactgagctagctgacacagatgcagcatcaatggctaatacaggttctgatgcgactcaaaaaagcgcttctttaccgccagtcaatacagatgttcacgattgggtaaaaaccaaaggagcttgggacaagggatacaaaggacaaggcaaggttgtcgcagttattgacacagggatcgatccggcccatcaaagcatgcgcatcagtgatgtatcaactgctaaagtaaaatcaaaagaagacatgctagcacgccaaaaagccgccggtattaattatgggagttggataaatgataaagttgtttttgcacataattatgtggaaaatagcgataatatcaaagaaaatcaattcgaggattttgatgaggactgggaaaactttgagtttgatgcagaggcagagccaaaagccatcaaaaaacacaagatctatcgtccccaatcaacccaggcaccgaaagaaactgttatcaaaacagaagaaacagatggttcacatgatattgactggacacaaacagacgatgacaccaaatacgagtcacacggtatgcatgtgacaggtattgtagccggtaatagcaaagaagccgctgctactggagaacgctttttaggaattgcaccagaggcccaagtcatgttcatgcgtgtttttgccaacgacatcatgggatcagctgaatcactctttatcaaagctatcgaagatgccgtggctttaggagcagatgtgatcaacctgagtcttggaaccgctaatggggcacagcttagtggcagcaagcctctaatggaagcaattgaaaaagctaaaaaagccggtgtatcagttgttgtagcagcaggaaatgagcgcgtctatggatctgaccatgatgatccattggcgacaaatccagactatggtttggtcggttctccctcaacaggtcgaacaccaacatcagtggcagctataaacagtaagtgggtgattcaacgtctaatgacggtcaaagaattagaaaaccgtgccgatttaaaccatggtaaagccatctattcagagtctgtcgactttaaagacataaaagatagcctaggttatgataaatcgcatcaatttgcttatgtcaaagagtcaactgatgcgggttataacgcacaagacgttaaaggtaaaattgctttaattgaacgtgatcccaataaaacctatgacgaaatgattgctttggctaagaaacatggagctctgggagtacttatttttaataacaagcctggtcaatcaaaccgctcaatgcgtctaacagctaatgggatggggataccatctgctttcatatcgcacgaatttggtaaggccatgtcccaattaaatggcaatggtacaggaagtttagagtttgacagtgtggtctcaaaagcaccgagtcaaaaaggcaatgaaatgaatcatttttcaaattggggcctaacttctgatggctatttaaaacctgacattactgcaccaggtggcgatatctattctacctataacgataaccactatggtagccaaacaggaacaagtatggcctctcctcagattgctggcgccagccttttggtcaaacaatacctagaaaagactcagccaaacttgccaaaagaaaaaattgctgatatcgttaagaacctattgatgagcaatgctcaaattcatgttaatccagagacaaaaacgaccacctcaccgcgtcagcaaggggcaggattacttaatattgacggagctgtcactagcggcctttatgtgacaggaaaagacaactatggcagtatatcattaggcaacatcacagatacgatgacgtttgatgtgactgttcacaacctaagcaataaagacaaaacattacgttatgacacagaattgctaacagatcatgtagacccacaaaagggccgcttcactttgacttctcactccttaaaaacgtaccaaggaggagaagttacagtcccagccaatggaaaagtgactgtaagggttaccatggatgtctcacagttcacaaaagagctaacaaaacagatgccaaatggttactatctagaaggttttgtccgctttagagatagtcaagatgaccaactaaatagagtaaacattccttttgttggttttaaagggcaatttgaaaacttagcagttgcagaagagtccatttacagattaaaatctcaaggcaaaactggtttttactttgatgaatcaggtccaaaagacgatatctatgtcggtaaacactttacaggacttgtcactcttggttcagagaccaatgtgtcaaccaaaacgatttctgacaatggtctacacacacttggcacctttaaaaatgcagatggcaaatttatcttagaaaaaaatgcccaaggaaaccctgtcttagccatttctccaaatggtgacaacaaccaagattttgcagccttcaaaggtgttttcttgagaaaatatcaaggcttaaaagcaagtgtctaccatgctagtgacaaggaacacaaaaatccactgtgggtcagcccagaaagctttaaaggagataaaaactttaatagtgacattagatttgcaaaatcaacgaccctgttaggcacagcattttctggaaaatcgttaacaggagctgaattaccagatgggcattatcattatgtggtgtcttattacccagatgtggtcggtgccaaacgtcaagaaatgacatttgacatgattttagaccgacaaaaaccggtactatcacaagcaacatttgatcctgaaacaaaccgattcaaaccagaacccctaaaagaccgtggattagctggtgttcgcaaagacagtgtcttttatctagaaagaaaagacaacaagccttatacagttacgataaacgatagctacaaatatgtctcagtagaagacaataaaacatttgtggagcgacaagctgatggcagctttatcttgccgcttgataaagcaaaattaggggatttctattacatggtcgaggattttgcagggaacgtggccatcgctaagttaggagatcacttaccacaaacattaggtaaaacaccaattaaacttaagcttacagacggtaattatcagaccaaagaaacgcttaaagataatcttgaaatgacacagtctgacacaggtctagtcacaaatcaagcccagctagcagtggtgcaccgcaatcagccgcaaagccagctaacaaagatgaatcaggatttctttatctcaccaaacgaagatgggaataaagactttgtggcctttaaaggcttgaaaaataacgtgtataatgacttaacggttaacgtatacgctaaagatgaccaccaaaaacaaacccctatctggtctagtcaagcaggcgctagtgtatccgctattgaaagtacagcctggtatggcataacagcccgaggaagcaaggtgatgccaggtgattatcagtatgttgtgacctatcgtgacgaacatggtaaagaacatcaaaagcagtacaccatatctgtgaatgacaaaaaaccaatgatcactcagggacgttttgataccattaatggcgttgaccactttactcctgacaagacaaaagcccttgactcatcaggcattgtccgcgaagaagtcttttacttggccaagaaaaatggccgtaaatttgatgtgacagaaggtaaagatggtatcacagttagtgacaataaggtgtatatccctaaaaatccagatggttcttacaccatttcaaaaagagatggtgtcacactgtcagattattactaccttgtcgaagatagagctggtaatgtgtcttttgctaccttgcgtgacctaaaagcggtcggaaaagacaaagcagtagtcaattttggattagacttaccggtccctgaagacaaacaaatagtgaactttacctaccttgtgcgggatgcagatggtaaaccgattgaaaacctagagtattataataactcaggtaacagtcttatcttgccatacggcaaatacacggtcgaattgttgacctatgacaccaatgcagccaaactagagtcagataaaatcgtttcctttaccttgtcagctgataacaacttccaacaagttacctttaagataacgatgttagcaacttctcaaataactgcccactttgatcatcttttgccagaaggcagtcgcgttagccttaaaacagctcaagatcagctaatcccgcttgaacagtccttgtatgtgcctaaagcttatggcaaaaccgttcaagaaggcacttacgaagttgttgtcagcctgcctaaaggctaccgtatcgaaggcaacacaaaggtgaataccctaccaaatgaagtgcacgaactatcattacgccttgtcaaagtaggagatgcctcagattcaactggtgatcataaggttatgtcaaaaaataattcacaggctttgacagcctctgccacaccaaccaagtcaacgacctcagcaacagcaaaagccctaccatcaacgggtgaaaaaatgggtctcaagttgcgcatagtaggtcttgtgttactcggacttacttgcgtctttagccgaaaaaaatcaaccaaagat

SEQ ID NO: 6298 - protein, 1647 aa, Streptococcus pyogenes
VEKKQRFSLRKYKSGTFSVLIGSVFLVMTTTVAADELSTMSEPTITNHAQQQAQHLTNTELSSAESKSQDTSQITLKTNREKEQSQDLVSEPTTTELADTDAASMANTGSDATQKSASLPPVNTDVHDWVKTKGAWDKGYKGQGKVVAVIDTGIDPAHQSMRISDVSTAKVKSKEDMLARQKAAGINYGSWINDKVVFAHNYVENSDNIKENQFEDFDEDWENFEFDAEAEPKAIKKHKIYRPQSTQAPKETVIKTEETDGSHDIDWTQTDDDTKYESHGMHVTGIVAGNSKEAAATGERFLGIAPEAQVMFMRVFANDIMGSAESLFIKAIEDAVALGADVINLSLGTANGAQLSGSKPLMEAIEKAKKAGVSVVVAAGNERVYGSDHDDPLATNPDYGLVGSPSTGRTPTSVAAINSKWVIQRLMTVKELENRADLNHGKAIYSESVDFKDIKDSLGYDKSHQFAYVKESTDAGYNAQDVKGKIALIERDPNKTYDEMIALAKKHGALGVLIFNNKPGQSNRSMRLTANGMGIPSAFISHEFGKAMSQLNGNGTGSLEFDSVVSKAPSQKGNEMNHFSNWGLTSDGYLKPDITAPGGDIYSTYNDNHYGSQTGTSMASPQIAGASLLVKQYLEKTQPNLPKEKIADIVKNLLMSNAQIHVNPETKTTTSPRQQGAGLLNIDGAVTSGLYVTGKDNYGSISLGNITDTMTFDVTVHNLSNKDKTLRYDTELLTDHVDPQKGRFTLTSHSLKTYQGGEVTVPANGKVTVRVTMDVSQFTKELTKQMPNGYYLEGFVRFRDSQDDQLNRVNIPFVGFKGQFENLAVAEESIYRLKSQGKTGFYFDESGPKDDIYVGKHFTGLVTLGSETNVSTKTISDNGLHTLGTFKNADGKFILEKNAQGNPVLAISPNGDNNQDFAAFKGVFLRKYQGLKASVYHASDKEHKNPLWVSPESFKGDKNFNSDIRFAKSTTLLGTAFSGKSLTGAELPDGHYHYVVSYYPDVVGAKRQEMTFDMILDRQKPVLSQATFDPETNRFKPEPLKDRGLAGVRKDSVFYLERKDNKPYTVTINDSYKYVSVEDNKTFVERQADGSFILPLDKAKLGDFYYMVEDFAGNVAIAKLGDHLPQTLGKTPIKLKLTDGNYQTKETLKDNLEMTQSDTGLVTNQAQLAVVHRNQPQSQLTKMNQDFFISPNEDGNKDFVAFKGLKNNVYNDLTVNVYAKDDHQKQTPIWSSQAGASVSAIESTAWYGITARGSKVMPGDYQYVVTYRDEHGKEHQKQYTISVNDKKPMITQGRFDTINGVDHFTPDKTKALDSSGIVREEVFYLAKKNGRKFDVTEGKDGITVSDNKVYIPKNPDGSYTISKRDGVTLSDYYYLVEDRAGNVSFATLRDLKAVGKDKAVVNFGLDLPVPEDKQIVNFTYLVRDADGKPIENLEYYNNSGNSLILPYGKYTVELLTYDTNAAKLESDKIVSFTLSADNNFQQVTFKITMLATSQITAHFDHLLPEGSRVSLKTAQDQLIPLEQSLYVPKAYGKTVQEGTYEVVVSLPKGYRIEGNTKVNTLPNEVHELSLRLVKVGDASDSTGDHKVMSKNNSQALTASATPTKSTTSATAKALPSTGEKMGLKLRIVGLVLLGLTCVFSRKKSTKD

SEQ ID NO: 6299 - DNA, 693 bp, Streptococcus agalactiae
atgatggaaaaaggatttaaagagggagtgaaagatgccttgcccacagctttagggtatatctcaataggcttggcgtttgggatagttgcttcagcatcagatttatctgcaatagaagttggtcttatgagtgccttggtatatgggggatctgctcagtttgctatgtgtgcgctattattagcaaaagcagacttgatgactattacgatgacagtatttttagttaatttgagaaatatgttaatgagtttacacgcgactactatcttcaagtctgctcacctaatgaatcaattagccataggaactctaataacagatgagagctacggcgttttacttggagaagcattacatcacaaagttgtatcgcctagttggatgcatggtaataatgtgatgagttatttgacatgggtaatctcaacgataataggaactttactggggagtactattcctaatccagaaatgtttggtttagactttgcattagtcgccatgtttataggtctctttgtatttcagttgtttgggatgttatctgatggaaagcgacttgttgtatatgttcttgcttctgtaggtttaagttacttcttattagctacttttttgtcaggagccttatcagtattgcttgcgactgttgttggatgtagtgtgggagttgttttagatgataaa

SEQ ID NO: 6300 - protein, 231 aa, Streptococcus agalactiae
MMEKGFKEGVKDALPTALGYISIGLAFGIVASASDLSAIEVGLMSALVYGGSAQFAMCALLLAKADLMTITMTVFLVNLRNMLMSLHATTIFKSAHLMNQLAIGTLITDESYGVLLGEALHHKVVSPSWMHGNNVMSYLTWVISTIIGTLLGSTIPNPEMFGLDFALVAMFIGLFVFQLFGMLSDGKRLVVYVLASVGLSYFLLATFLSGALSVLLATVVGCSVGVVLDDK

SEQ ID NO: 6301 - DNA, 249 bp, Streptococcus agalactiae
gtgacaactagagttggtatgccagccaataaatctaaccattttagtgttggcaattgtcctaatttaactgaaaaaaagctagagaatgttagggcaaataaaatagaaagaggaagaaattttaaaaatttcacaagactatttggtagccctttgtattttacaaatatgaatggagcgactcttggcacccaagaaacaacaaaacctaaaagaatagcaagaaaaacggtactatttatcatc

SEQ ID NO: 6302 - protein, 83 aa, Streptococcus agalactiae
MTTRVGMPANKSNHFSVGNCPNLTEKKLENVRANKIERGRNFKNFTRLFGSPLYFTNMNGATLGTQETTKPKRIARKTVLFII

SEQ ID NO: 6303 - DNA, 2250 bp, Streptococcus agalactiae
ttgatggaggaaattatggtaaaagtttcaaatttagggtatccacgtcttggtgaacagcgcgaatggaagcaagcgatcgaagctttctgggcagggaatcttgaacaaaaagatttagaaaaacaactaaaacaattacgtatcaatcatttaaagaaacaaaaagaggcaggtattgaccttattccagtgggggatttttcttgttatgatcatgttttggatttgtcatttcaattcaatgtaatcccaaagcgtttcgatgagtatgagaggaatttagacctttattttgctattgcaagaggtgataaagataatgtcgcatcatctatgaaaaagtggtttaataccaactaccactacatagtcccagaatgggaggttgagactaaacctcacttgcagaataattacttacttgatctttatctagaagctagggaagtagttggtgataaagcaaagccggttatcactggtccaataacctatgtttccttatcatcaggaattgtcgactttgaagcgactgttcagcggttattaccactttataagcaggtctttcaagatctgatagatgcaggcgccacctatattcagattgatgagccgatatttgtaactgatgaaggtgaacttttagtagatatagctaagtctgtttatgatttttttgcaagagaagtaccacaagcccacttcatctttcaaacctactttgaatcagcagtctgtttagataaactctctaagctgccagtaacgggatttggccttgattttatacatggtagggcggaaaatttagctgctgttaagcaaggtctattccgcgaaaaagaattatttgcaggaattgttaatggtcgaaatatctgggcagtaaatttagaagaaacgttggctttattggaagagataggtccctttgttaaacgattgactcttcaaccttcttcaagtcttttacatgtaccggtgacgactaaatacgaaacacatttagaccctgtgttaaagaatggcttatcatttgctgatgaaaaactaaaggaattagaactattagctagtgcttttgatggtaataaaacaaagggatatcacgaagctttatctcgtttttcagctcttcaagctgctgattttcgtcatgtagcattggaatcattagcagaagtaaagcttgaacgaagtccgtataaattacgccaagctttgcaagctgaaaaattacagttaccgattttaccaacaacaactattggatcctttcctcaatcacctgaaattaggaagaaacgccttgcttggaaaagaggaaatctatctgactcagattataaagatttcataaaaactgaaattagaagatggattgctattcaagaagatcttgatcttgatgtgttagtacatggcgaatttgagcgtgttgatatggttgaattttttggtcaaaagttagctggttttacgacaaccaaattaggctgggtacagtcttatggttcaagggcggtcaaaccacctatcatttatggtgatgtcaaacatattcaacccttaagccttgaagaaacggtttatgcccaaagtttgactaagaaacctgttaaaggcatgttgacaggtcctattactataacgaactggtcatttgagcgagatgatattagccgatctgatctttttaatcaaattgctttggctataaaagatgagattcaacttttggaacaatcaggtattgctattatacaagtggatgaagcagcccttcgagaaggtttacccttacgccagcaaaagcaacaggcttacttagatgatgctgttgcggcctttaaaattgcaacttcatctgtgaaagatgagacacaaattcatacacatatgtgttattcaaaatttgacgaaattattgattctatccgtgcactagatgcagatgttatttctattgaaacgagtagaagtcatggggacatcattgaaagttttgaaacagcagtttatcctctaggaattggcctgggtgtttatgatattcattcccctcgcatacctactaaggaagaaattattgtcaatattcaacgatcactaaaatgtctatcaaaagagcaattttgggtaaaccctgattgtggcttaaaaacacgccgtgaagcagaaacaattgctgccttggaggttcttgtttcagctaccaaagaggttcgtcagcaattagataat

SEQ ID NO: 6304 - protein, 750 aa, Streptococcus agalactiae
MMEEIMVKVSNLGYPRLGEQREWKQAIEAFWAGNLEQKDLEKQLKQLRINHLKKQKEAGIDLIPVGDFSCYDHVLDLSFQFNVIPKRFDEYERNLDLYFAIARGDKDNVASSMKKWFNTNYHYIVPEWEVETKPHLQNNYLLDLYLEAREVVGDKAKPVITGPITYVSLSSGIVDFEATVQRLLPLYKQVFQDLIDAGATYIQIDEPIFVTDEGELLVDIAKSVYDFFAREVPQAHFIFQTYFESAVCLDKLSKLPVTGFGLDFIHGRAENLAAVKQGLFREKELFAGIVNGRNIWAVNLEETLALLEEIGPFVKRLTLQPSSSLLHVPVTTKYETHLDPVLKNGLSFADEKLKELELLASAFDGNKTKGYHEALSRFSALQAADFRHVALESLAEVKLERSPYKLRQALQAEKLQLPILPTTTIGSFPQSPEIRKKRLAWKRGNLSDSDYKDFIKTEIRRWIAIQEDLDLDVLVHGEFERVDMVEFFGQKLAGFTTTKLGWVQSYGSRAVKPPIIYGDVKHIQPLSLEETVYAQSLTKKPVKGMLTGPITITNWSFERDDISRSDLFNQIALAIKDEIQLLEQSGIAIIQVDEAALREGLPLRQQKQQAYLDDAVAAFKIATSSVKDETQIHTHMCYSKFDEIIDSIRALDADVISIETSRSHGDIIESFETAVYPLGIGLGVYDIHSPRIPTKEEIIVNIQRSLKCLSKEQFWVNPDCGLKTRREAETIAALEVLVSATKEVRQQLDN

SEQ ID NO: 6305 - DNA, 1842 bp, Streptococcus agalactiae
atgtccaagtttttagagaaattaaaaacagatattctagtagctgacggtgcaatgggaactctcctttatacttatgggctagatacttgtcatgaatcctacaatgtaacacatccagaaaaggttctagccattcatcaagcttatattgaagcgggtgcagatgttattcagacgaatacctatggggctcaacgtcatcgattaaagaactacggtttggaagatcaggttgtctctatcaatcaagcagcagttaatatagctcatcaagcgactttgggtaaagaaacatttattttaggtactgttggaggttttcgttctcaaagacaatgcgatttaacattggataatattgtagaagaaactttggaacaagttgaggctttattggcgacaggacagctagacggattattgtttgaaacttattatgatattgaggagataacgacagttttaaaaattgtgagggagatgactgatctaccaattattactaatatttctcttcatgaagcaggggtaacatcaaatggaaagcctattgtagaggcgctcagccaattagttatgctaggtgcagatgtgattggcttaaattgtcaccttggaccctatcatatgatccaatcattgaagcaagttcctttatttgcccagtcttatttgtcagtttatcctaatgcaagtcagttatctttagatggtgagaatagtcaataccagtttagtcagaattcagagtattttggaaaatctgcagaacttctcgtagcagaaggagttaggcttattggtggttgttgtgggacaactccagatcatattagagctgtgaaacgatctattagaggattgaaacctattgaacgaaaggttgttactcctataatacctgtaaaagattttgttaggcgtatcagacgaacagatactctagtggataaggtaaaaaaagaagtaacaattatcgcagaattagatcctccaaagcatttagatatcgttcagtttcaaaaggctatacgagcgattgaccaaaaaggtattgcagcaattactttagcagataattcactatctaatacacgtatttgtaatttaagtatagctagcttgcttaaagatgaaattagcacaccctttttactacatatagcttgtcgtgaccataatttaattggtttacagtctagactgttgggcatggaattattaggttttaaccatattttagccataacaggagatccgactaaacttggtgatttcccaggagcgactagtgtttatgatgtgacttcctttaaactcctttctctgattaaacaacttaatcaaggtttatcttatagtggtgctagcttgagacgtccaacagattttacagttgctgctgcctttaatcctaatgtgaaaaaccttactcgaaccgtaaaattgattgagaaaaaagtagcttctggtgctgattattttatgacacaaccaatatttgatcactctgtgttaaaggaattagctgatcttactaaaacagttgaacaacccttttttatcggaattatgccaataacaagttataataacgctgtttttctacacaatgaagttcctggtattaaactttctgagtcatttttatctgctcttgaaaaggtaaaggacgacaaagaagcttgtttaactttggccttaaacgagagtaagtccttgattgatgaagccttgaactattttaatggtatctatttgattactccctttttacgctatgatctgactcttgagttaattgactatatacaaaaaaagcaagtaagaaagtcctct

SEQ ID NO: 6306 - protein, 614 aa, Streptococcus agalactiae
MSKFLEKLKTDILVADGAMGTLLYTYGLDTCHESYNVTHPEKVLAIHQAYIEAGADVIQTNTYGAQRHRLKNYGLEDQVVSINQAAVNIAHQATLGKETFILGTVGGFRSQRQCDLTLDNIVEETLEQVEALLATGQLDGLLFETYYDIEEITTVLKIVREMTDLPIITNISLHEAGVTSNGKPIVEALSQLVMLGADVIGLNCHLGPYHMIQSLKQVPLFAQSYLSVYPNASQLSLDGENSQYQFSQNSEYFGKSAELLVAEGVRLIGGCCGTTPDHIRAVKRSIRGLKPIERKVVTPIIPVKDFVRRIRRTDTLVDKVKKEVTIIAELDPPKHLDIVQFQKAIRAIDQKGIAAITLADNSLSNTRICNLSIASLLKDEISTPFLLHIACRDHNLIGLQSRLLGMELLGFNHILAITGDPTKLGDFPGATSVYDVTSFKLLSLIKQLNQGLSYSGASLRRPTDFTVAAAFNPNVKNLTRTVKLIEKKVASGADYFMTQPIFDHSVLKELADLTKTVEQPFFIGIMPITSYNNAVFLHNEVPGIKLSESFLSALEKVKDDKEACLTLALNESKSLIDEALNYFNGIYLITPFLRYDLTLELIDYIQKKQVRKSS

SEQ ID NO: 6307 - DNA, 741 bp, Streptococcus agalactiae
ttgaataaatcttggttgagaaagggaggtataaaaatggtatgtgtcgattttattgatcaaaaagtttatagtgaagcagaaggcctatttgtttccgatttagacttaggcattaaaggtttaataagagcacgttatccttttgctctggatagtgactttatttcgtatggaaatttaagtcattattgtatgaattatcttgacgaaattgttcagcgagcgaatcagaaaaatgagaagataaaatataatgtgactaccttgatgaaagaagaagagaagcccttcaacgttgaagagcgtttgaacaagcaagcaactatcggtcaacgaattgctgatgatgttgcacgttttggcggatcttggacttttattatcgtttttgtatccattatggctatttggatgttggttaatatcatgaagccttttggtattcaatttgatccttacccatttatcctgttaaacttagctttatcaacgattgctgcaatccaagcaccacttattatgatgagtcaaaatcgtgctgctgattatgatcgtttgcaagctcgaaatgactttaatgtcaataaaacctctgagttagaaattagattattgcacgaaaagattgatcatatggtacaacaagatcagtttgaattgttagagattcaaaagttacagacagaaatgctagtatcattgggaaatcagttagcacaattgaaacaactacaaaaa

SEQ ID NO: 6308 - protein, 247 aa, Streptococcus agalactiae
MNKSWLRKGGIKMVCVDFIDQKVYSEAEGLFVSDLDLGIKGLIRARYPFALDSDFISYGNLSHYCMNYLDEIVQRANQKNEKIKYNVTTLMKEEEKPFNVEERLNKQATIGQRIADDVARFGGSWTFIIVFVSIMAIWMLVNIMKPFGIQFDPYPFILLNLALSTIAAIQAPLIMMSQNRAADYDRLQARNDFNVNKTSELEIRLLHEKIDHMVQQDQFELLEIQKLQTEMLVSLGNQLAQLKQLQK

SEQ ID NO: 6309 - DNA, 1083 bp, Streptococcus agalactiae
atgacaacaaatgtaatggcaaattatagctacggagaagattgcttcaaagaaattcctagcgttttggcaacttaccgtattcaaagcattgctttcgtcggtggcaaacgtgccctagacagctcagaagccgaggttcgctctattttagaggaagcaaatattaaagtcacaggaagctttgtctatggaacggattcaacacaatctaacattgacaagttagtagccaacccacaagttcaagccgctgatgctatcttaggttttggcggtggaaaagctttagacacagctaaaatggtagcaaaagagttaggtaaaaatagctttactatcccaactatttgttctaattgctccgcaggtactgccattgcagttgtatataatgatgaccattctttcttaagatacggctatcccgagtctccacttcatatttttatcaatacacggattattgcacaggcaccaagcaaatatttttgggctggtattggggacggtatttcaaaagcccctgaagtagaacgtgctaccttagaggctaagaccaataaactaccacatactgcagtgttaggacaagcagtcgctctgtcttcaaaggaagctttttatcaatttggtgaacaaggtctaaaagatgttgaagctaatttagcttcgcgtgcagttgaagaaattgcgcttgatatcttaatctcaactggctatgcttctaatttagttaatcaacctgatttctactacaattcttgtcacgcgcatgcattttactatggtacaaccgctattcaaagacaaggtgaattcttacatggcgttgtagttgcgtttggtgtgttagttttacatgcttatttcaacgaactagaagaacttgaaaaagtagctcgttttaataagtcactaggtttgccaacaactctagctgacgtctctttatcagaaaaagatattccaaaaattgttgaaattgcaatgactactaatgaatacaaaaatacccctttcgatcccaaaatgtttgctcaagctattttagcagcagacgctttcggacagacactagcc

SEQ ID NO: 6310 - protein, 361 aa, Streptococcus agalactiae
MTTNVMANYSYGEDCFKEIPSVLATYRIQSIAFVGGKRALDSSEAEVRSILEEANIKVTGSFVYGTDSTQSNIDKLVANPQVQAADAILGFGGGKALDTAKMVAKELGKNSFTIPTICSNCSAGTAIAVVYNDDHSFLRYGYPESPLHIFINTRIIAQAPSKYFWAGIGDGISKAPEVERATLEAKTNKLPHTAVLGQAVALSSKEAFYQFGEQGLKDVEANLASRAVEEIALDILISTGYASNLVNQPDFYYNSCHAHAFYYGTTAIQRQGEFLHGVVVAFGVLVLHAYFNELEELEKVARFNKSLGLPTTLADVSLSEKDIPKIVEIAMTTNEYKNTPFDPKMFAQAILAADAFGQTLA

SEQ ID NO: 6311 - DNA, 537 bp, Streptococcus agalactiae
atgaaaatagcaataatcggatatagtgggtcgggtaagtccactttagcaagaaaattgggaaattactataattgcaatgtattacatcttgatagtattcacttcgccccaaattgggaagagagaaaatatgatgacatgattgacgatgtcagcaacatgttagaaaaaagaacatggattatagaaggtaactacaaaaaactgctatatcaagaacgtctagcagatgcagatgagattattttttttgactttaatcgcttcaactgcttgtggagagcattcaaacgttactgtaagtttcgtggtaagactagacctgatatggccaatggatgcccggaaaaattagattttgaatttatcagttggattcttaaagacggtcgctctgacaaacaaaaatcaaactataaacaagttgttgaggactaccctcaaaaaataaagattctaaaacaccaacgcgatcttgatcaatacctaaaagaactccctgttgcatccaatacagaccctctcaagagcttg

SEQ ID NO: 6312 - protein, 179 aa, Streptococcus agalactiae
MKIAIIGYSGSGKSTLARKLGNYYNCNVLHLDSIHFAPNWEERKYDDMIDDVSNMLEKRTWIIEGNYKKLLYQERLADADEIIFFDFNRFNCLWRAFKRYCKFRGKTRPDMANGCPEKLDFEFISWILKDGRSDKQKSNYKQVVEDYPQKIKILKHQRDLDQYLKELPVASNTDPLKSL

SEQ ID NO: 6313 - DNA, 504 bp, Streptococcus pyogenes
ttgaaaattgccatcattggacatagtggctctggcaagtcaaccttagcacgatttttaggccaacattaccattgtgaggtattccatttagaccaactacacttctcatcgaactggcaagaacggtcagatcatgacatgatagctgatttatcaacatgcctgctcaaacaagatttgattattgaggggaattatgccaattgtctctatgaagagcgcatgagtgaagctgattacattatctatgttaatttcagtcggtttcattgtgtctatcgagcatttaagcgttatttaaactataggggaaaaacgcgtcctgatatggctgacaactgtcaggaaaaatttgacgttgcgtttgtgaaatggattctactagatggacgttcaagaaaccaattaaaaaaataccaatccgttgtccaaaaatactctcataaaaccattgtcttaacaaatcaaaagcagctaagtcattatatgaatacgatcaac

SEQ ID NO: 6314 - protein, 168 aa, Streptococcus pyogenes
LKIAIIGHSGSGKSTLARFLGQHYHCEVFHLDQLHFSSNWQERSDHDMIADLSTCLLKQDLIIEGNYANCLYEERMSEADYIIYVNFSRFHCVYRAFKRYLNYRGKTRPDMADNCQEKFDVAFVKWILLDGRSRNQLKKYQSVVQKYSHKTIVLTNQKQLSHYMNTIN

SEQ ID NO: 6315 - DNA, 216 bp, Streptococcus agalactiae
gtggcaaaagaagatgtgattgaaattgaaggtaaagttgttgaaactatgcctaacgcaatgtttactgttgagttggaaaatggacaccaaattttggcaactgtatcaggaaaaatccgtaaaaactacatccgtattttggtaggtgatcgtgttactgttgaaatgagcccatacgatttaacacgtggacgcatcacataccgctttaaa

SEQ ID NO: 6316 - protein, 72 aa, Streptococcus agalactiae
MAKEDVIEIEGKVVETMPNAMFTVELENGHQILATVSGKIRKNYIRILVGDRVTVEMSPYDLTRGRITYRFK

SEQ ID NO: 6317 - DNA, 201 bp, Streptococcus pyogenes
gtgattgaaattgaaggcaaagtagtagaaacgatgccaaatgcaatgtttactgttgaattggaaaatggacatcaaattctagcaactgtatcaggaaaaatccgcaaaaattacattcgtattttagtaggtgaccgtgttacagtagaaatgagtccttatgacttgacacgtggacgcatcacataccgctttaaa

SEQ ID NO: 6318 - protein, 67 aa, Streptococcus pyogenes
VIEIEGKVVETMPNAMFTVELENGHQILATVSGKIRKNYIRILVGDRVTVEMSPYDLTRGRITYRFK

SEQ ID NO: 6319 - DNA, 636 bp, Streptococcus agalactiae
atgaatcttttaattatgggtttgcctggtgctggtaaaggtactcaagcagctaagatcgttgaagaatttggtgttgctcacatctcaacaggggatatgttccgcgccgcaatggctaatcaaaccgaaatgggacgtttagctaaaagttatattgataaaggtgaattggttcctgatgaagtaacaaacgggattgtaaaagagcgcttagctgaggatgatatcgcagaaaaaggttttttacttgatggatatccacgtactattgaacaagcacacgccttagatgctacgcttgaagaactaggactacgcttagatggtgttattaatattaaagtggatccatcatgtcttatagagcgtttgagtggtcgtattatcaatcgtaaaactggtgaaactttccacaaagtgttcaacccaccagtagattataaagaagaagattactatcaacgtgaagatgataagcctgaaactgtcaaacgtcgcttggacgttaatattgctcaaggagaacctattcttgaacactatcgtaagcttggtcttgttacagatattgaaggtaatcaagaaataacagaagtttttgcagatgttgaaaaagcgttgctagaactcaaa

SEQ ID NO: 6320 - protein, 212 aa, Streptococcus agalactiae
MNLLIMGLPGAGKGTQAAKIVEEFGVAHISTGDMFRAAMANQTEMGRLAKSYIDKGELVPDEVTNGIVKERLAEDDIAEKGFLLDGYPRTIEQAHALDATLEELGLRLDGVINIKVDPSCLIERLSGRIINRKTGETFHKVFNPPVDYKEEDYYQREDDKPETVKRRLDVNIAQGEPILEHYRKLGLVTDIEGNQEITEVFADVEKALLELK

SEQ ID NO: 6321 - DNA, 636 bp, Streptococcus pyogenes
atgaatcttttaatcatgggtttgccgggagctggtaaagggacccaagcagctaagattgttgaagaatttggtattgctcacatctcaacaggggatatgttccgcgccgcaatggctaatcaaaccgaaatgggacgtttagctaaaagttatattgataaaggtgaattggttcctgatgaagtcacaaacgggattgtaaaagagcgcttagctgaggatgatatcgcagaaaaaggttttttgcttgatgggtatccacgtactattgaacaagcacacgccttagatgcaacacttgaagaactaggactccgcttagatggtgttattaatattaaagtggatccatcatgtcttgtagagcgtttgagtggtcgtattatcaatcgtaaaactggtgaaacgttccataaagtgttcaacccaccagtagattataaagaagaagattactatcaacgtgaagatgataagcctgaaactgttaaacgtcgtttggacgtcaatatggctcaaggagaacctattcttgaacactatcgtaagcttggtcttgttacagatattgaaggtaatcaagaaataacagacgtttttgcagatgttgaaaaagcgttgctagaactcaaa

SEQ ID NO: 6322 - protein, 212 aa, Streptococcus pyogenes
MNLLIMGLPGAGKGTQAAKIVEEFGIAHISTGDMFRAAMANQTEMGRLAKSYIDKGELVPDEVTNGIVKERLAEDDIAEKGFLLDGYPRTIEQAHALDATLEELGLRLDGVINIKVDPSCLVERLSGRIINRKTGETFHKVFNPPVDYKEEDYYQREDDKPETVKRRLDVNMAQGEPILEHYRKLGLVTDIEGNQEITDVFADVEKALLELK

SEQ ID NO: 6323 - DNA, 1302 bp, Streptococcus agalactiae
atgtttttaaaattacttagagatgcactcaaagtaaagatggtaagaaataaaattttatttactatctttatccttcttgtatttcgtatcggaacgcatatcacagtaccgggcatcaatgttaagagtttagaacaaatgggtgaacttccatttctaaatatgcttaacttagttagtggtaatgcaatgagaaacttttcggtattctctatgggagttagcccttacattactgcgtctattgttgttcagttacttcaaatggatattcttccgaagtttgttgaatggggaaaacaaggagaggtaggtcgtcgtaagcttaaccaagctacacgttatatttctttgttccttgcattcgtacaatcaattggtattactgctggttttaacactctatcaagtgttgctttagttaaaactccgaatgtacaaacatatttgcttattggtgcaatccttacaacaggtagtatggtggttacttggctaggtgaacaaattactgataagggattcggaaatggagtgtctatgattatctttgcgggtatcatttcttccattccaagtgcaattacaactatctacgaagatttctttgtaaatgtacgctcttcagcaattacaaattcttacatctttgtcgggatccttatcgtagcagtattagcaattgtattttttacaacatttattcaacaagctgaatacaaaattccaatccaatatacaaaacttgttcaaggagctcctacaagttcatatcttcctctaaaagtaaatccagctggtgttattcccgttatctttgctagctcgattacaacaattccaagtacgattattcctttctttcaaaatggcaaagaaattccttggcttactaaactccaagaattacttaattatcaaaccccagtcggtatgattatctatgctatcttgattattctgttctctttcttctatacttttgtacaagtaaaccctgaaaagacagcagagaatcttcaaaaaaattcgtcctacattccaagtattcgaccaggacgagaaacagaagaatatatgtcatcgctattgaaaaaattagcaacaattggttcagtatttctagcatttatttccttgttaccaattattgctcaacaagcgttgcatttgtcatcaagtattgcgttaggtgggacaagcttactcattttgattgcaacgggtattgaaggtatgaaacaactcgagggctatcttttgaagagacgctatgttggattcatgaatacaacagaa

SEQ ID NO: 6324 - protein, 434 aa, Streptococcus agalactiae
MFLKLLRDALKVKMVRNKILFTIFILLVFRIGTHITVPGINVKSLEQMGELPFLNMLNLVSGNAMRNFSVFSMGVSPYITASIVVQLLQMDILPKFVEWGKQGEVGRRKLNQATRYISLFLAFVQSIGITAGFNTLSSVALVKTPNVQTYLLIGAILTTGSMVVTWLGEQITDKGFGNGVSMIIFAGIISSIPSAITTIYEDFFVNVRSSAITNSYIFVGILIVAVLAIVFFTTFIQQAEYKIPIQYTKLVQGAPTSSYLPLKVNPAGVIPVIFASSITTIPSTIIPFFQNGKEIPWLTKLQELLNYQTPVGMIIYAILIILFSFFYTFVQVNPEKTAENLQKNSSYIPSIRPGRETEEYMSSLLKKLATIGSVFLAFISLLPIIAQQALHLSSSIALGGTSLLILIATGIEGMKQLEGYLLKRRYVGFMNTTE

SEQ ID NO: 6325 - DNA, 438 bp, Streptococcus agalactiae
atgaaacttcatgaattaaaacctgcagaaggatcacgtaaagtccgcaatcgtgtgggtcgcggtacatcttcaggtaatggtaaaacttctggacgtggtcaaaaaggacaaaaagcgcgtagtggtggtggagtacgccttggttttgaaggtggacaaactccattgttccgtcgtatgccaaaacgtgggttctcaaacatcaatgcaaaagaatatgctcttgtgaaccttgaccaattaaatgtctttgaagatggtactgaagtaactccagttgttcttaaagaagctggaatcgtgcgtgctgaaaaatcaggcgttaaaattcttggtaatggtgaattaactaagaaattgtctgttaaagcagctaaattttctaaatctgctgaagcagctatcactgctaaaggtggttcaatcgaagtcatc

SEQ ID NO: 6326 - protein, 146 aa, Streptococcus agalactiae
MKLHELKPAEGSRKVRNRVGRGTSSGNGKTSGRGQKGQKARSGGGVRLGFEGGQTPLFRRMPKRGFSNINAKEYALVNLDQLNVFEDGTEVTPVVLKEAGIVRAEKSGVKILGNGELTKKLSVKAAKFSKSAEAAITAKGGSIEVI

SEQ ID NO: 6327 - DNA, 438 bp, Streptococcus pyogenes
atgaaacttcatgaattaaaagctgctgaaggctcacgtaaagtacgtaaccgtgttggtcgtgggacatcatcaggtaatggtaaaacatctggtcgcggtcaaaaaggtcaaaaagctcgtagcggtggcggtgtacgtttaggttttgaaggtggacaaacaccattgttccgtcgtattccaaaacgtggctttacaaatattaatactaaagaatatgcacttgtgaatcttgatcaactgaatgtttttgatgatggtacagaagtgactccggctattttaaaagatgctggtattgtccgagctgaaaaatcaggcgttaaagtgcttggtaacggtgaattgactaaaaaattgactgtaaaagcagctaagttctcaaaatctgctgaagcagctattattgctaaaggtggttcaatcgaagtcatc

SEQ ID NO: 6328 - protein, 146 aa, Streptococcus pyogenes
MKLHELKAAEGSRKVRNRVGRGTSSGNGKTSGRGQKGQKARSGGGVRLGFEGGQTPLFRRIPKRGFTNINTKEYALVNLDQLNVFDDGTEVTPAILKDAGIVRAEKSGVKVLGNGELTKKLTVKAAKFSKSAEAAIIAKGGSIEVI

SEQ ID NO: 6329 - DNA, 177 bp, Streptococcus agalactiae
atggctcaaattaaaattactttgactaagtctccaatcggtcgcaaaccagaacaacgtaaaacagttgttgcccttggacttggtaaattaaactcttcagttgttaaggaagataatgctgccatccgtggtatggttaacgctatctctcacttagtaactgttgaagaagct

SEQ ID NO: 6330 - protein, 59 aa, Streptococcus agalactiae
MAQIKITLTKSPIGRKPEQRKTVVALGLGKLNSSVVKEDNAAIRGMVNAISHLVTVEEA

SEQ ID NO: 6331 - DNA, 180 bp, Streptococcus pyogenes
atggctcaaattaaaattactttgactaagtctcctatcggacgtaagccagaacaacgtaaaactgttgttgctcttggacttggtaaattaaactcttcagtagtcaaagaagataatgctgctatccgtggtatggtgacagctatttctcacttggttaccgttgaagatgttaaa

SEQ ID NO: 6332 - protein, 60 aa, Streptococcus pyogenes
MAQIKITLTKSPIGRKPEQRKTVVALGLGKLNSSVVKEDNAAIRGMVTAISHLVTVEDVK

SEQ ID NO: 6333 - DNA, 273 bp, Streptococcus agalactiae
ttgagccattataatcccctttcttatgctaagtcagaaacagaaatgccacgtaaagcagcaacttcttctgcacgttttaattgtttcaagccctcaacagttgcgcgaacaatgttgattggagtgtttgaaccaagtgatttagatgtaatatctgcaacacctgctaattcgatgacggcacgaacagcacccccagcggcaaccccagcaccctcaacagctggtttcaacaatactttcgctccaccaaattctgaacgaacttcg

SEQ ID NO: 6334 - protein, 91 aa, Streptococcus agalactiae
MSHYNPLSYAKSETEMPRKAATSSARFNCFKPSTVARTMLIGVFEPSDLDVISATPANSMTARTAPPAATPAPSTAGFNNTFAPPNSERTS

SEQ ID NO: 6335 - DNA, 492 bp, Streptococcus agalactiae
atggcatttaaagataatgcagtagaacttgaagagcgcgttgttgcgattaaccgcgttacaaaagttgttaaaggtggacgtcgtctacgttttgcagctcttgtagttgttggtgaccgtaatggtcgtgttggttttggtacaggtaaagctcaagaagtaccagaagctattcgcaaagctgttgaagctgctaagaaaaacatggttgaagttcctatggtcggtacaacaattcctcacgaagttcgttcagaatttggtggagcgaaagtattgttgaaaccagctgttgagggtgctggggttgccgctgggggtgctgttcgtgccgtcatcgaattagcaggtgttgcagatattacatctaaatcacttggttcaaacactccaatcaacattgttcgcgcaactgttgagggcttgaaacaattaaaacgtgcagaagaagttgctgctttacgtggcatttctgtttctgacttagca

SEQ ID NO: 6336 - protein, 164 aa, Streptococcus agalactiae
MAFKDNAVELEERVVAINRVTKVVKGGRRLRFAALVVVGDRNGRVGFGTGKAQEVPEAIRKAVEAAKKNMVEVPMVGTTIPHEVRSEFGGAKVLLKPAVEGAGVAAGGAVRAVIELAGVADITSKSLGSNTPINIVRATVEGLKQLKRAEEVAALRGISVSDLA

SEQ ID NO: 6337 - DNA, 492 bp, Streptococcus pyogenes
atggcatttaaagataatgcagttgaacttgaagaacgcgttgttgcgattaaccgcgttacaaaagttgttaaaggtggacgtcgtcttcgctttgcagctcttgtagttgttggtgatggaaatggtcgtgttggatttggtactggtaaagctcaagaagttccagaagctatccgtaaagcagttgaagctgctaagaaaaacatgatcgaagtaccaatggttggtacaacaatccctcacgaagtttacactaacttcggtggagctaaagtattattgaaaccagctgtagaaggttctggagttgctgctggtggtgcagttcgtgccgtcatcgaattagcaggtgttgctgatattacttcaaaatctcttggttcaaacactccaatcaacattgttcgtgcaactgttgaaggattgaaacaacttaaacgtgcagaagaagttgccgcacttcgtggcatctcagtttctgacttagca

SEQ ID NO: 6338 - protein, 164 aa, Streptococcus pyogenes
MAFKDNAVELEERVVAINRVTKVVKGGRRLRFAALVVVGDGNGRVGFGTGKAQEVPEAIRKAVEAAKKNMIEVPMVGTTIPHEVYTNFGGAKVLLKPAVEGSGVAAGGAVRAVIELAGVADITSKSLGSNTPINIVRATVEGLKQLKRAEEVAALRGISVSDLA

SEQ ID NO: 6339 - DNA, 363 bp, Streptococcus agalactiae
gtgaaaattgtgatttcgaaaccagataaaaataaaatccgccaaaaacgccaccgtcgtgttcgcggtaaactctctggaactgctgatcgcccacgtttgaacattttccgttctaatacaggcatctacgctcaagtaattgatgacgtagcgggtgtaacgctcgcaagtgcatcaactcttgataaagaagtttctaacggaacaaaaacagaacaagccgttgttgtcggtaaacttgttgctgaacgcgcagtagctaaaggtatttctgaagtggtgtttgaccgcggtggatatctctatcacggacgtgtaaaagctttggctgactcagctcgtgaaaacggattgaaattc

SEQ ID NO: 6340 - protein, 121 aa, Streptococcus agalactiae
MKIVISKPDKNKIRQKRHRRVRGKLSGTADRPRLNIFRSNTGIYAQVIDDVAGVTLASASTLDKEVSNGTKTEQAVVVGKLVAERAVAKGISEVVFDRGGYLYHGRVKALADSARENGLKF

SEQ ID NO: 6341 - DNA, 363 bp, Streptococcus pyogenes
gtgaaaattgtgatttcgaaaccagataaaaacaaaatccgccaaaaacgccaccgtcgcgtccgcggtaaactctctggaactgctgatcgcccacgtttgaacgtattccgttctaatacaggcatctacgctcaagttattgatgacgtagcgggtgtaacgctcgcaagtgcatcaactcttgataaagacgtttctaaaggaacaaaaacagaacaagccgttgtagtcggcaaacttgttgctgaacgtgcagtggctaaaggtatttctgaagtggtgtttgaccgcggtggatatctctatcacggacgtgttaaagccttggctgatgcagctcgtgaaaacggattgaaattc

SEQ ID NO: 6342 - protein, 121 aa, Streptococcus pyogenes
VKIVISKPDKNKIRQKRHRRVRGKLSGTADRPRLNVFRSNTGIYAQVIDDVAGVTLASASTLDKDVSKGTKTEQAVVVGKLVAERAVAKGISEVVFDRGGYLYHGRVKALADAARENGLKF

SEQ ID NO: 6343 - DNA, 534 bp, Streptococcus agalactiae
atgtcacgtattggtaataaagtaattacattgcctgcaggtgttgaaatcattaacaaggataatgttgttactgtaaaaggacctaaaggccaactcactcgtgagtttaataaaaatattggaatcactgttgaagggactgaagtaacagttactcgtcctaacgactcaaaagaaatgaaaacaattcatggtacaactcgtgcgaacttgaacaacatggttgttggtgtttctgaaggtttcaaaaaagctcttgaaatgcgcggtgttggttaccgtgcacaacttcaaggatcaaaacttgttctttctgttggtaagtctcaccaagacgaagttgaagctccagaaggtgttacttttgaagtgccaactccaacaacaatcaacgtaatcggtatcaacaaagaaagcgttggacaaactgctgcttacgttcgtagcttacgttcaccagaaccatataaaggtaaaggtattcgttacgttggtgaattcgtacgccgtaaagaaggtaaaacaggtaaa

SEQ ID NO: 6344 - protein, 178 aa, Streptococcus agalactiae
MSRIGNKVITLPAGVEIINKDNVVTVKGPKGQLTREFNKNIGITVEGTEVTVTRPNDSKEMKTIHGTTRANLNNMVVGVSEGFKKALEMRGVGYRAQLQGSKLVLSVGKSHQDEVEAPEGVTFEVPTPTTINVIGINKESVGQTAAYVRSLRSPEPYKGKGIRYVGEFVRRKEGKTGK

SEQ ID NO: 6345 - DNA, 534 bp, Streptococcus pyogenes
atgtcacgtattggtaataaagtaattactatgcctgcaggcgttgaattaacaaataacaacaatgttattactgttaaaggccctaaaggcgaactcactcgtgagttcaacaaaaatattgaaatcaaagttgaagggactgaaatcacagttgtacgtcctaacgactcaaaagaaatgaaaacaatccatggtacaacccgtgctaacttgaataacatggttgtaggtgtttctgaaggtttcaaaaaagatcttgaaatgaagggtgtcggttaccgtgctcaacttcaaggtactaaacttgtcctttcagtaggtaaatctcaccaagacgaagttgaagctccagaaggaattactttcactgttgctaacccaacttcaatctcagttgaaggaatcaacaaagaagttgttggtcaaacagctgcttacatccgtagcttgcgttcaccagagccttacaaaggcaaagggatccgttacgttggtgaatacgtacgccttaaagaaggtaaaacaggtaaa

SEQ ID NO: 6346 - protein, 178 aa, Streptococcus pyogenes
MSRIGNKVITMPAGVELTNNNNVITVKGPKGELTREFNKNIEIKVEGTEITVVRPNDSKEMKTIHGTTRANLNNMVVGVSEGFKKDLEMKGVGYRAQLQGTKLVLSVGKSHQDEVEAPEGITFTVANPTSISVEGINKEVVGQTAAYIRSLRSPEPYKGKGIRYVGEYVRLKEGKTGK

SEQ ID NO: 6347 - DNA, 396 bp, Streptococcus agalactiae
atggttatgactgacccaattgcagactttttaactcgtattcgtaatgctaaccaagcaaaacatgaagtgttagaagtacctgcatcaaacattaaaaaagggattgctgatatccttaaacgtgaaggttttgtaaaaaacgttgaagttattgaagatgacaaacaaggcatcatccgtgtgttccttaaatatggacaaaatggtgaacgtgttatcactaacttgaaacgtatttcaaaaccaggtcttcgtgtttatactaaacatgaagatatgcctaaagttcttaacggacttggtattgcaattgtatcaacttctgaaggtcttttgactgacaaagaagctcgccaaaaaaatattggtggagaagtacttgcatatatttgg

SEQ ID NO: 6348 - protein, 132 aa, Streptococcus agalactiae
MVMTDPIADFLTRIRNANQAKHEVLEVPASNIKKGIADILKREGFVKNVEVIEDDKQGIIRVFLKYGQNGERVITNLKRISKPGLRVYTKHEDMPKVLNGLGIAIVSTSEGLLTDKEARQKNIGGEVLAYIW

SEQ ID NO: 6349 - DNA, 396 bp, Streptococcus pyogenes
atggttatgactgacccaattgcagactttttaacacgtatccgtaatgctaatcaagtaaaacacgaagtgttagaagtacctgcttcaaacattaaaaaagggattgctgagattcttaaacgtgaaggttttgtaaaaaatgttgaagttatcgaagatgataaacaaggcatcattcgtgtgttcttaaaatacggaaaaaatggtgaacgtgttatcactaacttaaaacgtatttcaaaaccaggtcttcgcgtttacgcaaaacgtgatgacatgcctaaagttcttaacggacttggaattgcaatcatttcaacatcagaaggtcttttgactgacaaagaagctcgccaaaagaatgttggtggagaagtgatcgcttacgtttgg

SEQ ID NO: 6350 - protein, 132 aa, Streptococcus pyogenes
MVMTDPIADFLTRIRNANQVKHEVLEVPASNIKKGIAEILKREGFVKNVEVIEDDKQGIIRVFLKYGKNGERVITNLKRISKPGLRVYAKRDDMPKVLNGLGIAIISTSEGLLTDKEARQKNVGGEVIAYVW

SEQ ID NO: 6351 - DNA, 183 bp, Streptococcus agalactiae
ttggctaaaaaatctatgattgctaagaacaaacgcccagcgaagttctctacgcaagcttacactcgttgtgaaaaatgcggacgtccacactcagtttaccgcaaattccaactttgccgtgtttgcttccgtgacttggcttataaaggtcaagtaccaggcgtaactaaagcatcttgg

SEQ ID NO: 6352 - protein, 61 aa, Streptococcus agalactiae
MAKKSMIAKNKRPAKFSTQAYTRCEKCGRPHSVYRKFQLCRVCFRDLAYKGQVPGVTKASW

SEQ ID NO: 6353 - DNA, 183 bp, Streptococcus pyogenes
ttggctaaaaaatctatgattgctaagaacaaacgtcctgcaaaacactctacacaagcttatactcgctgtgaaaaatgtggacgtccacattcagtttaccgcaagtttaaactttgtcgtgtttgcttccgtgaattggcttacaaaggtcaaattccaggtgttgtcaaagcttcttgg

SEQ ID NO: 6354 - protein, 61 aa, Streptococcus pyogenes
LAKKSMIAKNKRPAKHSTQAYTRCEKCGRPHSVYRKFKLCRVCFRELAYKGQIPGVVKASW

SEQ ID NO: 6355 - DNA, 540 bp, Streptococcus agalactiae
atggcaaatcgcttaaaagaaaaatatactaatgaagttgttcctgcgttgacagaaaaatttaactattcatctgttatggctgtgccaaaagttgagaaaatcgttcttaacatgggtgttggtgatgctgtatcaaacgctaaaaatcttgagaaagctgctgctgagttagcacttatttcaggtcaaaaaccacttattactaaagctaagaaatcaatcgctggcttccgtcttcgtgaaggtgtagcgatcggtgcaaaagttaccctgcgcggtgaacgtatgtacgaattcttggataaattagtttctgtttcacttccacgtgtacgtgacttccatggtgttccaacgaaatcatttgatggacgtggaaactacactcttggagttaaagaacaattgatcttcccagaaatcaactttgatgacgttgataaagtacgtggtcttgatatcgttatcgttactactgctaacactgatgaagagtcacgtgaattgctaaaaggccttggaatgccttttgcaaag

SEQ ID NO: 6356 - protein, 180 aa, Streptococcus agalactiae
MANRLKEKYTNEVVPALTEKFNYSSVMAVPKVEKIVLNMGVGDAVSNAKNLEKAAAELALISGQKPLITKAKKSIAGFRLREGVAIGAKVTLRGERMYEFLDKLVSVSLPRVRDFHGVPTKSFDGRGNYTLGVKEQLIFPEINFDDVDKVRGLDIVIVTTANTDEESRELLKGLGMPFAK

SEQ ID NO: 6357 - DNA, 540 bp, Streptococcus pyogenes
atggcaaatcgtttaaaagaaaaatatactaacgaagtaattcctgcgttgacagagaaattcaattacacatcagttatggctgtgccaaaagttgagaaaattgttctcaatatgggtgttggtgatgctgtatccaacgcaaaaaacctagagaaagctgcagctgaattagcacttatctcaggtcaaaaaccacttattactaaagctaagaaatcaatcgctggcttccgtcttcgtgaaggtgtagcgatcggtgcaaaagttaccctccgtggcgaacgtatgtacgaattcctagacaaattggttagcgtttcacttcctcgtgtacgtgacttccatggcgttccaacaaaatcgtttgatggacgcggaaactacactctcggtgtgaaagaacaacttatcttcccagaaatcagctttgatgatgttgataaagtacgtggtcttgatattgtaatcgtcactactgcaaatactgacgaagaatcacgtgaattgcttaagggccttggaatgccttttgcaaaa

SEQ ID NO: 6358 - protein, 180 aa, Streptococcus pyogenes
MANRLKEKYTNEVIPALTEKFNYTSVMAVPKVEKIVLNMGVGDAVSNAKNLEKAAAELALISGQKPLITKAKKSIAGFRLREGVAIGAKVTLRGERMYEFLDKLVSVSLPRVRDFHGVPTKSFDGRGNYTLGVKEQLIFPEISFDDVDKVRGLDIVIVTTANTDEESRELLKGLGMPFAK

SEQ ID NO: 6359 - DNA, 303 bp, Streptococcus agalactiae
atgtttgtaaaaaaaggcgacaaagttcgcgttattgctggtaaggacaaaggcactgaagctgtagttcttaaagctcttccaaaagtaaacaaagttgttgttgaaggcgtagccctcatcaagaaacatcaaaaaccaaataacgaaaaccctcaaggcgctatcgttgaaaaagaagctccaatccatgtgtcaaacgttcaagttcttgataaaaatggtgtagcaggacgtgttggttacaaagttgttgacggcaaaaaagttcgttacaacaaaaaatcaggcgaagtgcttgat

SEQ ID NO: 6360 - protein, 101 aa, Streptococcus agalactiae
MFVKKGDKVRVIAGKDKGTEAVVLKALPKVNKVVVEGVALIKKHQKPNNENPQGAIVEKEAPIHVSNVQVLDKNGVAGRVGYKVVDGKKVRYNKKSGEVLD

SEQ ID NO: 6361 - DNA, 303 bp, Streptococcus pyogenes
atgtttgtaaaaaaaggcgacaaagttcgcgtaattgctggcaaggacaaaggcactgaagctgtagttcttaaagcacttccaaaagttaacaaagttattgttgaaggtgttggaatgattaaaaaacaccaaaaacctaacactgaaaatcctcaaggagctatcgtcgaaaaagaagcacctatccatgtctctaatgttcaagtattagataaaaatggtgtagctggacgtattggttataaagttgttgacggtaaaaaagtacgttacagcaaaaaatcaggcgaagtgcttgat

SEQ ID NO: 6362 - protein, 101 aa, Streptococcus pyogenes
MFVKKGDKVRVIAGKDKGTEAVVLKALPKVNKVIVEGVGMIKKHQKPNTENPQGAIVEKEAPIHVSNVQVLDKNGVAGRIGYKVVDGKKVRYSKKSGEVLD

SEQ ID NO: 6363 - DNA, 366 bp, Streptococcus agalactiae
atgattcaacaagaaactcgcttgaaagttgctgataatagcggtgctcgtgagatcttgactatcaaagtacttggtggttcaggacgtaaattcgctaacatcggtgacgtaatcgttgcttctgtaaaacaagctactcctggtggagcagttaaaaaaggtgatgtggttaaagctgttatcgttcgtacaaaaactggtgcacgccgcccagacggttcatacatcaaatttgacgacaatgctgctgtaatcatccgtgacgataaaactcctcgcggaactcgtatctttggcccagttgcacgtgaattgcgtgaaggtggctacatgaagatcgtttcattggcaccagaagtactt

SEQ ID NO: 6364 - protein, 122 aa, Streptococcus agalactiae
MIQQETRLKVADNSGAREILTIKVLGGSGRKFANIGDVIVASVKQATPGGAVKKGDVVKAVIVRTKTGARRPDGSYIKFDDNAAVIIRDDKTPRGTRIFGPVARELREGGYMKIVSLAPEVL

SEQ ID NO: 6365 - DNA, 366 bp, Streptococcus pyogenes
atgattcaacaagaaactcgcttgaaagttgctgataatagcggtgctcgtgagatcttgactatcaaagtacttggtggttcaggacgtaaattcgctaacatcggtgacgtaatcgttgcttctgtaaaacaagctactcctggtggagcagttaaaaaaggtgatgtggttaaagctgttatcgttcgtacaaaaactggtgcacgccgtccagacggttcatacatcaaatttgacgacaatgctgctgtaatcatccgtgatgataaaactcctcgcggaactcgtatctttggcccagttgcacgcgaattgcgtgagggtggctacatgaagatcgtatcacttgcaccagaagtactt

SEQ ID NO: 6366 - protein, 122 aa, Streptococcus pyogenes; identical to SEQ ID NO: 6364

SEQ ID NO: 6367 - DNA, 258 bp, Streptococcus agalactiae
atggaacgtaatcaacgtaaaactctttacggacgcgtagtgtctgacaagatggacaaaacaatcacagttgtagttgaaactaaacgtaaccacccagtctatggtaaacgtatcaactattctaaaaaatataaagcacatgatgaaaacaacgttgctaaagaaggcgatatcgttcgtatcatggaaactcgcccactttcagctacaaaacgtttccgtcttgtggaagtagtggaaaaagctgttattatc

SEQ ID NO: 6368 - protein, 86 aa, Streptococcus agalactiae
MERNQRKTLYGRVVSDKMDKTITVVVETKRNHPVYGKRINYSKKYKAHDENNVAKEGDIVRIMETRPLSATKRFRLVEVVEKAVII

SEQ ID NO: 6369 - DNA, 258 bp, Streptococcus pyogenes
atggaacgtaatcaacgtaaaactctttacggacgcgtagtgtctgacaagatggacaaaacaatcacagttgtagttgaaactaaacgtaaccacccagtctatggtaaacgtatcaactattctaaaaaatataaagcacatgacgaaaacaacgttgctaaagaaggcgatatcgttcgtatcatggaaactcgcccactttcagctacaaaacgtttccgtcttgtggaagtagtggaaaaagctgttattatc

SEQ ID NO: 6370 - protein, 86 aa, Streptococcus pyogenes; identical to SEQ ID NO: 6368

SEQ ID NO: 6371 - DNA, 204 bp, Streptococcus agalactiae
atgaaacttcaagaaattaaagattttgttaaagagcttcgtggattgtctcaagaagaacttgctaagaaagaaaacgaactcaaaaaagaattgtttgatcttcgtttccaagctgcagcaggtcaacttgaaaagactgctcgccttgacgaagttaagaaacaaattgcacgtgttaaaactgtgcaatcagaaatgaaa

SEQ ID NO: 6372 - protein, 68 aa, Streptococcus agalactiae
MKLQEIKDFVKELRGLSQEELAKKENELKKELFDLRFQAAAGQLEKTARLDEVKKQIARVKTVQSEMK

SEQ ID NO: 6373 - DNA, 411 bp, Streptococcus agalactiae
atgttagtacctaaacgtgttaaacaccgtcgcgaattccgtggaaaaatgcgcggtgaggctaaaggtggtaaagaagtttcattcggtgaatacggacttcaagctacaactagccactggattacaaaccgtcaaatcgaagctgcccgtattgcgatgactcgttacatgaaacgtggtggtaaagtttggattaaaatcttcccacacaaatcatacactgcaaaagctatcggtgtacgtatgggttctggtaaaggggcacctgaaggttgggtagcaccagttaaacgtggtaaagtgatgtttgaaattgctggtgtttctgaagaagttgcacgtgaagcattacgtcttgctagccacaaattaccagttaaatgcaaattcgtaaaacgtgaagcagaa

SEQ ID NO: 6374 - protein, 137 aa, Streptococcus agalactiae
MLVPKRVKHRREFRGKMRGEAKGGKEVSFGEYGLQATTSHWITNRQIEAARIAMTRYMKRGGKVWIKIFPHKSYTAKAIGVRMGSGKGAPEGWVAPVKRGKVMFEIAGVSEEVAREALRLASHKLPVKCKFVKREAE

SEQ ID NO: 6375 - DNA, 411 bp, Streptococcus pyogenes
atgttagtacctaaacgtgttaaacaccgtcgcgaattccgtggaaaaatgcgcggtgaggctaaaggtggtaaagaagtttcattcggtgaatacggacttcaagccacaactagccactggattacaaaccgtcaaatcgaagctgcccgtattgcgatgactcgttacatgaaacgtggtggtaaagtttggattaaaatcttcccacacaaatcatacactgcaaaagctatcggtgtacgtatgggttctggtaaaggggcacctgaaggttgggtagcaccagttaaacgtggtaaagtgatgtttgaaattgctggtgtttctgaagaaattgctcgcgaagcattacgtcttgctagccacaaattaccagttaagtgcaaattcgtaaaacgtgaagcagaa

SEQ ID NO: 6376 - protein, 137 aa, Streptococcus pyogenes
MLVPKRVKHRREFRGKMRGEAKGGKEVSFGEYGLQATTSHWITNRQIEAARIAMTRYMKRGGKVWIKIFPHKSYTAKAIGVRMGSGKGAPEGWVAPVKRGKVMFEIAGVSEEIAREALRLASHKLPVKCKFVKREAE

SEQ ID NO: 6377 - DNA, 651 bp, Streptococcus agalactiae
gtgggtcaaaaagtacatccaattggtatgcgtgtcggaatcatccgtgactgggatgcgaaatggtatgctgaaaaagaatacgcggattaccttcatgaagatcttgcaatccgtaaattcattaataaagaattagctgacgcatcagtttcaactattgaaattgaacgtgcagtaaacaaagttattgtttcacttcacactgctaaaccaggtatggttatcggtaaaggtggagcaaacgttgacgctcttcgtggtcaacttaacaaattaactggaaaacaagtacacatcaacatcattgaaatcaaacaacctgatttagatgctcaccttgttggtgaaaatattgctcgtcaattagagcaacgtgttgctttccgtcgtgctcaaaaacaagcaatccaacgtacaatgcgtgcaggagctaaaggtattaaaactcaagtttctggtcgtttgaacggtgctgatatcgctcgtgctgaaggttattcagaaggaactgttccgcttcacacgcttcgtgctgatatcgactatgcttgggaagaagctgacacaacttatggtaaacttggcgttaaagtttggatttaccgtggagaagttcttccagctcgtaaaaacactaaaggaggcaaa

SEQ ID NO: 6378 - protein, 217 aa, Streptococcus agalactiae
MGQKVHPIGMRVGIIRDWDAKWYAEKEYADYLHEDLAIRKFINKELADASVSTIEIERAVNKVIVSLHTAKPGMVIGKGGANVDALRGQLNKLTGKQVHINIIEIKQPDLDAHLVGENIARQLEQRVAFRRAQKQAIQRTMRAGAKGIKTQVSGRLNGADIARAEGYSEGTVPLHTLRADIDYAWEEADTTYGKLGVKVWIYRGEVLPARKNTKGGK

SEQ ID NO: 6379 - DNA, 651 bp, Streptococcus pyogenes
gtgggtcaaaaagtacatccaattggtatgcgtgtcggaatcatccgtgactgggatgcgaaatggtatgctgaaaaagaatacgcggattaccttcatgaagatcttgcaatccgtaaattcattaataaagaattagctgacgcatcagtttcaactattgaaattgaacgtgcagtaaacaaagttattgtttcacttcacactgctaaaccaggtatggttatcggtaaaggtggcgcaaacgttgacgctcttcgtggtcaacttaacaaattaactggaaaacaagtacacatcaacatcatcgaaatcaaacaacctgatttagatgctcaccttgttggtgaaaacattgctcgtcaacttgagcaacgtgttgctttccgtcgtgctcaaaaacaagcaatccaacgtacaatgcgtgcaggagctaaagggattaaaactcaagtttctggtcgtttgaacggtgctgatatcgctcgtgctgaaggttattcagaaggaactgttccacttcacacgcttcgcgctgatatcgactatgcttgggaagaagctgacacaacttatggtaaacttggcgttaaagtttggatttaccgtggagaagttcttccagctcgtaaaaacactaaaggaggcaaa

SEQ ID NO: 6380 - protein, 217 aa, Streptococcus pyogenes
VGQKVHPIGMRVGIIRDWDAKWYAEKEYADYLHEDLAIRKFINKELADASVSTIEIERAVNKVIVSLHTAKPGMVIGKGGANVDALRGQLNKLTGKQVHINIIEIKQPDLDAHLVGENIARQLEQRVAFRRAQKQAIQRTMRAGAKGIKTQVSGRLNGADIARAEGYSEGTVPLHTLRADIDYAWEEADTTYGKLGVKVWIYRGEVLPARKNTKGGK

SEQ ID NO: 6381 - DNA, 342 bp, Streptococcus agalactiae
atggcagaaattacttcagctaaagcaatggctcgtacagtgcgtgtttcacctcgtaaaacacgtttagtacttgatcttatccgtggtaagaatgttgctgacgcaatcgcaatcttaaaattcactccaaacaaagcagctcgtgttattgagaaaactcttaactcagcaattgcaaatgcagaaaacaactttggtttggaaaaagcaaacttggtagtatctgaaacattcgctaacgaaggaccaacaatgaaacgtttccgtccacgtgcgaaaggttcagcttcaccaatcaacaaacgtacaactcacgtaactgtagttgtatcagaaaaa

SEQ ID NO: 6382 - protein, 114 aa, Streptococcus agalactiae
MAEITSAKAMARTVRVSPRKTRLVLDLIRGKNVADAIAILKFTPNKAARVIEKTLNSAIANAENNFGLEKANLVVSETFANEGPTMKRFRPRAKGSASPINKRTTHVTVVVSEK

SEQ ID NO: 6383 - DNA, 342 bp, Streptococcus pyogenes
atggcagaaattacttcagctaaagcaatggctcgtacagtgcgtgtttcacctcgtaaaacacgtttagtacttgatcttatccgtggtaagaaagttgctgacgcaatcgcaatcttaaaattcactccaaacaaagcagctcgtgttattgagaaaactcttaactcagcaattgctaacgcagaaaacaactttggtttggaaaaagcaaacttggtagtatctgaaacattcgctaacgaaggaccaacaatgaaacgtttccgtccacgtgcgaaaggttcagcttcaccaatcaacaaacgtacaactcacgtaactgtagttgtatcagaaaaa

SEQ ID NO: 6384 - protein, 114 aa, Streptococcus pyogenes
MAEITSAKAMARTVRVSPRKTRLVLDLIRGKKVADAIAILKFTPNKAARVIEKTLNSAIANAENNFGLEKANLVVSETFANEGPTMKRFRPRAKGSASPINKRTTHVTVVVSEK

SEQ ID NO: 6385 - DNA, 276 bp, Streptococcus agalactiae
atgggacgtagtcttaaaaaaggacctttcgtcgacgagcatttaatgaaaaaagttgaagctcaagcaaatgacgaaaagaaaaaagtaatcaaaacttggtcacgtcgttcaacgattttcccaagtttcatcggatacacaatcgcagtttatgatggacgtaaacatgttcctgtttatatccaagaggacatggtaggtcacaaacttggtgaatttgcaccaacacgtacttacaaaggtcacgcagctgacgacaagaaaacacgtcgt

SEQ ID NO: 6386 - protein, 92 aa, Streptococcus agalactiae
MGRSLKKGPFVDEHLMKKVEAQANDEKKKVIKTWSRRSTIFPSFIGYTIAVYDGRKHVPVYIQEDMVGHKLGEFAPTRTYKGHAADDKKTRR

SEQ ID NO: 6387 - DNA, 330 bp, Streptococcus pyogenes
ttgctcttgaattcaagccgctgtggtacattatttaaaggagaaaactacaaaatgggacgtagtcttaaaaaaggacctttcgtcgatgagcatttgatgaaaaaagttgaagctcaagcaaacgacgaaaagaaaaaagtaatcaaaacttggtcacgtcgttcaacgattttcccaagtttcatcggatatacaatcgcagtttatgacggacgtaaacatgtacctgtttacatccaagaagacatggtaggtcacaaacttggtgaatttgcaccaacgcgtacttacaaaggtcacgcagctgacgacaagaaaacacgtcgt

SEQ ID NO: 6388 - protein, 110 aa, Streptococcus pyogenes
LLLNSSRCGTLFKGENYKMGRSLKKGPFVDEHLMKKVEAQANDEKKKVIKTWSRRSTIFPSFIGYTIAVYDGRKHVPVYIQEDMVGHKLGEFAPTRTYKGHAADDKKTRR

SEQ ID NO: 6389 - DNA, 831 bp, Streptococcus agalactiae
gtgggtattaaagtttataaaccaacgacaaatggccgtcgtaatatgacttctttggattttgcagaaatcactacaaacactcctgagaaatcattgcttgtttcactaaagaataaagcaggacgtaacaacaacggacgtattactgttcgtcaccaaggtggtggacacaaacgtcattaccgtttgattgacttcaaacgtaataaagatggtgttgaagcagttgttaaaacaattgaatacgatccaaatcgtactgcaaatattgctcttgtacactatactgatggtgttaaagcttacatccttgcgcctaaaggccttgaagtaggtcaacgcattatttctggtccagaagcagacatcaaagttggtaacgcacttccgcttgctaacattccagtcggtacagttatccataatattgaattgcaaccaggtaaaggtgctgaattgattcgtgccgctggtgcttctgctcaagtacttggtcaagaaggtaaatatgttcttgttcgccttcaatcaggtgaagtacgtatgatccttggtacttgccgtgcaacaattggtactgttggtaatgaacagcaatcacttgttaacattggtaaagcaggacgtaatcgttggaaaggtgttcgccctacagttcgtggttctgtaatgaaccctaacgatcacccacacggtggtggtgaaggtaaagcaccagttggtcgtaaagcaccatctactccatggggtaaacctgcgcttggacttaaaactcgtaataagaaagctaaatcagacaaacttattgttcgtcgtcgtaaccaaaaa

SEQ ID NO: 6390 - protein, 277 aa, Streptococcus agalactiae
MGIKVYKPTTNGRRNMTSLDFAEITTNTPEKSLLVSLKNKAGRNNNGRITVRHQGGGHKRHYRLIDFKRNKDGVEAVVKTIEYDPNRTANIALVHYTDGVKAYILAPKGLEVGQRIISGPEADIKVGNALPLANIPVGTVIHNIELQPGKGAELIRAAGASAQVLGQEGKYVLVRLQSGEVRMILGTCRATIGTVGNEQQSLVNIGKAGRNRWKGVRPTVRGSVMNPNDHPHGGGEGKAPVGRKAPSTPWGKPALGLKTRNKKAKSDKLIVRRRNQK

SEQ ID NO: 6391 - DNA, 831 bp, Streptococcus pyogenes
gtgggtattaaagtttataaaccaacgacaaatggccgtcgtaacatgacttctttggatttcgcggaaatcacaacaagcacgcctgagaaatcattgcttgtttctcttaagagcaaagctggtcgtaacaacaatggtcgcatcacagttcgtcaccaaggtggtggacacaaacgtcattaccgtttgatcgacttcaaacgtaacaaagatggcgttgaagcagttgttaaaacaatcgaatacgatccaaaccgtactgcaaacatcgcacttgtacattacactgacggtgtgaaagcttacatcattgcacctaaaggtcttgaagtaggtcaacgtattgtttctggtccagatgcagatatcaaagttggtaacgcacttccattagcaaacattcctgtcggtacagttgttcacaatattgagttgaaacctggtaaaggtggagaacttgttcgtgcagctggagcttctgctcaagtacttggtcaagaaggtaaatacgttcttgttcgtcttcaatcaggcgaagttcgtatgattcttggtacatgccgtgcaactatcggtactgttggtaacgaacaacaatcacttgttaacattggtaaagcaggacgtagccgttggaaaggtatccgcccaacagttcgtggttctgtaatgaaccctaacgatcacccacacggtggtggtgaaggtaaagcaccagttggacgtaaagcgccatcaactccatggggtaaaccagcgcttggtcttaaaactcgtaacaagaaagctaaatcagacaaacttatcgttcgtcgtcgtaacgaaaaa

SEQ ID NO: 6392 - protein, 277 aa, Streptococcus pyogenes
VGIKVYKPTTNGRRNMTSLDFAEITTSTPEKSLLVSLKSKAGRNNNGRITVRHQGGGHKRHYRLIDFKRNKDGVEAVVKTIEYDPNRTANIALVHYTDGVKAYIIAPKGLEVGQRIVSGPDADIKVGNALPLANIPVGTVVHNIELKPGKGGELVRAAGASAQVLGQEGKYVLVRLQSGEVRMILGTCRATIGTVGNEQQSLVNIGKAGRSRWKGIRPTVRGSVMNPNDHPHGGGEGKAPVGRKAPSTPWGKPALGLKTRNKKAKSDKLIVRRRNEK

SEQ ID NO: 6393 - DNA, 294 bp, Streptococcus agalactiae
atgaatttgtatgacgtaatcaaaaaacctgttatcactgagaaatcaatggttgctcttgaagcagggaaatatacatttgaagttgacacacgtgcacacaaacttttgatcaaacaagctgttgaagctgcatttgacggagtaaaagttgcaagtgtaaacactgtgacagttaaacccaaagcaaaacgtgttggtcgttacacaggtttcacttcaaaaactaaaaaagctattatcactcttacagctgattcaaaagcaatcgagttgtttgctgctgaagctgaa

SEQ ID NO: 6394 - protein, 98 aa, Streptococcus agalactiae
MNLYDVIKKPVITEKSMVALEAGKYTFEVDTRAHKLLIKQAVEAAFDGVKVASVNTVTVKPKAKRVGRYTGFTSKTKKAIITLTADSKAIELFAAEAE

SEQ ID NO: 6395 - DNA, 294 bp, Streptococcus pyogenes
atgaatttgtacgacgtaatcaaaaaaccagttatcactgagaagtcaatgattgctcttgaagcaggcaaatacactttcgaagttgatactcgtgcacacaaacttttgatcaaacaagctgttgaagctgcttttgacggagttaaagttgcaagtgtaaacactgttaacgttaaaccaaaagcaaaacgcgttggtcgttacacaggtttcacttcaaaaactaaaaaagctatcatcactcttacagctgattctaaagcaatcgagttgttcgcagctgaagctgaa

SEQ ID NO: 6396 - protein, 98 aa, Streptococcus pyogenes
MNLYDVIKKPVITEKSMIALEAGKYTFEVDTRAHKLLIKQAVEAAFDGVKVASVNTVNVKPKAKRVGRYTGFTSKTKKAIITLTADSKAIELFAAEAE

SEQ ID NO: 6397 - DNA, 621 bp, Streptococcus agalactiae
atggcaaacgttaaactatttgaccaaactggtaaagaagttagctcagttgagcttaacgaagctatcttcggtattgaaccaaacgaatcagttgtttttgatgttgtaatcagccaacgcgctagccttcgccaaggaactcacgcggttaaaaaccgttcagcagtatctggtggtggacgtaaaccatggcgtcaaaaaggaactggacgcgctcgtcaaggttctatccgctcaccacaatggcgtggtggtggtgttgtctttggaccaactccacgttcatacggctacaaacttccacaaaaagttcgtcgccttgcgttgaaatcagtttattcagcaaaagttgctgaagataaatttgtagctgtagaaaacctttcatttgcagctccaaaaactgctgaatttgcgtcagttctttcagcacttagcattgattcaaaagtacttgtaatccttgaagaaggtaacgaatttgctgcactttcagcgcgtaaccttccaaacgttacagttgctactgcaactactgcaagtgttcttgatatcgttaacgcagacaaacttcttgttactaaagaagcaatctctacaatcgagggggttcttgca

SEQ ID NO: 6398 - protein, 207 aa, Streptococcus agalactiae
MANVKLFDQTGKEVSSVELNEAIFGIEPNESVVFDVVISQRASLRQGTHAVKNRSAVSGGGRKPWRQKGTGRARQGSIRSPQWRGGGVVFGPTPRSYGYKLPQKVRRLALKSVYSAKVAEDKFVAVENLSFAAPKTAEFASVLSALSIDSKVLVILEEGNEFAALSARNLPNVTVATATTASVLDIVNADKLLVTKEAISTIEGVLA

SEQ ID NO: 6399 - DNA, 621 bp, Streptococcus pyogenes
atggcaaacgtaaaactatttgaccaaactggtaaagaagttagctcagttgaattaaacgacgctatcttcggtatcgaaccaaacgaatcagttgtttttgatgttgtaattagccaacgcgctagccttcgccaaggtactcatgcggttaaaaaccgttcagcagtatcaggtggtggacgtaaaccatggcgtcaaaaaggaactggacgcgctcgtcaaggttctatccgctcaccacaatggcgtggtggtggtgttgtctttggaccaactccccgttcatacggatacaaacttccacaaaaagttcgtcgccttgcgttgaaatcagtttactcagcaaaagttgctgaagataaatttgtagctgtagaaggcctttcatttgcagcaccaaaaactgctgaatttgcaaaagtgctttcagctcttagcattgatacaaaagtacttgttcttgttgaagaaggaaatgaatttgcagcactttctgcacgtaaccttccaaacgtaactgttgcaactgcagcaactgcaagtgttcttgatatcgtgaacgcagacaaacttcttgttactaaagaagcaatctctacaattgaggaggttcttgca

SEQ ID NO: 6400 - protein, 207 aa, Streptococcus pyogenes
MANVKLFDQTGKEVSSVELNDAIFGIEPNESVVFDVVISQRASLRQGTHAVKNRSAVSGGGRKPWRQKGTGRARQGSIRSPQWRGGGVVFGPTPRSYGYKLPQKVRRLALKSVYSAKVAEDKFVAVEGLSFAAPKTAEFAKVLSALSIDTKVLVLVEEGNEFAALSARNLPNVTVATAATASVLDIVNADKLLVTKEAISTIEEVLA

SEQ ID NO: 6401 - DNA, 624 bp, Streptococcus agalactiae
atgacaaaaggaatcttagggaaaaaagtgggaatgactcaaatcttcactgaatcaggcgaattcatccctgttactgtcattgaagcaactccaaacgttgtgcttcaagttaaaactgttgaaacagacggttacgaagcagttcaggttggttttgatgacaaacgtgaagtattgagtaacaaacctgccaaaggccatgttgcaaaagcaaacacagctcctaagcgcttcattcgtgaattcaaaaacattgaaggcttagaagttggtgcagaattatctgtagaacaatttgaagctggtgatgttgttgacgtcacagggacatcaaaaggtaaaggtttccaaggtgttatcaaacgccatggtcaatcacgtggtcctatggctcacggttctcgttaccatcgtcgtccaggttctatgggacctgttgcgcctaaccgcgttttcaaaaacaaacgcttggcaggacgtatgggtggtaaccgtgtaacagttcaaaaccttgaaattgtacaagttatcccagagaaaaacgttgtcctcatcaaaggtaacgtaccaggtgctaagaaatctcttatcactatcaaatcagcagttaaagctgctaaa

SEQ ID NO: 6402 - protein, 208 aa, Streptococcus agalactiae
MTKGILGKKVGMTQIFTESGEFIPVTVIEATPNVVLQVKTVETDGYEAVQVGFDDKREVLSNKPAKGHVAKANTAPKRFIREFKNIEGLEVGAELSVEQFEAGDVVDVTGTSKGKGFQGVIKRHGQSRGPMAHGSRYHRRPGSMGPVAPNRVFKNKRLAGRMGGNRVTVQNLEIVQVIPEKNVVLIKGNVPGAKKSLITIKSAVKAAK

SEQ ID NO: 6403 - DNA, 624 bp, Streptococcus pyogenes
atgacaaaaggaatcttagggaaaaaagtgggaatgactcaaattttcactgaatcaggcgaattcatccctgttactgtcattgaagcaactccaaacgttgtgcttcaagttaaaactgttgaaacagacggttatgaagcagttcaggttggttttgatgacaaacgtgaagtcttgagtaacaaacctgccaaaggccatgttgcaaaagcaaacacagctcctaagcgcttcattcgtgaattcaaaaacattgaaggcttagaagttggtgcagaattatctgtagaacaatttgaagctggtgatgttgttgacgtcacagggatatcaaaaggtaaaggtttccaaggtgttatcaaacgccatggtcaatcacgtggtcctatggctcacggttctcgttaccatcgtcgcccaggttctatgggacctgttgcgcctaaccgcgttttcaaaaacaaacgcttggcaggacgtatgggtggtaaccgtgtaacagttcaaaaccttgaaattgtacaagttatcccagaaaagaacgttatccttgttaaaggtaacgtaccaggtgctaagaaatctcttatcactatcaagtcagcagttaaagctgctaaa

SEQ ID NO: 6404 - protein, 208 aa, Streptococcus pyogenes
MTKGILGKKVGMTQIFTESGEFIPVTVIEATPNVVLQVKTVETDGYEAVQVGFDDKREVLSNKPAKGHVAKANTAPKRFIREFKNIEGLEVGAELSVEQFEAGDVVDVTGISKGKGFQGVIKRHGQSRGPMAHGSRYHRRPGSMGPVAPNRVFKNKRLAGRMGGNRVTVQNLEIVQVIPEKNVILVKGNVPGAKKSLITIKSAVKAAK

SEQ ID NO: 6405 - DNA, 114 bp, Streptococcus agalactiae
atgagaaaatatttccttttcttattttatttcaaaaagttttttatgagcgttttttgtgctcaaaaaagttttttacgagcgttttttgtgctcagaaatcaaattaaagtt

SEQ ID NO: 6406 - protein, 38 aa, Streptococcus agalactiae
MRKYFLFLFYFKKFFMSVFCAQKSFLRAFFVLRNQIKV

SEQ ID NO: 6407 - DNA, 306 bp, Streptococcus agalactiae
atggcaaacaaaaaaatccgtatccgtttgaaagcgtacgaacaccgtacacttgatacagcggcagaaaaaatcgttgaaactgcaacacgtacaggtgctacagttgctggaccagttccgcttccaactgaacgcagtctttacacaattattcgtgcgactcacaaatataaagattctcgcgaacagtttgaaatgcgtacacacaaacgtttggtagacatcatcaacccaacacaaaaaactgttgatgctttgatgaaacttgatcttccaagtggtgtcaacgtagaaatcaaactt

SEQ ID NO: 6408 - protein, 102 aa, Streptococcus agalactiae
MANKKIRIRLKAYEHRTLDTAAEKIVETATRTGATVAGPVPLPTERSLYTIIRATHKYKDSREQFEMRTHKRLVDIINPTQKTVDALMKLDLPSGVNVEIKL

SEQ ID NO: 6409 - DNA, 306 bp, Streptococcus pyogenes
atggcaaacaaaaaaatccgtatccgtttgaaagcgtacgaacaccgtacacttgatacagcggcagaaaaaatcgttgaaactgcaacacgtacaggtgctacagttgctggaccagttccacttccaactgaacgcagtctttacacaattattcgtgcgactcacaaatacaaagattctcgcgaacaatttgaaatgcgtacacacaaacgtttggtagacatcatcaatccaacacaaaaaactgttgatgctttgatgaaacttgatcttccaagtggtgtcaacgtagaaatcaaactt

SEQ ID NO: 6410 - protein, 102 aa, Streptococcus pyogenes; identical to SEQ ID NO: 6408

SEQ ID NO: 6411 - DNA, 111 bp, Streptococcus agalactiae
gtggctgtttttgaaagttcactatcatcgatatattcaaaaaatgtaaccagaaatggttgcatttttttcgaaaataataaaataatgcttgcgtgtgctgtttttttt

SEQ ID NO: 6412 - protein, 37 aa, Streptococcus agalactiae
MAVFESSLSSIYSKNVTRNGCIFFENNKIMLACAVFF

SEQ ID NO: 6413 - DNA, 1278 bp, Streptococcus agalactiae
gtgcgttatagtaaagagattattcagttagctataccagctatgattgaaaatatcttacaaatgctcatgggagtagttgataattatctagtggctcagttaggtgttgtagcagtatcaggtgtttcagttgctaataatataattactatttatcaagctatttttatagctttaggggcgagtatagcaagtctattggccaagtcgttagcaggtagtaagaaggatgatgcaatttcagtatgttctcaagccatttttctaacattactgataggggcagtattaggaattatctcgattgtttttggacaaactttctttaaacttttagggacaacaaaaagtgtcgcacaagttggtggtttatatttagcaattgtgggtggaggtgttgttactttaggaatgttaaccaccctaggctcatttttacgtgtgcaagggcaacctcgtttaccaatgtatgtcagtatttttgtcaatttcctcaatgcagtcttatcaggttttgctatttttgagtggcgctatggtttggtcggagtggcagtatcaactcttatcgcaagattaattggtatttgtatccttgcgaagtatcttcctattaaaaagataataaaaagaatgacttggaaaatcagtgcacaaatttggaatcttgccttaccatcagcaggagaacgtctgatgatgcgagctggagatgttgttatagttgctattgttgttcagttaggtacaaatgttgtagcgggaaatgctattggagaaaccttgacacaatttaattatatgccaggacttggcatcgcaactgctacaattatcctaactgcaaaatatgtaggacaaaaaaacagagaatctatagaagaaactattcaaagttcgtattatattggcttagttctaatgatccttatatcaagttttatgcttcttgcaggcaaaccattgacacagttatttacaaataatccttctgccattaaaggaagtttgattgttattttgctatctttcgtaggagtacctgctactattgggaccttggtttatacagcagcttggcaaggattaggaaatgctaaactcccattttacacaacgactataggcatgtggttaatcagagtagttcttggttatttattaggaatagtttttgaattaggtttgcttggggtttggatggctacgatagcagacaatatctttaggtggctgtttttgaaagttcactatcatcgatatattcaaaaaatg

SEQ ID NO: 6414 - protein, 426 aa, Streptococcus agalactiae
MRYSKEIIQLAIPAMIENILQMLMGVVDNYLVAQLGVVAVSGVSVANNIITIYQAIFIALGASIASLLAKSLAGSKKDDAISVCSQAIFLTLLIGAVLGIISIVFGQTFFKLLGTTKSVAQVGGLYLAIVGGGVVTLGMLTTLGSFLRVQGQPRLPMYVSIFVNFLNAVLSGFAIFEWRYGLVGVAVSTLIARLIGICILAKYLPIKKIIKRMTWKISAQIWNLALPSAGERLMMRAGDVVIVAIVVQLGTNVVAGNAIGETLTQFNYMPGLGIATATIILTAKYVGQKNRESIEETIQSSYYIGLVLMILISSFMLLAGKPLTQLFTNNPSAIKGSLIVILLSFVGVPATIGTLVYTAAWQGLGNAKLPFYTTTIGMWLIRVVLGYLLGIVFELGLLGVWMATIADNIFRWLFLKVHYHRYIQKM

SEQ ID NO: 6415 - DNA, 1290 bp, Streptococcus pyogenes
atgatatataataatagaagaaaaattttctctttagctctgccttctatgatagaaaatattttacagatgttaatgggaatggttgataattacctggtggctcaaattggacttgtagcagtctctggtgtctccatagctaacaacattatcagtatttatcagtccctctttatcgcgctgggagctgctgtatctagtctgattgctcgaagtattggagaaaataatcagaacaaacaattaaactatatggcaggtgtcttgcaagtaacactcctcctttcggtcggcttagggttgttatcagttgctggacatcatcaggtgttagaatggctaggagctgaagcttctgtaacattggttggagggcaatatctatccattgtcggcggtatgattgttagtctaggacttttaactagcttaggagctattgttcgagctcaagggtatcctaagattcctatgcaagtgagcttattaataaacgtactcaatgccattttttctgccttgtctatctatgtatggggatttggtcttcttggtgttgcttgggcgacggttttatctcgtttagtgggtgtgtttttactttgtcagtttattcctattaaacaggttgcgaaacgattgatgagacctttggacaaaattatttttgatttatcactacctgctgctggtgaacgtttgatgatgagagcaggagatgtcctaattattggcattgttgttcgctttgggacaacggccttggcaggtaatgctattggagaaaccttgactcagtttaattacatgcctggcttagccatggcaacggcaacaattattctagtggctaggcaactggggggcggtaaggtgactgagataaggtatattattagagaagcttttattttatccaccctcatgatgctggttatgggagccttgacctatctgctaggtcctagtctcttgccgctatttacacagaatactgatgctcaaaggtctgccatgattgttttacttttttctttactaggagctcccgcaacggcaggcactttagtttatacagccgtctggcagggtttgggaaaagcaaagcttcctttctatgcaacaaccataggaatgtgggtgattcgcattggccttggttatgtgattggtgtggtttggcaatatggactcataggggtctggatggcgacagtgttagataataccagtcggtggtttattctctctaaacactttaaaaagtaccaagaaattacctttcat

SEQ ID NO: 6416 - protein, 430 aa, Streptococcus pyogenes
MIYNNRRKIFSLALPSMIENILQMLMGMVDNYLVAQIGLVAVSGVSIANNIISIYQSLFIALGAAVSSLIARSIGENNQNKQLNYMAGVLQVTLLLSVGLGLLSVAGHHQVLEWLGAEASVTLVGGQYLSIVGGMIVSLGLLTSLGAIVRAQGYPKIPMQVSLLINVLNAIFSALSIYVWGFGLLGVAWATVLSRLVGVFLLCQFIPIKQVAKRLMRPLDKIIFDLSLPAAGERLMMRAGDVLIIGIVVRFGTTALAGNAIGETLTQFNYMPGLAMATATIILVARQLGGGKVTEIRYIIREAFILSTLMMLVMGALTYLLGPSLLPLFTQNTDAQRSAMIVLLFSLLGAPATAGTLVYTAVWQGLGKAKLPFYATTIGMWVIRIGLGYVIGVVWQYGLIGVWMATVLDNTSRWFILSKHFKKYQEITFH

SEQ ID NO: 6417 - DNA, 1488 bp, Streptococcus agalactiae
atggcaatagtatatcaatcaacacgtgatgctagtaataaagtgacagctagtcaagcgattctaaagggattagctgacgatggaggactctttacccccatcacatttccaaaagttgatttagatttcactaaacttaaggatgcttcctaccaagaagtggctaaactcgttttgtcagctttttttgatgattttactgaacaagaattggattactgtattagtcaagcttatgatactaaatttgatacaactgaaatagccccgatagtaaagattggagaccggtatcaccttgaattatttcacggtcctacaattgcatttaaagatatggctttatccattcttccttatttgctaacaacagcagccaaaaaacaaggggttgataataaaatcgttattttaacagcaacatcaggtgacactggcaaggcagcgatggcaggttttgcagatgttccaggaactgagattattgtcttttatcctaaaaatggtgttagttatatccaagaattgcagatgataacacaagccggacaaaatactcatgttgttgcgattgaaggaaattttgatgatgcacagacttcagttaaagaaatgttcaataattcccttcttcgattaaaattatcacagcagcatatgcagttatcatcagccaattcaatgaacatcggtcgccttgttcctcaaattgtttactatatatatgcatatgctcaattagttaagtcaaaggaaatctcaattggtcaaccaattaattttagtgtacctacaggaaattttggtaatattttagcagcatattatgctagtcaaattggattacctgttaccaaactcatttgtgcctcaaatgataataacgttctaacagatttttttaagacacaaacctacgataaaaatcgagaatttaaagtgacatcaagtccctctatggatattttggtctcctctaatctagaacgattaatctttcaccttttaggcgatgatgcagaaacgactaaaaaattaatggaagatttagtgactactggggagtatgccttagaggctaggcaagcaaatattttagagagctttgtagcgggatttgcgacagaacaatttgttgaattagacatcaaacatttatttgaccagtatcagtatatagaggatccgcatacagctgtagcatcagctgtttatcaagcttatcagacagaaactaaagatcaaactccagcagtaattgtgtcaacagcaagtccttataagttcccgtgtgttgttacaaaggctattacaaataaagaagagatacaggatttcgctgctatttcaatcttaaacgatttgtcaggtgtttctttacctaaggcggttacagatctacaaaaggccgaagtaatccatagaacggtagtacctacctcaaatatgcgagaaacggttgaagagtgtctaggtttgaaacaa

SEQ ID NO: 6418 - protein, 496 aa, Streptococcus agalactiae
MAIVYQSTRDASNKVTASQAILKGLADDGGLFTPITFPKVDLDFTKLKDASYQEVAKLVLSAFFDDFTEQELDYCISQAYDTKFDTTEIAPIVKIGDRYHLELFHGPTIAFKDMALSILPYLLTTAAKKQGVDNKIVILTATSGDTGKAAMAGFADVPGTEIIVFYPKNGVSYIQELQMITQAGQNTHVVAIEGNFDDAQTSVKEMFNNSLLRLKLSQQHMQLSSANSMNIGRLVPQIVYYIYAYAQLVKSKEISIGQPINFSVPTGNFGNILAAYYASQIGLPVTKLICASNDNNVLTDFFKTQTYDKNREFKVTSSPSMDILVSSNLERLIFHLLGDDAETTKKLMEDLVTTGEYALEARQANILESFVAGFATEQFVELDIKHLFDQYQYIEDPHTAVASAVYQAYQTETKDQTPAVIVSTASPYKFPCVVTKAITNKEEIQDFAAISILNDLSGVSLPKAVTDLQKAEVIHRTVVPTSNMRETVEECLGLKQ

SEQ ID NO: 6419 - DNA, 846 bp, Streptococcus agalactiae
ttgggtcacgaaggcattggtatagtagaagaaattggagaaggcgtaacgtctttgagggttggtgatcgtgtctctattgcatggttctttgaagggtgcggtcattgcgaatactgtactacaggacgtgagacactttgtcgtagtgttaaaaatgctggatacagtgttgatggtggtatgagtgaatacgctattgttaccgcggactatgcggttaaggttcctgagggattagacccagctcaagcatcatcaatcacttgtgctggagtaacaacatacaaggctatcaaagaagctggagctgctcctggtcagtggattgcagtgtatggtgcaggtggtcttggaaacttagcagtccaatatgcaaaaaaagtattcaatgctcatgttgtagctgttgatattaacgcagataaacttcaattagctaaagaggttggagcagatttgacagttaatggcaaagaaataaaagatgttgcggcatatattcaagaaaagacaggcggttgtcatggagtggttgtgactgctgtttctaaagttgcgtttaatcaggcgattgacagcgttcgtgctggaggtacagtggtagctgtcggtcttccatcagaatatatggaattgagtattgtaaaaacagtacttgatgggattcgtgtggttggttccttagttggaactcgtaaagacttagaagaagccttcgcatttggagcagaaggcttggtagtaccggtggttgaaaaagtgcctgtggatacagctcctcaagtattcgatgaaatggaaagaggattgattcaaggacgtaaagttcttgactttacaaag

SEQ ID NO: 6420 - protein, 282 aa, Streptococcus agalactiae
MGHEGIGIVEEIGEGVTSLRVGDRVSIAWFFEGCGHCEYCTTGRETLCRSVKNAGYSVDGGMSEYAIVTADYAVKVPEGLDPAQASSITCAGVTTYKAIKEAGAAPGQWIAVYGAGGLGNLAVQYAKKVFNAHVVAVDINADKLQLAKEVGADLTVNGKEIKDVAAYIQEKTGGCHGVVVTAVSKVAFNQAIDSVRAGGTVVAVGLPSEYMELSIVKTVLDGIRVVGSLVGTRKDLEEAFAFGAEGLVVPVVEKVPVDTAPQVFDEMERGLIQGRKVLDFTK

SEQ ID NO: 6421 - DNA, 1071 bp, Streptococcus pyogenes
atgtacaatttatttgtaaccgattacaaaaaagtcattattagatggaggactgatatgaaagccgtagttgttaatcaagctagtacaggtgtcgaagttgttgagcatgatcttccaaatattggtcatggtgaagcgcttgttaaagtagaatactgtggcgtttgtcatactgatttacacgttgcacatggcgattttggtcaggtaccaggacgtattttggggcacgaaggtattggtatagtagaagaaattggagaaggcgtaacatccttaaaggttggtgatcgtgtctctattgcatggttctttgaaggatgtggtcattgcgaatactgtactacaggacgtgagacactttgtcgtagtgttaaaaatgctggatacagtgttgatggaggaatgagtgaatatgcagtagtaacagctgattatgcagttaaagttccagaaggtttagacccggctcaagcttcttccattacttgtgctggtgtaacaacttataaagctattaaagaggcaggtgctgctccaggccaatggattgttatctttggggctggtggccttggaaatctggctgttcaatacgctaaaaaagtctttaatgcacatgttgtcgcagtggacattaataatgataaacttgagttagctaaagaagttggcgcagatattttagttaacggcaaagaaattgaagatgttccaggctatattcaagaaaaaaccggtggagcacatggtgttgtggtaacggctgtttctaaagttgcttttaaccaagcaattgatagtgtccgtgccggtggaacagttgtagccgtaggtcttccatcagaatacatggaactgtctatcgtaaaaactgttttagatggtatcaaagtggtcggatcacttgtagggacacgtaaagacttggaagaagcctttgcctttggtgcagaaggtctggttgctccggttgtcgaaaaagttccagttgacactgctccagaagtctttgatgaaatggaacgtggtttaatccaagggcgcaaggtcttagatttcatcagc

SEQ ID NO: 6422 - protein, 357 aa, Streptococcus pyogenes
MYNLFVTDYKKVIIRWRTDMKAVVVNQASTGVEVVEHDLPNIGHGEALVKVEYCGVCHTDLHVAHGDFGQVPGRILGHEGIGIVEEIGEGVTSLKVGDRVSIAWFFEGCGHCEYCTTGRETLCRSVKNAGYSVDGGMSEYAVVTADYAVKVPEGLDPAQASSITCAGVTTYKAIKEAGAAPGQWIVIFGAGGLGNLAVQYAKKVFNAHVVAVDINNDKLELAKEVGADILVNGKEIEDVPGYIQEKTGGAHGVVVTAVSKVAFNQAIDSVRAGGTVVAVGLPSEYMELSIVKTVLDGIKVVGSLVGTRKDLEEAFAFGAEGLVAPVVEKVPVDTAPEVFDEMERGLIQGRKVLDFIS

SEQ ID NO: 6423 - DNA, 1296 bp, Streptococcus agalactiae
ttgaaattatttatcccagtattgatttatcaatttgctaatttttcagctacttttattgattcggttatgactggacagtatagtcagctacatttggcaggtgtgtcaactgctagtaatttatggactccgtttttcgctttattagtaggtatgatttcagcattagtaccagtagttggtcaacatttgggtagaggaaataaagaacaaattcgcacagaatttcatcaatttctatatttaggtttgatactgtccttaatattatttttaatcatgcaatttattgctcaacctgtcttggggagtttgggtttagaagatgaagttctagcagttggtcgtggttatttaaattatatgttgattggaatcatgccgctggtgttgtttagcatttgccgttcattctttgatgcattggggttaacaaggttatctatgtatctgatgcttttaattctaccctttaattcattttttaattatatgcttatctacggtaaatttggtatgcctagactaggaggtgcgggggcaggtcttggaacttctttaacttattgggctatttttattgttattattattgtgatgtcacttcatcctcaaattaaaacatatcatatatggactctggaaagaataaaagctcctttgattattgaagatattcgattgggattaccgattggtttacaaatttttgcagaagttgcaatttttgcagtagtaggcttattcatggcaaaattttcttcaatcattattgcagcacatcaggctgctatgaatttttcatcattaatgtatgcctttcctttaagtatttccactgctctagctattacaatatcgtttgaagtaggggcagagcgctttcaggacgcaaacacttatagtaggataggacgcttaacagcggtagggattacatcaggaaccttactatttttatttctatttcgtgagaatgtagcagcaatgtataatagtgaccctcactttgtcgctattacagctcaattcctaacttatagtctctttttccagtttgcagatgcttatgcagctcctgtacaggggattttacgaggctataaggatacaacaaaaccatttatgatcggtgcgggctcttattggttatgtgctttgccattagcggttatcttagaaaaaaatagccagttaggtccttttgcctattggattggtttaatcacaggtatttttgtttgtggtctatttctaaaccaacgtctgcaaaagattaagaagttgtattat

SEQ ID NO: 6424 - protein, 432 aa, Streptococcus agalactiae
MKLFIPVLIYQFANFSATFIDSVMTGQYSQLHLAGVSTASNLWTPFFALLVGMISALVPVVGQHLGRGNKEQIRTEFHQFLYLGLILSLILFLIMQFIAQPVLGSLGLEDEVLAVGRGYLNYMLIGIMPLVLFSICRSFFDALGLTRLSMYLMLLILPFNSFFNYMLIYGKFGMPRLGGAGAGLGTSLTYWAIFIVIIIVMSLHPQIKTYHIWTLERIKAPLIIEDIRLGLPIGLQIFAEVAIFAVVGLFMAKFSSIIIAAHQAAMNFSSLMYAFPLSISTALAITISFEVGAERFQDANTYSRIGRLTAVGITSGTLLFLFLFRENVAAMYNSDPHFVAITAQFLTYSLFFQFADAYAAPVQGILRGYKDTTKPFMIGAGSYWLCALPLAVILEKNSQLGPFAYWIGLITGIFVCGLFLNQRLQKIKKLYY

SEQ ID NO: 6425 - DNA, 210 bp, Streptococcus agalactiae
ttggagaagatttatcccttgatctttagcaccgaagatacacccacagtaacattgtcggtagatatcataatctttacacatctcaacggaacgttggtaacctttattttttttaaggtcgctaggaagatactgagtatcataaattttttggacatcaataccaatagtattgattgtttgagagtttttgtgaggactaatagt

SEQ ID NO: 6426 - protein, 70 aa, Streptococcus agalactiae
MEKIYPLIFSTEDTPTVTLSVDIIIFTHLNGTLVTFIFFKVARKILSIINFLDINTNSIDCLRVFVRTNS

SEQ ID NO: 6427 - DNA, 765 bp, Streptococcus agalactiae
atgatagacgttgagaatattcttgaaaaaatgaaacctaaccaaaaaatcaattacgattgggtcatgcaacaaatggttaagcagtggcaagctagtgatatccgtccgaaaattctgatgcatgtttgctgtgctccttgtagtacatatacccttgaatacttatcacaatgggcagatgttaccatctattttgctaattcaaatatccatcctaaagatgaatattatcgccgcgaatatgttactcaaaaatttgttcatgatttcaacaaaaatactggatattctgtacaattcttatcagcaccatatgaaccaaatgaatttttcaaaattgttcatgggttagaagaagaacctgaaggtggggatcgttgtaaagtttgctatgatttccgtcttgataagacagcggaaaaagccgttgaactaggttttgattactttggcagtgccctaactattagtcctcacaaaaactctcaaacaatcaatactattggtattgatgtccaaaaaatttatgatactcagtatcttcctagcgaccttaaaaaaaataaaggttaccaacgttccgttgagatgtgtaaagattatgatatctaccgacaatgttactgtgggtgtatcttcggtgctaaagatcaagggataaatcttctccaaatcaaaaaagatgcgaaagctttcgtgagtgataaagacggcaaagaagaatttcctaatatacgcttcacatttaatggcaagtcaatg

SEQ ID NO: 6428 - protein, 255 aa, Streptococcus agalactiae
MIDVENILEKMKPNQKINYDWVMQQMVKQWQASDIRPKILMHVCCAPCSTYTLEYLSQWADVTIYFANSNIHPKDEYYRREYVTQKFVHDFNKNTGYSVQFLSAPYEPNEFFKIVHGLEEEPEGGDRCKVCYDFRLDKTAEKAVELGFDYFGSALTISPHKNSQTINTIGIDVQKIYDTQYLPSDLKKNKGYQRSVEMCKDYDIYRQCYCGCIFGAKDQGINLLQIKKDAKAFVSDKDGKEEFPNIRFTFNGKSM

SEQ ID NO: 6429 - DNA, 774 bp, Streptococcus pyogenes
gtggccacaatgattgatttacaagagattctcgctaacatgaatcccaatcaaaagataaattatgacagggtcatgcaacagatggccaaggtttgggagaaggaatccgtgcgccccagtattttaatgcatgtctgctgcgccccatgctccacttacaccctagaatacctgacgcagtttgctgacattacggtttactttgccaattctaatattcaccctaaggacgaataccatcgcagagcttatgtgacacaacagtttgtctccgagttcaacgctaaaacaggcaatactgttcagtttctcgaagcggactatgtccccaatgagtacgttcgacaagtgcgaggcttagaagaggaaccagaaggtggggaccgttgccgtgtctgttttgattaccgactagacaagaccgctcaaaaagcagtggaacttggttttgactactttgccagtgccctaaccatcagtcctcataaaaattcgcaaaccattaatgatgtgggcatcgatgtgcaaaaggtttacaccaccaaatacctgccaagtgatttcaagaaaaacaacggttatcgcagatccgttgaaatgtgtgaggagtatgatatttaccgccaatgctattgtggctgtgtctatgctgccaaaatgcaaggtattgacttggttcaagtgaaaaaagatgccaaagcttttatggcagacaaggatttggataatgatttcacccacatccgctttagttatcgtggggatgagatg

SEQ ID NO: 6430 - protein, 258 aa, Streptococcus pyogenes
VATMIDLQEILANMNPNQKINYDRVMQQMAKVWEKESVRPSILMHVCCAPCSTYTLEYLTQFADITVYFANSNIHPKDEYHRRAYVTQQFVSEFNAKTGNTVQFLEADYVPNEYVRQVRGLEEEPEGGDRCRVCFDYRLDKTAQKAVELGFDYFASALTISPHKNSQTINDVGIDVQKVYTTKYLPSDFKKNNGYRRSVEMCEEYDIYRQCYCGCVYAAKMQGIDLVQVKKDAKAFMADKDLDNDFTHIRFSYRGDEM

SEQ ID NO: 6431 - DNA, 1005 bp, Streptococcus agalactiae
atgaatgaactgattaaacataagctagaattgttaccagacagtcctggttgttaccttcataaagataagaatgggacaattatttatgtaggtaaggctaaaaatcttaagaatcgtgtgaaaagttattttcatgggagtcataatactaagacagaacttttggtctctgagattgaagactttgaatacattgtgacaacatctaataccgaagctctattattggaaattaatttaatccaagaaaatatgccgaagtataatattcgattgaaagatgataagtcttacccatatatcaaaataacaaatgaacgttatcctcgtcttatgattacacgtcaagtaaaaaaatcagatggcacttattttggaccttatccggattctggggcagcaactgagattaagcggttactagataggctctttccttttaagaaatgtactaatccagcaaataaagtatgcttttattatcatttagggcaatgcaatgcacatacagtttgtcaaactaataaagcttattgggatagtctgagagaagatgtaaaacagtttcttaatggtaaagataataaaattgttaacggattaactgaaaaaatgaagagcgctgctatgactatggaatttgagcgtgcggctgaatatcgagatttgatcgaagcaattagtttgttgcgtactaagcagcgtgttattcatcaagatatgaaggatagagatgtttttggttatttcgttgataagggttggatgtgtgtacaggtcttttttgttcgaaatggaaaattgattcagcgtgacgtgaatatgtttccttattataatgaaccagaggaagattttctaacttacatagggcaattttatcaagatacaaaacattttctacccaaagaagtctttattccacaggatattgatgctaagtcggttgaaacaattgtaggctgtaagattgttaaaccacaacgtggtaaaagaaacagt

SEQ ID NO: 6432 - protein, 335 aa, Streptococcus agalactiae
MNELIKHKLELLPDSPGCYLHKDKNGTIIYVGKAKNLKNRVKSYFHGSHNTKTELLVSEIEDFEYIVTTSNTEALLLEINLIQENMPKYNIRLKDDKSYPYIKITNERYPRLMITRQVKKSDGTYFGPYPDSGAATEIKRLLDRLFPFKKCTNPANKVCFYYHLGQCNAHTVCQTNKAYWDSLREDVKQFLNGKDNKIVNGLTEKMKSAAMTMEFERAAEYRDLIEAISLLRTKQRVIHQDMKDRDVFGYFVDKGWMCVQVFFVRNGKLIQRDVNMFPYYNEPEEDFLTYIGQFYQDTKHFLPKEVFIPQDIDAKSVETIVGCKIVKPQRGKRNS

SEQ ID NO: 6433 - DNA, 519 bp, Streptococcus agalactiae
atggggaaatctgccattgattatctctataaaaaaggacataaaagcatccagtttgttacagatgatttaaattcagaagtatcagaagagcgctatttagggtattttaaaggtgctagaaagttaggtttaaaccaaaagccagctcttttatttgacagaggcaatccgcaagttttagaggaatttataaatagagtcaaagaagaagaaacaactgctttaattgttattggtgatactgtctctgttagagtaatgcaatttctttctttctataaattaaaagttccagatgacatttctatcatgacctttaataattctctcttctcacatctgattcatccttacctaagcacatttgatattaatgttaataatctaggaaggacaagcgttcgtcgtctgattgacatcattaaatctccagacaaagtctttagtgagactattattgtgccttttactttagaagagcgtgaaagtgtccgagatatttctaaaaataataat

SEQ ID NO: 6434 - protein, 173 aa, Streptococcus agalactiae
MGKSAIDYLYKKGHKSIQFVTDDLNSEVSEERYLGYFKGARKLGLNQKPALLFDRGNPQVLEEFINRVKEEETTALIVIGDTVSVRVMQFLSFYKLKVPDDISIMTFNNSLFSHLIHPYLSTFDINVNNLGRTSVRRLIDIIKSPDKVFSETIIVPFTLEERESVRDISKNNN

SEQ ID NO: 6435 - DNA, 1494 bp, Streptococcus agalactiae
atgaaaaaacgtgcaagtggtgtcttaatgcacatcacttctctaccaggtgatttaggtattggaacatttggacgagaagcctacgcttttgttgattttttggtcgaaactgatcaaaaattttggcaaattcttcccttaacaacaacaagcttcggggactctccttaccagtctttttctgcagtagctggtaatacacatttaattgattttgatttgctaacgcttgaaggtttcatttcgaaagatgactaccaaaatattagttttggacaggatccagaagttgttgattatgctggtctgtttgaaaaacgccgtccagttttagaaaaagcagttaaaaatttcttgcaagaagagagagctacgagaatgctatctgatttcttgcaagaagaaaaatgggtaactgattttgctgaatttatggcgatcaaagaacattttggtaataaggcgcttcaagaatgggatgacaaggctattatacgccgcgaagaagaagccttagcaggatatcgtcaaaagcttagtgaagtgataaaatatcatgaagtaacgcaatatttcttttacaaacaatggtttgagttaaaagaatatgctaatgataaagggattcaaattatcggtgatatgccaatctacgtttctgccgatagtgtagaagtttggacaatgcctgaactgtttaaattagatcgcgacaaacaaccacttgctattgctggtgtaccagcggatgatttttctgacgatggtcagctttggggcaatcctatttacaattgggattaccacaaagagtcagattttgactggtggatttatcgtattcaatctggtgttaagatgtatgactatttgcgtattgatcattttaaaggtttttcagattattgggaaattcgaggagattatcaaacagctaatgatggctcatggcaaccagctcccggtccagaattatttgcaactatcaaagaaaaattaggtgatttacctattattgctgagaatttaggctatattgatgagagagcagagagattactggctggaacagggttcccaggtatgaaaatcatggaattcggtttttatgatacaacaggaaatagtattgatattcctcataactacacagaaaatacaattgcatatgctggaactcatgataacgaagttattaatggctggtttgaaaatcttacagtcgaacagaaagcttatgcagaaaattacatgcgtcgtttgccaaatgagcccattactgagactgtactgcgtaccttgtatgcaaccgttagtcaaacaacgattacatgtatgcaagatctactagataaacctgcagatagccgtatgaacatgccaaataccgttggaggtaactggcaatggcgtatgagaaaagaagacttaacagaaaatcgcaaagcattcttaaaagagattacaactatttataatagagggaataaa

SEQ ID NO: 6436 - protein, 498 aa, Streptococcus agalactiae
MKKRASGVLMHITSLPGDLGIGTFGREAYAFVDFLVETDQKFWQILPLTTTSFGDSPYQSFSAVAGNTHLIDFDLLTLEGFISKDDYQNISFGQDPEVVDYAGLFEKRRPVLEKAVKNFLQEERATRMLSDFLQEEKWVTDFAEFMAIKEHFGNKALQEWDDKAIIRREEEALAGYRQKLSEVIKYHEVTQYFFYKQWFELKEYANDKGIQIIGDMPIYVSADSVEVWTMPELFKLDRDKQPLAIAGVPADDFSDDGQLWGNPIYNWDYHKESDFDWWIYRIQSGVKMYDYLRIDHFKGFSDYWEIRGDYQTANDGSWQPAPGPELFATIKEKLGDLPIIAENLGYIDERAERLLAGTGFPGMKIMEFGFYDTTGNSIDIPHNYTENTIAYAGTHDNEVINGWFENLTVEQKAYAENYMRRLPNEPITETVLRTLYATVSQTTITCMQDLLDKPADSRMNMPNTVGGNWQWRMRKEDLTENRKAFLKEITTIYNRGNK

SEQ ID NO: 6437 - DNA, 1491 bp, Streptococcus pyogenes
atgaacaaacgtgcaagcggtatcttaatgcatattagttccctgcctgggaaatttgggataggcacttttggaaaatcagcttttgaatttgttgattttctagcagagacgaaacaaacctattggcaaattctgcctttaacaacgacgagttttggagattctccttatcagtcattttcagctattgctgggaacacacatttcattgattttgaattgctagtagatgatgaacttttagaagcagcagatttgtgtgatattacattcggcacaaatcctgaagcagtagactatgctcagctttttcaagttagacgtccacttttagaaaaagcagtgagagcttttgttgctgaacaagaaaatgtgtgtaaattagaagcttttgaaacagcttctagctggttaactgattttgctgaatttatggctttaaaagaatattttaacaataaagccttacaagattgggacgacgaaactgtcattaaacgccaagaagactcacttaataattaccgtgagttgcttgcaaaaaagattacctatcataaagtctgtcaatacttcttttaccaacaatggtcagccttgaaaacttacgctaaccataaagggatagaaattattggtgatatgcctatttatgtttctgcggacagtgtagaagtttggacgatgcctgagctatttaaagtagatagtgataaaaagccattgtttattgcaggtgtaccagcagatggctttagtgaagatggtcagctgtggggaaatccaacctacaattggtctgctcatgaaaagtctaattttgcatggtggatttatcgtattcaagaaagtttcaaactatatgatcagctaagaatcgatcattttaaaggcttctcagatttttgggaaattcctgctggtgataaaactgctagaaatggccattgggcctcagccccaggtatagcattattttctgcggttcgtgaggccttaggagagctccctatcatcgcagaaaacctgggttatattgatgaaaaagcagagcagctattagcatcaacaggctttcctggcatgaagatattagaatttggtttatttgatataacgagtcaaagtatagatttaccacattactatgaccgtaattgtgtcgcttacacagggactcatgataacgaggtggttaacggatggtatgacaatcttagtgaagaacaagtacactttgtaaataactatcttcacaaacatgcagatgaaagtattacaaaagccatgctaagaacaatctttgcttctgtttgtgatacagccattctttgcatccaagatttattagataaagatggtaagagtcgtatgaatatgccaaatacaattggaggtaattggcaatggcgtatgcttgacggtgaattgaaccaagatcacaaagattaccttatttatttaacagatctttatggtcgcgcaaga

SEQ ID NO: 6438 - protein, 497 aa, Streptococcus pyogenes
MNKRASGILMHISSLPGKFGIGTFGKSAFEFVDFLAETKQTYWQILPLTTTSFGDSPYQSFSAIAGNTHFIDFELLVDDELLEAADLCDITFGTNPEAVDYAQLFQVRRPLLEKAVRAFVAEQENVCKLEAFETASSWLTDFAEFMALKEYFNNKALQDWDDETVIKRQEDSLNNYRELLAKKITYHKVCQYFFYQQWSALKTYANHKGIEIIGDMPIYVSADSVEVWTMPELFKVDSDKKPLFIAGVPADGFSEDGQLWGNPTYNWSAHEKSNFAWWIYRIQESFKLYDQLRIDHFKGFSDFWEIPAGDKTARNGHWASAPGIALFSAVREALGELPIIAENLGYIDEKAEQLLASTGFPGMKILEFGLFDITSQSIDLPHYYDRNCVAYTGTHDNEVVNGWYDNLSEEQVHFVNNYLHKHADESITKAMLRTIFASVCDTAILCIQDLLDKDGKSRMNMPNTIGGNWQWRMLDGELNQDHKDYLIYLTDLYGRAR

SEQ ID NO: 6439 - DNA, 2262 bp, Streptococcus agalactiae
atgacaagaaattttacaacttacgttggacaacaaggaaaagtattatcagaattaacaaatgaagagatttacgttgaattgttaaattttgtaaaagaagaagctgccgctaaatcaaaaaatagctctcaacgtaaggtatactatatttcagctgagtttctaattggtaaattactttcaaataatttgattaacttagggatttataaagatgtcaaaaaagagttagaacttgtaggtaaatcaattgctgaaatagaagatgtagagccagaaccatcacttggtaatggtggtttagggcgtttagcatcatgttttattgactcgatttcttctttaggtattaatggtgaaggtgttggtttaaactatcactgtgggcttttcaaacaagtatttcgcaacaatcaacaagaagcagaagctaactactggattgagaataattcttggttagtaccaacagatatttcttatgatgttcctttccgtgactttactttaaaatcacgcctagatagaattgatgtattaggttataagaaagatactaaaaattatttgaacctttttgatattgatggacttgattataaccttattgaaaaaggtatcacttttgataagacagaaatcaagaagaatttaaccttgttcttgtatccagatgattcagataaaaatggagaattattacgtatctatcagcaatatttcatggtttcaaatgctgctcaattattaattgatgaagcaatcgagcgtggttcaaaccttcatgatttagctgaatatgcttatgttcaaattaatgacactcacccatctatggtcatccctgagttgattcgtttattgacagaaaaacatggttttgaatttgacgaagctgtgtcagttgttcgcaatatggttggctatacaaaccataccatccttgcagaagctcttgaaaaatggcctttagagtatcttaatgaggtagtaccccacctagtaacaatcattaaaaaattagatcaaatgattcgtgaagagcaaacaaatccagaggttcaaattattgatgaagctggacgtgttcacatggcgcatatggatatccacttctcaacaagcgttaatggtgtagcagcattacatacagaaatccttaaaaatagtgaattaaaggttttctatgatatttacccagataagtttaacaataagacaaacggtattacattccgtcgctggttggagtttgctaaccaagatttagcagattacttgaaagaactaattggggatagctatcttactgatgcgactcagctcgaaaaattgttaacttatgctgatagcaatgaagttcatgataaattagctgctattaaatttaaaaacaaactggctcttaaacgttaccttaaggaaaataaaggtattgaattggatgaatactcaattattgatacacaaatcaaacgattccacgaatataagcgccaacaaatgaatgctttatatgttattcataaatacttagaaattaaacgtgggcatttcccatcacgtaaattaacagttatttttggtggtaaagctgctccagcctatactattgcacaggatatcattcacttaattctctgcttatcagaattaattaataatgatccagaagttaataaataccttaatgtccatttagtagaaaattacaatgtgacagtagcggaaaagttaatccctgcaacagatatttcggaacaaatttcattggcttccaaagaagcatctggtacaggtaacatgaaatttatgttgaatggtgctcttactcttggtactatggatggggcaaatgttgaaatagctgaattagctggcaaagagaacatctacacatttggtaaagactctgatactatcattaatctttatgaaacatctggttatcgttcaaaagattactatgataaagacaaagtaattcgtgaagctgttgattttatcattagtgatgatatagtgtcactcggtaatgcagaacgactaaagagattgcatgatgagttagtaggtaaagattggttcatgacattgattgatttgaaagaatacattgctgttaaagaacaagtgcttgctgattatgaagattatgaatcatggaataagaaagttatacacaatattgctaaagcagggttcttctcatcagatcgtacaatcgaacaatataatcaagatatttggcattcaaat

SEQ ID NO: 6440 - protein, 754 aa, Streptococcus agalactiae
MTRNFTTYVGQQGKVLSELTNEEIYVELLNFVKEEAAAKSKNSSQRKVYYISAEFLIGKLLSNNLINLGIYKDVKKELELVGKSIAEIEDVEPEPSLGNGGLGRLASCFIDSISSLGINGEGVGLNYHCGLFKQVFRNNQQEAEANYWIENNSWLVPTDISYDVPFRDFTLKSRLDRIDVLGYKKDTKNYLNLFDIDGLDYNLIEKGITFDKTEIKKNLTLFLYPDDSDKNGELLRIYQQYFMVSNAAQLLIDEAIERGSNLHDLAEYAYVQINDTHPSMVIPELIRLLTEKHGFEFDEAVSVVRNMVGYTNHTILAEALEKWPLEYLNEVVPHLVTIIKKLDQMIREEQTNPEVQIIDEAGRVHMAHMDIHFSTSVNGVAALHTEILKNSELKVFYDIYPDKFNNKTNGITFRRWLEFANQDLADYLKELIGDSYLTDATQLEKLLTYADSNEVHDKLAAIKFKNKLALKRYLKENKGIELDEYSIIDTQIKRFHEYKRQQMNALYVIHKYLEIKRGHFPSRKLTVIFGGKAAPAYTIAQDIIHLILCLSELINNDPEVNKYLNVHLVENYNVTVAEKLIPATDISEQISLASKEASGTGNMKFMLNGALTLGTMDGANVEIAELAGKENIYTFGKDSDTIINLYETSGYRSKDYYDKDKVIREAVDFIISDDIVSLGNAERLKRLHDELVGKDWFMTLIDLKEYIAVKEQVLADYEDYESWNKKVIHNIAKAGFFSSDRTIEQYNQDIWHSN

SEQ ID NO: 6441 - DNA, 2262 bp, Streptococcus pyogenes
atgacacgctttacagaatatgttgaaactaaactaggaaaatcacttacgcaagccagcaatgaagagatttatctatcattattaaactttgtcaaagaagaagctagccacaaggctaaaaattctgctaaacgcaaagtttactatatctcagcagagtttttgattggtaaattactatcaaacaacctgattaacctaggaatttacaaggacatcaaagaagaattggcagctgctggcaagtctatcgcagaagtcgaagatgttgaattagaaccatcactaggtaatggtggtttaggacgccttgcttcatgttttattgactctattgcatctcttgggattaatggtgaaggggttggtttaaactatcattgtgggttgtttaagcaagtcttcaaacacaatgagcaagaagctgagccaaacttctggattgaagatgactcatggttggttccaacagacatttcttacgatgtgccttttaagaacttcaccttgaaatctcgtcttgatcgtattgatgttttgggttacaaacgcgacactaaaaactaccttaacttgtttgatatcgagggcgttgattacgggttaatcaaagacggcatttcttttgataaaacgcaaattgctaaaaacttgaccttgttcctctacccagacgattctgacaaaaatggggaattgctccgtatttaccaacagtactttatggtgtcaaatgcagcgcaattaatcattgatgaagctatcgaacgtggttcaaaccttcatgaccttgcagactacgcttacgtgcaaattaatgacacgcatccatcaatggtcatcccagaattaattcgtctcttgactgaaaaacatggctttgactttgatgaagcggtagctgttgtgaaaaatatggttggttacactaaccacactattcttgcagaagcccttgaaaaatggccaactgcttacttaaacgaagtagtgccacacttggtaaccatcattgaaaaattggatgctcttgttcgttcagaagtgtctgatccagctgttcaaattattgacgaatcaggtcgtgtgcacatggcccatatggatattcattttgcaacaagtgtcaatggggtagcagcactccacacagaaatcttgaaaaacagcgaattaaaagctttctatgacctttacccagaaaaattcaacaacaaaaccaacgggattactttccgtcgttggctagaatttgctaaccaagacttggctgattacattaaagaacttattggcgatgagtacttgactgacgcaacaaaattagaaaaattgatggcctttgcagatgacaaagctgttcatgctaaattggctgaaatcaaattcaacaacaaattagctcttaaacgttaccttaaagacaataaagacattgagcttgatgaacattctattattgatacccaaatcaaacgtttccacgagtacaaacgtcaacagatgaatgctctttacgtgattcacaaatatttggaaattaaaaaaggcaaccttccaaaacgtaaaatcactgttatctttggaggtaaagcagcgcctgcttacattattgcgcaagacatcattcacttgatcctttgcttgtctgaattgattaacaatgaccctgaagtaagcccataccttaatgtgcatctagttgaaaattacaacgtgacagtagcagagcacttgattccagcaactgatatttctgagcaaatttcactagcatccaaagaagcttctggaactggtaatatgaaattcatgcttaacggtgctttaacacttggtacaatggacggtgctaacgtagaaatcgctgagcttgcaggcatggagaatatctatacctttggtaaagattctgacaccatcatcaacctttatgcgactgcttcttatgtagcaaaagattactatgataaccaccctgctattaaagcagcagtgaactttattatcagtccagaattgctagcatttggcaacgaagaacgtcttgatcgtctttataaagaattgatttcaaaagactggttcatgactttgattgaccttgaagagtacattgaagtgaaagaaaaaatgttagcagactatgaagaccaagatttatggatgacaaaagtggtccataacatcgcaaaagctggattcttctcatctgaccgtaccattgagcagtataacgaagatatttggcattcacga

SEQ ID NO: 6442 - protein, 754 aa, Streptococcus pyogenes
MTRFTEYVETKLGKSLTQASNEEIYLSLLNFVKEEASHKAKNSAKRKVYYISAEFLIGKLLSNNLINLGIYKDIKEELAAAGKSIAEVEDVELEPSLGNGGLGRLASCFIDSIASLGINGEGVGLNYHCGLFKQVFKHNEQEAEPNFWIEDDSWLVPTDISYDVPFKNFTLKSRLDRIDVLGYKRDTKNYLNLFDIEGVDYGLIKDGISFDKTQIAKNLTLFLYPDDSDKNGELLRIYQQYFMVSNAAQLIIDEAIERGSNLHDLADYAYVQINDTHPSMVIPELIRLLTEKHGFDFDEAVAVVKNMVGYTNHTILAEALEKWPTAYLNEVVPHLVTIIEKLDALVRSEVSDPAVQIIDESGRVHMAHMDIHFATSVNGVAALHTEILKNSELKAFYDLYPEKFNNKTNGITFRRWLEFANQDLADYIKELIGDEYLTDATKLEKLMAFADDKAVHAKLAEIKFNNKLALKRYLKDNKDIELDEHSIIDTQIKRFHEYKRQQMNALYVIHKYLEIKKGNLPKRKITVIFGGKAAPAYIIAQDIIHLILCLSELINNDPEVSPYLNVHLVENYNVTVAEHLIPATDISEQISLASKEASGTGNMKFMLNGALTLGTMDGANVEIAELAGMENIYTFGKDSDTIINLYATASYVAKDYYDNHPAIKAAVNFIISPELLAFGNEERLDRLYKELISKDWFMTLIDLEEYIEVKEKMLADYEDQDLWMTKVVHNIAKAGFFSSDRTIEQYNEDIWHSR

SEQ ID NO: 6443 - DNA, 1371 bp, Streptococcus agalactiae
atgttgaaaaaactatttgcaccccctcagaaaagagaacgtttatcagctgaggaaattaagcataaatatcctcgttatcgtgtacaagtccttatttctatttttgtaggttatatgggatactattttgttcgtaatacgacttcaattttatctggtatccttaatatgtctgctactgagattggtattattacctgtgctagctacattgcttatggtctctctaaatttatttctggtttgatttcagatgaatcgaattctaaaattttccttccagttggtttgtttcttacaggactagttaatgtgttaatcggtgttattccatctgtaattactagtatctggctctttactatcatgtatcttattaatggttggttacaagggatgggataccctcctggagcgcgtacattagtctattggtatgataataaagaaagaattaaatatgctaccatttggaatttatctcacaattttggtggagcaatagcgccgattttaactggtgtaggtctagctcttgctggtaatgattctcttaatcaagcgcgtgctgcttattggtttccaggggtggtggcttgtcttttggctgttcttgtttactttttacaagaagatactccagaatctatcggacttccgcctatagaagagtatcataaagagcaatatactaatgttgtggattcaagtgacattttagaagagcctgaagttttgggtatgggcgaaattataaaaaaatatattctaccaaatactaaactgatgtgggcatccttgtattcaatatttgtatatattttacgttacggtattgtctcatggactcctaagtttttagcgacgagtgtgcaagatggtggaaaaggtattactgcaacagctggtatgggtggtttttcactttttgaaataggtggtattattgggatgctaacagcaggatatctatctgccaaagtgtttaaaaactctaaacctttaaccaatgtagccttcttagttgtagcaatcttattactagctgcctattggtttattccagcaggacctcaatatatggcattagacttcattattttactaggtttgggggcatcaatctacggtcctgttatgatggttggcctgtatgctatggagttagttccaaaagcagcagctggagcagcttcaggattgactggcacatttagttatgtcggaggagcaacgatcgctactctagctattggtattattattgaccactttggttggggagtagcatttataatatttggtatttctggatttgcggctattgtctgtaccttgctttcaagagataagagtctagagtattgg

SEQ ID NO: 6444 - protein, 457 aa, Streptococcus agalactiae
MLKKLFAPPQKRERLSAEEIKHKYPRYRVQVLISIFVGYMGYYFVRNTTSILSGILNMSATEIGIITCASYIAYGLSKFISGLISDESNSKIFLPVGLFLTGLVNVLIGVIPSVITSIWLFTIMYLINGWLQGMGYPPGARTLVYWYDNKERIKYATIWNLSHNFGGAIAPILTGVGLALAGNDSLNQARAAYWFPGVVACLLAVLVYFLQEDTPESIGLPPIEEYHKEQYTNVVDSSDILEEPEVLGMGEIIKKYILPNTKLMWASLYSIFVYILRYGIVSWTPKFLATSVQDGGKGITATAGMGGFSLFEIGGIIGMLTAGYLSAKVFKNSKPLTNVAFLVVAILLLAAYWFIPAGPQYMALDFIILLGLGASIYGPVMMVGLYAMELVPKAAAGAASGLTGTFSYVGGATIATLAIGIIIDHFGWGVAFIIFGISGFAAIVCTLLSRDKSLEYW

SEQ ID NO: 6445 - DNA, 1341 bp, Streptococcus agalactiae
ttgtttatggaagaggattataacaaaagagaacctgagaagtttacgcaatttctgcgccgtcaaaaggtcgtcttttttgtcgcattttttggttatgtgtgtgcttacttggtacgcaacaatttcaaactaatgtcaaacactattatggtgcaaaatggttgggacaaggctcaaattgcgatcttgttatcgtgtttgaccgtttcttatggcttagcaaaattctatatgggagccttaggggatcgtgttagcttgaggaagctcttttcaatcagcttgggtgcaagcgctttgatttgtattttaattggttttttcaatagttcaatggtggtattaggaatactgctagtcttgtgtggtgtcgtacaaggtgccttggcacctgcctcacaagccatgattgccaattattttccaaataaaacacgcggcggagccatcgctggatggaacatttctcaaaacatgggatcagccctcttgccattaaccatcgccttgctcaccagtatgggcttggtggtaccagctaatggcaatattttacttgcctttttaatccctggcgttttagtgttcttgtttgctttgtgttgctggaagcttggcggtgataaccctgagtctgagggacttgactctcttcgaacgatgtatggtgatgcgggcgagtcagctgttgccagtgaagaagaaaagcataacctgtcttattggcaactcatctggaaatacgttttttgtaacccgtcgctcttacttgttgctgctgtcaatgtggccctttattttgttcgttttgggattgaagactggatgccgatctacttgtcacaagtagccaatatgtcagaggctcatatccattttgcgatttcaatgttagagtgggtcgctattccaggctcgctggtatttgcgtggttagcggttcgttatcctaataaaatggccaaggttggggctattgggctttttgtgttagcggctattgtctttgtctatgaacgcttgactgccacaggtgctccaaattatttcttgttgcttgttattgcaggtattttagggtcattgatttatggcccacagttgatcgtgaatattttaacaatcaactttgttcctttaaatgttgcaggaacagcgattggttttgtaggagtaacagcttatctcatcggcaatatgggagcaaactggctgatgccgattttggcagatggttttggctggttttggtcatatattgtcgttgcagccttatctgctttttcagcggttggttatttgattttagccaaacgtgaggaagaaatcatcaaagat

SEQ ID NO: 6446 - protein, 447 aa, Streptococcus pyogenes
LFMEEDYNKREPEKFTQFLRRQKVVFFVAFFGYVCAYLVRNNFKLMSNTIMVQNGWDKAQIAILLSCLTVSYGLAKFYMGALGDRVSLRKLFSISLGASALICILIGFFNSSMVVLGILLVLCGVVQGALAPASQAMIANYFPNKTRGGAIAGWNISQNMGSALLPLTIALLTSMGLVVPANGNILLAFLIPGVLVFLFALCCWKLGGDNPESEGLDSLRTMYGDAGESAVASEEEKHNLSYWQLIWKYVFCNPSLLLVAAVNVALYFVRFGIEDWMPIYLSQVANMSEAHIHFAISMLEWVAIPGSLVFAWLAVRYPNKMAKVGAIGLFVLAAIVFVYERLTATGAPNYFLLLVIAGILGSLIYGPQLIVNILTINFVPLNVAGTAIGFVGVTAYLIGNMGANWLMPILADGFGWFWSYIVVAALSAFSAVGYLILAKREEEIIKD

SEQ ID NO: 6447 - DNA, 303 bp, Streptococcus agalactiae
atgacttatgaattatgtctagaatacggtacttatccacttagacctgtagatgcttgggctgatgaaatcaatactgcacctgcgtttattactgaagataaaaaacttttagaacttttagaagaagtcaataccttattccatgagctctttttaacgatagaatgttccttccactatattggtcatgacttcccagaaaaaagagcaaaaatcacacaaatttatcatgtgattatcgaacatttaagcatacactaccctgaatatgacattaaaattgaatcattattaatgggg

SEQ ID NO: 6448 - protein, 101 aa, Streptococcus agalactiae
MTYELCLEYGTYPLRPVDAWADEINTAPAFITEDKKLLELLEEVNTLFHELFLTIECSFHYIGHDFPEKRAKITQIYHVIIEHLSIHYPEYDIKIESLLMG

SEQ ID NO: 6449 - DNA, 300 bp, Streptococcus pyogenes
atgacttatgaactttgtttagaatatgggacttatccgttgtcacgtgttgatgcttactggggagaagatcaaaatcccccaacattcattcaagaagatcgactgctttgccataaactagaaactatgaatcacctgttccatgatttatttgtaactattgaatcacaattccattatgttggttttaacatgcctgaaaaaagagcgcagattcggatactatatcaagaagtagctactatattaaaatccaaatataaggattatccaattaagattgagacgtttcttctt

SEQ ID NO: 6450 - protein, 100 aa, Streptococcus pyogenes
MTYELCLEYGTYPLSRVDAYWGEDQNPPTFIQEDRLLCHKLETMNHLFHDLFVTIESQFHYVGFNMPEKRAQIRILYQEVATILKSKYKDYPIKIETFLL

SEQ ID NO: 6451 - DNA, 984 bp, Streptococcus agalactiae
atgtcagaaaaaatcagagttttactctattataaatatgtttcaattgaaaatgcggaagagtacgctgcgaaacatctagaattttgtaaatctattgggcttaaaggtcgtattttgattgcggatgaggggattaatggaactgtttctggagattatgaaacaactcagaagtatatggattgggtccacagcgatgagcgttttgctgatctttggttcaagattgacgaggaaaatcaacaagctttccgtaaaatgtttgttcgttataagaaagagattgtgcaccttgggttagaagataataactttgatagcgatattaatcctttggaaacaacaggtgagtatttaaatcctaaacaatttaaagaagccttgcttgatgaagatactgttgttttagatacgcgtaatgattatgagtatgacttaggtcacttccgtggagcaattcgtcctgatattcgcaatttccgtgagttaccacaatgggtacgtgacaacaaagataagtttatggaaaaacgtgttgttgtgtactgtaccggtggtgttcgttgtgagaaattctcgggttggatggttcgagaaggttttaaagatgttggacaattacacggtggtattgcaacatatggaaaagatccggaagttcaaggtgaactttgggatggtgcgatgtatgtttttgatgatcgtatctcggtgccaattaatcatgttaatccaactgttattagtaaagattattttgatggaacaccttgtgaacgttatgtcaattgtgcaaatccgttttgtaacaaacaaatttttgcttcagaagaaaacgaagcgaagtatgttcgagggtgctcgcctgaatgtcgtgcacatgaacgtaatcgctatgtgcaagaaaatggtttatcacgtcaagaatgggcagaacgtttagaagctattggagaatccttacctcaagtagcaaatgtt

SEQ ID NO: 6452 - protein, 328 aa, Streptococcus agalactiae
MSEKIRVLLYYKYVSIENAEEYAAKHLEFCKSIGLKGRILIADEGINGTVSGDYETTQKYMDWVHSDERFADLWFKIDEENQQAFRKMFVRYKKEIVHLGLEDNNFDSDINPLETTGEYLNPKQFKEALLDEDTVVLDTRNDYEYDLGHFRGAIRPDIRNFRELPQWVRDNKDKFMEKRVVVYCTGGVRCEKFSGWMVREGFKDVGQLHGGIATYGKDPEVQGELWDGAMYVFDDRISVPINHVNPTVISKDYFDGTPCERYVNCANPFCNKQIFASEENEAKYVRGCSPECRAHERNRYVQENGLSRQEWAERLEAIGESLPQVANV

SEQ ID NO: 6453 - DNA, 984 bp, Streptococcus pyogenes
atgtcagaaaaaatcagagttttactctattataaatatgtttcaattgaaaatgcgcaagagtacgctgcgaaacatctagaattttgtaaatctattgggcttaaaggtcgtattttgattgcggatgaggggattaatggaactgtttctggagattatgaaacaactcagaagtatatggattgggtccacagcgatgagcgttttgctgatctttggttcaagattgacgaggaaaatcaacaagctttccgtaaaatgtttgttcgttataagaaagagatcgtgcaccttgggttagaagacaataactttgatagtgatattaatcctttggaaacaacaggtgagtatttaaatcctaaacaatttaaagaagccttgcttgatgaagatactgttgttttagatacgcgtaatgattatgagtatgacttaggtcacttccgtggagcaattcgtcctgatattcgcaatttccgtgagttaccacaatgggtacgtgacaacaaagataagtttatggaaaaacgtgttgttgtgtactgtacgggtggtgttcgctgtgagaaattctcgggttggatggttcgagaaggctttaaagatgttggacaattacacggtggtattgcaacatatggaaaagatccggaagttcaaggtgaactttgggatggtgcgatgtatgtttttgatgatcgtatctcggtgccaattaatcatgttaatccaactgtcattagtaaagattattttgatggaacaccttgtgaacgttatgtcaattgtgcaaatccgttttgtaacaaacaaatttttgcttcagaagaaaacgaaacaaagtatgttcgaggatgctcacctgaatgtcgtgcacatgaacgtaatcgctatgtgcaagaaaatggtttatcacgtcaagaatgggcagaacgtttagaagctattggagaatccttgccagaatttgtaggtgcc

SEQ ID NO: 6454 - protein, 328 aa, Streptococcus pyogenes
MSEKIRVLLYYKYVSIENAQEYAAKHLEFCKSIGLKGRILIADEGINGTVSGDYETTQKYMDWVHSDERFADLWFKIDEENQQAFRKMFVRYKKEIVHLGLEDNNFDSDINPLETTGEYLNPKQFKEALLDEDTVVLDTRNDYEYDLGHFRGAIRPDIRNFRELPQWVRDNKDKFMEKRVVVYCTGGVRCEKFSGWMVREGFKDVGQLHGGIATYGKDPEVQGELWDGAMYVFDDRISVPINHVNPTVISKDYFDGTPCERYVNCANPFCNKQIFASEENETKYVRGCSPECRAHERNRYVQENGLSRQEWAERLEAIGESLPEFVGA

SEQ ID NO: 6455 - DNA, 1125 bp, Streptococcus agalactiae
atgaaacattatcaaaccataattatcggtgcaggcgctgcaggaatcggttttggttctgccatgcaacgattaggacttacaaattttcttatcattgaaaaagggcacattggagaatcttttttaagatggcccagaacaacacaatttatcacaccttccttcactaccaatggctttggttttccagatctaaacgctgttattccagatacttctcctgctttctcatttgaaaaagaacatctttctggagtggaatatgcacgctacttacaattagttgctgctcattataatctccctatccaaaacgaaacatctgttctatctattgataaacgagatagcctttttgttattaaaacttcaaagggagatttttctgctgattatcttattatggcaacaggagaatttcaaaatccaaataccattgatattaaaggtgcagatctaggaatgcactatggtcaagttgataatttccatatcaaatctgacaatccatttatcatcattggtggaaacgaaagtgcttgtgatgcactaacacatctagtatatttgggaaatcaagtcgaattatatacagatacgtttggtcgtaaagagagcaatcccgatccaagcatctctttatcccccctaactaaagaacgtttaaaacatatacaagaccacaaaaaagaatattatagtatctctgaaggcaagaaagccattgagattaaacaaattggaaaacaatatcaagttacttttgatgacggtagtactgcggagtctttccataaacctattctttccacaggttttctaaatacctgtcatctcattgacggaatcgctttatttgaatacgataaaaatcagttgccaatagttactgaagatgacgaatctactatcgttaataactgtttcttaattggtccaagcttacgacaaagagatactattttctgctatatttataaattcagacagcgctttgtccctgttattaatcatatcgcacaacgagaagggattatattagacgaagatacccttgaattctttaaagaaaatcaaatgtaccttgataacctagcttgttgcgatgtcaattgtgattgc

SEQ ID NO: 6456 - protein, 375 aa, Streptococcus agalactiae
MKHYQTIIIGAGAAGIGFGSAMQRLGLTNFLIIEKGHIGESFLRWPRTTQFITPSFTTNGFGFPDLNAVIPDTSPAFSFEKEHLSGVEYARYLQLVAAHYNLPIQNETSVLSIDKRDSLFVIKTSKGDFSADYLIMATGEFQNPNTIDIKGADLGMHYGQVDNFHIKSDNPFIIIGGNESACDALTHLVYLGNQVELYTDTFGRKESNPDPSISLSPLTKERLKHIQDHKKEYYSISEGKKAIEIKQIGKQYQVTFDDGSTAESFHKPILSTGFLNTCHLIDGIALFEYDKNQLPIVTEDDESTIVNNCFLIGPSLRQRDTIFCYIYKFRQRFVPVINHIAQREGIILDEDTLEFFKENQMYLDNLACCDVNCDC

SEQ ID NO: 6457 - DNA, 1041 bp, Streptococcus agalactiae
gtgtttgtaaagaaaggactatttgtgtttttactattatgtattttatcgatgtggctcatgatttttggggttgcattctattactttgggtcgctacatcaatcattgacttcaaggattatttatcagtttgtacttactgttttgctaacgacaacagcttggttcatgggtgcctattttttagcatttgaaggtcattttaaaactgtctttcaattccaagaagcagatggtaaacaaattgtaaattgtttatttcaactttgtttcgccctttacgcagtagtaatgcttattgggtcaattattgatagagttcagacgaagcgacttttattagctgttgtttcttggcttttcttggtgtatacgcccttagcttatttaatttggaattcagagggtgtttttgcaaagatgggagtacttgatttttcaggcggaatgatcgttcatttatctgcagggctttcttcgtatattttagctcatgttattggcaagagtgaacatcagcacaataaggttaaaaatgatagtctctttttaggaatgatacttattacatttggttggtttggatttaatatgggtccagttggtgagtggaattcacaagccattatgatacttttaaatactatatttgctattataggtggtggtttggcgtggacattggctgctaagtggaatggtgaggaagagaaaacaggaagcttattgaatggcattattgttggtcttgtgacgagtacagcaggagttgggtatctcttaacttggcaattattagctgtaacattctttgcatccctcttcacctactttgtaacggattacgttgcgaaagcttttgccattgatgatgtcgtttcctcctttggaatgaatggtattgggggattgttgggaagtttaggagttggtctctttaaattatcacatatgccagttcaactgttagcattagctaccacaattcttttgtcaattataatgacctatatcatatctaaagcgatttttagaaaa

SEQ ID NO: 6458 - protein, 347 aa, Streptococcus agalactiae
MFVKKGLFVFLLLCILSMWLMIFGVAFYYFGSLHQSLTSRIIYQFVLTVLLTTTAWFMGAYFLAFEGHFKTVFQFQEADGKQIVNCLFQLCFALYAVVMLIGSIIDRVQTKRLLLAVVSWLFLVYTPLAYLIWNSEGVFAKMGVLDFSGGMIVHLSAGLSSYILAHVIGKSEHQHNKVKNDSLFLGMILITFGWFGFNMGPVGEWNSQAIMILLNTIFAIIGGGLAWTLAAKWNGEEEKTGSLLNGIIVGLVTSTAGVGYLLTWQLLAVTFFASLFTYFVTDYVAKAFAIDDVVSSFGMNGIGGLLGSLGVGLFKLSHMPVQLLALATTILLSIIMTYIISKAIFRK

SEQ ID NO: 6459 - DNA, 549 bp, Streptococcus agalactiae
gtgaccgcttttggtcgtgagggttcaagtccctctctccgcagactagtcgagttcatttggaactcgactttttgcatatttaagataaagatggagtatcacatgtcaaaagtacgtggctttgaattagttagccaatttagcaataaagagttattaccaaaacgagaaacagctcacgcagctggctatgatttaaaagtagctaaaaaaacggttattgaacctggtgaaattacattggtcccgaccggtattaaagcatacatgcaaccaggggaggtcctgtacctttatgatcgttcatcgaatccacgtaaaaaagggattgtcctaataaattcagttggtgttattgatggtgactactataataaccaagtcaatgaaggacatatttttgcacagatgcaaaatattactgatcaggctgttattttagaagaaggggaacggattgttcaggctgtttttgccccattcttattggcagatgacgatcaggctacaggaatgcgtacaggtggttttggtagtactggaaaa

SEQ ID NO: 6460 - protein, 183 aa, Streptococcus agalactiae
MTAFGREGSSPSLRRLVEFIWNSTFCIFKIKMEYHMSKVRGFELVSQFSNKELLPKRETAHAAGYDLKVAKKTVIEPGEITLVPTGIKAYMQPGEVLYLYDRSSNPRKKGIVLINSVGVIDGDYYNNQVNEGHIFAQMQNITDQAVILEEGERIVQAVFAPFLLADDDQATGMRTGGFGSTGK

SEQ ID NO: 6461 - DNA, 444 bp, Streptococcus pyogenes
atgacaaaaattcgtggtttcgagcttgtttcaagctttactaatcctgatttactaccaaaacgtgagacgactcatgcagctggttatgacctgtctgttgctgaggctgtaaccattgccccaggggagattaagttggtaccaacaggggttaaggcctatatgcaagatggcgaggtgctttacctctatgatcgttcgtcaaatccacgaaaaaaagggattatcctgattaattcagtaggtgtgattgatgcagattattatggtaatgaggctaatgaaggacatatttttgcacaaatgcaaaacattacagatcaccctgtgacattagctgtgggtgagaggatcgttcagggtgtttttatgccttttttaattgctgatggtgaccaagccagaggtgaacgaacaggtggttttggttcgacagggcag

SEQ ID NO: 6462 - protein, 148 aa, Streptococcus pyogenes
MTKIRGFELVSSFTNPDLLPKRETTHAAGYDLSVAEAVTIAPGEIKLVPTGVKAYMQDGEVLYLYDRSSNPRKKGIILINSVGVIDADYYGNEANEGHIFAQMQNITDHPVTLAVGERIVQGVFMPFLIADGDQARGERTGGFGSTGQ

SEQ ID NO: 6463 - DNA, 1362 bp, Streptococcus agalactiae
gtggctaagaaaaaatcagtcttcacctgtcaagagtgtggttaccaatcacctaagtatttgggacgttgtccaaattgctcagcctggtcttcatttgtagaagaggttgaagttcaagaagttaaaaatgcacgagttagtttgaacggtgaaaagtcccgaccgacgaagttaaaagatgtttcctcaattaactattctagaactaagactgatatggatgaatttaaccgtgttctaggaggcggtgttgtaccaggaagtttggttctgattggaggagaccctgggataggtaaatctactttattactacaagtatcaactcagctagctaataaaggtacagtattatatgtctcaggtgaggaatctgcagaacagattaagttacgaagtgagcgtctaggcgatatcgataatgaattttacctttatgccgagactaatatgcaaagtattcggtcggagattgagaagattaaaccagattttcttattattgattctatacaaactattatgagtcccgaagtatcaagtgtccaaggctctgttagccaagttcgcgaagtgaccgctgaattgatgcagttagctaaaactaataatattgctacttttattgtaggtcatgtgactaaggagggaacattagcaggccctcgaatgctagaacatatggtggatacggttctttattttgaaggggagcgtcatcacacgttccgtattttacgggcagtcaaaaaccgttttggttcgaccaatgaaataggtatctttgaaatgcagtcgggtggtctagttgaagttttgaatccaagtcaagtttttcttgaagaacgtttagacggtgcaacaggatctgctattgttgttactatggaaggaacaaggcctattttagcagaggttcaagctttagtgactccgactgtttttggaaatgctaagcgtacaacaacaggtcttgactttaatcgtgtcagtcttattatggcagttctagaaaaacgttgtggtttattgcttcaaaatcaagatgcctatttaaaatcagcgggtggtgttaaattggatgaaccagcaattgatttagctgttgctgtagctattgcttccagttacaaagaaaaacccacaaatccacaagaatcatttattggagaaattggactcactggtgagattcgtcgcgtgacacgtattgagcaacgtattaatgaggctagtaaattgggctttactaaaatttacgcaccaaagaattctctagctgggattgaaatacctaaaggcattgatgttattggtgtgacaactgttagtcaggtcttaaaagcagtgttttcaaca

SEQ ID NO: 6464 - protein, 454 aa, Streptococcus agalactiae
MAKKKSVFTCQECGYQSPKYLGRCPNCSAWSSFVEEVEVQEVKNARVSLNGEKSRPTKLKDVSSINYSRTKTDMDEFNRVLGGGVVPGSLVLIGGDPGIGKSTLLLQVSTQLANKGTVLYVSGEESAEQIKLRSERLGDIDNEFYLYAETNMQSIRSEIEKIKPDFLIIDSIQTIMSPEVSSVQGSVSQVREVTAELMQLAKTNNIATFIVGHVTKEGTLAGPRMLEHMVDTVLYFEGERHHTFRILRAVKNRFGSTNEIGIFEMQSGGLVEVLNPSQVFLEERLDGATGSAIVVTMEGTRPILAEVQALVTPTVFGNAKRTTTGLDFNRVSLIMAVLEKRCGLLLQNQDAYLKSAGGVKLDEPAIDLAVAVAIASSYKEKPTNPQESFIGEIGLTGEIRRVTRIEQRINEASKLGFTKIYAPKNSLAGIEIPKGIDVIGVTTVSQVLKAVFST

SEQ ID NO: 6465 - DNA, 1359 bp, Streptococcus pyogenes
atggcaaagaaaaaagcaacctttatctgtcaggagtgtggctaccagtcgccaaagtatttagggcgctgtccaaattgctcggcctggtcttcttttgtggaagaagtagaggtcaaagaagtcaaaaatgcccgtgttagtctagctggagaaaagtccagaccggttaaactaaaagatgtggataatattagttatcacagaacacagactgacatgtctgaatttaatagagttcttggagggggtgtggttcctggaagcttgattttaattggtggtgatccaggtattggaaaatccaccttactcttgcaggtatccacgcagctcgctaataagggaacggttctctatgtgtctggggaagaatcagcagagcagattaaactgcggagtgagcgtctgggtgatattgacaatgaattttacctctatgccgaaaccaatatgcaagctattcgcacagaaattgaaaatattaaaccagattttttaattattgactccattcagaccatcatgagccctgatattacaggtgttcaaggatcagtcagtcaggtgagagaagtcactgcagaattgatgcagcttgcaaagacgaacaacattgcaacctttattgtgggtcatgtcaccaaggaaggaaccttggctgggcctcgtatgttagaacatatggtggataccgttctctactttgaaggggaaaggcatcacacctttcgcattctgcgggctgtgaaaaaccgctttggctccactaacgagattggcatttttgaaatgcagtctggcggcttggtagaggtcttaaatcctagtcaagtctttttagaggaacgcttagatggggcaacaggatcggctgtcgttgtaacgatggaaggaagtcgtcctatcttagcagaggtgcaatctttagtgacaccaaccgtttttggcaatgccagacgaaccactacgggacttgatttcaatcgcgtaagcctaataatggcagttttagaaaagcgctgtggtttactcttacaaaatcaagatgcctacctcaagtcggctggtggtgtcaaactagacgaacctgccattgatttggcagtcgctgtggctatcgcatccagttataaggaaaaaccaaccagccctcaagaagctttcttaggcgagatcgggttaacaggtgagattcggcgagtgacccgtattgagcaacggattaatgaagcagcaaagcttggctttaccaaggtctatgctcctaaaaatgccttgcaaggcattgatatccctcaaggtattgaggttgtcggagtgactacggttggtcaggttttaaatgcagtttttagc

SEQ ID NO: 6466 - protein, 453 aa, Streptococcus pyogenes
MAKKKATFICQECGYQSPKYLGRCPNCSAWSSFVEEVEVKEVKNARVSLAGEKSRPVKLKDVDNISYHRTQTDMSEFNRVLGGGVVPGSLILIGGDPGIGKSTLLLQVSTQLANKGTVLYVSGEESAEQIKLRSERLGDIDNEFYLYAETNMQAIRTEIENIKPDFLIIDSIQTIMSPDITGVQGSVSQVREVTAELMQLAKTNNIATFIVGHVTKEGTLAGPRMLEHMVDTVLYFEGERHHTFRILRAVKNRFGSTNEIGIFEMQSGGLVEVLNPSQVFLEERLDGATGSAVVVTMEGSRPILAEVQSLVTPTVFGNARRTTTGLDFNRVSLIMAVLEKRCGLLLQNQDAYLKSAGGVKLDEPAIDLAVAVAIASSYKEKPTSPQEAFLGEIGLTGEIRRVTRIEQRINEAAKLGFTKVYAPKNALQGIDIPQGIEVVGVTTVGQVLNAVFS

SEQ ID NO: 6467 - DNA, 495 bp, Streptococcus agalactiae
atgaccacttattttgataactttttaaaaaccaatcaagcctatgctgacttacatggaacagctcatctacctatcaagccaaagacaaaggttgctattgtaacctgtatggattctcgtttacacgttgctcaagctctagggctagctttaggagatgctcatattttacgtaatgctggtggacgagttacagacgatgttctacgttctttagttatttcgcaacaacaattaggaacacgagaaatcgttgttctacaccatacagattgtggagcacagacgtttactaacgaagcttttgctgctcaattacagagagatttgggtgttgatatgcatggacatgattttcttccttttaatgatattgaagaaagcgttcgtgaagatgtggcaaaattacatgcttctccattaatcccagatgatgttgttatttctggtgctatttatgatgtagatactggtcgtatggtggaagttaaa

SEQ ID NO: 6468 - protein, 165 aa, Streptococcus agalactiae
MTTYFDNFLKTNQAYADLHGTAHLPIKPKTKVAIVTCMDSRLHVAQALGLALGDAHILRNAGGRVTDDVLRSLVISQQQLGTREIVVLHHTDCGAQTFTNEAFAAQLQRDLGVDMHGHDFLPFNDIEESVREDVAKLHASPLIPDDVVISGAIYDVDTGRMVEVK

SEQ ID NO: 6469 - DNA, 498 bp, Streptococcus pyogenes
ttgatgtcttattttgaacattttatggctgccaatcaggcttatgtggccttgcatgggacagctcatttgcccttaaaacccaagactaaagtagcgattgtgacttgtatggattcacggctacatgtggcccaagctctggggctggctctaggagatgctcatattttaaggaatgctggcggacgtgtcaccgaagacatgattcggtcgctggttatttctcagcagcaaatgggaacgagagagattgtggttctccaccatacagattgtggcgcgcagacttttactaatgaaggctttgccaagcatattcatgagcacttaggtgtggatgtttcagggcaagatttccttcccttccaagatgtggaagacagtgtccgcgaggatatggctaagataagagcctcctctcttatctctgatgatgtcgttattaacggtgccgtctacgatgtggatactggaaagatgacacaagtaatggaa

SEQ ID NO: 6470 - protein, 166 aa, Streptococcus pyogenes
LMSYFEHFMAANQAYVALHGTAHLPLKPKTKVAIVTCMDSRLHVAQALGLALGDAHILRNAGGRVTEDMIRSLVISQQQMGTREIVVLHHTDCGAQTFTNEGFAKHIHEHLGVDVSGQDFLPFQDVEDSVREDMAKIRASSLISDDVVINGAVYDVDTGKMTQVME

SEQ ID NO: 6471 - DNA, 1317 bp, Streptococcus agalactiae
atgaaaaaatatgatgtcattgttcttggttttggtaaagcaggtaaaacattagcagcaaaattagcaacacaaggtaaaagcgttgcaatggtcgaagaagacgataaaatgtacgggggaacatgtatcaacattggatgtattccgacaaaaacgcttttagtatcagctagcaaaaatcatgattttcaagaagctatgactactagaaatgaagttacaagtcgtttacgtgctaaaaattttgctatgttggataataaagacactgtggatgtttataatgctaaagcccgctttatatcaaataaagtggtcgaattaacaggaggagctgacaaacaagaacttacagctgatgttattattatcaatactggtgctaagtcagtacaattaccaatcccaggattagctgattctcaacatgtttatgattcaacggcaatccaagaattggctcatcttcctaaacggttaggtatcattggaggcggtaatattgggcttgaatttgcgactttatattccgaattagggagcaaagtgacagttattgatagtcaatcccgtatctttgcgcgtgaggaagaggaattatcagagatggctcaagattatttagaagagatggggatatcttttaaattatcagccgatatcaaatctgtgcaaaatgaagatgaagacgttgttattagctttgaggatgaaaaattaagctttgatgcagtattatatgcaacaggacgtaagccaaatacagaaggtttagcacttgaaaatacagatattaaattgacagaacgtggagctattgctgttgatgaatattgccaaacttctgttgagaatatttttgcagttggtgatgttaatggcggccctcaattcacatatatttctttagatgactcacgtattgtcttaaattatttgaattgtgataaggattattctctaaaaaatcgaggagcagtaccgacttcaacctttacaaatcctcctttagcaacggtaggtctagatgaaaagaccgctaaggaaaaaggatatcaagttaaatctaatagccttcttgtttctgccatgccacgtgcacatgttaataatgaccttagaggtatttttaaagttgtggtagatactgagacaaatcttattttgggagctcgcttatttggtgcagaatcccatgaattaattaatatcatcacaatggcaatggataataaaatcccatatacttatttccaaaaacaaattttcactcacccaacaatggtagagaattttaatgatttgtttaacttt

SEQ ID NO: 6472 - protein, 439 aa, Streptococcus agalactiae
MKKYDVIVLGFGKAGKTLAAKLATQGKSVAMVEEDDKMYGGTCINIGCIPTKTLLVSASKNHDFQEAMTTRNEVTSRLRAKNFAMLDNKDTVDVYNAKARFISNKVVELTGGADKQELTADVIIINTGAKSVQLPIPGLADSQHVYDSTAIQELAHLPKRLGIIGGGNIGLEFATLYSELGSKVTVIDSQSRIFAREEEELSEMAQDYLEEMGISFKLSADIKSVQNEDEDVVISFEDEKLSFDAVLYATGRKPNTEGLALENTDIKLTERGAIAVDEYCQTSVENIFAVGDVNGGPQFTYISLDDSRIVLNYLNCDKDYSLKNRGAVPTSTFTNPPLATVGLDEKTAKEKGYQVKSNSLLVSAMPRAHVNNDLRGIFKVVVDTETNLILGARLFGAESHELINIITMAMDNKIPYTYFQKQIFTHPTMVENFNDLFNF

SEQ ID NO: 6473 - DNA, 1509 bp, Streptococcus agalactiae
ttgactaattcagttaaactgaaaaagtttactatcagaaaatataggagtagaattttggctaataagattcgtgtgcgttatgcaccaagtccaacaggattgttacacatcggaaatgcgcgtactgcgctctttaactacctttatgctcgccatcatggtggggattttgttattcgtattgaagatactgaccgaaaacgccacgtcgaagatggtgaacgctctcaattggagaacttacgttggctaggtatggactgggatgaaagtcctgaaacacatgaaaattatcgtcaatcagaacgccttgagctctaccaacgttatattgatcagttgttagcagaaggtaaagcctacaagtcctatgtgactgaggaagaattagcagcagagcgtgaacgccaagaattggcaggcgaaacacctcgctatatcaacgaatttatcggaatgtcagaaactgaaaaagaagcttacattgcagagcgtgaagcagcaggcatcattccgacagtacgccttgctgttaatgaatctgggatttataaatggactgatatggtaaaaggtgacattgagtttgaaggctctaatatcggcggagactgggttattcagaagaaagatggttatccaacttacaatttcgcagtagtcattgatgatcatgacatgcaaatttcgcatgttatccgtggcgatgaccatattgcaaatacgccaaaacaattaatggtttatgaagcactcggttgggaagcgccacaatttggtcacatgacattgattataaactcagagactggtaagaaattatcaaaacgcgacaccaatactcttcaatttatcgaagactatcgtaaaaaaggttatatgtcggaagctgtctttaatttcattgcccttcttggctggaatcctggtggagaagaagaaatcttctcacgcgagcaattaattaatctatttgatgaaaatcgtcttagcaaatcaccagcagcattcgatcagaagaaaatggattggatgagtaatgattacctaaaaaatgctgattttgagagtgtttttgcactttgcaaaccattcttagaagaagctggtcgacttacagacaaagctgaaaaattagttgagctttatcaacctcaattaaaatcagctgatgagattgtaccattaacagaccttttctttgcagattttccagaactaacagaagccgaaaaagaagtaatggcagctgaaacagtcccaacagtcttatctgcttttaaggaaaagttagtatcgctttctgacgaagaattcactagagatactattttccctcaaattaaggctgttcaaaaagaaacaggtattaaaggtaagaacctatttatgcctattcgtattgcggtttctggtgaaatgcatggaccagagttaccagatactatttatttattaggtaaagaaaaatcagttcaacatatcgataatatgttagcaaaatta

SEQ ID NO: 6474 - protein, 503 aa, Streptococcus agalactiae
MTNSVKLKKFTIRKYRSRILANKIRVRYAPSPTGLLHIGNARTALFNYLYARHHGGDFVIRIEDTDRKRHVEDGERSQLENLRWLGMDWDESPETHENYRQSERLELYQRYIDQLLAEGKAYKSYVTEEELAAERERQELAGETPRYINEFIGMSETEKEAYIAEREAAGIIPTVRLAVNESGIYKWTDMVKGDIEFEGSNIGGDWVIQKKDGYPTYNFAVVIDDHDMQISHVIRGDDHIANTPKQLMVYEALGWEAPQFGHMTLIINSETGKKLSKRDTNTLQFIEDYRKKGYMSEAVFNFIALLGWNPGGEEEIFSREQLINLFDENRLSKSPAAFDQKKMDWMSNDYLKNADFESVFALCKPFLEEAGRLTDKAEKLVELYQPQLKSADEIVPLTDLFFADFPELTEAEKEVMAAETVPTVLSAFKEKLVSLSDEEFTRDTIFPQIKAVQKETGIKGKNLFMPIRIAVSGEMHGPELPDTIYLLGKEKSVQHIDNMLAKL

SEQ ID NO: 6475 - DNA, 1443 bp, Streptococcus pyogenes
atgtctaaaccaattcgtgtgcgttatgcaccaagtccaacagggcttttacatatcgggaatgcccgcacagccctatttaattacctttatgcccgtcgtcacggaggtacttttatcattcgtattgaagatactgaccgtaaacgtcatgttgaagatggtgaacgttctcaacttgaaaacctaaaatggttaggaatggattgggatgaaagcccagaaacgcatgaaaattaccgccagtctgaacgtctagcactttatcaacaatatattgatcaattgttagctgaaggaaaagcctacaagtcttacgtgactgaggaagaattggcagcagagcgtgaacgccaagaagcagctggcgaaacgcctcgctatatcaatgaatttattggtatgtcagctgacgaaaaagctaagtacattgctgagcgtgaagcagcaggtatcgttccaacagtccgtcttgctgttaatgagtccggtatttacaaatggactgacatggttaaaggcgatatcgagtttgaaggtggtaacatcggtggtgactgggttattcaaaagaaagatggctatccaacttataactttgccgttgttgttgatgatcatgatatgcaaatttctcacgttatccgtggcgatgaccatattgccaatacgccaaaacaattgatggtctatgaagctcttggctgggaagcgccagagtttggtcatatgactcttatcatcaattctgaaacgggtaaaaaattatcaaaacgcgacaccaataccctccaattcattgaagattaccgcaaaaaaggttatatgcctgaagctgtctttaacttcatcgcccttcttggctggaatcctggcggagaagaggaaatcttctctcgtgagcaactgattgccctttttgatgaaaatcgccttagcaagtcgccagctgcctttgaccagaagaaaatggattggatgagcaatgagtatcttaaacatgcggattttgaaacagtttatgccctctgcaaaccattccttgaagaggcaggccgtttgacagaaaaagctgagaagctagtagaattatacaaacctcaattaaaatctgcagatgagattattccattgactgaccttttcttttctgatttccctgaattaacagaagccgaaaaagaagtgatggcaggtgaaacagtttcgacagtcttgcaagctttcaaggctaagttggaagctatgtcagatgaagacttcaaaccagaaaatattttcccacaaattaaggctgttcaaaaagaaacaggaatcaaagggaaaaacctctttatgcctattcgtattgcagtatctggtgaaatgcatggcccagaattaccaaatacgatttatttattgggacgtgataaatccattgagcacatcaaaaacatgcta

SEQ ID NO: 6476 - protein, 481 aa, Streptococcus pyogenes
MSKPIRVRYAPSPTGLLHIGNARTALFNYLYARRHGGTFIIRIEDTDRKRHVEDGERSQLENLKWLGMDWDESPETHENYRQSERLALYQQYIDQLLAEGKAYKSYVTEEELAAERERQEAAGETPRYINEFIGMSADEKAKYIAEREAAGIVPTVRLAVNESGIYKWTDMVKGDIEFEGGNIGGDWVIQKKDGYPTYNFAVVVDDHDMQISHVIRGDDHIANTPKQLMVYEALGWEAPEFGHMTLIINSETGKKLSKRDTNTLQFIEDYRKKGYMPEAVFNFIALLGWNPGGEEEIFSREQLIALFDENRLSKSPAAFDQKKMDWMSNEYLKHADFETVYALCKPFLEEAGRLTEKAEKLVELYKPQLKSADEIIPLTDLFFSDFPELTEAEKEVMAGETVSTVLQAFKAKLEAMSDEDFKPENIFPQIKAVQKETGIKGKNLFMPIRIAVSGEMHGPELPNTIYLLGRDKSIEHIKNML

SEQ ID NO: 6477 - DNA, 966 bp, Streptococcus agalactiae
atgaaatttggaaaaaaacttggctttctagccttattgatgtctattgtcctcattctaggtgcatgtggtaaaactggacttggaaattcttctgggaattctacaaaaaatgtaaccaaaaaatctgctaaagatttgaaactaggtgtatctatttcaacaactaacaatccctactttgttgcgatgaaagacggtattgacaaatatgctagcaataaaaaaataagcattaaggtagctgatgctcaagatgacgccgcacgtcaagcagatgatgtccaaaactttattagtcaaaacgtagatgctattttgattaatcccgttgactcaaaagctattgtaacagctattaagtctgcaaacaacgctaatattcctgttattctaatggaccgtggtagtgagggaggcaaagtattaactactgtcgcttcagataacgttgctgctggtaagatggctgcggattatgccgttaaaaaactaggcaaaaaagcaaaagcctttgaattatctggagtaccaggtgcctctgctactgtagaccgtggtaaaggatttcattcagttgcaaaatctaaacttgacatcctttcaagccaatctgccaattttgaccgcgccaaagctttgaatactacacaaaatatgattcaaggacataaagatgtccaaattattttcgcacaaaatgatgaaatggcacttggggctgcacaggctgtcaaatctgctggcttgcaaaatgttcttatcgtaggaattgatggtcagccagatgcccatgatgccattaaaaaaggagatatttcagccactattgcacaacaaccagctaagatgggagaaatagcaattcaagcagcaattgattattataaaggcaaaaaagtagagaaagaaacaatttctccaatttaccttgttaccaaagacaatgttgaaaaatacaattgg

SEQ ID NO: 6478 - protein, 322 aa, Streptococcus agalactiae
MKFGKKLGFLALLMSIVLILGACGKTGLGNSSGNSTKNVTKKSAKDLKLGVSISTTNNPYFVAMKDGIDKYASNKKISIKVADAQDDAARQADDVQNFISQNVDAILINPVDSKAIVTAIKSANNANIPVILMDRGSEGGKVLTTVASDNVAAGKMAADYAVKKLGKKAKAFELSGVPGASATVDRGKGFHSVAKSKLDILSSQSANFDRAKALNTTQNMIQGHKDVQIIFAQNDEMALGAAQAVKSAGLQNVLIVGIDGQPDAHDAIKKGDISATIAQQPAKMGEIAIQAAIDYYKGKKVEKETISPIYLVTKDNVEKYNW

SEQ ID NO: 6479 - DNA, 636 bp, Streptococcus agalactiae
ttgggaatgctaaacggactcttcatttcttacggaaaattagcaccatttatcgttacactggcaacaatgactatctttagaggagcaacgctagtttattcaaacggcaacccaattaccgctggcttatccgatagttttctattccaatttttgggacaaggctatattgttggtatcccattcccagtcattctcatgtttcttacttttattattttgtatattttgttacataaaacagccttcgggaaatctgtttacgctttaggaggtaatgaaaaagcagcgtatatctcgggtattaagttaaacaaagttaaaattatcatctacactatctcaggtatcatggcttccatttctgggttaattatcacatcacgccttagctcagcacaaccaacagctggagcaagttatgagatggatgctattgccgccgttgtcttaggtggaacgtctttatctggtgggaaaggacgtatcattggaacattgattggtgctcttattattggtgtcctgaacaatggattaaacatcattggtgtctctgcattttggcaacaagttgtgaaaggtatcgttattttaatggctgttttacttgatcgctttaaagtagcaaaa

SEQ ID NO: 6480 - protein, 212 aa, Streptococcus agalactiae
MGMLNGLFISYGKLAPFIVTLATMTIFRGATLVYSNGNPITAGLSDSFLFQFLGQGYIVGIPFPVILMFLTFIILYILLHKTAFGKSVYALGGNEKAAYISGIKLNKVKIIIYTISGIMASISGLIITSRLSSAQPTAGASYEMDAIAAVVLGGTSLSGGKGRIIGTLIGALIIGVLNNGLNIIGVSAFWQQVVKGIVILMAVLLDRFKVAK

SEQ ID NO: 6481 - DNA, 348 bp, Streptococcus agalactiae
atgaagagtccgtttagcattcccaagatgccacctaaggcaacagataaaacgatagcaataccaacgggtactccgtggccgattaatccagctgttaatgcactagatagggctaatatggacccgactgataaatcaataccgccagtcaaaataacgaaggtcatcccgaaagcgataaaaccatttgcagttacttgtaataataaattgagtagattattggttgtgaggaaattaggattaatgagtgtgataataaccattaaaccagctaacgcaatcagggttgttaactctgatatatatttcatcatatttttcactttacttacctcctgtggc

SEQ ID NO: 6482 - protein, 116 aa, Streptococcus agalactiae
MKSPFSIPKMPPKATDKTIAIPTGTPWPINPAVNALDRANMDPTDKSIPPVKITKVIPKAIKPFAVTCNNKLSRLLVVRKLGLMSVIITIKPANAIRVVNSDIYFIIFFTLLTSCG

SEQ ID NO: 6483 - DNA, 1476 bp, Streptococcus agalactiae
atgaaaattgacatgaggaatatctccaaatccttcggtactaataaagttctagaaaagattgatttggaattacaatctggtcaaatacacgcgcttatgggtgaaaatggtgcgggtaaatcaaccttaatgaacattctaacaggactttttccagcaagtacaggaactatttatattgatggcgaggaacgaactttttcaaaccctcaagaagcagaggaatttggtattagttttattcaccaagagatgaatacttggccggaaatgactgtcttggaaaatctctttcttggacgtgaaatcaagacaacttttggcttactcaatcaaaaattaatgagacaaaaagcacttgaaacttttaaaagattaggtgtgactattcccctagacatcccgattggtaacttgtctgttggacaacaacaaatgattgaaatcgccaaaagtctcctaaaccaactctctattttggtaatggatgaaccgactgctgctttaacagatcgtgaaactgaaaatcttttccgagttatccgaggtttgaaacaagaaggagtgggcgttgtctatatctcccatcgaatggaggaaatttttaaaatcactgacttcgtaaccgtcatgagagatggtgtcattgtagatacaaaagaaacatcactcacaaattctgacgaattggttaaaaaaatggttggccgaaaattggaagattactatcctgaaaaacattctgaaattgggcctgttgcttttgaagttagtaacctctgtggagataatttcgaggacgtttccttttatgtccgtaaaggcgagattcttggattttctggattaatgggagctgggcgtactgaagttatgcgaactatctttggaattgataaaaagaagtctggtaaggtgaaaattgatgaccaagaaatcactattactaccccaagccaagctatcaagcagggcattggttttttgaccgaaaatagaaaagatgaaggtctcatcctagacttcaatatcaaggacaatatgactctccctagcactaaagattttagcaaacatggtttctttgatgaaaaaacaagcacaacatttgtgcaacaattgattaatcgtctctacattaaatcagggagaccagatttagaggttggaaatctttctggaggtaaccaacaaaaggtcgttctcgctaaatggattggtattgctcctaaagtcttaattcttgatgagccaacgcgtggtgttgatgtcggtgctaaacgagagatttaccaattaatgaatgaactagcagacagaggtgttccaattgtcatggtatcatcagacttacctgaaattctaggtgttagtgaccgcatcatggtaatgcacgaaggtcgaatcagtggagaactcagtcgaaaagaagctgaccaagaaaaagttatgcaactagccacaggaggtaag

SEQ ID NO: 6484 - protein, 492 aa, Streptococcus agalactiae
MKIDMRNISKSFGTNKVLEKIDLELQSGQIHALMGENGAGKSTLMNILTGLFPASTGTIYIDGEERTFSNPQEAEEFGISFIHQEMNTWPEMTVLENLFLGREIKTTFGLLNQKLMRQKALETFKRLGVTIPLDIPIGNLSVGQQQMIEIAKSLLNQLSILVMDEPTAALTDRETENLFRVIRGLKQEGVGVVYISHRMEEIFKITDFVTVMRDGVIVDTKETSLTNSDELVKKMVGRKLEDYYPEKHSEIGPVAFEVSNLCGDNFEDVSFYVRKGEILGFSGLMGAGRTEVMRTIFGIDKKKSGKVKIDDQEITITTPSQAIKQGIGFLTENRKDEGLILDFNIKDNMTLPSTKDFSKHGFFDEKTSTTFVQQLINRLYIKSGRPDLEVGNLSGGNQQKVVLAKWIGIAPKVLILDEPTRGVDVGAKREIYQLMNELADRGVPIVMVSSDLPEILGVSDRIMVMHEGRISGELSRKEADQEKVMQLATGGK

SEQ ID NO: 6485 - DNA, 396 bp, Streptococcus agalactiae
atgaaaaagactggtatattaaatagtcatctcgctaaattagcagacgaccttgggcatactgatcgagtttgtattggagatctgggtctacctgttccaaatggcattccaaagattgatttgtctttgacctctggaatacctagtttccaagaggtacttgatatctatttagagaatatcttagttgaaaaagtcattttagcagaagaaatcaaggaagcaaatccggatcaattatcaaggttattagctaaacttgataactctgttagcatagagtacgtcagtcacaatcatttaaaacaaatgacccaagatgtcaaagcagttattcgtacaggtgaaaatacaccgtattcaaatattattctacaatctggtgttatcatc

SEQ ID NO: 6486 - protein, 132 aa, Streptococcus agalactiae
MKKTGILNSHLAKLADDLGHTDRVCIGDLGLPVPNGIPKIDLSLTSGIPSFQEVLDIYLENILVEKVILAEEIKEANPDQLSRLLAKLDNSVSIEYVSHNHLKQMTQDVKAVIRTGENTPYSNIILQSGVII

SEQ ID NO: 6487 - DNA, 909 bp, Streptococcus agalactiae
atgagtaacattgtcattatcggtagtatttccatggacttagttatggaaaccaatcgtatcgccaaagagggagaaaccgtatttggccaacgtttttcaatggttccaggaggtaaaggtgctaatcaggctgtcgctattgggcgtcttagccaagagcgagataatattactattcttggtgccattggcgaggattcttttggtcccattcttttggataatttaaacaaaaatcatgttactacggattttgtgggaacgataccatcttcttcaggtgttgcccaaatcactctttataataatgataatcgaatcatttactgtcctggagccaacggaaaagttgatactaaaaaatggtctcaggagtggtcaataattaaagaagctgatttagttgtattacaaaatgaaattcctcatcaagcaaatatgaaaattgctaatttttgtaaagaacatagtattaaattactctataatcctgcaccatctagagagactgatattgagatgctcgataaggtcgattatttcacaccaaatgaacacgaatgtcaagagctgttcccaaaccaaaaactagaggatatattagccacatatcctgaaaaactaatcgtaacactcggcacaaaaggagccatctactctgatggaaaagaaagtcatttaattcctgctttagaaactaaagctgttgatacaactggtgcaggtgatacttttaacggtgcattcggttatgctatctcgaaaaaatttaagattgctaaggccttacgttttgcaactctagctgctcacttatccgtgcaaaaatttggtgcacagggtggcatgcctacaattaaagaaatggaggacaaccaacattatgaaaaagactggtatattaaa

SEQ ID NO: 6488 - protein, 303 aa, Streptococcus agalactiae
MSNIVIIGSISMDLVMETNRIAKEGETVFGQRFSMVPGGKGANQAVAIGRLSQERDNITILGAIGEDSFGPILLDNLNKNHVTTDFVGTIPSSSGVAQITLYNNDNRIIYCPGANGKVDTKKWSQEWSIIKEADLVVLQNEIPHQANMKIANFCKEHSIKLLYNPAPSRETDIEMLDKVDYFTPNEHECQELFPNQKLEDILATYPEKLIVTLGTKGAIYSDGKESHLIPALETKAVDTTGAGDTFNGAFGYAISKKFKIAKALRFATLAAHLSVQKFGAQGGMPTIKEMEDNQHYEKDWYIK

SEQ ID NO: 6489 - DNA, 1020 bp, Streptococcus agalactiae
gtgaaaccgtttccacaatataagaaaggagtttctatgagtacgattagacaagtcgccgagaaagctggcgtatcaacatctactgtctcaaggtatatatcccaaaatggttacgttagtcaaaaagcaagtcaaaaaatcgagcaagctatccgcgaactccattatgttccaaatttccttgcacaatctctgaaaaccaaaaaaaatcaacttgttggattactacttcccgatatttcaaaccctttctttccaagacttgctagaggagttgaagaatttctaaaagaacagggttatcgtgtcatgcttggcaacacaaataacaagagccatttagaagaagagtacttaaatgtgctattacaaagtaatgctgcagggattattacaacacacgatttcaccaaaaatcatcctgaaatagatattccagttgtagttgttgaccgcgttaatcaagaaacacagtacggcgttttctctgataataaagagggaggaaaattagcagctcaagctatttggacagcaggtgctaccaatatattactcattcgtggtccgctagataaagctgataaccttaatcaaaggtttcaaggaagccaaaattacctattaaacaaaggggcttgttttgctatcgaagatagtgccagttttgattttgcagagattcaaattgaagcgaaaactttacttgaccaccatccagacattgatagcattatcgctccatctgatatacatgctattgcctacctacacgagattcttaatcgagggaagcgaatccctgaagatgtacaaattattggttatgatgatattttaatgagccaatttatctacccttcgttgtcaactattcaccaatcatcatatattatgggacaaaaagcagctgaattaattttcaaaattactaatcaattacctattaccaataagcgtattaaattacccgttcattatgtcgaacgtgaaaccctaaggaggaaaatagatgag

SEQ ID NO: 6490 - protein, 340 aa, Streptococcus agalactiae
MKPFPQYKKGVSMSTIRQVAEKAGVSTSTVSRYISQNGYVSQKASQKIEQAIRELHYVPNFLAQSLKTKKNQLVGLLLPDISNPFFPRLARGVEEFLKEQGYRVMLGNTNNKSHLEEEYLNVLLQSNAAGIITTHDFTKNHPEIDIPVVVVDRVNQETQYGVFSDNKEGGKLAAQAIWTAGATNILLIRGPLDKADNLNQRFQGSQNYLLNKGACFAIEDSASFDFAEIQIEAKTLLDHHPDIDSIIAPSDIHAIAYLHEILNRGKRIPEDVQIIGYDDILMSQFIYPSLSTIHQSSYIMGQKAAELIFKITNQLPITNKRIKLPVHYVERETLRRKIDE

SEQ ID NO: 6491 - DNA, 1023 bp, Streptococcus pyogenes
ttgagattgaaaaatccccataaacttattttacaaggaggtaaggctatggtaaccattaaacaagttgctgaagaagcaggtgtttctagatcaacagtctccaggtatatttctcaaaaaggatatgtatctgatgatgcaaggcataaaatcaaagcagcgatagcaaaattacattacactccaaatgtcttggcgcagtcattgaagacgaaaaaaaatcaactagtcggtttattattaccagacatttccaatcctttttttccgaggttagcaagaggagcagaagaatatttaaaagaaaaggggtatcgggttatgctaggaaatatttcagacagcgaagctcttgaagaagaatacgtccatgtccttcttcaaagcaatgctgctggcattattactacccatgactttacaaagcggtatcctactcttgctattccagttgtagtggtagatcgtgttgaccaagagacccagtacggtgtcttttcagataatagggcagggggcttattggcggctcagactgtctggcaagcaggggcaaaagaagttttgttaataagaggtccgctggataatgctgaaaacattaatgagcggtttgaagctagtttttcttaccttcaaaaacaagacgtgactatgtatgtgtgtgatagtcagaattttgattttgaaagtattcagctagaagctagttacaacctcaagtgttacccaacaatagacagtattatagcaccttctgatatccatgctattgcttatattcatgaactgcattctcaaggtaaaaagattcctcaagatgttcaaataataggttatgatgacattttaatgagtcaatttatttatccttctttatcgactattcatcaatcctcttatttgatgggccgttatgccgccgaattagtttatactattgctagtcaattaactgtgaaagcaaatcggattaaattgcctgttcactacgttgagcgagaaacaataaggaaaaga

SEQ ID NO: 6492 - protein, 341 aa, Streptococcus pyogenes
LRLKNPHKLILQGGKAMVTIKQVAEEAGVSRSTVSRYISQKGYVSDDARHKIKAAIAKLHYTPNVLAQSLKTKKNQLVGLLLPDISNPFFPRLARGAEEYLKEKGYRVMLGNISDSEALEEEYVHVLLQSNAAGIITTHDFTKRYPTLAIPVVVVDRVDQETQYGVFSDNRAGGLLAAQTVWQAGAKEVLLIRGPLDNAENINERFEASFSYLQKQDVTMYVCDSQNFDFESIQLEASYNLKCYPTIDSIIAPSDIHAIAYIHELHSQGKKIPQDVQIIGYDDILMSQFIYPSLSTIHQSSYLMGRYAAELVYTIASQLTVKANRIKLPVHYVERETIRKR

SEQ ID NO: 6493 - DNA, 1119 bp, Streptococcus agalactiae
atgttcacatcaaaagatcaaaggagaaaaaccatgtcacatgcttggaaagaattaaccttttataagaaaaaatacctcctgattgaattgctaatcattgttatgatgttcatggtagtttttttatcaggtttagcaaacggtttaggtagagctgttagtgctgctattgaaaataacccagctcaaacctatattttgaatgaaggtgctgaacaagtgattacatcatctgtattgacaactaaagatcagacagatttaaacagtttgaatttaaaagatagtaccactttaaatattcaacgttcgagtttaactcgacaaggacacgaaaagaaaattgatatttcttattttgctattgataaagattcttttatggcacctacactttctgagggaaaacaactgacaagttacaaaaaagctattattttaaatgatagtttaaaagctgaagggataaagttaggtgataaagtgattgataagtcatcatctatatcactaacagtcgttggatttgtccataatagtatgtatggtcacggacctgtggcatttattgataaagacatttataccgaaattaataaaaagattaatcctcaataccagttcttacctcaggcattagttatgaaaaatgataaaagtatatctcatttaccaactcaattagaagctgttagtaaaaaagatgtcattcaacatattcctggttatagtgccgaacaatccactttgaatatgattttatgggtccttgtcgtagcttcagctggtattttaggtgtctttttctacatcatcacacttcaaaaacgtcatgaatttagcgtcatgaaagctattgggacaaaaatgtcagagattgccctatttcaattgagtcaagtcattatattggcactgtttggtatcattgttggagatggattggcggttgctctctcttatgtattaccagctcaaatgccatttgttattaattggcaaaatattattctagtatcgtttgtatttttagtcattgcaatgattagtagtgctttgtcaattgtaaaagttgctaaaatcgacccagtcgaagttattaatgggggaggagaa

SEQ ID NO: 6494 - protein, 373 aa, Streptococcus agalactiae
MFTSKDQRRKTMSHAWKELTFYKKKYLLIELLIIVMMFMVVFLSGLANGLGRAVSAAIENNPAQTYILNEGAEQVITSSVLTTKDQTDLNSLNLKDSTTLNIQRSSLTRQGHEKKIDISYFAIDKDSFMAPTLSEGKQLTSYKKAIILNDSLKAEGIKLGDKVIDKSSSISLTVVGFVHNSMYGHGPVAFIDKDIYTEINKKINPQYQFLPQALVMKNDKSISHLPTQLEAVSKKDVIQHIPGYSAEQSTLNMILWVLVVASAGILGVFFYIITLQKRHEFSVMKAIGTKMSEIALFQLSQVIILALFGIIVGDGLAVALSYVLPAQMPFVINWQNIILVSFVFLVIAMISSALSIVKVAKIDPVEVINGGGE

SEQ ID NO: 6495 - DNA, 1074 bp, Streptococcus pyogenes
atgtttttagcgcttaatgaaatgaaacaatccaaattgcggtatggtttgattgctggtttgctatgtttggttgcctatttgatgttctttttgtcaggattggcctttggtttgatgcaggagaaccgctcggcggttgatctttggaaagctgacagtgttttactagccaaggatgctgacgctaccttgaccttatcacaggtgtccagagctcaagaaaatcaaataacagcagacaaggtagctcctcttgctcaactcaataccgtggcgtggtcagttaaaaatcctaaggatgccgacaaagttaaggttagccttttcgggattgattctaatagctttattcgtcctaacattgtaaaaggtcgattatttaagactaacaaagaggttgttttggatcaaagccttgcaaaagaggaagcttttgcgattggcaaggacttttacacatcgagttctagtcaagcattaactatcgttggttatactcaaaatgctagatttagtgttgcaccagtggtttatatgaatttggaagcttttgaaacattaaaatatggagaaccactaccaaaagataagcaagttgttaatgcttttatcactaaaggaagtttaacagattatcctaaaaaagacttccaaaaattagatattaaaacctttattactaaattacctggttatagcgctcaacttttaacttttggctttatgattagttttcttgtcattatttcagctattattattggtatttttatgtatattttgactattcaaaaggcacctatttttgggattatgaaagcgcaaggaatttctaacaaaacgattacgaccgctgtgcttatgcagacattctttttgagttttttaggtagtggtttagggttgctaggtacttggctgacatcattattattaccaacagtagtaccttttcaaagcaattggtttttgtatttggctatattcgttagtatgatctgttttgctctattaggcaccttattttctgtttttaacattatacgaattgatcctttgaaagcaattgga

SEQ ID NO: 6496 - protein, 358 aa, Streptococcus pyogenes
MFLALNEMKQSKLRYGLIAGLLCLVAYLMFFLSGLAFGLMQENRSAVDLWKADSVLLAKDADATLTLSQVSRAQENQITADKVAPLAQLNTVAWSVKNPKDADKVKVSLFGIDSNSFIRPNIVKGRLFKTNKEVVLDQSLAKEEAFAIGKDFYTSSSSQALTIVGYTQNARFSVAPVVYMNLEAFETLKYGEPLPKDKQVVNAFITKGSLTDYPKKDFQKLDIKTFITKLPGYSAQLLTFGFMISFLVIISAIIIGIFMYILTIQKAPIFGIMKAQGISNKTITTAVLMQTFFLSFLGSGLGLLGTWLTSLLLPTVVPFQSNWFLYLAIFVSMICFALLGTLFSVFNIIRIDPLKAIG

SEQ ID NO: 6497 - DNA, 684 bp, Streptococcus agalactiae
atgtcagcaatcttagaattaaaacacatctcaaagcactatccagatggagatgagcttttatcaatattagataatttagatttatcagtttctgcaggtgagtttgtagctatactgggaccctcaggttcaggtaaaagcacacttttatccattgcagggttacttcttggcgcagatcaaggtagtttgtatgtcaatcatgagaacgttacggatttgtctcaaagacaaagaacacaattgcgccgtgaagcactaggttttatatttcaaagtcatcaactgcttccttatttaacaatccaagaacagttgcaacaagaggctcgatttgcaaaacactatgataagaaaacaagcttggaagaaattaataaattattatcagatttaggaatagagcagtgtgcacataaataccctaaccaattatcgggaggacaaaagcaacgcgcagcaattgctagagcatttattaatcatcctaaggttatcttggcagatgagccaacagctagccttgatgaagaacgtgggcgtcaagttacagaacttattcgtcaggaagttaaatcacataatactgcagctattatggtgacacacgatgagcgcgttctagatttagtagataccgtttatcgtttaaaggacgggaaattagttaaagaaaacttc

SEQ ID NO: 6498 - protein, 228 aa, Streptococcus agalactiae
MSAILELKHISKHYPDGDELLSILDNLDLSVSAGEFVAILGPSGSGKSTLLSIAGLLLGADQGSLYVNHENVTDLSQRQRTQLRREALGFIFQSHQLLPYLTIQEQLQQEARFAKHYDKKTSLEEINKLLSDLGIEQCAHKYPNQLSGGQKQRAAIARAFINHPKVILADEPTASLDEERGRQVTELIRQEVKSHNTAAIMVTHDERVLDLVDTVYRLKDGKLVKENF

SEQ ID NO: 6499 - DNA, 669 bp, Streptococcus pyogenes
gtgatgtcggttttaacatttaaacaagtgaccaaaacatttcaagatggtcatcacgaaatcaacgcattaaaggcaactgacttttccattgaagctggagaatttgtggctattattggaccatcaggttctggaaaatcaacctttttgaccattgctggtggcttacagaccccaagttctggtcagctaatcattgatggcactgattatacgcatttatcagaaaaagagcgctcacgcttgcgcttcaaatccgttggttttatcttacaagcttccaatctgatacctttttcaacggtccagcagcagttggaattggtcgatcatttgacaggaagcaaagaaaaagccaaagccaatcagttatttgacgatttaggcattacagggctaaaacatcagttacctcaagaattatccggcggagaaaggcaaagagcggctattgcccgtgctctttaccatgatccagcactgatattggcagacgaacctactgcaagtttggatactgaaaaagcctatgaagtggtcaaactgttggctaaggaaagtaaagaaaaaaacaaggccattattatggtcactcatgatgatcggatgctaaaatattgtgacaaagtctatcggatgcaagatggagagttatgtcaagagaga

SEQ ID NO: 6500 - protein, 223 aa, Streptococcus pyogenes
VMSVLTFKQVTKTFQDGHHEINALKATDFSIEAGEFVAIIGPSGSGKSTFLTIAGGLQTPSSGQLIIDGTDYTHLSEKERSRLRFKSVGFILQASNLIPFSTVQQQLELVDHLTGSKEKAKANQLFDDLGITGLKHQLPQELSGGERQRAAIARALYHDPALILADEPTASLDTEKAYEVVKLLAKESKEKNKAIIMVTHDDRMLKYCDKVYRMQDGELCQER

SEQ ID NO: 6501 - DNA, 669 bp, Streptococcus agalactiae
atgattaaaatattagttgtagaggataacattgttcaacaaaaaatcattaccacaaaattaacacaagagggctaccaatttatcactgcttcaaatggacaagaagctctaaattgtctagatacagaagaagtacaattgattataactgatatcatgatgcccatgatggatggttatcaattaattcaagaactcaggtcagctgcttataatgttccaatcattgttatgacagcaaaatcacaaatggaagatatgacaaaagggtttggccttggtgcagatgattatatggttaagcctgtgcagttacaagaattagctttacgtattaaggcactcttgaggagagctaatattgtagctcaacatcagctaattattgggaatacttgtcttaatgaagatgaattaagcttgaaatattttgagcaagaaattatatttcctcagaaagaatttagggttcttttccacttacttagctatcctaataggattttcacacgtttagaactattggatagtatttggggaatggatactgatttagatgagcgggtggtagatgcttgcatcaataaaattagacgaaaagtagaacacttaccagattttaagattgagacggtgagaggggtagggtatcgtgcaaaaaatgac

SEQ ID NO: 6502 - protein, 223 aa, Streptococcus agalactiae
MIKILVVEDNIVQQKIITTKLTQEGYQFITASNGQEALNCLDTEEVQLIITDIMMPMMDGYQLIQELRSAAYNVPIIVMTAKSQMEDMTKGFGLGADDYMVKPVQLQELALRIKALLRRANIVAQHQLIIGNTCLNEDELSLKYFEQEIIFPQKEFRVLFHLLSYPNRIFTRLELLDSIWGMDTDLDERVVDACINKIRRKVEHLPDFKIETVRGVGYRAKND

SEQ ID NO: 6503 - DNA, 1077 bp, Streptococcus agalactiae
gtgcaaaaaatgactaagctaaggcgatttcggtttccgttaagattttatttcacattaatgtttgtgttaacgatgcttttctcagtcctagcttctcttttactagttgcagcaatagtttttactttttttcaaggagtcttaactactcatgtattacaagttagtgctctcgctgttgtttttttaagccttgtgatagctagtattagtatgtggtacggttcttatcatttaacaaaaccaattttagatattagccatattgtgtccaatgttgcagacggtgactttgaagggcatatttatcgaaacagtaatcgtcgtaaatcctatgagtattataatgaattggatgagctatctgaaagtattaatcagatgattgtttctttatctcatatggatcatatgcgaaaagactttatcactaatgtttctcatgagctaaagactccgattgctgcagtagctaatattgtagaactattacaagatccagaattagatgaagaaacacaaagtgagttattaggtcttgttaaaacagagagcctaaggttaacaagattatgtgatacgatgttgcaaatgtcgcgcgtggataatcaggagactattggggagctatcctctgttcgtgtagatgaacaaattcgtcaagcaatgattagtttaacagaacgttggcaagctaaaaggataaattttcaactggattcaaaaccatatactgtttactcaaactctgacttgctgatgcaagtttggataaaccttttagataatgcaataaaatattccgaggatattgtagacttaagtgtacgaatggaagaaactaataatcattatctgagagttattatttctgataaaggtaggggaatttctcaatatgatgttcagcatatatttgataaattttaccaagcggatcagtcgcataatcaacaaggaaatggattaggactagcaatagttaaacgtataattgttctttgtaagggacgtattagtgtctccagtcagttggaaattggaacagaattttgtgtagaactacctttatca

SEQ ID NO: 6504 - protein, 359 aa, Streptococcus agalactiae
MQKMTKLRRFRFPLRFYFTLMFVLTMLFSVLASLLLVAAIVFTFFQGVLTTHVLQVSALAVVFLSLVIASISMWYGSYHLTKPILDISHIVSNVADGDFEGHIYRNSNRRKSYEYYNELDELSESINQMIVSLSHMDHMRKDFITNVSHELKTPIAAVANIVELLQDPELDEETQSELLGLVKTESLRLTRLCDTMLQMSRVDNQETIGELSSVRVDEQIRQAMISLTERWQAKRINFQLDSKPYTVYSNSDLLMQVWINLLDNAIKYSEDIVDLSVRMEETNNHYLRVIISDKGRGISQYDVQHIFDKFYQADQSHNQQGNGLGLAIVKRIIVLCKGRISVSSQLEIGTEFCVELPLS

SEQ ID NO: 6505 - DNA, 1188 bp, Streptococcus agalactiae
atgggaaaagaaaaattaattttagcttattctggtggtttagatacctctgttgctatagcttggttaaaaaaagattatgacgttattgctgtctgtatggatgttggcgaaggtaaagatcttgattttattcacgataaggctttaacaataggtgccatagaatcttatattttagatgttaaagatgagttcgctgagcattttgttttaccagctttacaggcacatgcgatgtatgaacaaaaatacccgcttgtttcagcgcttagtcgtccaattattgcccaaaaattagttgaaatggcacatcaaacaggtgcgaccacaattgcacatggctgtacaggtaaaggaaatgaccaagtgcgttttgaagttgcaattgcagcactagatcctgaattaaaagtaattgcccctgttcgtgagtggaagtggcatcgtgaagaggaaattacttttgcaaaagctaacggcgtacctattccagcagatttagataacccttattctatagaccaaaatttatggggacgtgccaatgaatgtggtgtgcttgagaatccttggaatcaagcgccagaagaagcttttggtattacaaaatcaccagaagaagctcctgattgtgcagaatatattgatattacgttccaaaatgggaagcctatagctataaacaatcaagaaatgacactagcagatttgattttatcgctaaatgaaattgcaggaaaacatggtattggacgcattgatcatgttgaaaatcgtttagtcggtatcaaatcacgtgaaatttatgaatgtcctgcggcaatggtactgttagctgctcataaagaaattgaagatttaacactagttcgtgaagtgtctcattttaaacctatccttgaaaatgaactatcaaatcttatttataatgctttatggtttagtccagctacaaaagctatcattgcctatgtcaaagaaacacaaaaagtggttaatggtactacaaaagttaagttatataaaggttctgcccaagtcgttgctcgccactcatctaattcattatatgatgagaatttagcaacctatacagctgctgatagctttgatcaagatgcagcagttggttttatcaaactctggggacttccaacccaagttaatgcccaagtaaacaaagga

SEQ ID NO: 6506 - protein, 396 aa, Streptococcus agalactiae
MGKEKLILAYSGGLDTSVAIAWLKKDYDVIAVCMDVGEGKDLDFIHDKALTIGAIESYILDVKDEFAEHFVLPALQAHAMYEQKYPLVSALSRPIIAQKLVEMAHQTGATTIAHGCTGKGNDQVRFEVAIAALDPELKVIAPVREWKWHREEEITFAKANGVPIPADLDNPYSIDQNLWGRANECGVLENPWNQAPEEAFGITKSPEEAPDCAEYIDITFQNGKPIAINNQEMTLADLILSLNEIAGKHGIGRIDHVENRLVGIKSREIYECPAAMVLLAAHKEIEDLTLVREVSHFKPILENELSNLIYNALWFSPATKAIIAYVKETQKVVNGTTKVKLYKGSAQVVARHSSNSLYDENLATYTAADSFDQDAAVGFIKLWGLPTQVNAQVNKG

SEQ ID NO: 6507 - DNA, 1386 bp, Streptococcus agalactiae
atgacaaaaaatcataagttatggggtggtcgttttgaaagtagtcttgaaaaatgggttgaagagttcggtgcatcaatcagtttcgaccaaaaattagctccctatgatatgaaggcttctatggcccatgtcacaatgttaggcaaaacggatattattagtcaagaagaagcaggcttgataaaagatggtttaaaaatactgcaagataaatacagagcaggtcaattgacttttagcatatcaaatgaagacattcatatgaacatagagagcttattaaccgctgaaattggagaagtagcaggtaagcttcatactgcacgttcacgaaatgatcaagtggctacagatatgcacctttatttgaaagataaattgcaagaaatgatgaagaaattgcttcatttacgaacaaccttagttaatttagcagaaaatcatatctatactgttatgccagggtatacacatttacaacatgctcagccgatttcatttggacatcatctaatggcttactataatatgtttacgcgtgatacagagcgattagagtttaatatgaaacacaccaatctatcaccattaggagctgctgctctagcagggacaacgtttcctattgaccgccatatgacaactcgtttattagattttgaaaaaccatatagtaattcgcttgatgctgtctcagatcgtgactttatcatagaatttttatccaatgctagcattttaatgatgcatttatcacgtttttgtgaagaaatcattaattggtgcagttatgaatatcaattcatcacattatcagatactttctctacaggatcatctattatgcctcaaaagaaaaatcctgatatggcagaattaattcgagggaagacaggccgtgtttatggaaatttatttagtttactaactgttatgaaatcattgccgttagcttataacaaagatttacaagaagataaagaagggatgtttgatagcgtagaaacagtcagcatagctattgaaatcatggctaatatgcttgagacaatgactgtgaatgagcacataatgatgacctcaacggagactgatttttcaaatgcaacagaattagcagattatttagcaagtaagggggtacctttcagaaaagcacatgaaattgtaggtaaattggttttagaatgcagtaaaaatggttcttatttacaggatatacctttaaaatattatcaagaaatttcagagttgatagaaaacgatatctatgagatattaactgcaaagacagcagttaaacgaagaaattcattaggaggaacggggtttgaccaggttaaaaaacagatcctattggcacgtaaagaattgaaagcggaa

SEQ ID NO: 6508 - protein, 462 aa, Streptococcus agalactiae
MTKNHKLWGGRFESSLEKWVEEFGASISFDQKLAPYDMKASMAHVTMLGKTDIISQEEAGLIKDGLKILQDKYRAGQLTFSISNEDIHMNIESLLTAEIGEVAGKLHTARSRNDQVATDMHLYLKDKLQEMMKKLLHLRTTLVNLAENHIYTVMPGYTHLQHAQPISFGHHLMAYYNMFTRDTERLEFNMKHTNLSPLGAAALAGTTFPIDRHMTTRLLDFEKPYSNSLDAVSDRDFIIEFLSNASILMMHLSRFCEEIINWCSYEYQFITLSDTFSTGSSIMPQKKNPDMAELIRGKTGRVYGNLFSLLTVMKSLPLAYNKDLQEDKEGMFDSVETVSIAIEIMANMLETMTVNEHIMMTSTETDFSNATELADYLASKGVPFRKAHEIVGKLVLECSKNGSYLQDIPLKYYQEISELIENDIYEILTAKTAVKRRNSLGGTGFDQVKKQILLARKELKAE

SEQ ID NO: 6509 - DNA, 741 bp, Streptococcus agalactiae
  misc_feature (1)..(741): n = a, c, g, or t
atggcaatcgtttcagcagaaaaattcgtccaagcagctcgtgataacggctatgcagtaggtggatttaacacaaacaaccttgagtggactcaagctatcttgcgcgcagcagaagctaaaaaagctccagtacttatccaaacttcaatgggtgcggctaaatacatgggtggttacaaactttgtaaacaacttattgaaactttggttgaatcaatgggtattactgtaccagttgctatccaccttgaccacggtcattacgatgatgcccttgagtgtattgaagtaggttacacttcaattatgtttgatggttcacaccttccagttgaagaaaaccttgaaaaagcacgcgaagttgttgctaaagcacatgctaaaggtatttcagtagaagctgaagttggtactatcggtggtgaagaagatggtattgtcggtaaaggtgaattagcaccaatcgaagacgctaaagctatggttgaaactggtattgacttcttggctgcaggtatcggtaacattcatggaccatacccagcaaactgggaaggacttgaccttgatcacttgaagaaattgactgaagctgttcctggtttcccaatcgtgttacacggtggttcaggtattcctgatgatcaaatccaagaagctatcaaacttggtgttgctaaagttaacgttaacacagaatgtcaattagctttctgtcaagcaannnnnttaattaat

SEQ ID NO: 6510 - protein, 247 aa, Streptococcus agalactiae
  MISC_FEATURE (1)..(247): Xaa = Any Amino Acid
MAIVSAEKFVQAARDNGYAVGGFNTNNLEWTQAILRAAEAKKAPVLIQTSMGAAKYMGGYKLCKQLIETLVESMGITVPVAIHLDHGHYDDALECIEVGYTSIMFDGSHLPVEENLEKAREVVAKAHAKGISVEAEVGTIGGEEDGIVGKGELAPIEDAKAMVETGIDFLAAGIGNIHGPYPANWEGLDLDHLKKLTEAVPGFPIVLHGGSGIPDDQIQEAIKLGVAKVNVNTECQLAFCQAXXLIN

SEQ ID NO: 6511 - DNA, 879 bp, Streptococcus pyogenes
atggcaatcgtttcagcagaaaaatttgtccaagcagctcgtgaaaacggatatgctgttggtggatttaacacaaacaacttagagtggactcaagcaatcttgcgtgcagcagaagctaaacaagctccagttcttatccaaacatcaatgggtgcagcaaaatacatgggtggttataaagtatgtcaatctcttattactaaccttgttgagtcaatgggtatcactgttcctgttgctatccaccttgatcatggtcactacgaagatgctcttgagtgtatcgaagtaggttacacttcaatcatgtttgacggttcacaccttccagttgaagaaaaccttgctaaaactgcagaagttgttaaaattgcacatgctaaaggcgtttcagttgaagctgaagttggtacaatcggtggtgaagaagacggtatcatcggtaaaggtgagctcgctccaatcgaagatgctaaagcaatggttgaaactggaattgacttcttggcagctggtatcggtaacatccacggtccatacccagaaaactgggaaggtcttgctcttgaccacttagaaaaattaacagcagctgtaccaggtttcccaatcgtattgcacggtggttctggtattcctgacgatcaaatcaaagaagcaatccgtcttggtgttgctaaagttaatgttaacactgaaagtcaaatcgctttctctaacgcaactcgtgaatttgctcgtaactacgaagctaacgaagcagaatatgatggtaaaaaattatttgacccacgtaaattcttggctccaggtatgaaagctgttcaaggtgctgttgaagaacgtatcgatgttttcggatcagctaacaaagca

SEQ ID NO: 6512 - protein, 293 aa, Streptococcus pyogenes
MAIVSAEKFVQAARENGYAVGGFNTNNLEWTQAILRAAEAKQAPVLIQTSMGAAKYMGGYKVCQSLITNLVESMGITVPVAIHLDHGHYEDALECIEVGYTSIMFDGSHLPVEENLAKTAEVVKIAHAKGVSVEAEVGTIGGEEDGIIGKGELAPIEDAKAMVETGIDFLAAGIGNIHGPYPENWEGLALDHLEKLTAAVPGFPIVLHGGSGIPDDQIKEAIRLGVAKVNVNTESQIAFSNATREFARNYEANEAEYDGKKLFDPRKFLAPGMKAVQGAVEERIDVFGSANKA

SEQ ID NO: 6513 - DNA, 690 bp, Streptococcus agalactiae
atgttttctggtaaacgattaaagaaaagacgaataacacttggctattctcaatctgaactagcagataaacttcatataaaccgctcttcttatttcaattgggaaaatgaaaagactaaaccaaaccaaagcaatctcaaacaactagctatcctattagatgttcctgaaacatatttcgagtcagaatataaaatagtcaatacttatcttcagctttctttacagaatcaggaaaaggtagagaaatatgctgaggaattacttcaaactcaaaaggttcatgaaaagattgttccactgtttgctgtggaagttctatcagaaattcaactatctgctggtccaggtgaaggtctgtacgatgaatttgaaactgagactgtctattcagaagatgaatacacaggattcgatatagcaacatggatttctggtaattctatggaacctgtttataaagacggtgaagtcgctttaattagatcgactggttttgatcacgatggagctgtctatgccttgaattggaatggatcgctctatatcaagaaactctatcgtgaagaagatggattccgaatggtgtcaattaacccagatgttgctgaaaggtttatcccatttgaagatgaaatcagaattgttggtaaaattgtaggccacttcatgcctgtgattggaggt

SEQ ID NO: 6514 - protein, 230 aa, Streptococcus agalactiae
MFSGKRLKKRRITLGYSQSELADKLHINRSSYFNWENEKTKPNQSNLKQLAILLDVPETYFESEYKIVNTYLQLSLQNQEKVEKYAEELLQTQKVHEKIVPLFAVEVLSEIQLSAGPGEGLYDEFETETVYSEDEYTGFDIATWISGNSMEPVYKDGEVALIRSTGFDHDGAVYALNWNGSLYIKKLYREEDGFRMVSINPDVAERFIPFEDEIRIVGKIVGHFMPVIGG

SEQ ID NO: 6515 - DNA, 636 bp, Streptococcus pyogenes
ttgggaagattgttgcatgtcaataaaatgacaatatctaattgggaaaaaggtaagaatataccaaatgaaaaacatttaaatgccttattgcatctattcaatgtgacatctgattatttcgacccaaactatagattgctaacgccttataaccagctgacaatatctaataaagaaaaagtaattggctattcagagcgattgttaaatcatcaaatagacaaaaaatctaaagatctcatagataaaccatcacaattatatgcttatcgggtctatgaaagtttatctgctggtactggttactcctattttggtgatggtaactttgatgttgtcttttacgatgaacaattagaatacgattttgcgtcttgggtttttggagattctatggagccaacttatttaaatggtgaagttgttcttataaaacaaaatagttttgattacgatggagcaatttatgcagtcgaatgggatgggcaaacatatatcaaaaaggtatttcgtgaagatgagggattacgtctagtgtccttaaataaaaaatattctgataagtttgctccctatagcgaagaacctcgcattattggcaaaattatcgctaattttaggcccttagaaatt

SEQ ID NO: 6516 - protein, 212 aa, Streptococcus pyogenes
LGRLLHVNKMTISNWEKGKNIPNEKHLNALLHLFNVTSDYFDPNYRLLTPYNQLTISNKEKVIGYSERLLNHQIDKKSKDLIDKPSQLYAYRVYESLSAGTGYSYFGDGNFDVVFYDEQLEYDFASWVFGDSMEPTYLNGEVVLIKQNSFDYDGAIYAVEWDGQTYIKKVFREDEGLRLVSLNKKYSDKFAPYSEEPRIIGKIIANFRPLEI

SEQ ID NO: 6517 - DNA, 132 bp, Streptococcus agalactiae
atgtcaagacagtttgacgacattatatttattaaagcaaatagaattattttattactcgaccaaaaagaatatgatgtaactaaccatttaactgaattggttgatgaattagcaaaattgaaatctagg

SEQ ID NO: 6518 - protein, 44 aa, Streptococcus agalactiae
MSRQFDDIIFIKANRIILLLDQKEYDVTNHLTELVDELAKLKSR

SEQ ID NO: 6519 - DNA, 1422 bp, Streptococcus agalactiae
gtgaatactatgggctatgtcgactactcaaaagaacctcgtagcgatattgcttttgtcgatatgaaatccttctatgcatctatcgaatgtgtagagagaggacttcacccgcttcatacttcactttgtgtgatgagtagggcagataattcagctggtctaattctagcttcttctccaatgttcaaaaaagtctttggtaaaggaaatgttggcagagcctacgacctcccctttgatgttcataccagaaaatttaactactaccgtgctaaaatttcaggattgccaacggatgcaaaatttgtttccttcatagaaaattgggccaagcgtacatttattgtgccaccgagaatggacttgtacattcaaaaaaatcttgaaatacaaaaagtatttcaaaattatgcagatccgacagatattctgccctattctattgatgaaggatttattgacttaacttcatcgctaaattattttgttgaagacaaatctctgagtcgcaaagataagttagatgtggtttcagcaaaaattcaacacgatatttgggaaaaaacgggtgtctattcaactgttggaatgagtaatgccaatccacttctagctaagttagcacttgataacgaagctaaaaccactgctaccatgcgtgccaattggtcttatgaagatgttgaaacgaaggtctggaatattcccaaaatgactgacttttggggaataggttcacgaacagaaaaacgactaaacaaattgggaatctacagcattaaagaattggccaactgtgaccctactatcttgaaaaaagaatttggtgttattggagtacaacattggtttcatgctaatggcatcgatgaaagtaatgtccatgaaccttatcgccctaaagcagtcgggattgggaattcgcaagtgctccataaagattacactcgtcaaagtgatatagagcttgtcctgcgtgagatggcagagcaagttgcgattcggctacgcagaagacataaaaaagcaactgtagtcgccataaatgtaggctattcaaatttcgaaaacaagaaatcaatcaatgttcagagaaaaattaacccaaataatcgtacgcttgtttttcaagatgaagttgtttctctctttcgttctaaatacgatggaggggcagttagaagcattgctgtaaggtacgatggattggtggatgaaaactttgctgtgatttctctttttgatgactttgaagaaagcgaaaaagaggaaaaattggagacaaccattgattccattcgtgatcgttttggatttcttgctgtacagaaagctagttctttattagaaaattcaagggcaatttctcgcagtagattagtcggcggacattccgctggaggattggagggtttaaaa

SEQ ID NO: 6520 - protein, 474 aa, Streptococcus agalactiae
MNTMGYVDYSKEPRSDIAFVDMKSFYASIECVERGLHPLHTSLCVMSRADNSAGLILASSPMFKKVFGKGNVGRAYDLPFDVHTRKFNYYRAKISGLPTDAKFVSFIENWAKRTFIVPPRMDLYIQKNLEIQKVFQNYADPTDILPYSIDEGFIDLTSSLNYFVEDKSLSRKDKLDVVSAKIQHDIWEKTGVYSTVGMSNANPLLAKLALDNEAKTTATMRANWSYEDVETKVWNIPKMTDFWGIGSRTEKRLNKLGIYSIKELANCDPTILKKEFGVIGVQHWFHANGIDESNVHEPYRPKAVGIGNSQVLHKDYTRQSDIELVLREMAEQVAIRLRRRHKKATVVAINVGYSNFENKKSINVQRKINPNNRTLVFQDEVVSLFRSKYDGGAVRSIAVRYDGLVDENFAVISLFDDFEESEKEEKLETTIDSIRDRFGFLAVQKASSLLENSRAISRSRLVGGHSAGGLEGLK

SEQ ID NO: 6521 - DNA, 336 bp, Streptococcus agalactiae
ttggtattctctagcaaccttaaatgggagataacttctatcaatcattttaaaccctccaatcctccagcggaatgtccgccgactaatctactgcgagaaattgcccttgaattttctaataaagaactagctttctgtacagcaagaaatccaaaacgatcacgaatggaatcaatggttgtctccaatttttcctctttttcgctttcttcaaagtcatcaaaaagagaaatcacagcaaagttttcatccaccaatccatcgtaccttacagcaatgcttctaactgcccctccatcgtatttagaacgaaagagagaaacaacttcatct

SEQ ID NO: 6522 - protein, 112 aa, Streptococcus agalactiae
MVFSSNLKWEITSINHFKPSNPPAECPPTNLLREIALEFSNKELAFCTARNPKRSRMESMVVSNFSSFSLSSKSSKREITAKFSSTNPSYLTAMLLTAPPSYLERKRETTSS

SEQ ID NO: 6523 - DNA, 348 bp, Streptococcus agalactiae
atgattgatagaagttatctcccatttaaggttgctagagaataccaagaccgaaagatggccaaatggatgggcttcttcttatcagaacatacggcaggacttgatagtgagcttaataaagttgactatacttctgagttatcaatttcagataaactactgctgctcaatcaattatacagtaatcagttgaatggtatcattgcagttcctggacaatattacagtggaaaagttgacaatctgacttttaaccatgtttcattgaagacaaaaacgggctttgtcagcattccaatcaaggatattctttcaattgatttggaggtggaatatgaatcagct

SEQ ID NO: 6524 - protein, 116 aa, Streptococcus agalactiae
MIDRSYLPFKVAREYQDRKMAKWMGFFLSEHTAGLDSELNKVDYTSELSISDKLLLLNQLYSNQLNGIIAVPGQYYSGKVDNLTFNHVSLKTKTGFVSIPIKDILSIDLEVEYESA

SEQ ID NO: 6525 - DNA, 357 bp, Streptococcus agalactiae
ttgatgatttataagtcaggtagtcctatgcgggctacctttttacaattgaaggagaatataatgaaattttttcaaaagaaaaaacaaaaccaggatcaattcaaacgactgattcatcgactatcagagatgtcagatagtgaactaaccaaagtagaacaactcctagatgtggtttttgatacaaattttaagcctgatacgagcgttgaattatctcaaagcgatataactgacgaggatcaaagtcttgataggtcaatccaggaagcgaaaaataaacttcacacggaacaattggaaaaaaacattgagaggtttagacaaggtaggcgagagagcaataataacaaa

SEQ ID NO: 6526 - protein, 119 aa, Streptococcus agalactiae
MMIYKSGSPMRATFLQLKENIMKFFQKKKQNQDQFKRLIHRLSEMSDSELTKVEQLLDVVFDTNFKPDTSVELSQSDITDEDQSLDRSIQEAKNKLHTEQLEKNIERFRQGRRESNNNK

SEQ ID NO: 6527 - DNA, 387 bp, Streptococcus agalactiae
atgagtaaaacatggaattttgatcagccactagacgatgtgaaaccaacatcgtcccatgaagaacgagctaaaatcgcagcactttttcataaacaggatgaaaaaccaattgaagaagtagattatgtggctgcttttgaacagcaacaaaaggagtcagaatcaaaagatgtacaaacgctcgcatcaaccgttaaacaaaatcagccgaagaaggtaaatatcacaagtgactataaacaacacttggctgataccattgcacaaaacaacaaggatatttccgcctgtcagaagcaaattgaagaacttcatcaattgattgatgaaaagaaaatccaaaataaaaagttgcaggctatttcagtagccattgatgattta

SEQ ID NO: 6528 - protein, 129 aa, Streptococcus agalactiae
MSKTWNFDQPLDDVKPTSSHEERAKIAALFHKQDEKPIEEVDYVAAFEQQQKESESKDVQTLASTVKQNQPKKVNITSDYKQHLADTIAQNNKDISACQKQIEELHQLIDEKKIQNKKLQAISVAIDDL

SEQ ID NO: 6529 - DNA, 225 bp, Streptococcus agalactiae
atgagtgtgattgaacgtctggctgaaaaagtagctaggcaagaagaaaaggtctcacgtgagactgagaaattggaacactatcgagaccaactacaaactgcaatgtatagcacctttatcaaacgacaacaatcaagtcagttgtcatttcatgaagcactagagcaagcctttggtaaagaaaccacactacacccaaattacagaaatgaggatacagaa

SEQ ID NO: 6530 - protein, 75 aa, Streptococcus agalactiae
MSVIERLAEKVARQEEKVSRETEKLEHYRDQLQTAMYSTFIKRQQSSQLSFHEALEQAFGKETTLHPNYRNEDTE

SEQ ID NO: 6531 - DNA, 1074 bp, Streptococcus agalactiae
atgacacgaattaaaatagtaaaacaaaaggccattttagatgtggctgaaagtttgggttattccttcagacgtttatcaggacaaatttatgaacacccagaccatgattcctttcggatttttgcggataccaatactttcaaatggttttcaagagatatacaaggggatgtgatagactttgtacagttagtggcaggagtgtctttcaaaaaagccttgtcttaccttgaaactggaggctttgaagaagctaaggtgattgaagaaacttatcaacccttccaatattatttgcgtgaagaaccctttcagcaagcacgtacttacttgaaagacatccgtggactaagtaatcagactattaattcctttggcagacaaggattgcttgctcaagctacttatcaagcggagtcagttttagtgtttaaaagctttgaccataatgggaccttacaggccgcaagccttcaaggtctcgtcaaaaatgaagaaaaatacgatcgaggttatctcaaaaaaatcatgaaaggatctcatggccatgtcggtattagtttcgatattgggaatcctaagcgactcattttttgtgaatcagttatcgatatgatgagttattatcaacttcaccaaaagcagctatcagatgttcgcctgatttcaatggaaggcctaaaactttcagtgattgcttatcagactttgcgtctagcagcagaggaacaggggaaattggcatttctagatacagtaaaaccaattagacttagccattatcttcaggcaatacaagagacgacaaccttttttcaaactcattcaaacgtcataactatggctgttgataacgatgaagcaggaagagaattttatcagaaactgtcagataaaggatttccgatttttcaagatttaccaccattgcaaagacttgaaacaaagtcagattggaatgatattgtgaaacgacaaaaggaattatctttaagagatcttatccagtcagcccaagcacaagtcaataagaatcatcctccacctaaacgagagcacgctttggaattg

SEQ ID NO: 6532 - protein, 358 aa, Streptococcus agalactiae
MTRIKIVKQKAILDVAESLGYSFRRLSGQIYEHPDHDSFRIFADTNTFKWFSRDIQGDVIDFVQLVAGVSFKKALSYLETGGFEEAKVIEETYQPFQYYLREEPFQQARTYLKDIRGLSNQTINSFGRQGLLAQATYQAESVLVFKSFDHNGTLQAASLQGLVKNEEKYDRGYLKKIMKGSHGHVGISFDIGNPKRLIFCESVIDMMSYYQLHQKQLSDVRLISMEGLKLSVIAYQTLRLAAEEQGKLAFLDTVKPIRLSHYLQAIQETTTFFQTHSNVITMAVDNDEAGREFYQKLSDKGFPIFQDLPPLQRLETKSDWNDIVKRQKELSLRDLIQSAQAQVNKNHPPPKREHALEL

SEQ ID NO: 6533 - DNA, 120 bp, Streptococcus agalactiae
ttggaatgggaaactggaggacatgaaagaagcaacagatggagccaattccagcataccaacgatccaaggaactacaacaagcgagaacaactagcaggagacagtcttctgcttttt

SEQ ID NO: 6534 - protein, 40 aa, Streptococcus agalactiae
MEWETGGHERSNRWSQFQHTNDPRNYNKREQLAGDSLLLF

SEQ ID NO: 6535 - DNA, 489 bp, Streptococcus agalactiae
gtgtcaaagaaaaagcaggaggaaagagcgacagtcctatcagatgagcttgtcaatgaatttctcactcaatatttcaccaaggtccagctgggtgaaaataacgctcgtatcaaaccctacatgacggactcggcattttcagaagaggaagcaaatcagaataaagcgatcaatcaagtttataaagactatatgcttgactaccgatttgaatcagccagtatctatgtcaatacagaaagccatgttgcacttgcggaagtttcctatcaagtaacttatgtttctgatttgagtgagcaacaacagcgaacaactcagacagaaaccaagacagttatgttatcctactccaaagtttccgacaagcttctagttaatcagttgaccatttggaatgggaaactggaggacatgaaagaagcaacagatggagccaattccagcataccaacgatccaaggaactacaacaagcgagaacaac

SEQ ID NO: 6536 - protein, 163 aa, Streptococcus agalactiae
MSKKKQEERATVLSDELVNEFLTQYFTKVQLGENNARIKPYMTDSAFSEEEANQNKAINQVYKDYMLDYRFESASIYVNTESHVALAEVSYQVTYVSDLSEQQQRTTQTETKTVMLSYSKVSDKLLVNQLTIWNGKLEDMKEATDGANSSIPTIQGTTTSENN

SEQ ID NO: 6537 - DNA, 252 bp, Streptococcus agalactiae
ttggcacaaggctatacaagtccagaagatagggcaaactaccaaactttaaaggaacagtatgaagatgagacctttgattacagtttttcaaagcgtgaaattactggacagctggaactcatcatcaaaagtcgtgagaatgatttttcaaacttagatgaggtgacgaagacggaataccttgacttggttacccaacttgatgaacttgaccaggaacaagccaactattatcgtaagcaattagcc

SEQ ID NO: 6538 - protein, 84 aa, Streptococcus agalactiae
MAQGYTSPEDRANYQTLKEQYEDETFDYSFSKREITGQLELIIKSRENDFSNLDEVTKTEYLDLVTQLDELDQEQANYYRKQLA

SEQ ID NO: 6539 - DNA, 1398 bp, Streptococcus agalactiae
ttggcacagcatggaattaaatcttacgtatttgaagctcttcgtccaacaccagaactctcttttgctgttcgccatttaaatgcctatgctggtattatggttactgcaagccacaatccagcacctttcaatggttataaagtctatggacaagacggaggtcaactaccaccagctgatgctgatgcactaacagactttatccgtgctattgaaaatccatttgcagttgaacttgctgatttagatgaaagcaaatcatcgggccttattcaggttatcggtgaagatgttgatattgaatatcttagagaggttaaagatgttaatatcaatcaagatttaatcaataactttggaaaagacatgaaaattgtctatactcctctccacggaactggtgagatgttgacacgccgtgcccttgctcaagccggttttgaatctgttgttgtagtagaatcacaagctaaggcagatccagacttttctactgtcaaatctcctaaccctgaaagccaagctgcctttgctcttgctgaagaactcggacgagaagttgatgcagatgtcttagtagctactgatcctgatgcagaccgcctaggcgttgaaattcgccaaccagatggttcttataaaaacctttctggaaatcaaattggagcgattattgcgaaatacatcctggaagctcataaaacagcaggaacacttccagaaaatgctgctctcgctaaatcaatcgtatcaacagaattagtaacaaaaattgccgaaagttacggcgctacaatgtttaacgttttaactggatttaaattcatcgctgagaaaattcaagagtttgaagaaaaacataaccacacctatatgtttggttttgaagaaagcttcggatatcttattaaaccatttgtccgtgataaagacgctattcaagcagttcttttggttgctgagatcgcagcttattaccgttcgcgtggtttaacacttgcagatggtattgatgaaatttacaaagaatatggttattttgctgaaaaaacgatttcagtaacactttcaggtgtggatggagctgctgaaattaagaagattatggacaaattccgtgaaaatggtccaaaacaatttaacaatactgacattgtattattagaagatttccaaaaacaaaccgctactaaaaatgatggaacaatatctaacttaacaactcctccaagtaatgttttgaagtacacgttagctgatgattcatggattgcagttcgcccttcaggaactgaaccaaaaatcaagttctatattgccacggtcggtaatgatttagcagatgcagaaacaaaaatcgccaatattgaaaaagagattacaacatttgtaaat

SEQ ID NO: 6540 - protein, 466 aa, Streptococcus agalactiae
MAQHGIKSYVFEALRPTPELSFAVRHLNAYAGIMVTASHNPAPFNGYKVYGQDGGQLPPADADALTDFIRAIENPFAVELADLDESKSSGLIQVIGEDVDIEYLREVKDVNINQDLINNFGKDMKIVYTPLHGTGEMLTRRALAQAGFESVVVVESQAKADPDFSTVKSPNPESQAAFALAEELGREVDADVLVATDPDADRLGVEIRQPDGSYKNLSGNQIGAIIAKYILEAHKTAGTLPENAALAKSIVSTELVTKIAESYGATMFNVLTGFKFIAEKIQEFEEKHNHTYMFGFEESFGYLIKPFVRDKDAIQAVLLVAEIAAYYRSRGLTLADGIDEIYKEYGYFAEKTISVTLSGVDGAAEIKKIMDKFRENGPKQFNNTDIVLLEDFQKQTATKNDGTISNLTTPPSNVLKYTLADDSWIAVRPSGTEPKIKFYIATVGNDLADAETKIANIEKEITTFVN

SEQ ID NO: 6541 - DNA, 831 bp, Streptococcus agalactiae
atggtcacaggaggattccgactagacctcttacttgagataactaagatagctcgtgcaacttactattatcaactaaagaaactgaataaaccagataaagacaaagcaatcaaatctgacattcaatccatttatgatgaacatagaggaaactatggctatcgtcggatttatttagaactgcgaaatcgtggctttgtcatcaaccacaaaagggtgcaaggcttgatgaaaagtatgggcttgactgctcgtattcgtcgtaagcgcaagtatgcctcttacaaaggtgaggttggtaagaaggctgataacctgattcaacgccagtttgaggggtcgaagccctatgagaagtgctataccgatgtgacggagtttgctttacctgaagggaaactttatctatcgcctgttcttgatggctataacagtgagataattgattttaccctgtctcggtctcctgacttgaaacaggttcaaaccatgcttgagagggcttttcctgcggcttcatacagcgaaactattctccacagcgaccaaggctggcagtaccagcacaagtcctaccatcaatttctggaggacaaaggcattcgtccttctatgtcacggaaggggaacagtcctgacaacggtatgatggaatctttctttgggattctaaagtctgagatgttctatggcttggagaagtcttataaatcacttgatgaccttgagcaagctatcacagattacattttttactacaacaacaagcgaatcaaagcaaaactaaaaggacttagtcctgtgcaatacagaactaaatccttcact

SEQ ID NO: 6542 - protein, 277 aa, Streptococcus agalactiae
MVTGGFRLDLLLEITKIARATYYYQLKKLNKPDKDKAIKSDIQSIYDEHRGNYGYRRIYLELRNRGFVINHKRVQGLMKSMGLTARIRRKRKYASYKGEVGKKADNLIQRQFEGSKPYEKCYTDVTEFALPEGKLYLSPVLDGYNSEIIDFTLSRSPDLKQVQTMLERAFPAASYSETILHSDQGWQYQHKSYHQFLEDKGIRPSMSRKGNSPDNGMMESFFGILKSEMFYGLEKSYKSLDDLEQAITDYIFYYNNKRIKAKLKGLSPVQYRTKSFT

SEQ ID NO: 6543 - DNA, 1731 bp, Streptococcus agalactiae
atgaaagcaagtcatcctaaaaagatacaaaaaaagcttgttcaagatcttctttctaaaaaaagcttagtaggaatggcattattagggacggttgtacaagtttgcctcactgtttatttgcctgttctaattggacaagcggtagacgttgtattatcgcctcattctatgatattattgttacctataatgtggaagatgattgcagtcattttagcaaatactattattcaatggattaatcctctgctctataaccgcttaatttttcattatgttgcttctttaagaaaggctgtaatggaaaagttgaatctattgcctatagcttaccttgataaacgtggcataggtgacttgattagtcgtgtgactaccgatacggagcaattatcaaatggtttattaatggtttttaaccagttctttgttggtttattaactattatagttactatttttagtatggcaaagattgatttattaatgctttttttggtattatttctgacgcctttatcactctttctagcccgctttattgctaaaaagagttatcacttatatcaaaatcaaacggcatcacgaggacgacaaactcaattcattgaagagatggtgagtcaagaaagccttattcaagcattcagtgcgcaagaagaaagtagtgatcattttaggactattaatcaagagtatgctaacttttctcaatcagcaattttttattcttcaactgtcaatccatcaacccgatttatcaatagtttgatttatggcttcttagctgggattggtgcccttcgcattatgtcaggggcttttagtgttggtcaattaatcactttcttaaattatgtcaatcaatatactaagccatttaatgacatctcttccgtcctgtctgagatgcaaagtgctctggcgtgtgcagaacgcctttactctattttagaagaatcgtcaccaaatataacaggtacagaaaaacttgattcatcaacggtcaaaggtcaaatcgattttaaaaacgttgtttttggttataataaatcaaaactactattgaatggtattaatttacacattccagcaggagctaaggtcgctattgtaggaccaacaggtgctgggaagtctactttaatcaatttaataatgcgtttctatgaagttgacgggggaaatatccttttagattgtaagcctattactgattatgagccatcacaattaaggcaagaaattggaatggtattacaagaaacgtggttaaaaagtgctacgattcacgataacattgcatatgccaatcctaaagctagccgtgaagaagtgatagaggctgcaaaagcagctaatgcagatttctttatcaaacaattaccgaatggatatgatacgtatttagaagatgctggagattcgttatcacaggggcaatgtcagctattgacaattgctcgtatttttcttaaattacctagaatattgatattagatgaggcgacatcgtctatagatactcgtactgaagttcttgttcaagaagcattccaaatgttgatgaaggggagaacaagctttattattgcacatcgcttatctaccattcaaacggcagatattattttagttatggtatctggtgaaattgtagaagtgggtaaccactctgaattaatggctcaaaaaggtatttattatcaaatgcaaaatgcacaaaag

SEQ ID NO: 6544 - protein, 577 aa, Streptococcus agalactiae
MKASHPKKIQKKLVQDLLSKKSLVGMALLGTVVQVCLTVYLPVLIGQAVDVVLSPHSMILLLPIMWKMIAVILANTIIQWINPLLYNRLIFHYVASLRKAVMEKLNLLPIAYLDKRGIGDLISRVTTDTEQLSNGLLMVFNQFFVGLLTIIVTIFSMAKIDLLMLFLVLFLTPLSLFLARFIAKKSYHLYQNQTASRGRQTQFIEEMVSQESLIQAFSAQEESSDHFRTINQEYANFSQSAIFYSSTVNPSTRFINSLIYGFLAGIGALRIMSGAFSVGQLITFLNYVNQYTKPFNDISSVLSEMQSALACAERLYSILEESSPNITGTEKLDSSTVKGQIDFKNVVFGYNKSKLLLNGINLHIPAGAKVAIVGPTGAGKSTLINLIMRFYEVDGGNILLDCKPITDYEPSQLRQEIGMVLQETWLKSATIHDNIAYANPKASREEVIEAAKAANADFFIKQLPNGYDTYLEDAGDSLSQGQCQLLTIARIFLKLPRILILDEATSSIDTRTEVLVQEAFQMLMKGRTSFIIAHRLSTIQTADIILVMVSGEIVEVGNHSELMAQKGIYYQMQNAQK

SEQ ID NO: 6545 - DNA, 1725 bp, Streptococcus pyogenes
atgattaaaacagatcatcacctcctaaagcgagtgcttcaggatttgttaaaaaaacctctacctgtttgtattctcgtgatcgctagttttgtacaagttggtttaagtgtttacttgcctgttcttatcggtaaagccgttgatatgagtttgtcagtcaattcttggcaaactttaaaatggctgttggggcaaatgttagttattattgtggtcaacacattgattcaatgggtgatgcctcttgtctatagtcgtttgctatatcaatatagccagcaattgaaagataagcttttggaaaaaattcatcgtcttccttttgcatatctagatcgtcaaaccattggagatttggttagtcgagtgataaccgacactgagcaactgatcaatggtctacaaatggtttttaaccagtttatacttggactattgacgattctgtgtaccattatagctatggcacagattgactggctcatgttaatcttggttttggtgttaacaccaagctccctctttttagctcgttttattgctcaaaagagttttcattatgcacaagcacagaccaaaagcagaggaaatttagctcagtttactgaagaaatccttcgtcaagaaggtttggttcaactgtttaatgctcaagagcagtctatctgtgattatcatgttttaaataaaacctattgcgaggcttcacaaaaagccattttttacgcctcaacagtcaatccagccactcgctttattaatagtgtcatttatgctttactggcaggtttaggggctgttcgtatcatggctggacttttttcagtaggtcagctaaccacttttttaaatgttgttgtccaatataccaaacctttcaacgatatttcatctgtcttggcagagatacagagttctttagcttgtgcgcaaaggctttatgaccttttagatattgaaataaaagagcaagagcactttctaacatttaaggcatcagcggttaaggggcaaattgactttgaagaagtaagtttttcttatcaaaaagacaggcccttactgaaagatattaatttttctgttcctgcgggttccaaggtagcgattgtagggcctacaggtgcaggtaaatcaactttaatcaatttactcatgcgcttttatgaacttgatgctggtagcatcaagttagataaagttcctattaagtgttatgctaaggaagaacttaggtccattactggcatagtattgcaagaaacctggttgaaagatgcgactgttcatgagttgattgcttacggcagtgaagaggctagccgtgatgaagtagtggcagcagccaaagcagctcatgcacacttctttattatgcaacttcctaagacttatgatacttacttaagtgcttctgatgatgctttgtcccaagggcagctccagttattagctattgccagaatgtttttgaaaaaaccaaaagtcttggttctagatgaagccacctcctctattgatattagaacagaagctgttattcaagaggcactaaaagaactcatgagaggaaggaccagctttatcattgcccatcgtttatcaacgattcaatcagctgatttgattcttgttatggatcaaggtcgattggttgagtggggaacacatgccagcttaatgtcaaaaaacggctgttatgttagattacaaaagatagaa

SEQ ID NO: 6546 - protein, 575 aa, Streptococcus pyogenes
MIKTDHHLLKRVLQDLLKKPLPVCILVIASFVQVGLSVYLPVLIGKAVDMSLSVNSWQTLKWLLGQMLVIIVVNTLIQWVMPLVYSRLLYQYSQQLKDKLLEKIHRLPFAYLDRQTIGDLVSRVITDTEQLINGLQMVFNQFILGLLTILCTIIAMAQIDWLMLILVLVLTPSSLFLARFIAQKSFHYAQAQTKSRGNLAQFTEEILRQEGLVQLFNAQEQSICDYHVLNKTYCEASQKAIFYASTVNPATRFINSVIYALLAGLGAVRIMAGLFSVGQLTTFLNVVVQYTKPFNDISSVLAEIQSSLACAQRLYDLLDIEIKEQEHFLTFKASAVKGQIDFEEVSFSYQKDRPLLKDINFSVPAGSKVAIVGPTGAGKSTLINLLMRFYELDAGSIKLDKVPIKCYAKEELRSITGIVLQETWLKDATVHELIAYGSEEASRDEVVAAAKAAHAHFFIMQLPKTYDTYLSASDDALSQGQLQLLAIARMFLKKPKVLVLDEATSSIDIRTEAVIQEALKELMRGRTSFIIAHRLSTIQSADLILVMDQGRLVEWGTHASLMSKNGCYVRLQKIE

SEQ ID NO: 6547 - DNA, 156 bp, Streptococcus agalactiae
atgcagatgttgcatcgtctaaaatcaaaaatggtatcttatcttgaactaaagctcttgcaatcgtcaacctttgcctttgaccaccagagaaattcctaccaaaactctctacaggggcgtcaagttgaccatctttttcttttacaaaatcac

SEQ ID NO: 6548 - protein, 52 aa, Streptococcus agalactiae
MQMLHRLKSKMVSYLELKLLQSSTFAFDHQRNSYQNSLQGRQVDHLFLLQNH

SEQ ID NO: 6549 - DNA, 1719 bp, Streptococcus agalactiae
atgaaaagactaacttattattttaaggggtatatcaaagaaactatctttggaccccttttcaaattattagaagcctcttttgaacttttggtaccaatcgttattgcaaaaatgattgacgagaccattccacgaggggatagaagtggtttactgttgcaaattggattgattttctttttggctgcggtgggtgttgtagtagcgataactgctcaatattattcttcaaaagccgcagttggttatacgagacaattgacagaggatctctaccaaaaagtcatgtcactgggtaaaaaagacagagatgaattgggaactgctagtttgattactcgtttgactgctgatacatttcaaatccaaactggtttaaatcaatttttacgtttatttttgagggctccgattattgtttttggtgccataattatggctttttccattagcccctcattgactatttggttcttggtaatggttgtcacgttatttatcattgtttttgtaatgtctcgactattaaatcctatttaccttaaaatcagaacttcaaccgattatttggtaaagttgactaggcaacaacttcaaggtgtacgagttatccgtgcctttaatcaagtagatagagagagtgaagcatttaatgatatcaattatcattatacgaatttacaattaaaagcaggtaggctttctagtttagtaacgcctctaacatttctagttgttaatatcactttggttgtgattatttggcgtggtaatttaaatatagctaatcatcttttatcacaaggaatgttggttgctttaattaattacttattgcaaattcttgttgaattgttaaaaatgacaatgttggtgacatcactgaaccaaagttatatcagtgctaagcgaattatagccgtttttgaaagaccgtctgaaataattgatgacaaacttgagccaaaatattcgaataaggctttagaagtgcaagaaatggcattttcttatccaaactcctctgaaaaagctttatctgatattactttttctatgaatgtaggagaaactttagggataattggtgggactggctctgggaaatcaaccttgattaatttattgcttcatatttataaagtgcaagaaggggatattgatatatatcatcagggaaaaagtccagatacaatttcaaattggcgtaccctggtaagagttgttcctcaaaatgctcagttgtttaaaggaactattcgttctaacctttctttgggacttggtaaagttagtgaggaaaaactttggactgctttagaaatagcacaagctagtgattttgtaaaagaaaaagatggtcaacttgacgcccctgtagagagttttggtaggaatttctctggtggtcaaaggcaaaggttgacgattgcaagagctttagttcaagataagataccatttttgattttagacgatgcaacatctgcattggattatttaacagaagctcgtttatttaaagctataactaaacatttcaaccaaactaatcttattattgtatcacagagaattaatagtatacaaaatgcagatagaatcttactccttgataagggcaaacaagttggttttgataatcatcaatctttattagctcataacaaagtttataagtccatttaccattcacaaaattttaaggaggaggag

SEQ ID NO: 6550 - protein, 573 aa, Streptococcus agalactiae
MKRLTYYFKGYIKETIFGPLFKLLEASFELLVPIVIAKMIDETIPRGDRSGLLLQIGLIFFLAAVGVVVAITAQYYSSKAAVGYTRQLTEDLYQKVMSLGKKDRDELGTASLITRLTADTFQIQTGLNQFLRLFLRAPIIVFGAIIMAFSISPSLTIWFLVMVVTLFIIVFVMSRLLNPIYLKIRTSTDYLVKLTRQQLQGVRVIRAFNQVDRESEAFNDINYHYTNLQLKAGRLSSLVTPLTFLVVNITLVVIIWRGNLNIANHLLSQGMLVALINYLLQILVELLKMTMLVTSLNQSYISAKRIIAVFERPSEIIDDKLEPKYSNKALEVQEMAFSYPNSSEKALSDITFSMNVGETLGIIGGTGSGKSTLINLLLHIYKVQEGDIDIYHQGKSPDTISNWRTLVRVVPQNAQLFKGTIRSNLSLGLGKVSEEKLWTALEIAQASDFVKEKDGQLDAPVESFGRNFSGGQRQRLTIARALVQDKIPFLILDDATSALDYLTEARLFKAITKHFNQTNLIIVSQRINSIQNADRILLLDKGKQVGFDNHQSLLAHNKVYKSIYHSQNFKEEE

SEQ ID NO: 6551 - DNA, 1722 bp, Streptococcus pyogenes
atgaaacgattacgtccatatgtgaaagggtacctaaaagaaagtatcttaggtcctctttttaaattattagaagctttatttgaattattagtccctttgttaattgctaacatgattgatatatcgattagtcaacacaacagccagggaattttgagggttgttttaacattatttggtttagcaaccattggcttattgctttccgttacagcccagtatttttcttcgaaagcagctgttggttttacaagacaaatgacagatgacttgtttaaaaaaatcatgtttttgagcaaggaggaccaagaccatcttggttatgctagtctgttatcacgattgaccagtgatagttttcaaattcaaactggtatcaatcaatttttgcgtctttttctaagggcccctattatcgtatgtggtgctatggtaatggcttattggattagtccaagtctaaccctatggtttgtgatgatggtgattgtcttactaacacttgtttttgttatgtcacatttattaggtcccctttatctcttaatccgccgagaaacagatcacttggttcgtttgactagccaacagttacaaggaatccgagtaattaaggcttttaatcaaacccaaaaagaactccaagcatttaagcagcaaaatatgctcttaagtcgccaccaatatcaagctgctaccctagccaatgtcttgaatcctatgacttttttagtggtcaatcttaccctgttaatcttgatttggcaaggaagttggcaagtagctcatagatcgcttagtcagggcatgttggttgctttaattaattacctcttgcagattttggcagaacttttgaaaatgaccatgttgatgggaaccatcaatcaaagtgtaacagccgcaaaacggattaatcaggtgtttgttttagctgatgaagcgcctttgcccttacttaaagatggtcctatttcaactcatctgttgaccatccggcacttgacctttacttatccaggagcagcagagccaagtctgtatgatattcagttaagtgctgatcagggagaatggattggcatcattggtggtactggagcaggcaaaacgactttgattgacttgatctgccaaacttattcacaatatagtggtgagattagtcttaattggcaaggagaagtgccaaaaacactaaccgagtggcgaaatgtgattgctcttgttcctcaaaaagctcaattatttaaaggaacgattagaagtaacctcctactgggacaatcaatgcctattagtgatgaggaactgtggcgggctcttgaattggctcaagcaaaagagtttgtcgctgccttaccagaacaattagaggcacctgttgaagccttcggccgtcatttttcaggagggcaacggcaacgtctagctattgccagagcacttctgaagccaaaacccattttgattttggatgatgccagttccgccttagacaatgagactcgaggacgactttttaaagctctaaaagaagagttatcagatgttttagtgattctagtcacgcaatctattaagaatttgcagtttgctgataagattttagtgttggaacagggccatcaattggattttgccagtcatgaccagttaaaagtaagcaatgcactttatcaagaaatgctagcgctttacgtgaagggggagcaaaaa

SEQ ID NO: 6552 - protein, 574 aa, Streptococcus pyogenes
MKRLRPYVKGYLKESILGPLFKLLEALFELLVPLLIANMIDISISQHNSQGILRVVLTLFGLATIGLLLSVTAQYFSSKAAVGFTRQMTDDLFKKIMFLSKEDQDHLGYASLLSRLTSDSFQIQTGINQFLRLFLRAPIIVCGAMVMAYWISPSLTLWFVMMVIVLLTLVFVMSHLLGPLYLLIRRETDHLVRLTSQQLQGIRVIKAFNQTQKELQAFKQQNMLLSRHQYQAATLANVLNPMTFLVVNLTLLILIWQGSWQVAHRSLSQGMLVALINYLLQILAELLKMTMLMGTINQSVTAAKRINQVFVLADEAPLPLLKDGPISTHLLTIRHLTFTYPGAAEPSLYDIQLSADQGEWIGIIGGTGAGKTTLIDLICQTYSQYSGEISLNWQGEVPKTLTEWRNVIALVPQKAQLFKGTIRSNLLLGQSMPISDEELWRALELAQAKEFVAALPEQLEAPVEAFGRHFSGGQRQRLAIARALLKPKPILILDDASSALDNETRGRLFKALKEELSDVLVILVTQSIKNLQFADKILVLEQGHQLDFASHDQLKVSNALYQEMLALYVKGEQK

SEQ ID NO: 6553 - DNA, 600 bp, Streptococcus agalactiae
atgtttaaatttttaaaacgtttgatagcattaattattattattttcattgggtaccgtctagttatcatccatgaaaatgttaaaaaagtgcttcaatatcatgatttagtgcagaatactcttgcagagaatggttcagaggctaatgtgcacttagtattatctatgatttatactgaaactaagggagatgctatagatgtgatgcaatcaagtgaaagtatcagtggaactacgaacagtattacggatagccacaccagtattaaacatggcgtcactctgttgtcacaaaatataagtcaagctaaaaaagctaaggttgatgtatggactgctgtccaagcatacaattttggttcttcttatattgattatgtagcggatcatgggggtgaaaattccattgagttggccaaaaattactctaaaaatgttgtagctcccagcctaggaaattataacggggacacttacttttactatcatcctctcgccttaatttcaggagggaagctctataaaaatggtggtaatatttactactcacgtgaagttcaattcaacctttatttgataaaaataatggagttgttt

SEQ ID NO: 6554 - protein, 200 aa, Streptococcus agalactiae
MFKFLKRLIALIIIIFIGYRLVIIHENVKKVLQYHDLVQNTLAENGSEANVHLVLSMIYTETKGDAIDVMQSSESISGTTNSITDSHTSIKHGVTLLSQNISQAKKAKVDVWTAVQAYNFGSSYIDYVADHGGENSIELAKNYSKNVVAPSLGNYNGDTYFYYHPLALISGGKLYKNGGNIYYSREVQFNLYLIKIMELF

SEQ ID NO: 6555 - DNA, 990 bp, Streptococcus agalactiae
atgagaattaatgttatgatggatttttatatcaaacagattattatacatcagttttctcctaacgacacagagttagtgctatcagatactccgctaaccctaactccaaggattgatgactactttcgtaaaaaattaagtaaagttttttctgatgaagctaagcgtggctattttggagaggataatgtatttatgagtcatttacaagatgatttatatgtttcttcctgtcaaattgcgcaactttggaaagaagagtttgtcatatcggaagatcaaaaaacgaatgacttagtttttattcaatttgacaaggatggaatggaacattttgctttccttcgaatctcattaaaggaacaatttgctcatgtttctgaaaatcaagagcagccaattacaataacacagaataaccttccaagtgctgctcaaactccagatgaagctttggttgttaacaagtcatcaaagcaatactatttaattgaaaagcgtatcaaacacaatggttcatttgctaattatttttctgaaaatttattacaagtacaaccagaacagtctgttaaaaaatctataaaaatggttgaacagacagctcaaaaaattgctgaaaatttcaacaaagatgatttttctttccaatcaaaaatgaaatcggctatttataagaatttagaagaagagcaagaattgtctccagaaaaattagcagatcaattatttgatgataatttaacagccaggctgacttttgttgatgaattgaaagacgcaatacctggacctgttcaagtaagtgatattgatcattcccgtcaaattaagaagttagagaatcagaagctatctctttcaaatggtattgaattgattgtacccaacaatgtctaccaagatgccgaatcagttgaatttatccaaaaccctgatggtacatactcaatactaatcaaaaacatacaggatattcaaaataaa

SEQ ID NO: 6556 - protein, 330 aa, Streptococcus agalactiae
MRINVMMDFYIKQIIIHQFSPNDTELVLSDTPLTLTPRIDDYFRKKLSKVFSDEAKRGYFGEDNVFMSHLQDDLYVSSCQIAQLWKEEFVISEDQKTNDLVFIQFDKDGMEHFAFLRISLKEQFAHVSENQEQPITITQNNLPSAAQTPDEALVVNKSSKQYYLIEKRIKHNGSFANYFSENLLQVQPEQSVKKSIKMVEQTAQKIAENFNKDDFSFQSKMKSAIYKNLEEEQELSPEKLADQLFDDNLTARLTFVDELKDAIPGPVQVSDIDHSRQIKKLENQKLSLSNGIELIVPNNVYQDAESVEFIQNPDGTYSILIKNIQDIQNK

SEQ ID NO: 6557 - DNA, 975 bp, Streptococcus pyogenes
atgttagatagttatataaaacgtattgtcattcatcaattttctcccaatgacactgagttactgttatcagatcgtttagtgagcattacaccgcgaattgatgaatatttccgaaaaaaattggccaaagtgttctcggacgaagccaaacgtggtcagtttgaggctaataataccttttttacaaccattggtgatgatttgttggaaacgtctgttaccattgcccagttatggaaggaagcctttgttatttcagaggatcaaaaaaccaatgacttagtctttgttcagtttgataaggatggcgaacccttttttgctttcttgcgaattgctttgaaagaacagtttgctcacctttctgacaattatgaacatccatttacggtgacgcagaataatctgccgagtcccacccagacaccagatgaagcactagtcattaatctcaaatctggtcagtactacttgattgaaaagcgtgtgaagcataatggcagttttgctaattatttttcagaacacctcttgaaagttacacctgagcaatctgttaaaaagtctatcaaaatgatagaacaaaccgctcaaaaaattgcagagcattttaatcaagatgattttacttttcagtcaaagatgaaatccactctttttaagcagttagaagcagacgacgttttatcaccagaaaaattagctgaccaactctttgatgataatttaacagcccgtttaacctttgtggatcaagtcaaagatgtcattccagaacctataaaaattagcgatattgaacattctagacagataaaaaaactagaaaatcaaaagctatcgttatcaaacgggatagaattaacagtaccaaatgccatttatcaggatgctgaagcggttgaatttttgttaaatgatgatgggacttattcaatcttgattaaaaatatagaggatattaaaaccaaa

SEQ ID NO: 6558 - protein, 325 aa, Streptococcus pyogenes
MLDSYIKRIVIHQFSPNDTELLLSDRLVSITPRIDEYFRKKLAKVFSDEAKRGQFEANNTFFTTIGDDLLETSVTIAQLWKEAFVISEDQKTNDLVFVQFDKDGEPFFAFLRIALKEQFAHLSDNYEHPFTVTQNNLPSPTQTPDEALVINLKSGQYYLIEKRVKHNGSFANYFSEHLLKVTPEQSVKKSIKMIEQTAQKIAEHFNQDDFTFQSKMKSTLFKQLEADDVLSPEKLADQLFDDNLTARLTFVDQVKDVIPEPIKISDIEHSRQIKKLENQKLSLSNGIELTVPNAIYQDAEAVEFLLNDDGTYSILIKNIEDIKTK

SEQ ID NO: 6559 - DNA, 1254 bp, Streptococcus agalactiae
atgatttttgataaagacaattttaaagaatttgaccaagaactttggcaggctattcatgatgaggaaattcgccaacaaaataatattgaattaattgcatcagaaaacgttgtttcaaaagctgttatggcagcacaaggttctgttttgacaaataaatatgccgaagggtatcctagtcatcgttattatggaggaacagattgtgttgatgtagttgaaagtttagctatagaacgagctaagacgttatttaatgctgagtttgctaatgttcaaccacattctggtagtcaggctaatgcagcagcttacatggctttaatcgagccgggagatactgtcttagggatggacttagcagcaggtgggcacttaacacatggcgcttcagttagcttctcaggaaaaacttatcattttgtttcttactctgttgatcctaagacggagatgctagactatgataacattttgaaaatagcacaggaaacgcagcctaaattaattgttgcaggggcgtcggcttattctcgcattattgattttgaaaaatttcgtcaaatagcagacgcagtagatgcttacttaatggttgatatggctcacattgcaggtttagttgcttctggtcatcaccctagtcctattccttatgctcatgtaacgacaacgacaacacataagactctacgtggacctagaggtggtttgattttaaccaatgatgaagcaattgctaaaaaaattaattctgcagtctttccaggactccaaggtggaccattagaacatgtaattgctgcaaaagctgtagctttgaaagaagccctagatccttcctttaaaatatacggtgaggatattattaaaaatgctcaagccatggctaaagtttttaaagaagatgatgactttcatttgatttctgatggtactgataatcatttgttcttagtagacgtcacaaaagttattgagaatggcaaaaaggcacaaaatgttcttgaagaagtcaatatcacccttaacaagaactctataccgtttgagcgactatcaccatttaaaacatcaggtattcgaattggtactccagcaattactagtcgaggaatgggagttgaagaatctcgaagaatcgctgaattaatgattaaggcactcaaaaatcatgaaaatcaagatgtcctcacagaagttcgtcaagaaattaaatcattaacggacgctttccctttgtatgagaat

SEQ ID NO: 6560 - protein, 418 aa, Streptococcus agalactiae
MIFDKDNFKEFDQELWQAIHDEEIRQQNNIELIASENVVSKAVMAAQGSVLTNKYAEGYPSHRYYGGTDCVDVVESLAIERAKTLFNAEFANVQPHSGSQANAAAYMALIEPGDTVLGMDLAAGGHLTHGASVSFSGKTYHFVSYSVDPKTEMLDYDNILKIAQETQPKLIVAGASAYSRIIDFEKFRQIADAVDAYLMVDMAHIAGLVASGHHPSPIPYAHVTTTTTHKTLRGPRGGLILTNDEAIAKKINSAVFPGLQGGPLEHVIAAKAVALKEALDPSFKIYGEDIIKNAQAMAKVFKEDDDFHLISDGTDNHLFLVDVTKVIENGKKAQNVLEEVNITLNKNSIPFERLSPFKTSGIRIGTPAITSRGMGVEESRRIAELMIKALKNHENQDVLTEVRQEIKSLTDAFPLYEN

SEQ ID NO: 6561 - DNA, 1260 bp, Streptococcus pyogenes
atgacaatgatttttgataaaggtaatgttgaagactttgataaagagctttgggatgccattcatgctgaagaagaaagacaagaacatcatatcgaattgattgcatctgaaaacatggtttcaaaagctgtcatggcagctcaaggttctgttttaaccaataagtatgcagaaggctatccaggtaatcgctattatggtggaacagaatgtgtggatattgtcgaaacgcttgctattgaacgtgctaagaaacttttcggtgccgcatttgccaatgttcaagcccattccggaagtcaagccaatgcagcagcttatatggccttgattgaggctggtgacaccgtattaggaatggatttggctgcaggtggtcatctcacgcatggctctccagtaaatttttctggaaaaacctaccattttgtgggttactcagtagatactgatactgaaatgttaaattatgaggcgattttagaacaagcaaaggcggtccaaccaaagcttatcgttgcaggggcttcggcctactctagaagcattgattttgaaaagtttcgtgccattgctgatcacgtaggtgcttacttaatggtggacatggctcacatcgctggccttgtagcagcaggtgtgcacccgagtcctgtcccttatgcgcatattgtgacatcaacaacccataaaaccttacgtggtcctcgtggaggcttgatattaaccaatgacgaagctcttgctaaaaagattaattcggccgttttccctggtttacaaggaggacctctggaacacgtgattgctgccaaagcggttgccttcaaagaagccttggatccagcctttaaagactatgcacaagctattattgataatactgcggctatggcagcagtttttgcacaagatgatcgtttccgtctgatctcaggtggtacagataatcatgtctttttagtagatgtcactaaggttattgctaatggtaaactagcgcaaaatcttctggatgaggttaatattacccttaataaaaatgccattccttttgaaaccttgtcgccatttaaaacctcaggtattcgcattggttgtgctgccataaccagccgtggtatgggtgttaaagagagtcagaccattgcccgtcttatcatcaaagccttggttaatcatgatcaagaaactattcttgaagaagtccgtcaggaagtgcgtcagttaaccgatgccttcccactctataaaaag

SEQ ID NO: 6562 - protein, 420 aa, Streptococcus pyogenes
MTMIFDKGNVEDFDKELWDAIHAEEERQEHHIELIASENMVSKAVMAAQGSVLTNKYAEGYPGNRYYGGTECVDIVETLAIERAKKLFGAAFANVQAHSGSQANAAAYMALIEAGDTVLGMDLAAGGHLTHGSPVNFSGKTYHFVGYSVDTDTEMLNYEAILEQAKAVQPKLIVAGASAYSRSIDFEKFRAIADHVGAYLMVDMAHIAGLVAAGVHPSPVPYAHIVTSTTHKTLRGPRGGLILTNDEALAKKINSAVFPGLQGGPLEHVIAAKAVAFKEALDPAFKDYAQAIIDNTAAMAAVFAQDDRFRLISGGTDNHVFLVDVTKVIANGKLAQNLLDEVNITLNKNAIPFETLSPFKTSGIRIGCAAITSRGMGVKESQTIARLIIKALVNHDQETILEEVRQEVRQLTDAFPLYKK

SEQ ID NO: 6563 - DNA, 594 bp, Streptococcus agalactiae
atgaatgatttgggacagattttagaggatcatggcgcagttattatgccaacagaaacagtctacggaatttttgccaaagctttgagtgaagaagctgtgaaccacgtctatgagcttaaaaaaaggcctcgtgataaggctatgaacttaaatatatgtgattttgagactattttaaaatattctaaaaatcaaccgacctatttaaagcaattgtacgatgcttttttaccaggaccgctaaccattattttggaagcttcacaagaagttccgcattggatcaattctgggttattaagcgtaggatttcggatgcctaaacaccctgtaacccttgatatgattgctaaccatggtccactgattggtccttctgctaatatttctggatgtgatagtggtcgtgtgttctcagaaattcaaaaacagtttaatcatcaagttttaggtattgaagatgataaagcattgacaggtgtggattctactattattgatttgtctggtgatagagttaagattttaaggcaaggtgcaatcacgcaagaggtactaacggctacgatacctgaattaatttttgaaaat

SEQ ID NO: 6564 - protein, 198 aa, Streptococcus agalactiae
MNDLGQILEDHGAVIMPTETVYGIFAKALSEEAVNHVYELKKRPRDKAMNLNICDFETILKYSKNQPTYLKQLYDAFLPGPLTIILEASQEVPHWINSGLLSVGFRMPKHPVTLDMIANHGPLIGPSANISGCDSGRVFSEIQKQFNHQVLGIEDDKALTGVDSTIIDLSGDRVKILRQGAITQEVLTATIPELIFEN

SEQ ID NO: 6565 - DNA, 618 bp, Streptococcus pyogenes
ttggcaaagaaaggatggtggttgttgattatggagtatctagctagtatcattgaatcaggtgatgcccttgttttaccaacagaaacggtttatggtctttttgccaaggctttagatgaaaaagcagtaaatgctgtttatgacttaaaacaaagaccccgagataaagcaatgaaccttaatgtggctgattttaatagtatcttagccttttcaaaagaacagccgagatacctcaagaaattataccaagcctttttaccaggtccgttaacgattattttaaaagctaatgaccaggttccttattggattaattcgggactttcaacggttggttttcgcttacccagtcatccaattaccgcagctttaattcaaaaaacaggccctttaattggtccttctgcaaacttatctggcaaagctagtggtcgagtttttgatcatattatgcaagattttgactttcaagtgtttggttatgcagatgatccttttctaacaggtaaggattcaaccatcttagacttatcaggtgagcgtgctgtgattttacgtcaaggtgctatcaccaaagaagaattattagctaacgtgcctgaacttcgcttt

SEQ ID NO: 6566 - protein, 206 aa, Streptococcus pyogenes
LAKKGWWLLIMEYLASIIESGDALVLPTETVYGLFAKALDEKAVNAVYDLKQRPRDKAMNLNVADFNSILAFSKEQPRYLKKLYQAFLPGPLTIILKANDQVPYWINSGLSTVGFRLPSHPITAALIQKTGPLIGPSANLSGKASGRVFDHIMQDFDFQVFGYADDPFLTGKDSTILDLSGERAVILRQGAITKEELLANVPELRF

SEQ ID NO: 6567 - DNA, 828 bp, Streptococcus agalactiae
atgaattatgcgcagttaatcaagcattacggacagttattagaagcttgtggtgaagaagtcgaaaattttatttatgtattaaaagacctaaaacaatggtcaacaactgattaccttttaaatcaaaatagtagtgtgagtgatactgatcagcaattaatggaaaatatttttcaacagcttaaaaaacatagatcaccgcagtatattacaggtaaagcttactttagagaccttattttctttgttgatgaacgagttttaattccgaggcctgaaacagaggagttggttgatctaatcttatcagagaataaagtagaagattgttctgttttagatattggtacaggtagtggagcaattgccatttctctaaaaaaagaacgcccctcttgggatgttctagctagtgacatttctgtatctgcattagacttggcaaaggaaaatgctaataattgtgatgcggaagtgacttttatagaatcagatgtctttagtaacatttcaggtaaatttgatattattgtgtctaatcctccctatatttcttacaatgacaaagacgaggtggggaagaatgtgctagcttcagagcctcatagtgccctttttgcagacgaagaaggattagctatttatcgtaaaatcattgaaaactcaagagaatatttgcaacctagaggtaaattatattttgaaataggttacaaacaaggtgatgatttacgaagtttattgaaaagatattttccaaacaatcgttgcagagttttgaaagatatatttggtaaagatagaatggtggtattagataatgaa

SEQ ID NO: 6568 - protein, 276 aa, Streptococcus agalactiae
MNYAQLIKHYGQLLEACGEEVENFIYVLKDLKQWSTTDYLLNQNSSVSDTDQQLMENIFQQLKKHRSPQYITGKAYFRDLIFFVDERVLIPRPETEELVDLILSENKVEDCSVLDIGTGSGAIAISLKKERPSWDVLASDISVSALDLAKENANNCDAEVTFIESDVFSNISGKFDIIVSNPPYISYNDKDEVGKNVLASEPHSALFADEEGLAIYRKIIENSREYLQPRGKLYFEIGYKQGDDLRSLLKRYFPNNRCRVLKDIFGKDRMVVLDNE

SEQ ID NO: 6569 - DNA, 837 bp, Streptococcus pyogenes
atgaactatgctacattaatcagaacttatgaagataaactagaacaaatagatgaggatcgcgaaaatctcgcctatgtttttagagaaatcaaagaatggtcaagtctagatatgttgattcaccaaaatcaagctgtgactcctgaagatgctgttcttttggaacatattttctgttctctaagtcagcatttatctcctcaatatattacaggtaatgcttattttcgtgatttgaagcttgcagtcgacaagcgtgtattaattccaaggccagaaacagaagaattagttgacatgattttagctgaaaatcttgatgcaccgttgaatgttttagatattggtacaggtagtggagcgattgctatttctctcaaaaaagaaaggcctaactggcaagtaacggcatctgatatttctagagctgctcttgacttggcaaaagccaatgctgatgcttaccagcttgatataacgtttattgaatcagatgtttttagtctcatttcagaaacatttgatattattgtgtcaaatcctccctacatatcctacgaggataaggaagaagtcagtctaaatgttttgcaatcagagcctcatttggcactttttgctaaagaaaatggctatgctatttaccgtaagattattgaacaagctgacaattacttaactaaggaggggaagctttactttgaaattggttataagcaagctgaaggtataaaagatatgttacaagcctattttcctcaaagacatatacgagccgtaacggatatatttggcaaagaaaggatggtggttgttgattatggagtatctagc

SEQ ID NO: 6570 - protein, 279 aa, Streptococcus pyogenes
MNYATLIRTYEDKLEQIDEDRENLAYVFREIKEWSSLDMLIHQNQAVTPEDAVLLEHIFCSLSQHLSPQYITGNAYFRDLKLAVDKRVLIPRPETEELVDMILAENLDAPLNVLDIGTGSGAIAISLKKERPNWQVTASDISRAALDLAKANADAYQLDITFIESDVFSLISETFDIIVSNPPYISYEDKEEVSLNVLQSEPHLALFAKENGYAIYRKIIEQADNYLTKEGKLYFEIGYKQAEGIKDMLQAYFPQRHIRAVTDIFGKERMVVVDYGVSS

SEQ ID NO: 6571 - DNA, 1077 bp, Streptococcus agalactiae
atgaatatttatgatcaattgcaggcagttgaagatcgttatgaagagttaggtgagttacttagtgatccagatgttgtttcagatacaaagcgatttatggaattatcacgtgaagaagctagtactcgagaaactgtcacagcttatagagaatataagcaagtcattcaaaatatttcagatgctgaagaaatgatcaaagatgcttctggtgatgctgaattggaagaaatggctaaagaagaacttaaagaatcaaaagcagctaaagaagagtatgaagaaagattaaaaatccttctattacctaaagatcctaacgatgataaaaacattattttagaaattcgtggtgctgctggtggcgatgaagcagcgctttttgctggtgatcttttaacaatgtatcaaaaatatgctgaaactcaaggatggcgttttgaagttatggaatcatccgttaatggtgttggtggtattaaagaagtggttgctatggtttctggtcagtcagtttattctaagcttaaatatgaatcaggagctcatcgtgttcaacgtgtcccggtgacagagagtcagggtcgtgttcatacttcaactgcaactgttttggtaatgccagaagttgaagaagtagaatacgaaattgatcaaaaagaccttcgcgtcgatatttaccacgcgtctggtgctggtggtcagaacgtcaataaagttgctactgcagttcgtatggtacacattcctacaggaatcaaagttgaaatgcaagaagaacgtactcagcaaaaaaaccgtgataaagcgatgaagatcattcgtgctcgtgttgctgaccattttgcgcaaattgctcaagatgaacaagatgctgaacgtaaatcaacagttggtactggtgatcgttcagaacgtattcgtacttataatttcccacaaaatcgtgtaacagatcatcgtattggtttgacacttcaaaaattagatactattttatctggaaaaatggatgaagttattgatgcactcgttatgtatgatcagactcaaaagttagaagccttaaataaa

SEQ ID NO: 6572 - protein, 359 aa, Streptococcus agalactiae
MNIYDQLQAVEDRYEELGELLSDPDVVSDTKRFMELSREEASTRETVTAYREYKQVIQNISDAEEMIKDASGDAELEEMAKEELKESKAAKEEYEERLKILLLPKDPNDDKNIILEIRGAAGGDEAALFAGDLLTMYQKYAETQGWRFEVMESSVNGVGGIKEVVAMVSGQSVYSKLKYESGAHRVQRVPVTESQGRVHTSTATVLVMPEVEEVEYEIDQKDLRVDIYHASGAGGQNVNKVATAVRMVHIPTGIKVEMQEERTQQKNRDKAMKIIRARVADHFAQIAQDEQDAERKSTVGTGDRSERIRTYNFPQNRVTDHRIGLTLQKLDTILSGKMDEVIDALVMYDQTQKLEALNK

SEQ ID NO: 6573 - DNA, 1077 bp, Streptococcus pyogenes
atgaatatttatgatcaattgcaggcagttgaagatcgttatgaagagttaggtgagttacttagtgatccagatgttgtttcagatacaaagcgatttatggaattatcacgtgaagaaactaatactcgagaaactgtcacagcttatagagaatataagcaagtcattcaaaccatttcagatgctgaagaaatgatcaaagatgccagtggtgatcctgaattagaagaaatggctaaagaagaacttaaagaatcaaaagcagctaaagaagagtatgaagaaaaattaaaaatccttctattacctaaagatcctaacgatgataaaaacattattttagaaattcgtggtgctgctggtggcgatgaagcagcgctttttgctggtgatcttttaacaatgtatcaaaaatatgctgaaactcaaggatggcgttttgaagttatggaatcatccgttaatggtgttggtggtattaaagaagtggttgccatggtttctggtcagtcagtttattctaagcttaaatatgaatcaggagctcatcgtgttcaacgtgtcccagtgacagagagtcagggtcgtgttcatacttcaactgcaactgttttggtaatgccagaagttgaagaagtagaatacgacattgatcctaaagaccttcgcgtcgatatttaccacgcgtctggtgctggtggtcagaatgtcaataaagttgctactgcagttcgtatggtacacattcctacaggaatcaaagttgaaatgcaagaagagcgtactcagcaaaaaaaccgtgataaagcgatgaaaatcattcgtgctcgtgttgctgaccattttgcgcaaattgctcaagatgaacaagatgctgaacgtaaatcaacagttggtactggtgatcgttcagaacgtattcgtacttataatttcccgcaaaatcgtgtaacagatcatcgtattggtttgacacttcaaaaattagatactattttatctggaaaaatggatgaagttattgatgcactcgttatgtatgatcagacaaagaaattagaatctctcaataac

SEQ ID NO: 6574 - protein, 359 aa, Streptococcus pyogenes
MNIYDQLQAVEDRYEELGELLSDPDVVSDTKRFMELSREETNTRETVTAYREYKQVIQTISDAEEMIKDASGDPELEEMAKEELKESKAAKEEYEEKLKILLLPKDPNDDKNIILEIRGAAGGDEAALFAGDLLTMYQKYAETQGWRFEVMESSVNGVGGIKEVVAMVSGQSVYSKLKYESGAHRVQRVPVTESQGRVHTSTATVLVMPEVEEVEYDIDPKDLRVDIYHASGAGGQNVNKVATAVRMVHIPTGIKVEMQEERTQQKNRDKAMKIIRARVADHFAQIAQDEQDAERKSTVGTGDRSERIRTYNFPQNRVTDHRIGLTLQKLDTILSGKMDEVIDALVMYDQTKKLESLNN

SEQ ID NO: 6575 - DNA, 567 bp, Streptococcus agalactiae
ttggctcaactctattataaatatgggacaatgaattctggtaaaaccattgaaattttaaaagttgctcataactatgaagaacaaggaaaacctgtggttattatgacaagcgccttggacactcgagatgaatttggagtcgtttcaagtcgtattggaatgcgtcgtgaagcagttccaatttcagatgatatggacattttctcctatattcagaatttaccacaaaagccttattgtgttttaattgatgaatgtcaatttttgagtaagaaaaacgtctacgatttagctagagtagtagatgacttagatgtaccagtcatggcttttggtttgaaaaatgatttccaaaacaatctttttgaaggttcaaaacatttgctattattggccgataagattgatgaaatcaaaacaatttgccaatactgtagtaagaaagcaaccatggttttaaggacagaaaacggaaaacctgtctatgaaggtgatcagatacaaattggtggtaatgaaacatatatcccagtttgtcgaaaacattattttaatccagatatt

SEQ ID NO: 6576 - protein, 189 aa, Streptococcus agalactiae
MAQLYYKYGTMNSGKTIEILKVAHNYEEQGKPVVIMTSALDTRDEFGVVSSRIGMRREAVPISDDMDIFSYIQNLPQKPYCVLIDECQFLSKKNVYDLARVVDDLDVPVMAFGLKNDFQNNLFEGSKHLLLLADKIDEIKTICQYCSKKATMVLRTENGKPVYEGDQIQIGGNETYIPVCRKHYFNPDI

SEQ ID NO: 6577 - DNA, 567 bp, Streptococcus pyogenes
ttggctcaactctattataaatatgggacaatgaattctggtaaaaccattgaaattttaaaagttgctcataactatgaagaacaaggcaaacctgttgtcattatgacaagtgctcttgatacacgtgatggttttggcatcgtctcaagccgtattggtatgcgacgagaagctatccccatttcaaatgacatggatattttcacatttattgcccaattggaggaaaaaccttattgtgtcctgattgacgaaagccaatttttaagcaagcaaaatgtttatgatttggcgcgtgtggtggatgagctaaatgttcctgtcatggcttttggtttgaaaaatgatttccaaaacaatctttttgaaggttcaaaacatttgctattattggccgataagattgatgaaatcaaaacaatttgccaatactgtagtaagaaagcaaccatggttttaaggacagaaaacggaaaacctgtctatgaaggtgatcagatacaaattggtggtaatgaaacatatatcccagtttgtcgaaaacattattttaatccagatatt

SEQ ID NO: 6578 - protein, 189 aa, Streptococcus pyogenes
LAQLYYKYGTMNSGKTIEILKVAHNYEEQGKPVVIMTSALDTRDGFGIVSSRIGMRREAIPISNDMDIFTFIAQLEEKPYCVLIDESQFLSKQNVYDLARVVDELNVPVMAFGLKNDFQNNLFEGSKHLLLLADKIDEIKTICQYCSKKATMVLRTENGKPVYEGDQIQIGGNETYIPVCRKHYFNPDI

SEQ ID NO: 6579 - DNA, 180 bp, Streptococcus agalactiae
atgccatttgtaaaaattgacttgtttgagggacgctcacaagaacaaaaaaatgaattagctcgcgaggttactgaagtagtatcacgcattgcaaaagcacctaaagaaaatatccatgtttttatcaacgatatgcctgaaggaacctactatcctcaaggtgaacttaagaaaaaa

SEQ ID NO: 6580 - protein, 60 aa, Streptococcus agalactiae
MPFVKIDLFEGRSQEQKNELAREVTEVVSRIAKAPKENIHVFINDMPEGTYYPQGELKKK

SEQ ID NO: 6581 - DNA, 183 bp, Streptococcus pyogenes
atgccatttgtaacaattgacttgtttgagggacgctcacaagaacaaaaaaatcaattagctcgcgaggttaccgaagtagtctcacgcattgcaaaagcacctaaagaaaatatccatgtttttatcaacgatatgcctgaaggaacttactatcctcaaggtgaaatgaaacaaaaatca

SEQ ID NO: 6582 - protein, 61 aa, Streptococcus pyogenes
MPFVTIDLFEGRSQEQKNQLAREVTEVVSRIAKAPKENIHVFINDMPEGTYYPQGEMKQKS

SEQ ID NO: 6583 - DNA, 951 bp, Streptococcus agalactiae
ttggaggtggaaaatttgcaactttctcatagtttaagactcatgggaacgactatcgatattcaaattaattctaaaaatgctcaaaaacaaatccgagaggtcatagaactcttggagctctacaaaaatcgctttagtgcaaatgactttaattcagagttaatggctataaataacaacgctggtatcaagcctattcaagtacatccagacctctttgaattaatcacaattgggaaagaacacagcttagctaggcctagtaacctaaatattgctattggtcctttagtgcaaacttggagaattggattttcagatgctaaactacctagccctagtgaaatatcagaagctatgattttatctgacccaactcatatacttctagattcaaataaacaatctgtttttttaaatcagataggaatgaaaattgatttgggtgcacttgcaaaaggatatatcgctgacaaaattatgacctatctcaaaaatgagatgattgattctgctattattaatttaggcggaaacgttttagttcacggagataatcctaatcgttcagaagggtattgggttatcggcattcaacatccgaaaaagaaacggggaaaaaatattggaactgtcaaaattaaaaaccaatctgttgtaacctcaggtacttatgaacgccgtctgattattgacgataaggaataccatcatatttttgatcgacagactggttatccgatacaaacagagatggctagcatttctattgtttctaaacaatccgtcgactgtgaaatctggaccacaaggttgttcggcttatccattaaagaggctcttgatattttaaacgctgtttcctacattgaaggcattatcatcactaaagatgatcgtatctatttatctgatggcttaaaacatcattttcaactattttatcat

SEQ ID NO: 6584 - protein, 317 aa, Streptococcus agalactiae
MEVENLQLSHSLRLMGTTIDIQINSKNAQKQIREVIELLELYKNRFSANDFNSELMAINNNAGIKPIQVHPDLFELITIGKEHSLARPSNLNIAIGPLVQTWRIGFSDAKLPSPSEISEAMILSDPTHILLDSNKQSVFLNQIGMKIDLGALAKGYIADKIMTYLKNEMIDSAIINLGGNVLVHGDNPNRSEGYWVIGIQHPKKKRGKNIGTVKIKNQSVVTSGTYERRLIIDDKEYHHIFDRQTGYPIQTEMASISIVSKQSVDCEIWTTRLFGLSIKEALDILNAVSYIEGIIITKDDRIYLSDGLKHHFQLFYH

SEQ ID NO: 6585 - DNA, 936 bp, Streptococcus pyogenes
atgtttgttacgcaacaattaaagctaatgggaacagttattgatattcagatcgaatctgacaaagcttgccaacaactaagtagagtcattgacttattatatacttacaaaaatcgtttttcagctaatgattcaaactctgaattgatggctattaatcaggcggctggtgttaaacccgtcagcgttcactctgatttatttaacctaatccaaattggtaaagctcatagcttgtcaacaccaagtaatcttaatatcgccattgggccacttgttcaagcctggcgaattggatttgaagatgctagagtgcctagtcataaccttatctcacaacagttagctctaacagatcctagacaggttcttatagatgacaaaaaacagactgtctttttacaacaagtaggaatggctttagacttaggagccttagcaaaaggttatattactgataagattatggcctacctgattgaagatggtattgactctgcccttattaatttaggtggaaatgtacgcgttcatggacctaatccgaaaagccctgacaagacttttcgaattggcattcaaaaaccagatgctaaacgtgggcaacatcttggtgtcatcaaggttaacaatcactctgttgtgacttctggaatttatgaaaggcagtttacatccaaagggaaacagtatcatcatatcttagatcgtcagacaggctaccctatagaaacagatatgcttagcttaacgatcatggctccttcttctttttattgtgacatatggactacccgtttatttggtcttgatagctcaatgattatcacacttttaaatacctttgataatattgaaggtcttctagtaacaagaaagcaccatgtccttatgtcaaatggtttgagacactattttcaaccatactatcat

SEQ ID NO: 6586 - protein, 312 aa, Streptococcus pyogenes
MFVTQQLKLMGTVIDIQIESDKACQQLSRVIDLLYTYKNRFSANDSNSELMAINQAAGVKPVSVHSDLFNLIQIGKAHSLSTPSNLNIAIGPLVQAWRIGFEDARVPSHNLISQQLALTDPRQVLIDDKKQTVFLQQVGMALDLGALAKGYITDKIMAYLIEDGIDSALINLGGNVRVHGPNPKSPDKTFRIGIQKPDAKRGQHLGVIKVNNHSVVTSGIYERQFTSKGKQYHHILDRQTGYPIETDMLSLTIMAPSSFYCDIWTTRLFGLDSSMIITLLNTFDNIEGLLVTRKHHVLMSNGLRHYFQPYYH

SEQ ID NO: 6587 - DNA, 600 bp, Streptococcus agalactiae
atgaaacttattggaatcgttggaactaactcaaataaatcaacaaatcgtcaattattacaatacatgcaacaacactttgctgacaaagcagaaattgaactcatcgaagttaaagaccttccgttatttaataaacctgctgataaaaatgttccccaagtaattttggatattgctgctaaaattgaagaaactgatggtgttattattggtacgccagaatatgatcattctataccttcggccttaatgagtgttttagcttggctatcatatggtatttacccacttctcaacaaacccgttatgattactggtgcttcatatggaacacttggatcatcacgtgcacaattacaattacgtcaaatacttaacgctcctgaactaaaagcaagtgttttacctgacgaattcttgttatcacactctctccaagcctttgataaagatggcaacctacacgatatcgaaacaagtcagaagctagatgctatctttgatgattttcgtctttttgttaagattactggtaaattatcaaatgctcgtgatttacttcaaaaagaagcagaaaattttgactgggaaagttta

SEQ ID NO: 6588 - protein, 200 aa, Streptococcus agalactiae
MKLIGIVGTNSNKSTNRQLLQYMQQHFADKAEIELIEVKDLPLFNKPADKNVPQVILDIAAKIEETDGVIIGTPEYDHSIPSALMSVLAWLSYGIYPLLNKPVMITGASYGTLGSSRAQLQLRQILNAPELKASVLPDEFLLSHSLQAFDKDGNLHDIETSQKLDAIFDDFRLFVKITGKLSNARDLLQKEAENFDWESL

SEQ ID NO: 6589 - DNA, 540 bp, Streptococcus pyogenes
atgaaacatattttatttattgttggctcgcttcgtgaagggtcttttaaccatcaattagcggctcaagcacaaaaagctctggaacatcaagcagttgtatcttacttaaattggaaagacgttcctgttttgaatcaagatatcgaagctaatgcacctttaccagttgttgacgctcgtcaagctgttcagtcagcggatgctatctggatttttacaccagtttacaacttctctattccaggttctgttaaaaacctgctagactggttgtctcgtgctcttgatttgtctgatccgacgggcccatctgctattggcggtaaggtggttacggtctcttcagttgcaaatggcgggcatgatcaagtatttgatcagtttaaagcactattgccgtttatccgaacttcagtagcaggagagtttacaaaagcaactgtgaatcctgatgcctggggaacaggaaggcttgagatttcaaaagagacaaaagcaaacttgctatctcaggcagaggctcttttagcggctatt

SEQ ID NO: 6590 - protein, 180 aa, Streptococcus pyogenes
MKHILFIVGSLREGSFNHQLAAQAQKALEHQAVVSYLNWKDVPVLNQDIEANAPLPVVDARQAVQSADAIWIFTPVYNFSIPGSVKNLLDWLSRALDLSDPTGPSAIGGKVVTVSSVANGGHDQVFDQFKALLPFIRTSVAGEFTKATVNPDAWGTGRLEISKETKANLLSQAEALLAAI

SEQ ID NO: 6591 - DNA, 192 bp, Streptococcus agalactiae
atgattatgttcaggagtagcaataataacgccatcagctcgtgtaatcttattattaagaagacgaagttggaaactttcttcccaattttggtcttgattaaacattggaatatcatcgatttcaaggacttccaattcaaatttggttttaaaattcttgcgaataaattcaagcaacatacgattata

SEQ ID NO: 6592 - protein, 64 aa, Streptococcus agalactiae
MIMFRSSNNNAISSCNLIIKKTKLETFFPILVLIKHWNIIDFKDFQFKFGFKILANKFKQHTII

SEQ ID NO: 6593 - DNA, 1233 bp, Streptococcus agalactiae
atgaaatttgtaggtattgttggctcaaatgcagagcaatcatataatcgtatgttgcttgaatttattcgcaagaattttaaaaccaaatttgaattggaagtccttgaaatcgatgatattccaatgtttaatcaagaccaaaattgggaagaaagtttccaacttcgtcttcttaataataagattacacgagctgatggcgttattattgctactcctgaacataatcatactattacagccgctcttaaaagtgtgcttgagtggctctcatttgctgtgcatccactcgaaaataaacctgttatgattgtcggtgcttcatattatgatcaaggcacatcacgtgctcaaatacaccttcgtaaaatccttgatgctcctggcgttaatgcttacacacttccaggaaatgaattcttattaggaaaagctaaagaagcctttgacgataatggaaacattatcaatcctgggactgttcaatttttagaaacttgtcttgataattttatcaaatatgtaggagttgtatcatcattgagaaaacctaaagctattgaatctgaagacctctactgtcagggacaaattgatacaaccattactggtatcgacccagatgatcctgattggttagacaaggcagctgagaaagttaacgccgttgaaggggatgcttacgttaaactagacaatggtttacttactgttaaccaacttaatatgtttttaaatgctatgccatttgagctaacatatgcagatgataataatcaatttctatattacaataataatcatccagatccagatacaatgttaggaaaacgtgttcgtgaacaagtaggaaaccgtatggctacagttcatggtagtttaccaccggcacgaatgaaaaatgttgaatgggttatcggtactcttcgtaatggaaatcaagaatatgtacgtacagtcgttcctggtacacctccagaagttatcaatactcacaactatcaagctatgtactacccagacggatcttatgctggtattaatgaaattatctttaactttaaaccgtggttagattggtacctccaaactactggacaacgtttggtcggtggaactactgctgctcctggagcttcagcagttgacgctacttctagcgcttcaactagcacaggggatgctcccgtggatcaagccacagatgccacttctggtgcctctgaacat

SEQ ID NO: 6594 - protein, 411 aa, Streptococcus agalactiae
MKFVGIVGSNAEQSYNRMLLEFIRKNFKTKFELEVLEIDDIPMFNQDQNWEESFQLRLLNNKITRADGVIIATPEHNHTITAALKSVLEWLSFAVHPLENKPVMIVGASYYDQGTSRAQIHLRKILDAPGVNAYTLPGNEFLLGKAKEAFDDNGNIINPGTVQFLETCLDNFIKYVGVVSSLRKPKAIESEDLYCQGQIDTTITGIDPDDPDWLDKAAEKVNAVEGDAYVKLDNGLLTVNQLNMFLNAMPFELTYADDNNQFLYYNNNHPDPDTMLGKRVREQVGNRMATVHGSLPPARMKNVEWVIGTLRNGNQEYVRTVVPGTPPEVINTHNYQAMYYPDGSYAGINEIIFNFKPWLDWYLQTTGQRLVGGTTAAPGASAVDATSSASTSTGDAPVDQATDATSGASEH

SEQ ID NO: 6595 - DNA, 687 bp, Streptococcus pyogenes
atgaaaaatgccatttccattttagcgctcttaacacctgaaaaccaacttgaagagacgtttattagagagctttcccaccacttctcacacctttttgaggtgactattctcactagcaaagccaacattcagtcaaatcaattgtcgactttccaaggaattttcagtttccatgagcatgacattgacttgcctacactctatttcaaaacttctcaacatggtcagggctttttagtgacagaaagtgtctttgatcaagcaacagcagtcttatcgttaagccaatacctcactggattttaccaaaaatttgatggacattttttacagtaccttcctttgcaagcaaggttatctgatgcaaatggaaacatcatagtcgataatcatgcttttaatggaagttttttgccaactactgataaagaaatagaagattggattcttgctgaattgcgtttatcagataacccttgtaaaaccttcctacttccttcgggttcattggatcatatttacatgcagcattatcaagctcttaaaaatcctcaaggtcagctggtgggagttttggataccgttcaagacattaaaccgttattaaaccagtatttagaagaaactggacaagccattgttggctggtccgatgtcacatcaggcccttccattttagatcac

SEQ ID NO: 6596 - protein, 229 aa, Streptococcus pyogenes
MKNAISILALLTPENQLEETFIRELSHHFSHLFEVTILTSKANIQSNQLSTFQGIFSFHEHDIDLPTLYFKTSQHGQGFLVTESVFDQATAVLSLSQYLTGFYQKFDGHFLQYLPLQARLSDANGNIIVDNHAFNGSFLPTTDKEIEDWILAELRLSDNPCKTFLLPSGSLDHIYMQHYQALKNPQGQLVGVLDTVQDIKPLLNQYLEETGQAIVGWSDVTSGPSILDH

SEQ ID NO: 6597 - DNA, 90 bp, Streptococcus agalactiae
atgaaagcaaatacaaaacctgatagagcaggagagattttaccaatagtatcagctgcgacgataccagcagcagtactcattgttaaa

SEQ ID NO: 6598 - protein, 30 aa, Streptococcus agalactiae
MKANTKPDRAGEILPIVSAATIPAAVLIVK

SEQ ID NO: 6599 - DNA, 786 bp, Streptococcus agalactiae
atgtcactttttcaagaaaaaattgcttacaattgcgctaaaaaggaagcgctttataaagagagtttaggacgctacgccttgaggtcaatgctagctggggcttatttaacaatgagtactgctgctggtatcgtcgcagctgatactattggtaaaatctctcctgctctatcaggttttgtatttgctttcatctttagttttggacttatttatgttttaatatttaatggtgaattggcgacatctaatatgctttatctcactgcaggagcctataataaaaatatctcttggaaaaaagccatgacaattttaatttattgtacttttttcaacctcgttggtgcttgtatattagcttggttgtttaatcaatcgtactcattccagcatttaacaaatgatagctttttagggcatgtcgttgctaaaaagttaggaaaacctagttcaggagctttcctagaaggtattattgctaatatgtttgtgaatttagctatccttgcttacatgttattaaaagaagaatcggcaaaaatgacggttattttatctgctatttttatgtttgtttttctatcaaacgaacacttaattgctaattttgcatcctttatgttagctgcttttagccatatcgaacatattaaaggttttactcttctaaacattatccgccaatggacacttgtattctttggtaactggataggagggggcgttttcatcggcctagcctatgcttggttaaataaaacaaaaacttctcaccatgaa

SEQ ID NO: 6600 - protein, 262 aa, Streptococcus agalactiae
MSLFQEKIAYNCAKKEALYKESLGRYALRSMLAGAYLTMSTAAGIVAADTIGKISPALSGFVFAFIFSFGLIYVLIFNGELATSNMLYLTAGAYNKNISWKKAMTILIYCTFFNLVGACILAWLFNQSYSFQHLTNDSFLGHVVAKKLGKPSSGAFLEGIIANMFVNLAILAYMLLKEESAKMTVILSAIFMFVFLSNEHLIANFASFMLAAFSHIEHIKGFTLLNIIRQWTLVFFGNWIGGGVFIGLAYAWLNKTKTSHHE

SEQ ID NO: 6601 - DNA, 879 bp, Streptococcus pyogenes
atgataatgacgagccctttcttgttgaaagggcttgcattttttaggaaaattgatatactaaagtgtgtgtttgtgaatacagtaacaaaaggagatatcatgaaaacaccagaacagattttagaagcaactattcatattggggaacataaggttaccaaaacttttttggctaaatctatcttaggctttattggtggagcgatgattagccttggttatttactatacgtgagaattgccgccagtggtttagaaacttttggtgctttttccagtatcgtaggagcttgtgcttttccgattggtctaattattattttaatggcgggtggagaattaattacagggaacatgatggctgtttctgcagctttgttggccaaaaaaattaagtttagcgagcttgccaagaattggcttatcattaccttgtttaatgtgattggagctgtttttgtagcttttgtgtttggtcattttctaggcttaacatcagctggtatttttaaagaagaagtgattgaggtggcccatgctaaaatagcagcgagccctttgcaggcactagtatcaggaattggttgtaactggtttgttggtttggccttgtggctatgctatggggcaaatgatgctgctggtaaattccttggtacttggtttcctgtcatgacctttgtagcccttggttttcagcatagtgtagcaaatgcttttgtcattcctgctgctatttttgaaggaggagcaacatggttggattttgtcactaattttatttttgtctatagtggtaatattatcggtggagccatttttgttagttttttatattttaaagtttactatcatccgcaaaagagtaaaactcaa

SEQ ID NO: 6602 - protein, 293 aa, Streptococcus pyogenes
MIMTSPFLLKGLAFFRKIDILKCVFVNTVTKGDIMKTPEQILEATIHIGEHKVTKTFLAKSILGFIGGAMISLGYLLYVRIAASGLETFGAFSSIVGACAFPIGLIIILMAGGELITGNMMAVSAALLAKKIKFSELAKNWLIITLFNVIGAVFVAFVFGHFLGLTSAGIFKEEVIEVAHAKIAASPLQALVSGIGCNWFVGLALWLCYGANDAAGKFLGTWFPVMTFVALGFQHSVANAFVIPAAIFEGGATWLDFVTNFIFVYSGNIIGGAIFVSFLYFKVYYHPQKSKTQ

SEQ ID NO: 6603 - DNA, 222 bp, Streptococcus agalactiae
ttgataaataaaggaaagtatcatattaattttttaggcaatccattcaaaatgatatttaaaacaacagctgtcagggttgagataacaataccatttgtcaaaaacatttgtaaagtattaggaagactaatgaagagatttgtcccattaaaacctactcctgctgcaattgatacggctgcaatgataaagttatgctcattatgctcaaaatcaacc

SEQ ID NO: 6604 - protein, 74 aa, Streptococcus agalactiae
MINKGKYHINFLGNPFKMIFKTTAVRVEITIPFVKNICKVLGRLMKRFVPLKPTPAAIDTAAMIKLCSLCSKST

SEQ ID NO: 6605 - DNA, 279 bp, Streptococcus agalactiae
atgagcccaataaggattgaaattgacttcaaaaagccttttgcgaaaatattaattaataaaacaacaccaatcgttaccagtgataaagttaaagattgtaagcttggctcttttgcattatcacccatatttcccatcgcaactggtattaatgtcaaaccaattgtagtaataactgatcctgttacaattggaggaaagaaatttgcaactttagaaaaaatgccagcaactaaaacgacatatattcctgaagcaattaaagctccaaacata

SEQ ID NO: 6606 - protein, 93 aa, Streptococcus agalactiae
MSPIRIEIDFKKPFAKILINKTTPIVTSDKVKDCKLGSFALSPIFPIATGINVKPIVVITDPVTIGGKKFATLEKMPATKTTYIPEAIKAPNI

SEQ ID NO: 6607 - DNA, 1272 bp, Streptococcus agalactiae
atgaaatttaatgtgcaaagtaattcgcaagcagcacttctaggcttgcaacacctgttagctatgtatgcaggatccattcttgtacctatcatgattgctagtgctcttggttataatgctaagcaactaacttatcttattgcgacagatatttttatgtgtgggattgccaccttattacaattacgattaagtaagcactttggagtgggtcttccagttgtattagggtgtgcctttcagtctgtagctcctttatcaattattggtgcacaacaaggttctggctatatgtttggagctttaattgcttcaggaatatatgtcgttttagttgctggcattttttctaaagttgcaaatttctttcctccaattgtaacaggatcagttattactacaattggtttgacattaataccagttgcgatgggaaatatgggtgataatgcaaaagagccaagcttacaatctttaactttatcactggtaacgattggtgttgttttattaattaatattttcgcaaaaggctttttgaagtcaatttcaatccttattgggctcatttcaggtacaattcttgcagcatttatgggcttagttgatgcttctgtggtagcagatgcaccacttgtacatattccgaagccattttattttggagctcctagatttgaatttacttctattttaatgatgtgtattattgcaacagtttctatggtagaatcaacaggtgtttaccttgcgctttcagatattacaaacgataaattagacagtaagagacttcgtaatggttaccgttcagaaggattggcagtattacttggcggcttatttaatacctttccatataccggtttttctcaaaatgtgggactggtacagatatctgggatacgtacgcgtaagccgatatattttacagctctcttcttagttatacttggcttgttacctaaatttggcgcaatggctcaaatgattccaagtccagttcttggtggtgccatgttagttttatttggtatggtagcacttcaagggatgaaaatgcttaatcaggttgattttgagcataatgagcataactttatcattgcagccgtatcaattgcagcaggagtaggttttaatgggacaaatctcttcattagtcttcctaatactttacaaatgtttttgacaaatggtattgttatctcaaccctgacagctgttgttttaaatatcattttgaatggattgcctaaaaaattaata

SEQ ID NO: 6608 - protein, 424 aa, Streptococcus agalactiae
MKFNVQSNSQAALLGLQHLLAMYAGSILVPIMIASALGYNAKQLTYLIATDIFMCGIATLLQLRLSKHFGVGLPVVLGCAFQSVAPLSIIGAQQGSGYMFGALIASGIYVVLVAGIFSKVANFFPPIVTGSVITTIGLTLIPVAMGNMGDNAKEPSLQSLTLSLVTIGVVLLINIFAKGFLKSISILIGLISGTILAAFMGLVDASVVADAPLVHIPKPFYFGAPRFEFTSILMMCIIATVSMVESTGVYLALSDITNDKLDSKRLRNGYRSEGLAVLLGGLFNTFPYTGFSQNVGLVQISGIRTRKPIYFTALFLVILGLLPKFGAMAQMIPSPVLGGAMLVLFGMVALQGMKMLNQVDFEHNEHNFIIAAVSIAAGVGFNGTNLFISLPNTLQMFLTNGIVISTLTAVVLNIILNGLPKKLI

SEQ ID NO: 6609 - DNA, 1281 bp, Streptococcus pyogenes
atgacacattcaacaaagcaggaacattctcactcgcaatcagctgtccttggcttacagcatgtgctttcgatgtatgccggatctattttagtaccaattatgatcgcaggtgctttaggttattccgctagagagttgacctacctgatttcgacagatattttcatgtgtggtgtggctactttcttacagttaaagttaaccaagcatacgggagtgggattaccagttgttttaggatgtgcttttcaatcagtggcacctctatccattattggagcgcaacaaggttcaggtgccatgtttggagccctcattgcgtcaggaatttatgtcattttagtggcaggtattttttctaagattgctcgtttcttcccaccaattgttacaggatcggtcattaccgttattggcttaagtctcgtaggtgttgctatggggaatatgggagataacgtcaaagagcctacggcacaaagcatgatgttatcattgttgacgattgtcattattcttttagtccaaaaatttaccaaaggttttgtgaaatccatttccattttgattgggcttgtagcgggaactttggtttcagctatgatgggattagtagatacaactcctgttgtagaggcttcttggattcatgtgccaaccccattttattttggcatgccaacttttgaaatcacttctattgtgatgatgtgtatcatcgcaacggtttctatggttgaatcaacaggtgtctacttagcgctttcagatttgactaatgatcaattagatgaaaaacgtttgcgcaatggttatcgctcagaagggatcgcagtctttctcggtgggttatttaacaccttcccttacactggtttttctcaaaacgttggacttgtccaaatctcaggtattaaaacccgtcgtccgatttactacgcagcaggtatccttgtggtcattggcctactccctaaatttagagcaatggcacaaatgattccaagcccagttcttggtggagccatgcttgttctctttggtatggttgctcttcaaggaatgcaaatgcttaatcgtgttgatttccaaaagaacgagtataattttattattgctgccgtttccatctcagcaggtttaggctttaatggcactaatctttttgccagcttaccagagacagctcaaatgttcttaacgaatggtattgtgattgccactttgacatctgttgtcttaaatttagttttaaatggcaaagacaaacaagatgaa

SEQ ID NO: 6610 - protein, 427 aa, Streptococcus pyogenes
MTHSTKQEHSHSQSAVLGLQHVLSMYAGSILVPIMIAGALGYSARELTYLISTDIFMCGVATFLQLKLTKHTGVGLPVVLGCAFQSVAPLSIIGAQQGSGAMFGALIASGIYVILVAGIFSKIARFFPPIVTGSVITVIGLSLVGVAMGNMGDNVKEPTAQSMMLSLLTIVIILLVQKFTKGFVKSISILIGLVAGTLVSAMMGLVDTTPVVEASWIHVPTPFYFGMPTFEITSIVMMCIIATVSMVESTGVYLALSDLTNDQLDEKRLRNGYRSEGIAVFLGGLFNTFPYTGFSQNVGLVQISGIKTRRPIYYAAGILVVIGLLPKFRAMAQMIPSPVLGGAMLVLFGMVALQGMQMLNRVDFQKNEYNFIIAAVSISAGLGFNGTNLFASLPETAQMFLTNGIVIATLTSVVLNLVLNGKDKQDE

SEQ ID NO: 6611 - DNA, 579 bp, Streptococcus agalactiae
atgaagttattggaagaacgtattcttaaagatggtgatgttttaggtgagaacattttaaaagttgattcttttttgactcatcaggtagattttgagttaatgcaggaaataggtaaagtttttgctgataaatataaagaagccggcattacgaaggttgttacaattgaagcatctggaattgcgccagcagtgtacgcagctcaagcattgggcgtaccaatgatatttgctaaaaaagctaagaacattactatgactgaaggtatcttaactgctgaagtgtattcttttacaaagcaagttacgagtcaagtttctattgtgagtcgctttttatctaacgatgatactgtactcatcattgatgactttttagcaaacggtcaagcggctaaaggattacttgaaattattggtcaagctggagctaaggttgctggtatcggaatcgttattgaaaaatctttccaagatgggcgtgatttgttagaaaaaacaggtgttccagttacttctcttgcccgtattaaagcgtttgaaaatggtcgagttgtttttgcggaggctgatgct

SEQ ID NO: 6612 - protein, 193 aa, Streptococcus agalactiae
MKLLEERILKDGDVLGENILKVDSFLTHQVDFELMQEIGKVFADKYKEAGITKVVTIEASGIAPAVYAAQALGVPMIFAKKAKNITMTEGILTAEVYSFTKQVTSQVSIVSRFLSNDDTVLIIDDFLANGQAAKGLLEIIGQAGAKVAGIGIVIEKSFQDGRDLLEKTGVPVTSLARIKAFENGRVVFAEADA

SEQ ID NO: 6613 - DNA, 579 bp, Streptococcus pyogenes
atgcagttacttgaagaacgcatcttaacagatggcaatattctaggagagaatattctaaaggtagataattttttaactcatcaagttgattaccggttgatgaaagcaattggtaaagtgtttgctcaaaaatatgctgaggctggcattacaaaagtggttacaatcgaagcttcaggtattgcaccagccgtatacgctgcagaagcaatggatgttcctatgatttttgcgaaaaaacataaaaacattaccatgacagaaggcattttgacagcagaagtttattctttcactaaacaagtgacgagcacggtgtctatcgctggtaaattcctatctaaagaagacaaggttttgattattgatgactttttagctaatggtcaggcagccaaaggcttgattgagattattggtcaagcaggggcacaagtcgtcggcgttggtattgtgattgagaaatctttccaagatggtcgtcgattgattgaagatatgggcattgaagtgacctcattagcccgtattaaaaactttgaaaatggtaatctaaacttcttggaggctgacgca

SEQ ID NO: 6614 - protein, 193 aa, Streptococcus pyogenes
MQLLEERILTDGNILGENILKVDNFLTHQVDYRLMKAIGKVFAQKYAEAGITKVVTIEASGIAPAVYAAEAMDVPMIFAKKHKNITMTEGILTAEVYSFTKQVTSTVSIAGKFLSKEDKVLIIDDFLANGQAAKGLIEIIGQAGAQVVGVGIVIEKSFQDGRRLIEDMGIEVTSLARIKNFENGNLNFLEADA

SEQ ID NO: 6615 - DNA, 981 bp, Streptococcus agalactiae
atgtttaacgatattcctgtttttgattatgaagatattcaattaataccaaacaagtgtattatatctagccgctcacaagctgacacaagtgtcaaacttggaaactatacctttaaacttccagtaatccctgctaatatgcagactattattgatgaagaggtagctgaaacattagcgtgtgaaggttatttttatattatgcaccgttttaatgaagaagaaagaaaaccttttatcaagcgtatgcatgataaaggtttaattgcatcgatttcggttggggtcaaagactatgaatatgacttcgtgacaagtctgaaagaagatgctcctgagtttatcactattgatattgcacatggccattctaacagtgttatagagatgatccaacacattaaacaagagcttccagaaactttcgttattgctggaaatgtaggaacgcctgaagctgttagagaattggaaaatgcaggtgcagatgcaactaaagttggtattggacctggtaaagtttgtattactaaagtcaagacaggttttggtactggaggttggcaattagctgccttacgttggtgttctaaagctgctcgcaagccaattattgctgatggtggtattcgaacacatggggatattgcaaaatctatccgctttggtgctagtatggtaatgattggttcgctgtttgctggtcaccttgaaagtcctggaaaacttgtggaagtagaaggacagcaatttaaagaatactatggctcagcttctgaatatcaaaagggagaacataaaaatgttgaaggtaagaaaattctattacctgttaaagggcgactagaggatactttgacagaaatgcaacaagatttgcaaagttctatttcttacgcaggaggaaaagaattggatagcttgagacacgttgattacgttattgttaaaaattctatttggaatggtgattccatt

SEQ ID NO: 6616 - protein, 327 aa, Streptococcus agalactiae
MFNDIPVFDYEDIQLIPNKCIISSRSQADTSVKLGNYTFKLPVIPANMQTIIDEEVAETLACEGYFYIMHRFNEEERKPFIKRMHDKGLIASISVGVKDYEYDFVTSLKEDAPEFITIDIAHGHSNSVIEMIQHIKQELPETFVIAGNVGTPEAVRELENAGADATKVGIGPGKVCITKVKTGFGTGGWQLAALRWCSKAARKPIIADGGIRTHGDIAKSIRFGASMVMIGSLFAGHLESPGKLVEVEGQQFKEYYGSASEYQKGEHKNVEGKKILLPVKGRLEDTLTEMQQDLQSSISYAGGKELDSLRHVDYVIVKNSIWNGDSI

SEQ ID NO: 6617 - DNA, 1002 bp, Streptococcus pyogenes
atgttaaaagaggagaaacttatgtttaatgacatccctgtatttgattatgaagatattcaactgattcctaacaagtgcattattactagtcgttcacaagcagatacaagtgtgacactcggaaaataccagttcaagctaccagttatcccagcaaatatgcaaaccattattgatgaaacaattgctgagcagttggcaaaagagggttatttttatattatgcatcgttttgatgaagatagccgcaaaccttttatcaaacgcatgcatgaacaaggcttgattgcatcaatctctgttggggttaaagcttgtgaatatgaatttgtgacctctttgaaagaggatgctcctgagtttatcaccattgatattgctcatggtcatgctaacagtgttattgatatgattaagcatatcaagactgaattaccagaaacatttgtcattgctggaaatgttggtacgccagaagctgtacgagaactcgaaaatgcaggtgctgatgctactaaagtaggcatcggtccaggcaaagtatgtatcactaaagttaaaaccggtttcggtacaggtggttggcagctagcagcactgcgctggtgcgcaaaggcagctcgtaaacctatcattgctgatggtgggattcgcacacatggtgatattgctaaatccatccgctttggagctagtatggtcatgattggatcgctttttgcaggacattttgaaagtcctggaaaaacggtagaagtggatggtgaaacgtttaaagaatattatggctcggcgtcagaatatcaaaaaggcgagcataaaaatgtagaaggcaaaaaaatcttattgcctacaaaaggtcacttatcagataccctgaccgaaatgcaacaggatttgcaatcgtccatttcttacgcgggtggtaaagatttagacagtttgcgtcatgttgattatgttatcgtcaaaaattctatttggaatggtgattccatt

SEQ ID NO: 6618 - protein, 334 aa, Streptococcus pyogenes
MLKEEKLMFNDIPVFDYEDIQLIPNKCIITSRSQADTSVTLGKYQFKLPVIPANMQTIIDETIAEQLAKEGYFYIMHRFDEDSRKPFIKRMHEQGLIASISVGVKACEYEFVTSLKEDAPEFITIDIAHGHANSVIDMIKHIKTELPETFVIAGNVGTPEAVRELENAGADATKVGIGPGKVCITKVKTGFGTGGWQLAALRWCAKAARKPIIADGGIRTHGDIAKSIRFGASMVMIGSLFAGHFESPGKTVEVDGETFKEYYGSASEYQKGEHKNVEGKKILLPTKGHLSDTLTEMQQDLQSSISYAGGKDLDSLRHVDYVIVKNSIWNGDSI

SEQ ID NO: 6619 - DNA, 1338 bp, Streptococcus agalactiae
atgactaaaaagggatggcgtattatgcctgccataattacaacggctatattaggtttttcagggattcttattgaaacatctatgaatgtcacttttccgcttttgatgaaagaatttggggttaaccccgctgttattcaatgggtgacaacaggaaatttgttagctgttgctgtgactgtgcctttgtcagcatttatgattaaaaatttatcagagagacaaatttttacattggcaaatgtgctttttttatctggtgttttaattgatagctttgcccctaatttagctatattgttagtagggagagttttgcaaggtgttgggacaggattagccctccctttattgtttcatatcattcttacacaaatcccgatggagcgtagaggactaatgatgggagtagctgctatggtcacacttttagcaccggcagttggacctacttatggcggtgttatttcaggaatgttaggatggaagatgatttttatgcttctggcaccaatacttatcatatccacctttataggtttggcttctattcccaaacgtcaagtaagaattaatgataaactcaattttcctgcctttatcagtttaggtattggcttggcaacccttcttttagctattgaaaagatgtctattttttacttattagtagctattgttagttttgttattttttactatttaaataaacagctagaatttttgaatttgaatgtttttaaagataaagatttctcaatcttattgtatggcgtcctggcttttcaaatgattcctctagcactttcgttcttattacctaacctcttgcaacttgttttacatcaaacttcaaccaaagctggtttgtttatgtttccaggtgcaatagcagtagtttttttatccccttttgcaggttatctcctggataaaattggtgcatttaagccaattatgataggcatctccctttctttgataggtttaattggtacagctatattcattcctgcgaagtctgttgtagtacttttagcctttgatatccttactaaaattggtatggggattggagcaagtaatatggttacgacagctttaacaaaactaaagccagcacagtcagcggatggtaatagtatcttgaatacactacaacaatttgcgggagcttttgcaaccgcagtagcctcacaaatttttaccatcggacaagtagctattccgaaaaatggagctataattggtagtcaatttgcagttctattcgttatcgttgttgttatcttagctattgtaggattaacttatcttcgaaaaagaaaagcaata

SEQ ID NO: 6620 - protein, 446 aa, Streptococcus agalactiae
MTKKGWRIMPAIITTAILGFSGILIETSMNVTFPLLMKEFGVNPAVIQWVTTGNLLAVAVTVPLSAFMIKNLSERQIFTLANVLFLSGVLIDSFAPNLAILLVGRVLQGVGTGLALPLLFHIILTQIPMERRGLMMGVAAMVTLLAPAVGPTYGGVISGMLGWKMIFMLLAPILIISTFIGLASIPKRQVRINDKLNFPAFISLGIGLATLLLAIEKMSIFYLLVAIVSFVIFYYLNKQLEFLNLNVFKDKDFSILLYGVLAFQMIPLALSFLLPNLLQLVLHQTSTKAGLFMFPGAIAVVFLSPFAGYLLDKIGAFKPIMIGISLSLIGLIGTAIFIPAKSVVVLLAFDILTKIGMGIGASNMVTTALTKLKPAQSADGNSILNTLQQFAGAFATAVASQIFTIGQVAIPKNGAIIGSQFAVLFVIVVVILAIVGLTYLRKRKAI

SEQ ID NO: 6621 - DNA, 690 bp, Streptococcus agalactiae
atgctaatacccaagaaaatagtggcttttgcctcaaatgaatctgaaaataatttctttattacgttaaagacttactttaattatttattttctatacaaatcattacagatatttcaactctcaatcatgcagattttgacggtagctttgcattccatgatatagaaactagcatacctcatctggtaattgactccaactacttagcgattagtcagactaactcaaaaatagaggctaacgatattaaaacgttctcggaactctccaaaacaatgaccgagtttcactatatgctaaattttgacttatttaaccatctcccatatcgttttagattgcataataaggacggtcaaacaatttattcgaaccataaacctgaagatccttttgatatttatcctgaagaagaatatcctatagacaaatgggttcaaaacagcctaatagagaaaaaagcgaaagagctacatttactcttacctagcgcatcacaagattatattctagtacaatcttataaacgcttagaaaatgatagtgggcaactagttggttatattgaacatgttcataatattaaaccactgctagagggttatttaaaagaatccggtcaagctatcgttggatggtctgatgtcacgtctggtgcttctatctctaacgatgattttgaacta

SEQ ID NO: 6622 - protein, 230 aa, Streptococcus agalactiae
MLIPKKIVAFASNESENNFFITLKTYFNYLFSIQIITDISTLNHADFDGSFAFHDIETSIPHLVIDSNYLAISQTNSKIEANDIKTFSELSKTMTEFHYMLNFDLFNHLPYRFRLHNKDGQTIYSNHKPEDPFDIYPEEEYPIDKWVQNSLIEKKAKELHLLLPSASQDYILVQSYKRLENDSGQLVGYIEHVHNIKPLLEGYLKESGQAIVGWSDVTSGASISNDDFEL

SEQ ID NO: 6623 - DNA, 2007 bp, Streptococcus agalactiae
ttggcagaaatgcaacatgtcaatcattcttcttttgataaagcatcaaaagcaggatttattattgctttaggcattgtttatggagatattggtacaagcccactctatacaatgcaatcattggttgaaaaccaaggtggtatttctagtgttacagaatcgtttatcttaggttctatatctttaatcatatggactctgacacttattacaactatcaagtatgtgcttgtagctttaaaggcggataatcaccacgaaggtggtattttttctttatatacccttgttcgaaaaatgacaccttggttaattgtgccagctgttattggaggtgcaaccttgttgtcagatggagctttgacgccagctgtaaccgtaacttcagccgttgagggattaaaagtagttcctagtttgcagcatattttccagaatcagagtaacgttatttttgcgaccttgtttattttactgttactttttgccatccaaaggtttggaacgggtgtgattgggaaattatttgggccaattatgtttatatggtttgcctttttaggtattagcggtctccttaatagttttgcccatccagaagttttcaaagcaattaatccatactacggtttgaaattgttatttagtccagagaatcataaaggtatttttattttaggatctattttcctggcgacaacgggggcagaagcactatactctgacttaggtcatgttgggcgtggaaatatacatgtttcatggccgttcgttaaggttgccattatactttcttattgtgggcaaggggcatggattttagctaataagaacgcaggaaatgaattgaatcccttttttgctagtatcccttcgcaatttacaatgcatgtcgttattttagctactttggcagctatcatcgcttcacaggcactgatttctggatcatttaccttagtttctgaagctatgcgactaaaaatattcccgcaatttcgttcaacttatcctggtgacaatattggtcaaacctacatacctgttattaattggttcttatttgccattacaacctctattgttttgctttttaagacttcagcgcacatggaagcagcatatggattagcgataacaattacgatgctaatgacaactattttactgtctttctttttaattcaaaaaggagtaaaaagaggtttagtcttattgatgatgattttctttggtattttagagggaatcttcttccttgcttcagctgttaaatttatgcatggaggctatgttgttgttattatagcagtagcaattatattcatcatgactatctggtataaaggtagtaaaattgtttcgcgttatgttaagttgttggatttaaaagattacatcggacaattagataaacttagacatgatcatcgttatccgatttatcatactaacgttgtttatttgacaaatcgtatggaagaagacatgattgataagtctatcatgtattctatccttgataagcgccctaaaaaagcacaagtttattggtttgtaaacattaaggtcactgatgaaccttatacagctgagtataaagttgacatgatgggaacagacttcattgtgaaggtagaactttaccttggatttaagatgcgtcagactgtgtcacgctatcttcgtacgattgtagaagaattacttgaaagtggacgtctgcctaaacaaggaaagacatacagcgttagacctgatagtaacgtaggagattttaggtttattgtccttgatgaacgtttctcaagtagtcaaaacctaaaacctggtgaacgatttgttatgctaatgaaatcatctataaagcattggacagcaacaccaatacgatggtttggtctacaattttccgaagttacaacagaagtagttcctttgatttttacagctaatcgaggtctaccaattaaagaaaaaagtgaacttacaacaactggagat

SEQ ID NO: 6624 - protein, 669 aa, Streptococcus agalactiae
MAEMQHVNHSSFDKASKAGFIIALGIVYGDIGTSPLYTMQSLVENQGGISSVTESFILGSISLIIWTLTLITTIKYVLVALKADNHHEGGIFSLYTLVRKMTPWLIVPAVIGGATLLSDGALTPAVTVTSAVEGLKVVPSLQHIFQNQSNVIFATLFILLLLFAIQRFGTGVIGKLFGPIMFIWFAFLGISGLLNSFAHPEVFKAINPYYGLKLLFSPENHKGIFILGSIFLATTGAEALYSDLGHVGRGNIHVSWPFVKVAIILSYCGQGAWILANKNAGNELNPFFASIPSQFTMHVVILATLAAIIASQALISGSFTLVSEAMRLKIFPQFRSTYPGDNIGQTYIPVINWFLFAITTSIVLLFKTSAHMEAAYGLAITITMLMTTILLSFFLIQKGVKRGLVLLMMIFFGILEGIFFLASAVKFMHGGYVVVIIAVAIIFIMTIWYKGSKIVSRYVKLLDLKDYIGQLDKLRHDHRYPIYHTNVVYLTNRMEEDMIDKSIMYSILDKRPKKAQVYWFVNIKVTDEPYTAEYKVDMMGTDFIVKVELYLGFKMRQTVSRYLRTIVEELLESGRLPKQGKTYSVRPDSNVGDFRFIVLDERFSSSQNLKPGERFVMLMKSSIKHWTATPIRWFGLQFSEVTTEVVPLIFTANRGLPIKEKSELTTTGD

SEQ ID NO: 6625 - DNA, 1998 bp, Streptococcus pyogenes
atgtctgatagccatcttactgcctttgacaaagcttcaaaagcaggttttattattgctttaggtattgtttatggagatattggaacaagccccctttatacgatacagtctctagttgaaaatcaaggaggggttaatcaggtttctgaatcctttattttaggatcaatctctttaattatttggacactgaccttaatcacaacaatcaagtacgttttgattgctctaaaagcggataaccaccatgaaggtgggattttttctttattcaccttggtacgtaaaatgtcaccgtggctcattattccggcgatgattggaggtgcaacacttttgtctgatggggctcttacacctgcggtaacagttacttcagctattgagggcttgaaagccgttcctggtctgagtcacatctaccaaaatcaaaccaatgtcattatcacaactctagtgattttaatagtcttgtttggtattcagcggtttggaacaggttttattggtaaaatttttggaccagttatgtttatctggtttagttttctaggtgttagtggtttttttaatacgttggggcatctggaaattttcaaggctatcaatccttactatgctctgcatttgctgtttagtcctgaaaaccatcgtgggatttttatcttggggtccatttttcttgcgacaacaggagctgaagctctttattcggatttaggacatgttggtcgaggaaatatttacgtgagctggccctttgttaagatgtgtattgtgttgtcttactgtggccaggctgcgtggattttagcgaataaacactcaggtattgaactaaaccctttctttgctagtgtgccatcacaattaagagtttaccttgttagtttggcaaccttggcagctattattgcctcacaggctcttatttcaggctcctttaccttggtttcagaggccatgcgtttgaaaattttccctttgtttcgtgtgacttacccaggggcaaatttggggcaattgtatattcctgtcattaactggattttatttgcagtgacctcttgtactgttttggcttttagaacatcagcccacatggaggcagcttatggtcttgctattaccatcaccatgttgatgacaacaatcctcttaaagtattacttaatcaagaaaggaacgagacccatcttggctcatttagtgatggctttctttgcccttgtagaattcattttcttcttggcttcagctatcaaatttatgcacggtggctatgcggttgttatcttggcacttgcaattgtctttgtcatgtttatctggcatgcgggcacacggattgttttcaagtatgtgaaatctcttaatttgaatgattacaaggagcagattaaacaacttcgtgacgacgtttgttttgacctctaccaaacaaatgttgtctacctatccaatcgtatgcaggatcatatgattgaccggtctattttatactccattttagacaagcggccaaaacgcgctcaagtttattggtttgtaaatgtccaggtaactgatgaaccttatacagctaagtacaaggtagatatgatgggaacggattatatggttcgagtcaacctttatcttggttttagaatgccacagactgtgccacgctatttgcgcacgattgttcaggatttgatggaaagtggccgtttacccaaacaagaacaggaatataccatcacacctggtcgtgatgttggtgattttcgctttgttttaatagaagaacgggtctccaatgcacgtcaattgagtaactttgaacgctttattatgcagactaaggcaagcattaaacatgttaccgctagtccaatgcgttggtttgggcttcaatattcagaagtaacccttgaagtggttcccttgattctatcagatgtcttgaagttaccaatcaaagaattggtgcctgtggaagacagtgaagca

SEQ ID NO: 6626 - protein, 666 aa, Streptococcus pyogenes
MSDSHLTAFDKASKAGFIIALGIVYGDIGTSPLYTIQSLVENQGGVNQVSESFILGSISLIIWTLTLITTIKYVLIALKADNHHEGGIFSLFTLVRKMSPWLIIPAMIGGATLLSDGALTPAVTVTSAIEGLKAVPGLSHIYQNQTNVIITTLVILIVLFGIQRFGTGFIGKIFGPVMFIWFSFLGVSGFFNTLGHLEIFKAINPYYALHLLFSPENHRGIFILGSIFLATTGAEALYSDLGHVGRGNIYVSWPFVKMCIVLSYCGQAAWILANKHSGIELNPFFASVPSQLRVYLVSLATLAAIIASQALISGSFTLVSEAMRLKIFPLFRVTYPGANLGQLYIPVINWILFAVTSCTVLAFRTSAHMEAAYGLAITITMLMTTILLKYYLIKKGTRPILAHLVMAFFALVEFIFFLASAIKFMHGGYAVVILALAIVFVMFIWHAGTRIVFKYVKSLNLNDYKEQIKQLRDDVCFDLYQTNVVYLSNRMQDHMIDRSILYSILDKRPKRAQVYWFVNVQVTDEPYTAKYKVDMMGTDYMVRVNLYLGFRMPQTVPRYLRTIVQDLMESGRLPKQEQEYTITPGRDVGDFRFVLIEERVSNARQLSNFERFIMQTKASIKHVTASPMRWFGLQYSEVTLEVVPLILSDVLKLPIKELVPVEDSEA

SEQ ID NO: 6627 - DNA, 99 bp, Streptococcus agalactiae
gtgtcatgggttgctagccaaccagaacacattaatattaatcgcatagaaataatgccagtcagtcaaacttatggacctcaacctgtttatcgtgat

SEQ ID NO: 6628 - protein, 33 aa, Streptococcus agalactiae
MSWVASQPEHININRIEIMPVSQTYGPQPVYRD

SEQ ID NO: 6629 - DNA, 156 bp, Streptococcus pyogenes
gtgaaggccatttatcaaggagcacatgccattcaacctcaaaatattgcgtcgaccgtatcatgggtgattcatcagccccctcatgttaatgttaatcgtattgagctgatgccagtgtcgcaaagttatggaccgcaaccagttactcgtgac

SEQ ID NO: 6630 - protein, 52 aa, Streptococcus pyogenes
VKAIYQGAHAIQPQNIASTVSWVIHQPPHVNVNRIELMPVSQSYGPQPVTRD

SEQ ID NO: 6631 - DNA, 651 bp, Streptococcus agalactiae
  misc_feature (1)..(651): n = a, c, g, or t
atgaaaacaagatcaaaacttgcagcaggctttttgacacttatgtcagttgccacattagctgcctgctcaggtaaaacatcaaatggaacaaatgttgttacaatgaagggcgacactattacagtctctgatttttatgatcaagtaaaaacatcaaaagctgcacaacaatcaatgcttacattgatcctctcacgtgtttttgatacacagtatggtgataaagtttcagataaaaaagtatcagaagcttataataagacagctaaaggctatggtaattcattttcaagcgcactttcacaagcaggtttgactccggaaggttacaaacaacaaattcgcacaactatgcttgtggaatatgctgtaaaagaagcagctaagaaagaattaacagaagcaaactataaagaagcatataaaaactatactcctgaaacttctgtacaagtaatcaaattggatgcagaagataaagctaaatctgtccttaaagatgtaaaggctgatggagctgattttgcaaagattgcaaaagaaaaaacaacagctactgataagaaagttgagtataaatttgattctgcagggacaaccctccctaaagaagttatgtcagcagcctttaagctagannnnnttaat

SEQ ID NO: 6632 - protein, 217 aa, Streptococcus agalactiae
  MISC_FEATURE (1)..(217): Xaa = Any Amino Acid
MKTRSKLAAGFLTLMSVATLAACSGKTSNGTNVVTMKGDTITVSDFYDQVKTSKAAQQSMLTLILSRVFDTQYGDKVSDKKVSEAYNKTAKGYGNSFSSALSQAGLTPEGYKQQIRTTMLVEYAVKEAAKKELTEANYKEAYKNYTPETSVQVIKLDAEDKAKSVLKDVKADGADFAKIAKEKTTATDKKVEYKFDSAGTTLPKEVMSAAFKLXXXN

SEQ ID NO: 6633 - DNA, 1053 bp, Streptococcus pyogenes
atgaaaaactcaaataaactcattgctagtgttgtgacattggcctcagtgatggctttagcagcttgtcaatcaactaatgacaatactaaggttatttcgatgaaaggtgatacaattagcgttagtgatttttacaatgaaacaaaaaacacagaagtatcgcaaaaagcgatgctaaatctggtaattagtcgtgtttttgaagctcaatatggtgataaggtttcaaaaaaagaagttgaaaaggcgtatcataaaacagctgaacagtatggcgcttcattctctgctgctttggcacaatcaagcttgacacctgagacttttaagcgtcagatccgctcttcaaaattagtagaatatgcggttaaagaagcagctaaaaaagaattgacaacacaagaatataagaaagcatatgaatcttatactccaacaatggcagtcgaaatgattactttagataatgaagagacagctaaatcagtcttagaggaactaaaagccgaaggcgcagactttacagctattgctaaagaaaaaacaacaacacctgagaaaaaagtgacctataaatttgattcaggtgcgacaaatgtaccgactgatgtcgtaaaagcggcttcaagtttgaatgagggtggcatatcagacgttatctcggttttagatccaacttcttatcaaaagaagttttacattgttaaggtgactaaaaaagcagaaaaaaaatcagattggcaagaatataagaaacgtttgaaagctatcattatagctgaaaaatcaaaagatatgaatttccaaaacaaggttattgcaaatgcattggataaagctaatgtaaaaattaaagacaaagcttttgctaatattttggcgcaatatgcaaatcttggtcaaaaaactaaagctgcaagtgaaagttcaacaaccagcgaatcatcaaaagctgcagaagagaacccatcagaatcagagcaaacacagacatcatcagctgaagaaccaactgagactgaggctcagacgcaagagccagctgcacaa

SEQ ID NO: 6634 - protein, 351 aa, Streptococcus pyogenes
MKNSNKLIASVVTLASVMALAACQSTNDNTKVISMKGDTISVSDFYNETKNTEVSQKAMLNLVISRVFEAQYGDKVSKKEVEKAYHKTAEQYGASFSAALAQSSLTPETFKRQIRSSKLVEYAVKEAAKKELTTQEYKKAYESYTPTMAVEMITLDNEETAKSVLEELKAEGADFTAIAKEKTTTPEKKVTYKFDSGATNVPTDVVKAASSLNEGGISDVISVLDPTSYQKKFYIVKVTKKAEKKSDWQEYKKRLKAIIIAEKSKDMNFQNKVIANALDKANVKIKDKAFANILAQYANLGQKTKAASESSTTSESSKAAEENPSESEQTQTSSAEEPTETEAQTQEPAAQ

SEQ ID NO: 6635 - DNA, 705 bp, Streptococcus agalactiae
gtggttcaatcttacagtaaaaatgctaatcataatatgcgtcgtccagtagttaaagaagaaattgttcaatatatgcgtcagcaccaaaaacaaaataatggctgtttagcagagttagaagcatttgctaaacaggaaaatatccctattatacctcatgaaacagcgacttattttcgttttttgatgcaaacattacaacctaagcacattttagaaattggaacagctattggtttttcggcccttttgatggcagaaaacgctcctgaagcaaagataacaacgatcgatcgtaatgaagagatgattgccttggctaaggaaaactttgcaaaatatgataatcacaatcagataacccttttggaaggcgatgctgtggatgtgttacaaacattggataaatcttacgattttgtattcatggattctgctaagtctaaatatatcgtttttttacctcaagtattaaaacatttagatgttggaggagtagttgttttagatgatattttccaaggtggagatattgcaaaacctatcgatgaagtgagaagaggtcagcgaactatctaccgaggtctgcaacgtttatttgactcgactttgcaacatcctgatttaactgctactttggtacctttgggagatggtttattgatgattcgtaaaaatgcagatcatattgtactagaagat

SEQ ID NO: 6636 - protein, 235 aa, Streptococcus agalactiae
MVQSYSKNANHNMRRPVVKEEIVQYMRQHQKQNNGCLAELEAFAKQENIPIIPHETATYFRFLMQTLQPKHILEIGTAIGFSALLMAENAPEAKITTIDRNEEMIALAKENFAKYDNHNQITLLEGDAVDVLQTLDKSYDFVFMDSAKSKYIVFLPQVLKHLDVGGVVVLDDIFQGGDIAKPIDEVRRGQRTIYRGLQRLFDSTLQHPDLTATLVPLGDGLLMIRKNADHIVLED

SEQ ID NO: 6637 - DNA, 705 bp, Streptococcus pyogenes
atggttaaatcatacagtaaaacagcaaatcataatatgcgtcgtcctgttgtcaaagaagagcttgttcattatatgcgaacacggcagaagcaaaccacaggttttttagcagagttagagcaattcgcaagacaagaaaacattcctattattcagcctgaggtcgtggcttatttcaggtttttattgcaaagcttacagccaaaacacattttggagattggcacagccattggtttttctgcgcttttaatggctgaaaatgcaccagatgcgacgattgtgactattgatcgtaatcgagagatgatcgattttgctaaagcaaattttgctaagtacgacagtcgccaacagatccgcctgttagaaggagatgcagcagatatattatctacacttgaaggaaattttgactttgtgtttatggattccgccaaatccaaatatattgtctttctaccagagattttaagactgctaaaagtcggtggtgtagtcattttggatgatgtctttcaaggaggtgacattacaaaaccgatcgaagatattcgacgaggtcagcgtactatttatcgtggcttacagtctttgtttgatgccaccttaactcatccaaacctaacaactagcctggtccctcttagtgatggattattaatgattcgtaaaaatcaagcagatattgtattaccagat

SEQ ID NO: 6638 - protein, 235 aa, Streptococcus pyogenes
MVKSYSKTANHNMRRPVVKEELVHYMRTRQKQTTGFLAELEQFARQENIPIIQPEVVAYFRFLLQSLQPKHILEIGTAIGFSALLMAENAPDATIVTIDRNREMIDFAKANFAKYDSRQQIRLLEGDAADILSTLEGNFDFVFMDSAKSKYIVFLPEILRLLKVGGVVILDDVFQGGDITKPIEDIRRGQRTIYRGLQSLFDATLTHPNLTTSLVPLSDGLLMIRKNQADIVLPD

SEQ ID NO: 6639 - DNA, 696 bp, Streptococcus agalactiae
gtggaaatacctacccaagttatgatttttatgagaccaaaactgctattgtcaaaaaagaagggaaataggatgaagaagcttacttttatttgggatttagatgggacattaatagattcgtatgtaccaattatggaagctcttgaagaaacctatcgtcattttggtttaatatttgataaagaattaatccatgaatatattttacaggaatcagtggggaaattattggtaaacctttcagaggaagagcaaatacctcatgaaaaactgaaagcatattttacaaaagaacaagaaagtcgagattctaaaatacatttaatgccatatgcaaaagagattttagaatggaccaaagaacaagatatccccaattttatgtatacacataaaggagcaagtacgcattcagtgttggaaaccttgcagatctctcattattttgatgaaattttaactggtgtttcgggattcgagcgaaaaccacatccacaagggattaattatttagttaaacgatattctttagataaatcaatgacttattacataggagatcgtccactagatttggaggttgctcaaaatgctggtataaaatccataaacttaaggttagagaattccaaagaaaactataatatttcaagtctcaaagatataatatcacttgatttcactcgtttggat

SEQ ID NO: 6640 - protein, 232 aa, Streptococcus agalactiae
MEIPTQVMIFMRPKLLLSKKKGNRMKKLTFIWDLDGTLIDSYVPIMEALEETYRHFGLIFDKELIHEYILQESVGKLLVNLSEEEQIPHEKLKAYFTKEQESRDSKIHLMPYAKEILEWTKEQDIPNFMYTHKGASTHSVLETLQISHYFDEILTGVSGFERKPHPQGINYLVKRYSLDKSMTYYIGDRPLDLEVAQNAGIKSINLRLENSKENYNISSLKDIISLDFTRLD

SEQ ID NO: 6641 - DNA, 1803 bp, Streptococcus agalactiae
atgtcagacaatcgctcacatattgaagaaaaataccaatgggatttaactactgtctttgcgactgatgagttatgggaaactgaagtggtagagcttactcaagccatcgataatgcaaagggtttttcaggtcatctgttggactcaagccaatctttattggagatcacggaggttgaattagatttatctcgccgtttagaaaaagtttatgtctatgcttcaatgaaaaatgaccaagacaccactgttgcgaaatatcaagaatttcaagcgaaagcgacagcgctctatgcaaaatttagtgaaacattttcgttttacgagccagaactattgcaactttcagagtctgattaccagtcattccttttagaaatgcctgacttgcaaaaatatgatcatttctttgagaaaatatttgcaaataaacctcatgtcttatctcaaaacgaagaagaattgttagctggtgctagtgagatttttggagcagctggtgagacatttgaaatccttgataatgcagatatggtcttcccagttgtaaaaaatgcaaaaggtgaggaagttgagcttacacatggtaatttcatttcccttatggaatctagcgataggacggttcgaaaagaagcatatcaagctatgtatagcacatatgaacaattccagcatacttacgctaaaacattacaaacaaatgtgaaatctcaaaattttaaggctcgtgtgcatcattatcaatcagcacgccaatcagctctatctgccaattttattccagaagaggtctacgaaactctaattaagacagttaatcatcatttaccgctcttacatcgttatatgaagttgcgtcaaaaagttcttgggctagatgatttgaagatgtatgacgtatatacacccctttctcaaatggatatgagttttacttatgatgaagctctaaaaaaatcagaggaggttctagctatttttggcgaagcatattctgaacgtgttcatcgtgcttttactgaacgttggattgatgtccatgttaacaaaggaaagaggtcaggcgcttattcaggtggatcttatgacactaatgctttcatgcttcttaactggcaagatactttagataatctttatacgctggtgcatgaaactggacatagtctacactcgacgtttactcgtgaaaatcaaccctatgtttatggtgattattctattttcctagctgaaattgcatcaacaacaaatgaaaatatattaacagaaacccttttgaaagaagttaaagatgataaaaatcgctttgcaattctcaatcattatttggacggtttcaaaggaacaatttttaggcaaacacagttcgctgaattcgaacatgccattcatgtagctgatcaggaggggcaagtactaactagcgaatacttaaacaatctttacgctgagcttaatgaaaaatattatggtttgactaaagaagataatcattttattcaatatgaatgggcaagaattccacacttttactacaattattatgttttccaatatgcaaccggcttcgcagcagcaaattatttagcagagcgtattgtaaacggtaatccggaggataaagaggcctacctaaattaccttaaagctgggaattcagattaccctctaaacgtcattgctaaagctggtgttgatatgactagtgcagactatctggatgcagcttttagagtatttgaagagcgtttagtggaactggaaaatcttgtagcaaaaggcgtccataatgat

SEQ ID NO: 6642 - protein, 601 aa, Streptococcus agalactiae
MSDNRSHIEEKYQWDLTTVFATDELWETEVVELTQAIDNAKGFSGHLLDSSQSLLEITEVELDLSRRLEKVYVYASMKNDQDTTVAKYQEFQAKATALYAKFSETFSFYEPELLQLSESDYQSFLLEMPDLQKYDHFFEKIFANKPHVLSQNEEELLAGASEIFGAAGETFEILDNADMVFPVVKNAKGEEVELTHGNFISLMESSDRTVRKEAYQAMYSTYEQFQHTYAKTLQTNVKSQNFKARVHHYQSARQSALSANFIPEEVYETLIKTVNHHLPLLHRYMKLRQKVLGLDDLKMYDVYTPLSQMDMSFTYDEALKKSEEVLAIFGEAYSERVHRAFTERWIDVHVNKGKRSGAYSGGSYDTNAFMLLNWQDTLDNLYTLVHETGHSLHSTFTRENQPYVYGDYSIFLAEIASTTNENILTETLLKEVKDDKNRFAILNHYLDGFKGTIFRQTQFAEFEHAIHVADQEGQVLTSEYLNNLYAELNEKYYGLTKEDNHFIQYEWARIPHFYYNYYVFQYATGFAAANYLAERIVNGNPEDKEAYLNYLKAGNSDYPLNVIAKAGVDMTSADYLDAAFRVFEERLVELENLVAKGVHND

SEQ ID NO: 6643 - DNA, 1803 bp, Streptococcus pyogenes
atgactgataatcgcagccatttagaagaaaaatacacttgggatttgagcactatttttgcaacagataaggattgggaagctgaagtcagtgacttagctactgaagttgaggcatctaaaggttttgctggtcatttgctggattctagtgctaatttgttaaaggttacaaaaacatatttagaattggctcgtcgtgtggagaaagtctatgtttatgctcacatgaaaaatgaccaagacactactgttgccaagtatcaagaataccaagctaaggcttcaggcttgtatgcaaagtttagcgaagtcttttcattctatgatccagaagtgatgatgcttcatcaagaagactatcaggcttttcttactgaaacccctgagttgaaagtgtacaaccatttctttgacaaattattccaagcccgcgaacatgttcttagtcaagcagaagaggaattattagcaggagctcaagaaattttcaatggtgcggaagaaacctttagtattcttgataacgctgacattgtctttccagtagttaaaaatgataagggggaagatgttgaattaacccatggtaacttcattagcctaatggaatctaaggaccgtagcgttcgccaagctgcttatgaagccatgtatagtacttatgaacagttccaacatacttacgctaaaaccttgcaaaccaatgtgaaagtgcaaaactataaggcgcgtgttcataaatacgattcagcacgtcaagctgccatggctgctaactttattccagaagctgtttacgacactttattagaaacggttaataaacatttgccactcttacaccgttatttgaaattgcgtcaagaggttcttggtttagacgatttgaagatgtatgatgtttacacaccattatctgaaacagatctagccattggttatgatgaggctttggaaaaggctgagaaggttttggctgtttttggtaaagattacgcagatcgtgtgcatcgtgcttttaccgaacgttggattgatgttcatgtcaataaagggaagcgctctggggcttattcaggtggttcctatgataccaatgcctttattctgttgaattggcaagatacacttgataatctttacacacttgtccacgaaacaggccacagtttgcattctactttcactcgtgaaacacagccttatgtgtatggggattatagtatcttcttggcagaaattgcatccacaacgaatgaaaatattatgacagaagctctcttaaatgaggttcaagatgagaaagaacgctttgccattttaaaccattacctcgatggtttccgtggaacagttttccgtcaaacccaatttgctgagtttgaacatgccattcatcaagctgatcaaaaaggagaagtgttaacaagtgaataccttaaccagctatacgctgatttaaatgaaaaatattatggtttaagtaaaaaagataatcattttattcagtatgaatgggcacgtattcctcatttctattacaattattatgtttaccaatatgcaacaggttttgcagctgcaagctatttagcagataagattgtgcatggcacacaagatgatatcgatcattacttggcctacctcaagtcaggaaattctgattacccacttgaagtgattgctaaagcaggcgttgatatggaaaaaggtgattatttggaagccgcctttaaagtctttgacgaacgtctaacagaacttgaagtactcgtgtccaaaggcatacacaaaagc

SEQ ID NO: 6644 - protein, 601 aa, Streptococcus pyogenes
MTDNRSHLEEKYTWDLSTIFATDKDWEAEVSDLATEVEASKGFAGHLLDSSANLLKVTKTYLELARRVEKVYVYAHMKNDQDTTVAKYQEYQAKASGLYAKFSEVFSFYDPEVMMLHQEDYQAFLTETPELKVYNHFFDKLFQAREHVLSQAEEELLAGAQEIFNGAEETFSILDNADIVFPVVKNDKGEDVELTHGNFISLMESKDRSVRQAAYEAMYSTYEQFQHTYAKTLQTNVKVQNYKARVHKYDSARQAAMAANFIPEAVYDTLLETVNKHLPLLHRYLKLRQEVLGLDDLKMYDVYTPLSETDLAIGYDEALEKAEKVLAVFGKDYADRVHRAFTERWIDVHVNKGKRSGAYSGGSYDTNAFILLNWQDTLDNLYTLVHETGHSLHSTFTRETQPYVYGDYSIFLAEIASTTNENIMTEALLNEVQDEKERFAILNHYLDGFRGTVFRQTQFAEFEHAIHQADQKGEVLTSEYLNQLYADLNEKYYGLSKKDNHFIQYEWARIPHFYYNYYVYQYATGFAAASYLADKIVHGTQDDIDHYLAYLKSGNSDYPLEVIAKAGVDMEKGDYLEAAFKVFDERLTELEVLVSKGIHKS

SEQ ID NO: 6645 - DNA, 945 bp, Streptococcus agalactiae
atgttaattgctaaagacaaacaaggaaatttaattaatctactcgagtctcatccgggaaagggacagtatttttgtccaacttgttgttcagctgtaaggttaaaggcaggtcgaatcatgagaagacactttgcacatattagtctaaaaaattgtcagttttatcatgaaaatgagtctaatgagcacttgcaattaaaagcaaagttatatatgagtttaagtagagagaatgaaactatgctcgagcatcatttgccagaaattaatcagattgcagatttatttgtgaatgagacattggctttagaagttcagtgtagccgactatcagagcagcgactcagggagcgaacaaaagcatatctacaggcagactttcaagtgagatggttactaggggaaaaactctggttaaagcatcgtttaacaaatctacataaacaatttttacaattttctcaaagtatcggatttcatatttgggagttagatttgaggttagaagtactgagactaaaatatttgatttacgaagatttacgcggacatgtctattacttaagtaaaacttgccctcttagtggagacgttctagcatttttgaagtggccataccaatcaaaaaatctaaatttttataaggttaaacaagacagaaatatcagagattatgtgcgtcagcagttacgctatggcaatcaattttggttacgaaaacaagaaaaggcctacctttctggtcagaatctattgacccaagagctaatgatgttttttcctcaaatacagccaccacgtgtagatactgatttttgtcaaataacaaattctctaacatcgttttatcagaattttacaaattattatcaaaaaaataagaataacttagaccaaacactttatccccctgtattttatgataaaatagtcactaagaat

SEQ ID NO: 6646 - protein, 315 aa, Streptococcus agalactiae
MLIAKDKQGNLINLLESHPGKGQYFCPTCCSAVRLKAGRIMRRHFAHISLKNCQFYHENESNEHLQLKAKLYMSLSRENETMLEHHLPEINQIADLFVNETLALEVQCSRLSEQRLRERTKAYLQADFQVRWLLGEKLWLKHRLTNLHKQFLQFSQSIGFHIWELDLRLEVLRLKYLIYEDLRGHVYYLSKTCPLSGDVLAFLKWPYQSKNLNFYKVKQDRNIRDYVRQQLRYGNQFWLRKQEKAYLSGQNLLTQELMMFFPQIQPPRVDTDFCQITNSLTSFYQNFTNYYQKNKNNLDQTLYPPVFYDKIVTKN

SEQ ID NO: 6647 - DNA, 960 bp, Streptococcus pyogenes
gtgacaaaaatattaaccgctttagatgataagaatcagctcatttcgctagtaactcagcctatttcaacgaaaccgccttttcgttgcccagcttgcaaatctcctgttcgcttgcgtcaggggacaattagacgacctcattttgcccatgtacaactagctcattgtcaattccaagcagaaaatgaatctgaggaacatttgacgttgaaggcaaaactttacaccagtttagtccgaacagaagctgtctgtattgaaaaatatcttcctgagctgcaacagatagcagacctttgggtgaatgataagttagccttagaaattcagtgcagtcccttgccagttgagcgtctaaagaaacgcaccaaagcctatcaagaaaaggggtatccggtacgatggttactgggaagaaaattgtggcttaacactcacttaactgctttgcaaaaacagtttctttacttttcatctagtttgggctttcatttgtgggagctggatgcagctgcaaatctgctacgtctcaaatatttaatccatgaagacttatttggtaaggtaagttacctaaccaaaaccatttctttagaccacaatattatggaaatgtttcggttaccctatcagcaagaaatcctttattcttatcagaaaaaaatgactgtgaacctatctaaaagaatacaaagagctcttttagctagacacccgaaatggctacgacgacaagaaaaggcttacttatcaggctataatttacttatgttaacaactgatgctttttatcctcaatggagaccagttcaatcttccagcggtttttgtcaaattaaaggaaatcttcgcccttattatgaaagttttaaagtctattataaaaaagaaaaggataagaaggtgcaaacgcttttttcaccaaaatattatgttaaaatggatagtaatagaaaa

SEQ ID NO: 6648 - protein, 320 aa, Streptococcus pyogenes
VTKILTALDDKNQLISLVTQPISTKPPFRCPACKSPVRLRQGTIRRPHFAHVQLAHCQFQAENESEEHLTLKAKLYTSLVRTEAVCIEKYLPELQQIADLWVNDKLALEIQCSPLPVERLKKRTKAYQEKGYPVRWLLGRKLWLNTHLTALQKQFLYFSSSLGFHLWELDAAANLLRLKYLIHEDLFGKVSYLTKTISLDHNIMEMFRLPYQQEILYSYQKKMTVNLSKRIQRALLARHPKWLRRQEKAYLSGYNLLMLTTDAFYPQWRPVQSSSGFCQIKGNLRPYYESFKVYYKKEKDKKVQTLFSPKYYVKMDSNRK

SEQ ID NO: 6649 - DNA, 1149 bp, Streptococcus agalactiae
ttgaattcaaaactttcattgaaattgactattttatcgatttctatctttttgatgtctcatttagcaattgctcctgcaattcctaaattgtatgccttttaccatactcaaaaccctcatattggactagcttcagtagagagtttagttactattccagctatgatgattactatttttgttattttgagtaattttgtagtcacaaaacttggcaaaaaaaacacggtcttacttggtttatgtttaatcttaatgtctgggtttatctcattttttacaagtaatttttcacttgcgatggctagtcgactacttttgggtattggtattggtctctataattcgctatcaattagtatcataacggatttatatgaggctgatgagagagccagtatgattggtcttagaacagcatcactcaatatcggtaaagccttaactacatttattgttggattggttttagctattggtgtgaattatatttatttggtttaccttctggttattcctgttttctttttcttttggaaaaatgttccagaggttgaaaatcaaacacatacccttaaagctagtacaacatttgatactaaagcggctttgttgatgctcatcacgttcttagtaggtattgcttatataggagcaactgtcaaaattccaaccttactagtgacaaaatatcactacgcgacgagcttctctagtaatatgttaactctccttgcttttagtggtattttagttggatctgtatttggaaaattagttaaagtattccaagagaagacgctattaatcatgattctagctatgggaataggtaatgtgctatttgctttagctaataatcagatcatttttatcgtagctagtattttaataggagctagttttgttggcaccatgtcttctgtattcttttatatttcaaaaaactatgcaaaagaacataataactttatcacaagccttgccttaacagctggtaatataggagttattttgacaccgcttattttaacgaaacttccaagccagctacatctggaaccttttatgacaccatttttaataacaagtgggctgatggtgattaatgtctttgtttacctagttttaatgtcaaaaaataaa

SEQ ID NO: 6650 - protein, 383 aa, Streptococcus agalactiae
MNSKLSLKLTILSISIFLMSHLAIAPAIPKLYAFYHTQNPHIGLASVESLVTIPAMMITIFVILSNFVVTKLGKKNTVLLGLCLILMSGFISFFTSNFSLAMASRLLLGIGIGLYNSLSISIITDLYEADERASMIGLRTASLNIGKALTTFIVGLVLAIGVNYIYLVYLLVIPVFFFFWKNVPEVENQTHTLKASTTFDTKAALLMLITFLVGIAYIGATVKIPTLLVTKYHYATSFSSNMLTLLAFSGILVGSVFGKLVKVFQEKTLLIMILAMGIGNVLFALANNQIIFIVASILIGASFVGTMSSVFFYISKNYAKEHNNFITSLALTAGNIGVILTPLILTKLPSQLHLEPFMTPFLITSGLMVINVFVYLVLMSKNK

SEQ ID NO: 6651 - DNA, 717 bp, Streptococcus agalactiae
atgcgtttagataaattattaggtcaggcaggatttgggtctagaaatcaggttaagaaattaatttgttctaggcaagtttctgtagatggtcaaattgttacaaaggataatgttattgtagatagtggtctacaatcgatttttgtaggaaaagagagggtctgcctaaaagaaagttcttattaccttctttataagccatcaggagttgtttcagcagttagagattcagaacataaaacagtcatagacttaattagcgaaaaagataaggtggagggattgtatccgattggtcgtctagatcgtgatacggaagggcttttaatagtcacgaataatggtccactgggttaccgaatgttacatccaaaacaccacgttgcaaaaacatattatgttgaagtaaatggtttcttggaaagagatgctattaccttttttgaagaaggagttgtatttgacgatggaacaaagtgtaaaccagctgaattaacgattgatacggctaataatgacaaaagtaccgcaagaataactatcacagaagggaaatttcaccaagtaaaaaagatgtttcttgcatatggcgttaaagttatatacttgaggcgtatttcttttggtgacttgaggcttgatatgaatttgaaaccaggtcagtatcgtagattgagagattcagaggcagctatcttaaaaaggtatttagat

SEQ ID NO: 6652 - protein, 239 aa, Streptococcus agalactiae
MRLDKLLGQAGFGSRNQVKKLICSRQVSVDGQIVTKDNVIVDSGLQSIFVGKERVCLKESSYYLLYKPSGVVSAVRDSEHKTVIDLISEKDKVEGLYPIGRLDRDTEGLLIVTNNGPLGYRMLHPKHHVAKTYYVEVNGFLERDAITFFEEGVVFDDGTKCKPAELTIDTANNDKSTARITITEGKFHQVKKMFLAYGVKVIYLRRISFGDLRLDMNLKPGQYRRLRDSEAAILKRYLD

SEQ ID NO: 6653 - DNA, 582 bp, Streptococcus pyogenes
atgcgtttagataaattattagaaggtacaaaagttggctctagaagtcaagtgaagaaactgattaaggctcaaggggtttgggttgatcacatgcctgccagaaatggtcgacaaaatgttgatcctggcttgcaactgattgaggtgactggacagcgagtgacgcatcctaaacattcttacattatcctcaacaagccatcaggggtggtctcagctaagaaagatactaactatttaaccgttattgatcagcttgctgaagaagataaaagtccagacttgtatcctgttggcagattggatagagataccgaagggttggttttactcactgataatggtcccctagggtttcggatgttgcaccctagtcatcatgtttctaaaacgtatcttgtaaccgttaatggcttgttagcagaagatgcctcagatttttttgcagctggtatttgtttcccaacaggtgaacaatgccaaccagctcaattgactattcttaaagccgatacagaccagtcacaggctagtttgaccatttcagaaggaaaatttcaccaagtgaaaaaatgtttt

SEQ ID NO: 6654 - protein, 194 aa, Streptococcus pyogenes
MRLDKLLEGTKVGSRSQVKKLIKAQGVWVDHMPARNGRQNVDPGLQLIEVTGQRVTHPKHSYIILNKPSGVVSAKKDTNYLTVIDQLAEEDKSPDLYPVGRLDRDTEGLVLLTDNGPLGFRMLHPSHHVSKTYLVTVNGLLAEDASDFFAAGICFPTGEQCQPAQLTILKADTDQSQASLTISEGKFHQVKKCF

SEQ ID NO: 6655 - DNA, 1017 bp, Streptococcus agalactiae
ttgctaattctttttaaaatctttatactactaattagtaatagaaaaacaaaggagattatcatgggacttttagtagatggcaaatgggttgatcaatggtatgatactgcatcaactggtggtaaattcgtccgaaccgttacacaattccgtcattgggttactaaagatggttcagcagggcctagtggggatgcaggttttaaagcagaatctggacgatatcatctctacgtttcactagcttgcccttgggcatcacgtgtattaatcatgagaaagcttaaaaatctagaatctcatatctctatctccattgttaaccctttaatgttggagaatggttggacttttcaagaatataaaggcgttattcctgatatgattaaccaaagccaatacctttaccaaatctatcaagcaagtcaaagtgattatacaggacgcgtgacagtccctgttctttgggataaaaaattccatacaatcgttaacaatgaatcatctgaaattatgcgtatgttaaatactgcatttaatcatattactggaaatactgacgattactatcccgattccttacaaggacaaattgacgaaatgaataattttatttatccaaaaataaataatggtgtctataaagctggttttgccacttctcagaacgtttatcaaaaggaagttgaaaccttattcacagctttagatcagttagaaaaacacttatctgataaccattatcttgttggagaacaatttaccgaagctgatattcgccttttcacaactttagttcgctttgacaccgtttattatggtcattttaaatgtaatttaaaagcgctacatgattacccacatttatggcattatacaaaacgtatttacaacctacctggaattgctgagacagttaattttgatcatatcaaaaaacactattacggtagccataaaaccattaaccctactggtattattccagctggacctaacttagactggacaatt

SEQ ID NO: 6656 - protein, 339 aa, Streptococcus agalactiae
MLILFKIFILLISNRKTKEIIMGLLVDGKWVDQWYDTASTGGKFVRTVTQFRHWVTKDGSAGPSGDAGFKAESGRYHLYVSLACPWASRVLIMRKLKNLESHISISIVNPLMLENGWTFQEYKGVIPDMINQSQYLYQIYQASQSDYTGRVTVPVLWDKKFHTIVNNESSEIMRMLNTAFNHITGNTDDYYPDSLQGQIDEMNNFIYPKINNGVYKAGFATSQNVYQKEVETLFTALDQLEKHLSDNHYLVGEQFTEADIRLFTTLVRFDTVYYGHFKCNLKALHDYPHLWHYTKRIYNLPGIAETVNFDHIKKHYYGSHKTINPTGIIPAGPNLDWTI

SEQ ID NO: 6657 - DNA, 699 bp, Streptococcus agalactiae
atgagagttattacagttaagaacgacattgaggggggaaaaattgcatttactcttttagaagagaaaatgaaagctggtgctcaaactttaggattggcaacaggaagtagcccaatcaccttttacgaagagattgtaaaaagtaatcttgatttttcaaatatggtttctattaaccttgatgaatatgttggaattgccgcaagtaatgatcaaagttactcttattttatgcataaacatctttttgatgctaaacctttcaaggaaaataaccttccaaacggcttggctaaagatttgaaagaagaaataaaacgatacgatgctgtcataaatgctaatccaattgattttcaaatccttggaattggtcgtaacggtcatattggttttaatgaaccaggtacaccttttgatattacaacacatgtggttgatttagctccaagtacaattgaagctaatagtcgtttctttaatagtattgatgatgtaccaaagcaagccttatcaatgggtataggctctattatgaaatcaaaaacaatcgtattagtggcgtatggtattgaaaaagcagaagcgattgcaagtatgattaaaggacctatcacagaagatatgccagcaagtatcctccaaaaacatgatgatgttgtgattattgtggatgaagcagcggcatcaaagttg

SEQ ID NO: 6658 - protein, 233 aa, Streptococcus agalactiae
MRVITVKNDIEGGKIAFTLLEEKMKAGAQTLGLATGSSPITFYEEIVKSNLDFSNMVSINLDEYVGIAASNDQSYSYFMHKHLFDAKPFKENNLPNGLAKDLKEEIKRYDAVINANPIDFQILGIGRNGHIGFNEPGTPFDITTHVVDLAPSTIEANSRFFNSIDDVPKQALSMGIGSIMKSKTIVLVAYGIEKAEAIASMIKGPITEDMPASILQKHDDVVIIVDEAAASKL

SEQ ID NO: 6659 - DNA, 702 bp, Streptococcus pyogenes
atgaaaattattcgggtccaagatcagattgaaggtgggaaaatcgcttttaccttattgaaagatagcttagctaagggagctaagacgttaggattagcaacaggaagttcaccaattagtttttaccaagaaatggtcaaaagtcctttggatttttcggacttaacaagtattaacttggatgaatatgtcggtctttcagtagagagcgatcagagttatgattattttatgcgtcaaaacctttttaatgcgaagccttttaaaaagaattacttgcccaatggtttagcaaccgatgtcgaagcagaagctaaacgatataaccaaatcattgcagagcatccgattgattttcaagtgcttgggattgggcgtaatgggcacattggttttaacgaacctgggacctcttttgaagaagaaacgcatgtggtggatcttcaagaatcaaccattgaagccaatagtcgtttctttacaagtattgaggatgtgccaaaacaagctatctctatgggaattgcctccatcatgaagtccgaaatgattgttcttcttgcctttggacaagaaaaagctgatgcgatcaagggaatggtttttggaccaatcacagaacacctcccagcaagtattctccaaaaacatgatcatgttatcgtcattgtggatgaagctgctgcgtcacaattagac

SEQ ID NO: 6660 - protein, 234 aa, Streptococcus pyogenes
MKIIRVQDQIEGGKIAFTLLKDSLAKGAKTLGLATGSSPISFYQEMVKSPLDFSDLTSINLDEYVGLSVESDQSYDYFMRQNLFNAKPFKKNYLPNGLATDVEAEAKRYNQIIAEHPIDFQVLGIGRNGHIGFNEPGTSFEEETHVVDLQESTIEANSRFFTSIEDVPKQAISMGIASIMKSEMIVLLAFGQEKADAIKGMVFGPITEHLPASILQKHDHVIVIVDEAAASQLD

SEQ ID NO: 6661 - DNA, 678 bp, Streptococcus agalactiae
atgaaagaagcaaaaaatttttcccaacaattgaatattttaagagctggtgttcttggtgctaatgatggtatcatctctgtagctggtgttgttattggtgttgcgagtgcaactcataacctttggattatttttttatcagcagcttccgcgattttagctggtgcattttctatggctggcggggagtatgttagtgtttctactcaaaaagatactgaacaagcagcagttgcgcgtgaagagaaactactagaaaataatccagaacttgccaaaaaatccttagttgatatctacttagcaaaaggagaaagtcacgaacatgctcaatggctagttgacaaggctttttcaaagaatgctattgagcatttagttgaagaaaaatatggtattgagttcggtgaatatacaagcccctggcatgctgctatatctagttttatagcttttgccatcggatcaatttttccaactataactattctgttattgccattttcggtacgaattgtaggaacggtaataattgttattgtttcactattatcaactggttatgtaagtgctaagttaggtcaagctcctacagtacctgccatgcgtcgaaatgtgatgattggttgtttgacaatgttggcaacctacgtcattggacaattattttcaata

SEQ ID NO: 6662 - protein, 226 aa, Streptococcus agalactiae
MKEAKNFSQQLNILRAGVLGANDGIISVAGVVIGVASATHNLWIIFLSAASAILAGAFSMAGGEYVSVSTQKDTEQAAVAREEKLLENNPELAKKSLVDIYLAKGESHEHAQWLVDKAFSKNAIEHLVEEKYGIEFGEYTSPWHAAISSFIAFAIGSIFPTITILLLPFSVRIVGTVIIVIVSLLSTGYVSAKLGQAPTVPAMRRNVMIGCLTMLATYVIGQLFSI

SEQ ID NO: 6663 - DNA, 1026 bp, Streptococcus agalactiae
atgaatacaaacgattttgatttttatttaccagaagaactcattgcccaaacaccacttgaaaaaagagacgcttctaaattattagtcattgatcataagaataagacgatgacagatagccatttcgatcatatcttagatgaactcaagcctggtgatgctttagtaatgaataacacacgtgttctgcccgctcgcctttatggtgaaaagcaagatacacacggccatgtagagttattacttctcaaaaatacagaaggcgatcaatgggaagtgcttgctaaacccgctaaacgcttacgagtagggaccaaagtttcatttggtgatggtcggttaatagcaacagtcacaaaggaattagaacatggtgggcgtattgtagaattctcatatgatggtatttttctagaagtccttgaaagtttgggcgaaatgccacttccgccatatattcatgaaaaactagaagatcgtgaccgctatcagactgtgtatgcaaaagaaaatggttctgctgctgcaccaacagccggtctccattttacaaaagaactattggaaaaaattgaaacaaaaggtgtgaagcttgtctatttgacgcttcacgttggacttggaactttccgtcctgtttcagttgataatcttgatgaacacgaaatgcattctgagttttaccaattatctaaagaagctgctgatactctcaatgcagttaaagaatctggtggacgtattgtagctgttggtacaacttctattcgcacattagagacaatcggttctaaattcaatggtgaattaaaagccgactcagggtggacaaatatttttatcaagcctggttatcagttcaaggttgtagacgctttttcaaccaactttcacttaccaaagtctactcttgtcatgttagtatcagcatttgctggacgtgattttgtactagaagcttacaaccatgcagttgaagaacgatatcgtttcttcagctttggtgatgctatgtttgttaag

SEQ ID NO: 6664 - protein, 342 aa, Streptococcus agalactiae
MNTNDFDFYLPEELIAQTPLEKRDASKLLVIDHKNKTMTDSHFDHILDELKPGDALVMNNTRVLPARLYGEKQDTHGHVELLLLKNTEGDQWEVLAKPAKRLRVGTKVSFGDGRLIATVTKELEHGGRIVEFSYDGIFLEVLESLGEMPLPPYIHEKLEDRDRYQTVYAKENGSAAAPTAGLHFTKELLEKIETKGVKLVYLTLHVGLGTFRPVSVDNLDEHEMHSEFYQLSKEAADTLNAVKESGGRIVAVGTTSIRTLETIGSKFNGELKADSGWTNIFIKPGYQFKVVDAFSTNFHLPKSTLVMLVSAFAGRDFVLEAYNHAVEERYRFFSFGDAMFVK

SEQ ID NO: 6665 - DNA, 1026 bp, Streptococcus pyogenes
atgaatactaacaattttgattttgagttaccagaagaattgattgcccaaaccccactcgaaaaaagagacagttcaaaactattgattattgatcaccgtcaaaaaactatggttgatagccattttgaccatatcattgatcaattaaatccaggggatgccctcgtcatgaataacacccgtgtcttgcctgccagactttatggagaaaaacccgatactcatggtcatgtggaattgcttttgcttaaaaatacacaaggagatcaatgggaagttttagccaagccagccaaacggctcaaggttggtagccaagtcaattttggagatgggcgtctcaaagccaccattatcgacgaattagaacatggtggacgaattgttgaattcagctatgatgggattttcttagaagttttagagagcctcggcgaaatgccattgcctccttatattcacgaaaaattagaggatgctgagcgataccaaaccgtttatgctaaagaaaatggctctgcggccgccccaactgctggtctccacttcacaacagacttgctcaaaaaaatcgaagccaaaggggtacatttggtttatttgaccctacatgtagggcttgggacttttagacctgtttccgtggataacctcgatgagcatgatatgcattcggaattttattccctctcagaagaagcagcgcaaaccctaagagacgtcaaacaagctggcggtcgtgttgtcgctgtaggaaccacctctattcgtacgttggaaaccatcggaggtaagttccaaggggacattcaagctgattcaggttggaccaatatttttattaaaccaggctaccaattcaaggtagttgatgctttttcaactaatttccatcttccaaaatcaacccttgtgatgctagtatcagcctttgcagggcgtgactttgtccttgaagcttacagacacgcggttgacgaaaagtatcgtttctttagctttggcgatgccatgtttgtcaac

SEQ ID NO: 6666 - protein, 342 aa, Streptococcus pyogenes
MNTNNFDFELPEELIAQTPLEKRDSSKLLIIDHRQKTMVDSHFDHIIDQLNPGDALVMNNTRVLPARLYGEKPDTHGHVELLLLKNTQGDQWEVLAKPAKRLKVGSQVNFGDGRLKATIIDELEHGGRIVEFSYDGIFLEVLESLGEMPLPPYIHEKLEDAERYQTVYAKENGSAAAPTAGLHFTTDLLKKIEAKGVHLVYLTLHVGLGTFRPVSVDNLDEHDMHSEFYSLSEEAAQTLRDVKQAGGRVVAVGTTSIRTLETIGGKFQGDIQADSGWTNIFIKPGYQFKVVDAFSTNFHLPKSTLVMLVSAFAGRDFVLEAYRHAVDEKYRFFSFGDAMFVN

SEQ ID NO: 6667 - DNA, 1062 bp, Streptococcus agalactiae
gtgaaacaaacaaagaaagaatttattttaggattaaccattattattacccttactttattaatcatgctgatttttttagtaatgtttaataagtccagtaactctaagttgaagcagacaaaagatagaagaatatcatctacttcaaccacaaggacatccagtagctcacatgatcaaaaaattgtagaaaagtctcttgaaaaaaagaaaatggtcatggaacaagatatggaattgatgaatgcctataggctctattatgattatgcccatttgtccttgaaagaggttgttctggcctatatgtctgaatatggcattgaaaaaaatagtgttgctttttcttataaaaatttaaaaacaggacaaagggacgctatgaatgatactcaggctatgacagcagggagcacctataagttacctcttaacatgttggtagtagatgcagtggtcaagggcaagttgtccatggaagaacgctttgatattaccgagactgactatgaatatattggtgaacataataattatgttgctgctttctcgggggcaatgtctattgatgatatgcaaaaatactctttagtttattcagaaaatacacccgcctatgctttagctgagcgtattggtggcatggatagtgcttattcaaagtttggtcgttatggccaatctaaaggagacatcaaaaatatacaaaaaaacggtaataaagtgacaacagattactatattcaagtgctagactatctctggaaacatcgtaaaaagtatgatagtttaattacttatttagaagaagcttttccaacagattattatcgtgctttgataccatctgatgttgttgttgctcaaaagccagggtatgtccgtgaggcgttgaatgttggagcaattgtcaaagaagaagtgccttatattgttgctatttatactgcaggtttaggtggctctactcaggaagattcagaaattaatggagtgggactatatcagctagaacaattatgttttgttattaatcaatggcatcgtgttaatatgaat

SEQ ID NO: 6668 - protein, 354 aa, Streptococcus agalactiae
MKQTKKEFILGLTIIITLTLLIMLIFLVMFNKSSNSKLKQTKDRRISSTSTTRTSSSSHDQKIVEKSLEKKKMVMEQDMELMNAYRLYYDYAHLSLKEVVLAYMSEYGIEKNSVAFSYKNLKTGQRDAMNDTQAMTAGSTYKLPLNMLVVDAVVKGKLSMEERFDITETDYEYIGEHNNYVAAFSGAMSIDDMQKYSLVYSENTPAYALAERIGGMDSAYSKFGRYGQSKGDIKNIQKNGNKVTTDYYIQVLDYLWKHRKKYDSLITYLEEAFPTDYYRALIPSDVVVAQKPGYVREALNVGAIVKEEVPYIVAIYTAGLGGSTQEDSEINGVGLYQLEQLCFVINQWHRVNMN

SEQ ID NO: 6669 - DNA, 588 bp, Streptococcus pyogenes
atgacagagcgttttgacattacagaaactgattatgaatatgatcaggaacatcatgcctatgttgctcagttcaatggtgccatgtctattccggatatgcaagaatattccttggtgtactcagaaaacacgccagcttatgctctagcagaacgattgggtggcatgaataaggcttaccaattatttgaccgctacgggaaggtatccggggctattacgaccattgatcgtaatggcaataaaatcaccaccgcttactatttgcaagttttggattacttgtggcagcatcaggataaatataaggatatcttgtactacattggtgaatctttccctgatttgtattacaagacttatttgcctcatgtaaaggtttatcaaaaaccgggttatgtcagagaagccttaaatgtaggtgccattgtttgcgaagagtctccttatttgattgctctttattcatctggtttgggtggagcaacacaagcatcagaggaagtcaatggccttggttatgtgcagcttgttcagctaccatatgtaattaatgagtggtatagaggcaatctcaacatgatc

SEQ ID NO: 6670 - protein, 196 aa, Streptococcus pyogenes
MTERFDITETDYEYDQEHHAYVAQFNGAMSIPDMQEYSLVYSENTPAYALAERLGGMNKAYQLFDRYGKVSGAITTIDRNGNKITTAYYLQVLDYLWQHQDKYKDILYYIGESFPDLYYKTYLPHVKVYQKPGYVREALNVGAIVCEESPYLIALYSSGLGGATQASEEVNGLGYVQLVQLPYVINEWYRGNLNMI

SEQ ID NO: 6671 - DNA, 513 bp, Streptococcus agalactiae
ttggaaacaatctttgctaatataatcgtaactactaaagctgcaattgcaggaataatattttgtaccattaagcttgttaaatcaaccttaaatgcttctgaagcagcaattgtattaggattgggtgagataatattcccagccttaccaccaccaatcattgctaacagtatgctagatttagaaagattagcttttttacctattgctaatgcaatcggagcaactgtaataactgcaatatcaataaagacacctactgcacaaataatcattgttgcgatggctaaagctgtgatggctcgctgttgtcctaattttttaatgatactttctgcaattttttcagctgatccggttttaattaaagcacccgctaaaatccctgatgttaaaatgcgtaatatggatgacatcatcccttgcgcacctaataccattgtattgacaattgtaactaaatcaccgccaccaatcaaaccaccaactaatgctccaagaatgagacta

SEQ ID NO: 6672 - protein, 171 aa, Streptococcus agalactiae
METIFANIIVTTKAAIAGIIFCTIKLVKSTLNASEAAIVLGLGEIIFPALPPPIIANSMLDLERLAFLPIANAIGATVITAISIKTPTAQIIIVAMAKAVMARCCPNFLMILSAIFSADPVLIKAPAKIPDVKMRNMDDIIPCAPNTIVLTIVTKSPPPIKPPTNAPRMRL

SEQ ID NO: 6673 - DNA, 1254 bp, Streptococcus agalactiae
atggaagctacatttacaacaacaggggctttaataggattagcgcttgctattttactgattatcaaaaaagttcatcctgcctatagtctcattcttggagcattagttggtggtttgattggtggcggtgatttagttacaattgtcaatacaatggtattaggtgcgcaagggatgatgtcatccatattacgcattttaacatcagggattttagcgggtgctttaattaaaaccggatcagctgaaaaaattgcagaaagtatcattaaaaaattaggacaacagcgagccatcacagctttagccatcgcaacaatgattatttgtgcagtaggtgtctttattgatattgcagttattacagttgctccgattgcattagcaataggtaaaaaagctaatctttctaaatctagcatactgttagcaatgattggtggtggtaaggctgggaatattatctcacccaatcctaatacaattgctgcttcagaagcatttaaggttgatttaacaagcttaatggtacaaaatattattcctgcaattgcagctttagtagttacgattatattagcaaagattgtttccaagaaaaataacgatatttcttatgatagtgaggagcaagtgggctctgatctgccagcattcttaccggctatttctggtccacttgtggttatctgcttattagctcttcgtcctttatttggaatcactattgatcccttgattgcactgccgttgggtggtctaattagtattttagcaacaggttacctaaaagaaacggtaccgtttgttgaatacggtttatcaaaagttgttggcgtttcaattcttttgattggaacaggtacgctctcaggtattattaaagcatctaatctacaatttgatatgattcatctccttgaatttttaaatatgccgacctttatccttgccccactctcaggtatttttatgggagcagcaacagcatcaacgacttctggaacaactattgcttcacaaacgtttgctgaaaccttgattaaatcaggggtaccggcggtttcgggtgcagctatgattcacgcaggtgcgactgttttggattcgctacctcatggatccttcttccatgcgacaggcggagctgtcaatatggctataaaagatcgtatgaaactaattagctatgaagctttgattggattaactagcacaatagttgctgtcgtttactattgtttctttggg

SEQ ID NO: 6674 - protein, 418 aa, Streptococcus agalactiae
MEATFTTTGALIGLALAILLIIKKVHPAYSLILGALVGGLIGGGDLVTIVNTMVLGAQGMMSSILRILTSGILAGALIKTGSAEKIAESIIKKLGQQRAITALAIATMIICAVGVFIDIAVITVAPIALAIGKKANLSKSSILLAMIGGGKAGNIISPNPNTIAASEAFKVDLTSLMVQNIIPAIAALVVTIILAKIVSKKNNDISYDSEEQVGSDLPAFLPAISGPLVVICLLALRPLFGITIDPLIALPLGGLISILATGYLKETVPFVEYGLSKVVGVSILLIGTGTLSGIIKASNLQFDMIHLLEFLNMPTFILAPLSGIFMGAATASTTSGTTIASQTFAETLIKSGVPAVSGAAMIHAGATVLDSLPHGSFFHATGGAVNMAIKDRMKLISYEALIGLTSTIVAVVYYCFFG

SEQ ID NO: 6675 - DNA, 1329 bp, Streptococcus pyogenes
atggaaattattggttctctgggggtcttggtaggtgttattgttattatttacctgtatgtcaaagaagttaacattatcatcgctgcgcctcttgctaccagcttggtcattttgtttaatcaaatggatccaaccacaaccttacttggaaaagaacccaaccaatttatgggggcactctccacttatattctcaattattttgctatctttttattaggttctatcttagccaaattaatggaaacaagcggtgcaaccacttctattgcagattatattttaaaaaaagttggtcatgatagtccttataaagtactcgttgctatttttctgatcagtgctatattaacttatgggggaatcagcctctttgttgtcatgtttgctgtcttgccgcttgcacgaagcctattcaaaaaaatggacttggcttggaacttaattcaagttcctctttggctcggtattgcaacttttaccatgacgattttacccggaacacctgccattcaaaatgttattcctattcaatacttggacacctcactaactgctgccgccattccgagtatcgttggctcaattggctgcgtggcttttgggctcttttatatgaaatattgtctagcaaaaagtatggcaaggggtgaaacttatgccacttatgcttttgacaatgagatacaagtgaaaacaaaaaatctcccacatttccttgccagtatcttacctttattgttgctcattattatcgccctaaccggtagccttttcggaaacgatttttttaagaagaacattattttcatagcacttttagctgtcattctcaccgcaagctggctctttagacagtttattcctaataagattgctgtctttaatttaggagctagcagctctattgcacctatttttgcgacagcatctgcagttgccttcggagccgttgtgatgattgtcccaggtttcacattcttctcagatctcattttgaatattcccggtaatcctcttattagtttagccgtgttgacttcctctatgtcagctattaccggctcttcttccggtgctctaggaattgtcatgcctaactttgcccagtattatttagatcaaggccttaatcccgaaatgattcaccgtgttgccactattgcttctaatatctttaccattgtgccccaaagtggtgtctttctcaccttcttagcattgacaggacttaaccacaaaaatgcttttaaagaaacctttattactgtttctgtaagtacttttatcgcacaggtcattgtgatagcctttgatctgttttct

SEQ ID NO: 6676 - protein, 443 aa, Streptococcus pyogenes
MEIIGSLGVLVGVIVIIYLYVKEVNIIIAAPLATSLVILFNQMDPTTTLLGKEPNQFMGALSTYILNYFAIFLLGSILAKLMETSGATTSIADYILKKVGHDSPYKVLVAIFLISAILTYGGISLFVVMFAVLPLARSLFKKMDLAWNLIQVPLWLGIATFTMTILPGTPAIQNVIPIQYLDTSLTAAAIPSIVGSIGCVAFGLFYMKYCLAKSMARGETYATYAFDNEIQVKTKNLPHFLASILPLLLLIIIALTGSLFGNDFFKKNIIFIALLAVILTASWLFRQFIPNKIAVFNLGASSSIAPIFATASAVAFGAVVMIVPGFTFFSDLILNIPGNPLISLAVLTSSMSAITGSSSGALGIVMPNFAQYYLDQGLNPEMIHRVATIASNIFTIVPQSGVFLTFLALTGLNHKNAFKETFITVSVSTFIAQVIVIAFDLFS

SEQ ID NO: 6677 - DNA, 1140 bp, Streptococcus agalactiae
atgaaggtagtagtagctattgattctttgaaagggagtctttcttctttagaagctggcaatgctataaaggagtcaattaatgaagtaatctcaggggcggatgtggaagtacatccattagcagacgggggagaaggaactgttgaagctttgacgctaggtatggggggtacgatcgaaacaatccctgttaaggggcctcttggagaaaaagtacatgcgagttatggtattattccacagcgtcagttagctattattgaaatggctgcagctgctggtattaccctaattgctactgaagagagaaatcctctccacacaaccacttatggagttggagaaatgataaaggatgctataagtaaaggctgtaggcactttattattggtattggaggtagtgctactaatgatggtggggcaggtatgctacaagctttgggatatgcattattagataaagataatcaagaaatcagtttgggagcacaaggattggcagatttaaaatctatctctactgataaggttattgaggaattaaaagaatgtgattttaaaattgcatgtgatgtaacaaatcctttatgtggtgctcaaggttgtagttcgatttttggaccgcaaaaaggtgctgatgaagatatgattacaaaaatggatacttggttaagtaattatgctaccttagctacttcagttagtgaaaaagcagatgcaactattgaaggaacaggtgcagcgggtgggcttggatttgcctttttagcctttacaaatgctaccttagaacctggtattgatattattctatcagaaattaatatagaaaaagcgatttctgaagctgatttagtagttactggtgaaggtcgtttggatgggcaaacggtgatgggaaaagctccaattggcgtagcaaaattagctaaaaaatatggtaagaaagtagtggcattttctggatctgtcaccgaagatgctatactttgtaatcaacatggtattgatgctttttttccaatcgtacgacgccttatcagcttagatgaggctatgtctaaagaggtagcttataaaaatatgaaagaaactgctactcaagtctttagattaatcaatttgtataatcat

SEQ ID NO: 6678 - protein, 380 aa, Streptococcus agalactiae
MKVVVAIDSLKGSLSSLEAGNAIKESINEVISGADVEVHPLADGGEGTVEALTLGMGGTIETIPVKGPLGEKVHASYGIIPQRQLAIIEMAAAAGITLIATEERNPLHTTTYGVGEMIKDAISKGCRHFIIGIGGSATNDGGAGMLQALGYALLDKDNQEISLGAQGLADLKSISTDKVIEELKECDFKIACDVTNPLCGAQGCSSIFGPQKGADEDMITKMDTWLSNYATLATSVSEKADATIEGTGAAGGLGFAFLAFTNATLEPGIDIILSEINIEKAISEADLVVTGEGRLDGQTVMGKAPIGVAKLAKKYGKKVVAFSGSVTEDAILCNQHGIDAFFPIVRRLISLDEAMSKEVAYKNMKETATQVFRLINLYNH

SEQ ID NO: 6679 - DNA, 1140 bp, Streptococcus pyogenes
ttgactattaatagggttttaaaggatgataatctgctacaatatacagaaaaggaatttattgaagatatgaaaattttggtagccatagattcttttaagggatcggtaacgtctccagaacttaacactagtgtagctcaagcccttctttctgtcgataagcagttagttattgaaacaagagctatcgctgatggaggagaaggaagtttagtagccctctcacaaaccgtggcggggaggtggcatcaagtaaaaaccattgatctattaagacgcccgattaaagtcgcttattatcgtcacgcaaagcaagcttttattgaatctgcgagtattattggtattgataagatcacctccaattcagtaacctatgcacaagccacttcctacggtttgggtttggcagttaaagatgccattcaaaaaggagctactcaaatcgaaatcatgctaggaggcacaggcacttctgatggtggcaaagggtttttggaaagtttaaactatgatttcatgacaggaagatcttatcttgatactttagcatcacctgttacgctattagggctgactgatgtgaccaatccatatcatggccctcaaggatttgctgcggtctttggccctcaaaaaggtgggagtcttagtcaaattgaagaaactgatcaaattgcaagtaactttgctaaaaaagttttttgccaaacaaccattgatttacagacaataccaggaagtggagcagctggaggattaggaggtgccattgtcctattaggaggcaccttaactagtggttttagcaggattgcagagctactaaatctggataattcccttcagtcttgtgatttagttattactggagaaggatgcctggatacacaatcacaatctggcaaggtacctgttgcgattgcaagaatggctaaaaaatatcaagttccaacgattgctctatgtggttctgtaaagattgagacaggactagcagcagaagactttttggctgttttttcaatacaacagcagccaatttccttagaagcagcgatagataaaacaacaacactttctaatatcaaaatattagcagctaaccttatgctattgatagctcagtttaataag

SEQ ID NO: 6680 - protein, 380 aa, Streptococcus pyogenes
LTINRVLKDDNLLQYTEKEFIEDMKILVAIDSFKGSVTSPELNTSVAQALLSVDKQLVIETRAIADGGEGSLVALSQTVAGRWHQVKTIDLLRRPIKVAYYRHAKQAFIESASIIGIDKITSNSVTYAQATSYGLGLAVKDAIQKGATQIEIMLGGTGTSDGGKGFLESLNYDFMTGRSYLDTLASPVTLLGLTDVTNPYHGPQGFAAVFGPQKGGSLSQIEETDQIASNFAKKVFCQTTIDLQTIPGSGAAGGLGGAIVLLGGTLTSGFSRIAELLNLDNSLQSCDLVITGEGCLDTQSQSGKVPVAIARMAKKYQVPTIALCGSVKIETGLAAEDFLAVFSIQQQPISLEAAIDKTTTLSNIKILAANLMLLIAQFNK

SEQ ID NO: 6681 - DNA, 1092 bp, Streptococcus agalactiae
atgaaattaagaaaacaactcgcacaacaaatcgttacctctatcaaagatgtttgtcaacaagatattaattttattaataccaaaggaatcattttcgctagtaccaatccaaaacgtgttggagaattccatgaaattggtttaaaagtagcacagacaggacaaatgattgaagtaacagatcaagaatcttattttgggacacaagcagggatcaatattcctttctattataattgtgaattattagctactattgggattagtggaaaccccaaccaagtaggaaaatatgctttacttgctcaaaaaatgactcgactcatcttaaaagagcatgaattagattatctggatttcgggcgaaaaaacgaagcttctattgtcttacatcatcttgttgaaggcagagagttagactactattacctcaatcaatttttaaaccaataccacctatcagaaaaaactgactatcgtctactcacttttgaaatcaatagtcaaaaacaaaaattactcttaagtcaatctgaaatgtcactcttgaacttttttgataaacttgacactgctatttatacctttaattatcccaatcaatactggcttttactttctgaccatatgtttgactattattatccaaatatcctatcaaagtttgaatgcgaaaagggcctctataaagttggtatcggacaaaaatcatctttatcacttttaaaaagatcatatgaaacgtctatcttagccctgaaagctttaaaaggtcaacaaaaggtcaacctcgtcgacgaccttgatcttgaactgttattaacaagtattgattctaatattaaacaatatgtgctaaataaagcgcttgtaaacttatctgaaaatgataagatcttgcttaactcatattttaagcataatctatcattaaaagaatgtagtcaggaactttttatccataaaaatactgttcaatataggttaaataagatttatgaatcaacgcaactcaatccaagaaactttaaggatgcaactttattgtatctagcacttaaatcagaagatattaaccttcataaatta

SEQ ID NO: 6682 - protein, 364 aa, Streptococcus agalactiae
MKLRKQLAQQIVTSIKDVCQQDINFINTKGIIFASTNPKRVGEFHEIGLKVAQTGQMIEVTDQESYFGTQAGINIPFYYNCELLATIGISGNPNQVGKYALLAQKMTRLILKEHELDYLDFGRKNEASIVLHHLVEGRELDYYYLNQFLNQYHLSEKTDYRLLTFEINSQKQKLLLSQSEMSLLNFFDKLDTAIYTFNYPNQYWLLLSDHMFDYYYPNILSKFECEKGLYKVGIGQKSSLSLLKRSYETSILALKALKGQQKVNLVDDLDLELLLTSIDSNIKQYVLNKALVNLSENDKILLNSYFKHNLSLKECSQELFIHKNTVQYRLNKIYESTQLNPRNFKDATLLYLALKSEDINLHKL

SEQ ID NO: 6683 - DNA, 1425 bp, Streptococcus agalactiae
atgacggtttttcctaaacattttctatggggaggtgcagttgctgccaatcaggtagagggtgcatttagaacagatggcaaaggtttatctgtacaagatgtacttccaaatggtggtttaggcgatttcaccgccaaacctactccagacaatttgaagctagaagcaattgatttttatcataactataaaaatgatataaaactgtttgcagagatgggctttaaagtttttagaacctctattgcctggtctcgaatttttccaaatggtgatgatagtgctccaaacgaagctggcttacaattttatgataatttatttgatgagttgcttaaatataatatcgagcccttggttaccttatctcattatgaaacaccgcttcatcttgcaaaaacttataatggttgggctgatagacgtttgatagcattttttgagaaatttgctcaaacagtcatggagcgttataaagataaggtgaaatattggttgacttttaatgaagtgaattctattttacatatgcctttcaccagtggtgctattatgaccgacaaatcacaactaagtcctcaggagctttatcaagctattcatcatgaattagtagcatcggctagagtgacaaaattagggcgttctatcaatcctaattttaaaattggctgtatgattctggctatgccagcttatcctatgacatctgatccaagagatgtcctggctgcaagacaatttgaacaacataatctgctattttcagatatacatgtcagaggtaaatatcccacttatattcagtcctatttcaaaaataatggtattaaaattaaatttgaagaaggagatgaggaagtattggcacaaaatacagtagattttctatcgtttagttactatatgagcgtgacacaagcttatgactttgaaaattatcaaagtggtcagggaaatatccttggaggcctaactaatcctcatttaacaacttcagaatggggatggcaaatcgatcccatcgggctacgcctagtcttaaatcagtattatgaacgttatcagattccgttgtttattgtagaaaatggattgggagcaaaagatcaattgatagaaacactagacggtgattatactgtcgaagatgattatcgtattgattatatgaatcaacatttagttcaagttgctaaagctattgaagatggtgttgaaataatgggatatacatcttgggggtgtattgattgtgtatccatgtctacagctcaactaagtaaacgttatggtctaatatatgttgatcgaaatgatgatggaacagggagtctacaacgttacaagaagaagtcatttggttggtaccaaaaagtgattaagacaaatggccaatcattgtttgaacatcataacaga

SEQ ID NO: 6684 - protein, 475 aa, Streptococcus agalactiae
MTVFPKHFLWGGAVAANQVEGAFRTDGKGLSVQDVLPNGGLGDFTAKPTPDNLKLEAIDFYHNYKNDIKLFAEMGFKVFRTSIAWSRIFPNGDDSAPNEAGLQFYDNLFDELLKYNIEPLVTLSHYETPLHLAKTYNGWADRRLIAFFEKFAQTVMERYKDKVKYWLTFNEVNSILHMPFTSGAIMTDKSQLSPQELYQAIHHELVASARVTKLGRSINPNFKIGCMILAMPAYPMTSDPRDVLAARQFEQHNLLFSDIHVRGKYPTYIQSYFKNNGIKIKFEEGDEEVLAQNTVDFLSFSYYMSVTQAYDFENYQSGQGNILGGLTNPHLTTSEWGWQIDPIGLRLVLNQYYERYQIPLFIVENGLGAKDQLIETLDGDYTVEDDYRIDYMNQHLVQVAKAIEDGVEIMGYTSWGCIDCVSMSTAQLSKRYGLIYVDRNDDGTGSLQRYKKKSFGWYQKVIKTNGQSLFEHHNR

SEQ ID NO: 6685 - DNA, 1866 bp, Streptococcus agalactiae
atgactaaataccaagagactgctaaagctattttagcagcagtagggggagaaaaaaatattcaacacgtaacccactgtgtgacacgattacgattagttttagacaatgatgaaattgtcaacgatcaggttattaaaactattccgaatgttatcggtgttatgcgtaaaaatgatcaataccaaattattttgggaaatgatgtcaataattattataatgcttttttggccttaggtcattttgaaaatactaccagagaattttcatcacaaaaaaagagttcaatacttgagaaattaattgaaacgattgcaggagtcattacgccgcttatacctgctcttctaggaggagggatgctcaaggttataggtattttgctccctatgctcggtatagcaagctctagttctcaaacagtagcttttatcaatttttttggtgatgccgcttattattttatgccaataatgattgcttattcagctgcgtcacgatttaaagttacacctgtattagctgctacagtaggagggattctcttacaccctgcttttgtgacaatggtagctgaaggaaaaccattatctttatttggagctccggttacactggctagttatggttcttctgttattccaatcttaattatggtttttcttatgcaatatattgagagatggattaataaaattgttcctagtgtaatgaagagttttttacaaccgactttgattattctcatttctggctttttagctttagtggtcgtggggccactgggggtaattattggtaaaggattgtctagtgcaatgctttcgatttaccatgtggcgccatggttagctttatctattcttggtgctattatgccattggttgttatgacaggaatgcactgggcatttgctccaatatttttagctgcttctgttgcgacaccagatgttttgattttaccagcaatgttagcttctaatttagctcaaggtgcggcttctcttgctgttgcagttaaggctaaacaaaaacaaacacgtcaggtggcctttgcagcaggtttatcagcactactagctggtatcacagaacctgcactttatggtgtcacactgaaattcaagaagcctttatacgctgcaatgatatcaggtggtttagtaggagcttatattggattagttaatattgcttcctatacatttgtagtaccatctattattggtttgccacaatatatcaatccacaggggggcaataatttcagtaatgctgttattgcagcaatagctactattattttgactttcattattacatggttcttgggaattgatgaaggagaaaacgaaaaaagtagtattaatgctcaagagcacacacatattagaagtggtttatcaaaaaaagagacattgtattcacctatggtaggcaatgtattacctttatctaaagtacccgatgaaacattttcatctaaattactaggtgaaggtttagcaatcactcctagtgtgggtgaagtttatgcaccatttgatggtgaaattataagtttatttcctacaaaacatgccattgccttaaaggatgataagggagtcgaagtgttaatccatattggaatagatactgtagaactaaatggagaaggttttgaacaattggtcaaagttggcgattttgttaaacgaggacagttacttttgcgaatggatattgattttattagttcaaaggggtattctcttattagtccggttgtagttacaaattcaattgaccaacttgaaattatcgttaaagacgcagagacaatggttacaaatgaagatgatttacttgtaattctt

SEQ ID NO: 6686 - protein, 622 aa, Streptococcus agalactiae
MTKYQETAKAILAAVGGEKNIQHVTHCVTRLRLVLDNDEIVNDQVIKTIPNVIGVMRKNDQYQIILGNDVNNYYNAFLALGHFENTTREFSSQKKSSILEKLIETIAGVITPLIPALLGGGMLKVIGILLPMLGIASSSSQTVAFINFFGDAAYYFMPIMIAYSAASRFKVTPVLAATVGGILLHPAFVTMVAEGKPLSLFGAPVTLASYGSSVIPILIMVFLMQYIERWINKIVPSVMKSFLQPTLIILISGFLALVVVGPLGVIIGKGLSSAMLSIYHVAPWLALSILGAIMPLVVMTGMHWAFAPIFLAASVATPDVLILPAMLASNLAQGAASLAVAVKAKQKQTRQVAFAAGLSALLAGITEPALYGVTLKFKKPLYAAMISGGLVGAYIGLVNIASYTFVVPSIIGLPQYINPQGGNNFSNAVIAAIATIILTFIITWFLGIDEGENEKSSINAQEHTHIRSGLSKKETLYSPMVGNVLPLSKVPDETFSSKLLGEGLAITPSVGEVYAPFDGEIISLFPTKHAIALKDDKGVEVLIHIGIDTVELNGEGFEQLVKVGDFVKRGQLLLRMDIDFISSKGYSLISPVVVTNSIDQLEIIVKDAETMVTNEDDLLVIL

SEQ ID NO: 6687 - DNA, 849 bp, Streptococcus agalactiae
atgattataaaacgcgtattaaatcataatgcagtcatatcagtaacacatcaaggattagatgtgctactgatggggaaaggaattgcatttaagaaaagaataggtgataggattaatagcgatgctattgagaagtcatttgttttaaaaaatagtgataacatgaaccgttttacggagttatttattactgttccagaagaagtagttgcatgttcagaacgaattatcaacctaggtaaaatcaaattgggtaagaacttagatgaaattctttatatcaatttgacagatcatattcattcggctattgaaagacatgaacaaggaatggttatccaaaatccactaaggttggaaatccaacgttactatcctgatgaatactccattgggatgaaggctctggaacttataaaggatgaattgggcatttgtttaacaatcgatgagtcggcttttattgctatgcactttgtaaatgctggattggataatccgtttaatgaagcgcataaaatcactgagattgtatcttacattgaacagaaagtaaaaatagattttcgaacagaactagatgaaagttcaattgattattatcgtttcatgacacataccaaattatttgctcaacgcgttttatcaggaatgaaatacgaagatgatgatgctgatttacttttggtagttaagaaaaaatatccgagagaatataaatgtgttaaagagatcggcaacaatatggctatccaataccaatatcaacttaattcaagtgaactcctatatctgacggtgcatgttaaacgattagttaaaaatttaaaggagatatcagatgac

SEQ ID NO: 6688 - protein, 283 aa, Streptococcus agalactiae
MIIKRVLNHNAVISVTHQGLDVLLMGKGIAFKKRIGDRINSDAIEKSFVLKNSDNMNRFTELFITVPEEVVACSERIINLGKIKLGKNLDEILYINLTDHIHSAIERHEQGMVIQNPLRLEIQRYYPDEYSIGMKALELIKDELGICLTIDESAFIAMHFVNAGLDNPFNEAHKITEIVSYIEQKVKIDFRTELDESSIDYYRFMTHTKLFAQRVLSGMKYEDDDADLLLVVKKKYPREYKCVKEIGNNMAIQYQYQLNSSELLYLTVHVKRLVKNLKEISDD

SEQ ID NO: 6689 - DNA, 840 bp, Streptococcus pyogenes
atgttgattaaacgcgttttaaaccataatgcggcgatttcgaccaaccatcaaggattagatattttattgatgggaaaagggattacctttggaaaaaaagttggagatagtattgagcttaatgctatcgaaacatcatttgttttaaaaaatagtgacaatatgaatcgcttcacagagttatttattacggtgccacaagaagttgttgcttgctcagagagaattatcaatctaggtaaaattaaattaggcaaaaccttagatgaaattctctatattaatttaacggatcatattcactctgctattgaaaggcatgagcaaggaatgttgattcataacccactacggtgggaaattcaacgctattatcctgatgaatatagtctaggggtaaaagccttagagctaattgagcgtaatctaggagtcactctagctattgatgaagcagcttttattgccatgcattttgtcaatgctagtttggacactccttttaaggagccacatcgcctgacggagattgtttcttatattgagcaaaaaatcaaaacagacttcaaaacagaattggatgacacatccatcgattattaccgctttatgacccatattaaattatttgctcaacgtgtgttatcacagatgtcttacgatgatgatgatgcggaactgcttttagtggtgaaaacgaaataccctaaagaatatcggtgcgtcttagatattagtgaggagataaaaaagcggtacaactaccaccttaattcaagcgaacttttgtatttgacggttcatgttaaacgtttagtgaaacatttaaaggagact

SEQ ID NO: 6690 - protein, 280 aa, Streptococcus pyogenes
MLIKRVLNHNAAISTNHQGLDILLMGKGITFGKKVGDSIELNAIETSFVLKNSDNMNRFTELFITVPQEVVACSERIINLGKIKLGKTLDEILYINLTDHIHSAIERHEQGMLIHNPLRWEIQRYYPDEYSLGVKALELIERNLGVTLAIDEAAFIAMHFVNASLDTPFKEPHRLTEIVSYIEQKIKTDFKTELDDTSIDYYRFMTHIKLFAQRVLSQMSYDDDDAELLLVVKTKYPKEYRCVLDISEEIKKRYNYHLNSSELLYLTVHVKRLVKHLKET

SEQ ID NO: 6691 - DNA, 537 bp, Streptococcus agalactiae
atgacactacatcatgataagcaccatgcaacttatgttgctaatgcaaatgctgctcttgagaaacatcctgaaattggagaagacttagaggcgctcttagctgatgtttctcaaattccagaagatattcgtcaggcagtcatcaataacggtggtggacatcttaaccacgctcttttctgggaattgatgtcaccagaagaaactcaaatttcacaagagttatctgaagacattaatgcaacttttggttcatttgaagactttaaagctgctttcacagcagcagcaacaggacgttttggttcaggttgggcttggcttgttgttaatgctgaaggcaaacttgaagtgctttcaactgccaatcaagatactccaattatggaaggcaagaaacctattttagggcttgatgtatgggagcatgcttattacttaaactatcgtaatgttcgtcctaactacatcaaagctttctttgaaattattaactggaataaagtaaatgaactttaccaagctgctaaagct

SEQ ID NO: 6692 - protein, 179 aa, Streptococcus agalactiae
MTLHHDKHHATYVANANAALEKHPEIGEDLEALLADVSQIPEDIRQAVINNGGGHLNHALFWELMSPEETQISQELSEDINATFGSFEDFKAAFTAAATGRFGSGWAWLVVNAEGKLEVLSTANQDTPIMEGKKPILGLDVWEHAYYLNYRNVRPNYIKAFFEIINWNKVNELYQAAKA

SEQ ID NO: 6693 - DNA, 603 bp, Streptococcus pyogenes
atggctattattttaccagaacttccatacgcgtatgatgctcttgaaccacagtttgatgcggagacaatgactcttcatcatgataaacaccatgccacttatgtcgctaataccaatgcggctttagaaaaacacccagagatcggagaaaatctggaggaactattggcagatgtcactaagattccagaagatattcgtcaaaccttaattaataatggtggcggacacctaaaccatgcgcttttctgggaactattatcacctgaaaaacaagacgtcactcctgatgttgcacaagccattgatgatgcttttgggtcatttgacgcctttaaagaacaatttacagcagctgctactggacgttttggttcaggttgggcatggttagttgttaataaagaaggacaactcgaaatcacatcaaccgctaaccaagatactccaatttcagaaggcaaaaaaccaattctagcgcttgatgtgtgggagcatgcttactacttgaattatcgtaatgtacgtccaaattatatcaaagctttctttgaaatcgttaattggaaaaaagtatcagaactttaccaagccgctaaa

SEQ ID NO: 6694 - protein, 201 aa, Streptococcus pyogenes
MAIILPELPYAYDALEPQFDAETMTLHHDKHHATYVANTNAALEKHPEIGENLEELLADVTKIPEDIRQTLINNGGGHLNHALFWELLSPEKQDVTPDVAQAIDDAFGSFDAFKEQFTAAATGRFGSGWAWLVVNKEGQLEITSTANQDTPISEGKKPILALDVWEHAYYLNYRNVRPNYIKAFFEIVNWKKVSELYQAAK

SEQ ID NO: 6695 - DNA, 132 bp, Streptococcus agalactiae
ttgaaagctgttccaaattcctatagaataagggtaataatagatgaaaagaggatttcgacatggcaattattttaccagatttaccctatgcatatgatgcgcttgagccacatattgatgctgagacaa

SEQ ID NO: 6696 - protein, 44 aa, Streptococcus agalactiae
MKAVPNSYRIRVIIDEKRISTWQLFYQIYPMHMMRLSHILMLRQ

SEQ ID NO: 6697 - DNA, 1035 bp, Streptococcus agalactiae
atgattgcgattgaagaaattgggagaattaccccagataatttagggttagtaactgttttagcaggagaagatttagggcaatatgctcagatgaaagagaagctatttcaggtaattggattcaataaagacgatttagcctattcttattttgatttaagtgaagaagactatcaaaatgcggaattagacttagaaagtttaccttttttatcagactacaaggttgttatttttgatcagtttcaagatattacaactgataaaaaaacttatttagatgaacaagcaatgaagcgctttgaagcctacttgcagaatcctgtagatactacgagacttgttatttgtgctccaggaaaacttgatggaaaacgtcgacttgtaaagttattgaaacgtgatgctcgtgttttagaggctaatactttaaaagaatcagatttaaagacgtattttcaaaaatatgctcaccaagaaggattagtttttgaagcaggtgtttttgatgagttattgattaagtctaactatgattttagtgatactttaacgaatatcgctttcttaaagtcatataaaacagacggtcatatttcgtccaatgatgttagagaggctatccctaaaagcctgcaagataatatatttgatttgactcaagatgtcttacttggcaggatagatttagcgcgtgatttagtaagagatttacgtctacaaggcgaagacgaaatcaaattgattgcaatcatgttaggacagtttcggatgtttttgcaagttaaaatattggctagtaaagggaagtcagagagtcaaattgtttctgaactatcccattacataggacgtaaaatcaacccttatcaagtaaaatttgctgtcagagattctagaaaccttccccttgcttttttaaaagaagcgattaggattttaatcgagactgactatgctattaaaagagggacttatgataaggattatctctttgatttagccttattaaaaattgctcataaaaagccc

SEQ ID NO: 6698 - protein, 345 aa, Streptococcus agalactiae
MIAIEEIGRITPDNLGLVTVLAGEDLGQYAQMKEKLFQVIGFNKDDLAYSYFDLSEEDYQNAELDLESLPFLSDYKVVIFDQFQDITTDKKTYLDEQAMKRFEAYLQNPVDTTRLVICAPGKLDGKRRLVKLLKRDARVLEANTLKESDLKTYFQKYAHQEGLVFEAGVFDELLIKSNYDFSDTLTNIAFLKSYKTDGHISSNDVREAIPKSLQDNIFDLTQDVLLGRIDLARDLVRDLRLQGEDEIKLIAIMLGQFRMFLQVKILASKGKSESQIVSELSHYIGRKINPYQVKFAVRDSRNLPLAFLKEAIRILIETDYAIKRGTYDKDYLFDLALLKIAHKKP

SEQ ID NO: 6699 - DNA, 1038 bp, Streptococcus pyogenes
atgattgcgatagaaaagattgaaaaactgagtaaagaaaatttgggtcttataacccttgtcacaggagatgacattggtcagtatagccagttgaaatcccgcttaatggagcagattgcttttgataaggatgatttggcctattcttactttgatatgtctgaggccgcttatcaggatgcagaaatggatctagtgagcctacccttctttgctgagcagaaggtggttatttttgaccatttgttagatatcacgaccaataaaaaaagtttcttaaaagaaaaagacctaaaggcctttgaagcctatttagaaaatcccttagagactactcgactaattatctttgctccaggtaaattggatagtaagagacggcttgttaagcttttgaaacgtgatgcccttgttttagaagccaaccctctgaaagaagcagagctaagaacttattttcaaaaatacagtcatcaactgggtttaggtttcgagagtggtgcctttgaccaattacttttgaaatcaaacgatgattttagtcaaatcatgaaaaacatggcctttttaaaagcctataaaaaaacgggaaatattagcctaactgatattgagcaagccattcctaaaagtttacaagataatattttcgatctgactagacttgtcctaggaggtaaaattgatgcggctagagatttgattcatgatttacggttatctggagaagatgacattaaattaatcgctatcatgctaggccaatttcgcttatttttgcagctgactattcttgctagagatgtaaaaaacgagcaacaactagtgattagtttatcagatattcttgggcggcgggttaatccttaccaggtcaagtatgcgttaaaggattctaggaccttatctcttgcctttctaacaggagcggtgaaaaccttgattgagacagattaccagataaaaacaggactttatgagaagagttatctagttgatattgctctcttaaaaatcatgactcactctcaaaaa

SEQ ID NO: 6700 - protein, 346 aa, Streptococcus pyogenes
MIAIEKIEKLSKENLGLITLVTGDDIGQYSQLKSRLMEQIAFDKDDLAYSYFDMSEAAYQDAEMDLVSLPFFAEQKVVIFDHLLDITTNKKSFLKEKDLKAFEAYLENPLETTRLIIFAPGKLDSKRRLVKLLKRDALVLEANPLKEAELRTYFQKYSHQLGLGFESGAFDQLLLKSNDDFSQIMKNMAFLKAYKKTGNISLTDIEQAIPKSLQDNIFDLTRLVLGGKIDAARDLIHDLRLSGEDDIKLIAIMLGQFRLFLQLTILARDVKNEQQLVISLSDILGRRVNPYQVKYALKDSRTLSLAFLTGAVKTLIETDYQIKTGLYEKSYLVDIALLKIMTHSQK

SEQ ID NO: 6701 - DNA, 726 bp, Streptococcus agalactiae
atgtttcacagagaagatttttcaaaagcattattaaaaaaagctttgcagcccggtatgagagttatggatattggttgtggtagtggggaattgacgcgtttggctgctgatatcgttggtaaagaaggtgatgttgtaggaattgatattaatgagcaacttttatggcaagctagacatgataatggctatgctaatgttagttatcaaaacgcagatttagcagcactttcctcctttgaaacaaaaagttttgatgcaattattggacgtcgtgtattaatgtatcaaaaagatccaaagaaagtaatagaaagtttaacacctttgttaaagccaaatggtttttatgtttttcaagaaagtgatgcaatgtgtttagaactagctaagcctagctttgtaaatatgaataaaatacaatcactaatctggcaaactgttgagaaggaaggaggacacattcatattggaagtcaacttgagcaattaatgttagaagcaggcttaatcgttgaccattttgtatcagaaaatgtcattcaaacgtcacaaactggtacagatttatcttggctactaaatatcatgaaagaaagaatacaaaaatatagtgaccttcagggattagaagatgtcaatttacaaaaagaattagaagagaataatgaccattttatccgagattgtcaatttggaattatttctcatagagttgatgaa

SEQ ID NO: 6702 - protein, 242 aa, Streptococcus agalactiae
MFHREDFSKALLKKALQPGMRVMDIGCGSGELTRLAADIVGKEGDVVGIDINEQLLWQARHDNGYANVSYQNADLAALSSFETKSFDAIIGRRVLMYQKDPKKVIESLTPLLKPNGFYVFQESDAMCLELAKPSFVNMNKIQSLIWQTVEKEGGHIHIGSQLEQLMLEAGLIVDHFVSENVIQTSQTGTDLSWLLNIMKERIQKYSDLQGLEDVNLQKELEENNDHFIRDCQFGIISHRVDE

SEQ ID NO: 6703 - DNA, 990 bp, Streptococcus agalactiae
atgaaaaactatcgaaaacttattgtactactacttctaaccttttttgtcatttttatgggagcatatgcttacactcatattgttgaaaaaagatccctaactagcaatactattgaaaaaactctacctgtggtaaatcagattaagcctcaaaccatcaaagaataccaaaattacttaactaaggtagctaaacgtaatgttcttcctgtagacattcctcaggcattaaataatgaaaaggtagaaattaccgctactgatggcatgcaaacattcacttggaatgataaaaataatcctaagcaaaaggttatcttctatgttcatggaggatcatatatccatcaagcttctgaattacaatatatttttgtcaataaactagctaaaaaattagatgcaaaagttgtctttcctatttaccctaaagctcctacatataattatagtgatgctatccccaaaattaaaaaattataccaaaatacattagctagcgtcacatctcccaaacaaattatcctagtaggtgaaagtgcaggcggaggtcttgctttaggtcttgctgataaccttgtcacggagcatatcaaacaaccaaaagaaattattttaatatcaccatggttagatattgctactaataatccaaagattgaaaaagttcaaaaaaaagatccccttcttaaagcttggcaattacaacaagtagctccttactgggcaaatggaaaaaagaattttaaaaatcctcaagttagtcctctttacagtagccaatttaacaagatggctccaatatcattttttataggaacgcacgatattttctaccccgataatcaattattacatcaaaaattagcaaaagaaaacattaaacaccactatatcgttggtcaaaaaatgaaccacgtttatccagtcttaccgattcctgaagcagagactgctttcaaacaaatgcttaaaattatcaatcat

SEQ ID NO: 6704 - protein, 330 aa, Streptococcus agalactiae
MKNYRKLIVLLLLTFFVIFMGAYAYTHIVEKRSLTSNTIEKTLPVVNQIKPQTIKEYQNYLTKVAKRNVLPVDIPQALNNEKVEITATDGMQTFTWNDKNNPKQKVIFYVHGGSYIHQASELQYIFVNKLAKKLDAKVVFPIYPKAPTYNYSDAIPKIKKLYQNTLASVTSPKQIILVGESAGGGLALGLADNLVTEHIKQPKEIILISPWLDIATNNPKIEKVQKKDPLLKAWQLQQVAPYWANGKKNFKNPQVSPLYSSQFNKMAPISFFIGTHDIFYPDNQLLHQKLAKENIKHHYIVGQKMNHVYPVLPIPEAETAFKQMLKIINH

SEQ ID NO: 6705 - DNA, 942 bp, Streptococcus agalactiae
atgacaagtattagtgatatagctaaaaaggcaggtgttgctaaatcaacagtttcccgtgttatcaatcatcacccacatgtttctgatgagacgcgacaaaaagtaatggctcttatcaccgaattggattatataccaaatcaactagcgcgggatttaagtcgaggcaaaacacaaaaaataggtgtcgtcattccccacacgcgccatccttattttacacaattaataaatggcctattagatgctgctaaaactaccgactatcaacttgttatgatgccttcggattacaaccaagaattagaactttcctacttgaaacagctcaagatggaagctattgatgctttaatattcacttcaagagcaattagcctcgatattattgaaacttatgcaaaatatggacgaatagtagtttgtgaaaaattgcaggaatataatcatctatcctctgcttaccttgatcgctattcttcatttctagaggcgttttctgatatgaagttacgaggtttggagcacttagttttattattttcaaggaataatgaatcctctgctacctatcaatccgcattattagcttatcaagaggtctatgggcaactatcctctccatatatggtagttgggaatgttcatgactttaatgatggactaaatttatcttatcaattggtaaaagaagttagtatagatggtatattagctacaagtgatgaagttgcggcagggctaataaaaggttatgaagaaagtaggaaaaaatgtccttatattattggtcaggaatgtttattagttgggcaacttttgaaactcccaacaattgaccacaaatcctattatttagggaaattagcttttaaacaggctttagctgaaaagattagtcaagaagttttattctcagagtttttatctcaagacaat

SEQ ID NO: 6706 - protein, 314 aa, Streptococcus agalactiae
MTSISDIAKKAGVAKSTVSRVINHHPHVSDETRQKVMALITELDYIPNQLARDLSRGKTQKIGVVIPHTRHPYFTQLINGLLDAAKTTDYQLVMMPSDYNQELELSYLKQLKMEAIDALIFTSRAISLDIIETYAKYGRIVVCEKLQEYNHLSSAYLDRYSSFLEAFSDMKLRGLEHLVLLFSRNNESSATYQSALLAYQEVYGQLSSPYMVVGNVHDFNDGLNLSYQLVKEVSIDGILATSDEVAAGLIKGYEESRKKCPYIIGQECLLVGQLLKLPTIDHKSYYLGKLAFKQALAEKISQEVLFSEFLSQDN

SEQ ID NO: 6707 - DNA, 807 bp, Streptococcus agalactiae
atgactatcaaacgtattttttgtgacatggatggtacactattaaatagtgaaggacaagtgagtaaaagtaacgctaccttaatacgtgaggcagcgattccagtaactttagtgtctgctagggcacctatggaaatgaaggatgccgtagatgcacttcaattaggaggagtccaagttgcttttaatggaggattgatttatagaataggagataataatcaagttctacctattcatacacaaatcattaaaaaaagcacagtaaaacaattgctaagaggaatacggtttcattttcctcaagttagtttatcttattacgatcttaataactggtattgtgataaaatagatgaaggaatccgatacgaacatagtttaactcaacaatgcccaacgtttattcataatgaggatcagtttttagaaggtcacacaaatacttttaaaattatgatgattactttcgatgaagcaaatatgctagaattagaaaaatatcttcaaagtttggagttaccagaaatcactattcaacgttcaggtaaagcgtatcttgaaattacacatctcttagccaaaaaatctaaaggaattgcttacatccttcaaaaagagcagttagctagagaagaaacggctgcatttggagatggacataatgatttgcctatgcttgaaatggtaggttaccctattgttatggataatgcttttgatgatatcaaagcgatagcatatcaactaactaagtctaatgatgaagacggagtgggatatgggattcaaaaatttttaaag

SEQ ID NO: 6708 - protein, 269 aa, Streptococcus agalactiae
MTIKRIFCDMDGTLLNSEGQVSKSNATLIREAAIPVTLVSARAPMEMKDAVDALQLGGVQVAFNGGLIYRIGDNNQVLPIHTQIIKKSTVKQLLRGIRFHFPQVSLSYYDLNNWYCDKIDEGIRYEHSLTQQCPTFIHNEDQFLEGHTNTFKIMMITFDEANMLELEKYLQSLELPEITIQRSGKAYLEITHLLAKKSKGIAYILQKEQLAREETAAFGDGHNDLPMLEMVGYPIVMDNAFDDIKAIAYQLTKSNDEDGVGYGIQKFLK

SEQ ID NO: 6709 - DNA, 216 bp, Streptococcus agalactiae
atgactattaaaagaaaaaggctgggctttccaaaaataagtggccttggaaacagttgcccagtccattttaataacacttctaggatttcaaacaaactattaatacaacttaatttaacgataggcgataagacaaatataacagttaataaaggcaaaaatataatatcaaatgcaaaagataaaagtgctgttaatataattgatattggt

SEQ ID NO: 6710 - protein, 72 aa, Streptococcus agalactiae
MTIKRKRLGFPKISGLGNSCPVHFNNTSRISNKLLIQLNLTIGDKTNITVNKGKNIISNAKDKSAVNIIDIG

SEQ ID NO: 6711 - DNA, 2235 bp, Streptococcus agalactiae
atgttacaattgactaagtattttcctctaaaacctatttatttagcattgttggtcttccaaatttacttactagtgttttcttggacaatgcttggttgtgcctttcttttattttcttttatttttctgatttatcaatatgatcgtgaaactatttttaaaacaatagcaatagtaatttttttcttattttattttttatggcaaaatcacaatatgaatgtccaatatcaaagagtaccgaatcatattagccagattaaagtgcgtattgatactatttctatcaatggtgatgttttatcattccaggcagatgcttcaggtaacacttatcaagctttttacacattaaaaaataaaagtgagaaagattattttcaaaatcttgataataatataatgataattgcagatatcaaacttgaagaagcagaggagagaaggcattttaatggctttgattatcgtcagtatttaaaaagacatggaatttatcgtatcgccaaagtgacaaagataaaacagatacgcttatttcaacataggtctttctttgctcttatgtctaagtggcgtagaagtgcaattgttattagtcaaacttttccaaatcctatgcgtcactatatgtcagggcttttgtttggatatctagataagacctttgatgacatgtccgatttatatagtagtctaggtattatacatttatttgctttgtcaggtatgcaagtaggtttttttctcggtatttttcgttatatctgtctacgtattggcttacgtctagaccatgtttggttacttcaaataccattctcgctaatttatgctggtttaacaggctttagtatctcagtcgttagggcacttattcaatctttattatcacatagcggtgtcaagaaagatgagaactttgctctctgcttgttaatttgtcttatctccctcccccactcacttttgactacgggaggagttcttagctttgcttatgcttttatacttacgatgacctcctttgatcatttttcgagtataaaaaaagtagctatcgaatctttgacagtctctgtaggaattcttcccatactaacctactatttttcgggttttcaaccaatatcaattatattaacagcacttttatcttttgcatttgatattatatttttgcctttattaactgttatatttgtcttatcgcctatcgttaaattaagttgtattaatagtttgtttgaaatcctagaagtgttattaaaatggactgggcaactgtttccaaggccacttatttttggaaagcccagcctttttcttttaatagtcatgattataattttgggattactttatgattattatcattctaaatgttttcgttattgctcccttcttattatctttaccttgttttttatcactaagaatccaattactaacgaggttgcgattttagatgttggacagggagatagtattttagtgagggattggttaggaaaaacaattttaattgatactgggggaagggtgagatttgaacagcctgaagaatggaaacaaaaagtaaatcagtctaatgctaagagaacgctcattccttacttgaaaagcagaggtattagcaagatagatgatttagtgataactcataccgatacagatcatatgggggatatggaagttatctcaaagcattttaaagttgcacgtttgattacaagttcaggttctttaacgaattcgcagtacgttaagcatttatcaaagataggtgtagcggtaaaatctatagaagccggtgataaacttgctgtcatgggaagttatttacaagtactttacccatggcacaagggtgatggaaaaaataatgattcaattgttttatatggacatttattaggaaaaggcttcttatttaccggtgatttggaggaagagggagaaaagcagttattagaagcttatcctaatttatcagtagatatccttaaagcaggacatcatggttctaagggctcatcaagtctatcctttctgaaaaagttgtctcctagtgtggttctagtttcagctggtaaaaataatcgttaccagcatcctcatcaagagactttacaaaggttccaaaagattaaaagcaagattttccgaacggatcaatcaggtacaattaggctaacaggatggtggaagtggcatattcagacagttcgt

SEQ ID NO: 6712 - protein, 745 aa, Streptococcus agalactiae
MLQLTKYFPLKPIYLALLVFQIYLLVFSWTMLGCAFLLFSFIFLIYQYDRETIFKTIAIVIFFLFYFLWQNHNMNVQYQRVPNHISQIKVRIDTISINGDVLSFQADASGNTYQAFYTLKNKSEKDYFQNLDNNIMIIADIKLEEAEERRHFNGFDYRQYLKRHGIYRIAKVTKIKQIRLFQHRSFFALMSKWRRSAIVISQTFPNPMRHYMSGLLFGYLDKTFDDMSDLYSSLGIIHLFALSGMQVGFFLGIFRYICLRIGLRLDHVWLLQIPFSLIYAGLTGFSISVVRALIQSLLSHSGVKKDENFALCLLICLISLPHSLLTTGGVLSFAYAFILTMTSFDHFSSIKKVAIESLTVSVGILPILTYYFSGFQPISIILTALLSFAFDIIFLPLLTVIFVLSPIVKLSCINSLFEILEVLLKWTGQLFPRPLIFGKPSLFLLIVMIIILGLLYDYYHSKCFRYCSLLIIFTLFFITKNPITNEVAILDVGQGDSILVRDWLGKTILIDTGGRVRFEQPEEWKQKVNQSNAKRTLIPYLKSRGISKIDDLVITHTDTDHMGDMEVISKHFKVARLITSSGSLTNSQYVKHLSKIGVAVKSIEAGDKLAVMGSYLQVLYPWHKGDGKNNDSIVLYGHLLGKGFLFTGDLEEEGEKQLLEAYPNLSVDILKAGHHGSKGSSSLSFLKKLSPSVVLVSAGKNNRYQHPHQETLQRFQKIKSKIFRTDQSGTIRLTGWWKWHIQTVR

SEQ ID NO: 6713 - DNA, 2241 bp, Streptococcus pyogenes
atgacattttcttggactaagctagtgcccctgtcaaagattcaatttgcttttttaatcttggttttcttttatcaaatccatagccctagctggttaacgtttctccttagccttagtttgatttgcttacttgtcaagcgtttgtctaaaaaagaatttctcggtgtctttgccatccttagtttctgtgctttgtttttgctgtatcagaaacagcagttggttcaaaaactggaaattcagccagtacaaataacctctgtagcattagttcctgatagtattcggattaatggtgatcaattagctgttcttggacgtcacgggaaacattcttatcagttattttaccgtttgaaaagccaagcagaagcccaattgttcaagaaagagcaccgttggttagtgatgcacgcaaaagtgacattggaaaaagctgaggaagttcgaaattttaaaggctttaattatcagacttttttgacttatcaaggaatttacaggatagggaaggtagagcaaatagaacagcttgaagtgatttcacccgagtcaatatgtgactatttgtcctctttaagacgacgagccattgttcattgccagcagcattttccaagacctatgtctcactacctgacgggcctcctttttggttatttagataagtcgtttggtgagatgacagattattatagtcagttgggtatcattcatctctttgctttatcagggatgcaggttggcttctttctcacttgttttagaagggtgttgctattactcgcagttcctttggaatggataaaatggatagagcttccttttgcttgcttttatgccgcgttgacaggttatagtatttctgttattcgaagcctcgtgcagtcgcagttgcgtcatttaggaataaaaggattagacaatctggcttgtacttttttacttgtctttttatgggatgctcatttcttaatgactgttggtggcgtattaacgtttagctatgcttttttgttaacagtggttactgttgaagaattatcaggagctaaaagacagttggtacaagtcttgaccatttccctaggaatattaccatttttgctcttttatttttccagttttaacccaatgtcaatggtcttaacagggctcttgtcttatctctttgacctttttattttgccccttctttgtctggttttttgtctatcccctttggtgactgtctcaatatgtaaccatctttttattttattagaaaaagtcattcaatttctcggaaatactttcaatagttcccttgtttttggaagcccgaccagttggcacttgcttatcttggtgattagcttcgctattttttatgattatcggcaggtgcgacaacgagttatcacttgcggtttggttatagcgttgacacttttgtctgtcaaatatcctttgaccaatgaagtgacctttatcgacattggccagggagatagtattttggtgagggagtggacagggaaaaatctcttaatagatgtaggtgggcgccctttcttttcttcaaaagagcactggcgacgaggacatcacgtagctaatgctcagaaaaccttaattccttacttaaaaagtagaggtattcacacaattgaccaactattagtaactcacgcagatactgatcatatgggggatatcgaagtggttgccaaagctattcggataaaggagattttgactagtcaaggcagtttaagccatccaagctttgttaggcggctaaggcgtttaaaatgtcacgttagggttttagcagctggagaccagttgcctattatgggaagtgtcttacaggtactctacccttggcagttaggggacgggaaaaataacgattctttggtactttatggcaggctcttaaatcgaacttttcttttcacaggtgacttggaaaaagagggggaaaacgagatcataaaacgttatcctcaactaagagtagattatttaaaagcaggtcaccatggatcaaatacctcttctagtgcagcttttttagaccatattcagcctaaagtggcctttatttctgctggaaaaaataaccgttatcagcatcctcacagagaaaccttagcccgtttggaagacagacaaatcacttattaccgaacggatacgcaaggagctattcgtttgactggtcggacaagctggcatcttgaaacggttcgt

SEQ ID NO: 6714 - protein, 747 aa, Streptococcus pyogenes
MTFSWTKLVPLSKIQFAFLILVFFYQIHSPSWLTFLLSLSLICLLVKRLSKKEFLGVFAILSFCALFLLYQKQQLVQKLEIQPVQITSVALVPDSIRINGDQLAVLGRHGKHSYQLFYRLKSQAEAQLFKKEHRWLVMHAKVTLEKAEEVRNFKGFNYQTFLTYQGIYRIGKVEQIEQLEVISPESICDYLSSLRRRAIVHCQQHFPRPMSHYLTGLLFGYLDKSFGEMTDYYSQLGIIHLFALSGMQVGFFLTCFRRVLLLLAVPLEWIKWIELPFACFYAALTGYSISVIRSLVQSQLRHLGIKGLDNLACTFLLVFLWDAHFLMTVGGVLTFSYAFLLTVVTVEELSGAKRQLVQVLTISLGILPFLLFYFSSFNPMSMVLTGLLSYLFDLFILPLLCLVFCLSPLVTVSICNHLFILLEKVIQFLGNTFNSSLVFGSPTSWHLLILVISFAIFYDYRQVRQRVITCGLVIALTLLSVKYPLTNEVTFIDIGQGDSILVREWTGKNLLIDVGGRPFFSSKEHWRRGHHVANAQKTLIPYLKSRGIHTIDQLLVTHADTDHMGDIEVVAKAIRIKEILTSQGSLSHPSFVRRLRRLKCHVRVLAAGDQLPIMGSVLQVLYPWQLGDGKNNDSLVLYGRLLNRTFLFTGDLEKEGENEIIKRYPQLRVDYLKAGHHGSNTSSSAAFLDHIQPKVAFISAGKNNRYQHPHRETLARLEDRQITYYRTDTQGAIRLTGRTSWHLETVR

SEQ ID NO: 6715 - DNA, 651 bp, Streptococcus agalactiae
atgtttgaaatagtattggaaaaaattaaatcgcataaatgggagacaacaggaattattgtaggactcttattatttggaattttgggtttaaatcattttggcactcatcataaagaagacaatttaaatatcaatttagagaaaaaagtatcaactataacagaaaaaaaggtaccaatgattagtcacgtcaaagataaagtatctaatcaagtaacggttgacgtaaaaggggcagtcaatcatccaggtgtttatagtttgccttctcaaagtcgtgtaacagatgcgattaagcgtgcaggtggactaagcaatctcgctgatagtaaatccgttaatctagcacagaaattacaagatgagacggttatctatgttgctcaaaaaggtgaaaaaataactgttgtggaagaggagaaagcaaataatatcgctactcagggaaatagtaaggggaaaattaatcttaataaagcagatttatcaagtcttcagaccatatcaggcgttggggctaaaagagctcaagatattttagattatcgtgatagtcaaggtggttttaaaactattgatgacctcaaaaacgtatcaggtattggtgagaaaacactagaaaaattacgtcaagatgttacaattgac

SEQ ID NO: 6716 - protein, 217 aa, Streptococcus agalactiae
MFEIVLEKIKSHKWETTGIIVGLLLFGILGLNHFGTHHKEDNLNINLEKKVSTITEKKVPMISHVKDKVSNQVTVDVKGAVNHPGVYSLPSQSRVTDAIKRAGGLSNLADSKSVNLAQKLQDETVIYVAQKGEKITVVEEEKANNIATQGNSKGKINLNKADLSSLQTISGVGAKRAQDILDYRDSQGGFKTIDDLKNVSGIGEKTLEKLRQDVTID

SEQ ID NO: 6717 - DNA, 660 bp, Streptococcus pyogenes
atgttagacgaattattaattaaaggaaaatcgtttttgagagagcggtattttctgccatacctaattagtcttttattaggactttttctaatactaagcttcagttttttgttctggggaaataggcagagcaaggcagccgttcctgctttgagagaaatatcgcctgtgaaacagcaggttagtgaagaaaaaaaggaaattcaagaagatagcagtattttagtggatttaaaaggcgccgtacaaaaagagggagtttataagctaactgctagcagtcgtgtgcgagatgtcattgaactagctggaggcctaacttcagaagctgataaacatgctattaattttgcagaaaaactaactgatgagcaagttgtttatgtacctaaacaaggagaagagatttctgtgctaccaagatcattagtttctggtaaaaaagaaactgccagcaaggatcagtcaaaggttcatattaataaggccagcttagaagaactacaacatatcccaggtattggtgctaaaagagctcaggatattattgatatgagagataagttaggtggttttaaagcgttagaagatctccgtcaggtttcggggattggcgaaaaaacgctcgagaaattaaaagatgacattttcttggac

SEQ ID NO: 6718 - protein, 220 aa, Streptococcus pyogenes
MLDELLIKGKSFLRERYFLPYLISLLLGLFLILSFSFLFWGNRQSKAAVPALREISPVKQQVSEEKKEIQEDSSILVDLKGAVQKEGVYKLTASSRVRDVIELAGGLTSEADKHAINFAEKLTDEQVVYVPKQGEEISVLPRSLVSGKKETASKDQSKVHINKASLEELQHIPGIGAKRAQDIIDMRDKLGGFKALEDLRQVSGIGEKTLEKLKDDIFLD

SEQ ID NO: 6719 - DNA, 738 bp, Streptococcus agalactiae
atgttctatacttacttacgtactttagttatgttcttgatttgggtggctaatggtaatgcgcactatcataatgaagataaaatgttaaaagatgatgaaaattatattttagtagctccacacagaacattttgggatcctgtgtacatggcttttgctgctagacccaaacagtttatttttatggccaaaaaagaattattcacgaatcgtttgtttggttggtggattaaaatgtgtggtgctttccctattgatcgtgaaaagccagggcaagatgctattcgatatcctgtaaagatgctgaaaaatagcaaccgttctttggtgatgtttccgagtggaagccgccactccaaagatgtcaaaggaggcgtagctgttattgcaaaaatggcaaaagtcagaattatgccagcagcatatagaggtcctatggtttttaaaaatctattaaaggggcatcgtgttgatatgaattttggtaaccctattgatgtttctgatattaagcgtatggatgccgaagggattgcagaagtatctcgtcgtattcaggaagaatttgatcgtttagatagagaaaatgaaacttatgatgatggtaagaaattaaatccattgacttatatttatcgtctacctttagcaattatagctattgtcttgcttgtcctaactctaatttttagttatttagcaagctttgtgtgggatccacaaaaacatctaaaa

SEQ ID NO: 6720 - protein, 246 aa, Streptococcus agalactiae
MFYTYLRTLVMFLIWVANGNAHYHNEDKMLKDDENYILVAPHRTFWDPVYMAFAARPKQFIFMAKKELFTNRLFGWWIKMCGAFPIDREKPGQDAIRYPVKMLKNSNRSLVMFPSGSRHSKDVKGGVAVIAKMAKVRIMPAAYRGPMVFKNLLKGHRVDMNFGNPIDVSDIKRMDAEGIAEVSRRIQEEFDRLDRENETYDDGKKLNPLTYIYRLPLAIIAIVLLVLTLIFSYLASFVWDPQKHLK

SEQ ID NO: 6721 - DNA, 816 bp, Streptococcus pyogenes
ttgaagagtgattttgactttcgaaaagtcagctttcgtgatacaataagtaagattattctattaaaggagaagcctgtgttttacgcttacttacgcggtttagtagtctttttattatgggttgtcaatggcaatgcccactaccatcatgaagaaaagatgttagatgcttctgagaattatattctggtagcaccccatcgaaccttttgggatccagtttacatggcatttgcagcacgtcctaagcagtttatttttatggctaaaaaagagttgtttgcaaatcgtctctttgcttggtggattaaaatgtgtggtgcttttcctattgatcgtgacaaaccgagtccagatgctattcgttaccctgttaatatgctcaaaaagagcaatcgttctcttcttatgtttccaagtggaagtaggcattcgcaagaggtcaaaggaggggtcgctgtgattgctaaattggctaaggtcaagattatgccagcagcctatcaggggcctatgtcggtcaagggattactagcgggagaacgggttgacatgacttttgggaatcccattgacgtctcagatattaaacgcatgaatgatgaagggattgctgaggtggcaaaccgtattcaggcagagtttgatcggattgatgacgagttggcacctttccaaccaggcaaagcaaggaaccctttaacttatctctaccgtttaccattaggattggttttggtggtggtattattattaaccatgttattttcctatattgctagttttgtttggaatccagataaacatcgccat

SEQ ID NO: 6722 - protein, 272 aa, Streptococcus pyogenes
LKSDFDFRKVSFRDTISKIILLKEKPVFYAYLRGLVVFLLWVVNGNAHYHHEEKMLDASENYILVAPHRTFWDPVYMAFAARPKQFIFMAKKELFANRLFAWWIKMCGAFPIDRDKPSPDAIRYPVNMLKKSNRSLLMFPSGSRHSQEVKGGVAVIAKLAKVKIMPAAYQGPMSVKGLLAGERVDMTFGNPIDVSDIKRMNDEGIAEVANRIQAEFDRIDDELAPFQPGKARNPLTYLYRLPLGLVLVVVLLLTMLFSYIASFVWNPDKHRH

SEQ ID NO: 6723 - DNA, 762 bp, Streptococcus agalactiae
atgatagatacaattttaaaagaaaatgaacgcattgatcagcttttttcaactgatgtcaaaatcatccaaaacaaagaagttttttcctattccatagatagtgttttattgtctcggttccctaaacttccttctcgtggtcttatcgttgacttatgtagtggtaatggtgctgtcggtttgtttgccagcaccaaaacaaatgcgacaattatagagatcgaactacaagagagccttgcggatatggctaagcgttcgattaagctcaataaattggaaaaacaggttactatgattaatgatgatttaaaaaatcttcttgatcatgttcaacgttcaaacgttgatttaatgctttgcaatccaccttatttcaaagcaagcgaaacctctaaaaaaaatctaagcccgcattatctccttgcaagacacgaaataacaacaaaccttagagagatttgtcaaattgctcaacatgctctaaaaacaaaaggacgtatcgctatggtacatcgtccagaccgtttccttgaaattattgatacgatgcgtcagttcaatttagcacctaaacgtatccaatttgtttatccaaaattaggaaaagatgctaatatgcttttaattgaagctattaaagatggctcgacagaaggtatgaaaatacttcctcctcttgttgttcatcaagataatggagactatactgagactatttttgatatatatttcggagaaaacggaaaatctcatgat

SEQ ID NO: 6724 - protein, 254 aa, Streptococcus agalactiae
MIDTILKENERIDQLFSTDVKIIQNKEVFSYSIDSVLLSRFPKLPSRGLIVDLCSGNGAVGLFASTKTNATIIEIELQESLADMAKRSIKLNKLEKQVTMINDDLKNLLDHVQRSNVDLMLCNPPYFKASETSKKNLSPHYLLARHEITTNLREICQIAQHALKTKGRIAMVHRPDRFLEIIDTMRQFNLAPKRIQFVYPKLGKDANMLLIEAIKDGSTEGMKILPPLVVHQDNGDYTETIFDIYFGENGKSHD

SEQ ID NO: 6725 - DNA, 774 bp, Streptococcus pyogenes
atgataaaagcaatcttaaaagaaggcgaacgtattgatcaactcttttcaagtgatgttggcattattcaaaacaaggatgtctttagttactctattgatagcgtcctcttatcccgcttccccaagatgccttccaaagggttaattgtggatttgtgctcaggaaatggggcggttggcttatttgctagcactagaaccaaggcagccatcgttgaagtagaattacaagaacggcttgctgatatgggacaacgctctatccagctcaatcaactggaagaccaagtaaccatgatttgtgatgatttaaaaaacctcctaaaccatgtgccacgttcaggagttgatttgatgctctgcaatcccccttactttaaaagtcacgaaagttctaagaagaacgtctctgaacattatttactggctcgtcatgaagtgaccactaatttagaagagatttgtcaggtagcccgtcatgcccttaaatcaaatggtcgtctggcaatggttcatcgaccagatcgattcttggaaattatagatagccttagagctaatggtcttgcccctaaaagggtacaatttgtctatcctaaattaggtaaatcagctaatatgttacttattgaagcaatcaaagacggttctattgaagggatgactattttacctcctttagttgtccacaaggaaaacggagaatacactgatcatatttttgagatttattttggtgctgcttccaaaggaaaacctaatcatgaccac

SEQ ID NO: 6726 - protein, 258 aa, Streptococcus pyogenes
MIKAILKEGERIDQLFSSDVGIIQNKDVFSYSIDSVLLSRFPKMPSKGLIVDLCSGNGAVGLFASTRTKAAIVEVELQERLADMGQRSIQLNQLEDQVTMICDDLKNLLNHVPRSGVDLMLCNPPYFKSHESSKKNVSEHYLLARHEVTTNLEEICQVARHALKSNGRLAMVHRPDRFLEIIDSLRANGLAPKRVQFVYPKLGKSANMLLIEAIKDGSIEGMTILPPLVVHKENGEYTDHIFEIYFGAASKGKPNHDH

SEQ ID NO: 6727 - DNA, 264 bp, Streptococcus agalactiae
atgattaaagttcctgcttatatgtatgttttagaatgttcagatggaacactttatacaggttatactacagatgtcaagcgccgtctcaatacacacaatactggaaaaggtgctaaatatactcgtgcgagattgccagtaaaacttctttattctgaagcttttaatagcaaacaagaagcaatgagggcagaagcattatttaaacaaaagactcggcaagcaaaattgacttatattaaacaacataaaaatgaacaa

SEQ ID NO: 6728 - protein, 88 aa, Streptococcus agalactiae
MIKVPAYMYVLECSDGTLYTGYTTDVKRRLNTHNTGKGAKYTRARLPVKLLYSEAFNSKQEAMRAEALFKQKTRQAKLTYIKQHKNEQ

SEQ ID NO: 6729 - DNA, 276 bp, Streptococcus pyogenes
atgaccactaaaaaagcttatatgtatgtgttagaatgtgttgataaaaccctctacactggttatacaactgatttgaaaaaacgcttagctacacataacgcaggaaagggggctaaatatactcgctaccggttacctgtttctttactttattacgaagtgtttgatagcaaagaggctgcgatgagcgctgaagcactctttaaaaaacgaaaaacaagaagccagaaattggcctatattgctactcatcaaaaagaaaagaaaaatcat

SEQ ID NO: 6730 - protein, 92 aa, Streptococcus pyogenes
MTTKKAYMYVLECVDKTLYTGYTTDLKKRLATHNAGKGAKYTRYRLPVSLLYYEVFDSKEAAMSAEALFKKRKTRSQKLAYIATHQKEKKNH

SEQ ID NO: 6731 - DNA, 1584 bp, Streptococcus agalactiae
ttgaaatttacagaacttaacttatcgcaagatattctttcagcggtagaaaaagcaggctttgtagagccatcaccaatccaagaaatgactatcccacttgctcttgaaggcaaagatgtcattggtcaagcgcagacaggtacaggaaaaactgcagcttttgggttaccaactttaaataaaattcatactgaagataatactatccaagcacttattattgctcctacacgtgaacttgcagtacaatcacaagaagaattgttccgttttggacgcgataaaggtgttaaggtccgctctgtttatggtgggtcaagtattgaaaaacaaatcaaggcattacgttcaggagcacacgttgttgttggaactccaggtcgattacttgatttaattaaacgtaaagcacttaaacttaatcacattgaaactcttattcttgatgaagcagacgaaatgcttaacatgggatttttagaggacattgaagcaatcattagtcgtgtaccagaaacacgtcaaactcttttattctcagcgacaatgcctgatccaatcaaacgtatcggcgttaaattcatgaaagatcctgagcatgttaaaattaaagcaactgaattaactaatgtgaatgttgatcagtattatgttcgtgttaaggaaaatgaaaaattcgatactatgacacgtttgatggacgttgatcaaccagaattgtcaattgtctttggacgtacgaaacgtcgtgtagatgaattaactcgtggactaaaattacgtggtttccgagcagaaggaattcatggagacttagatcaaaataaacgtcttcgtgttatcagagactttaaaaatgaccatattgatattcttgttgccacagatgttgctgcgcgtggtttagatatttcaggcgttacacatgtttacaactatgatattccccaagatcccgaaagttatgttcaccgtattggacgtactggtcgtgctggtaaatctggtcaatctatcacttttgtttcaccaaacgaaatgggatatttgacaattattgaaaacttaactaaaaaacgtatgactggaatgaagcctgctactgcaagcgaagcatttcaggctaagaaaaaagttgcattgaaacgtattgcacgtgactttgaggatcaggaattagtttctaaatttgataaatttaaagccgatgctttagaattagcaactcaatacacaccagaagaacttgctctttatgtcttaagcttaacagttcaggatccagaatcgttaccagaagttgaaatcacacgtgaaaaaccattaccatttaaaccatcaggtggtggctttaaaggtaaaggtggacgaggcaatggccgtggtggcgatcgtcgacgcaatgatcgtggtgatcgtcgtggaaatcgtgaccgtgatgatcgtggtagtcgttgtgattttaaacgtcgtgatgataagttcaagaaagataatcgtcgtcaagaaaataaaaaacctcataaaaacacttcaagtgaaaaacaaactggatttgttattcgcaacaaaggcgataaa

SEQ ID NO: 6732 - protein, 528 aa, Streptococcus agalactiae
MKFTELNLSQDILSAVEKAGFVEPSPIQEMTIPLALEGKDVIGQAQTGTGKTAAFGLPTLNKIHTEDNTIQALIIAPTRELAVQSQEELFRFGRDKGVKVRSVYGGSSIEKQIKALRSGAHVVVGTPGRLLDLIKRKALKLNHIETLILDEADEMLNMGFLEDIEAIISRVPETRQTLLFSATMPDPIKRIGVKFMKDPEHVKIKATELTNVNVDQYYVRVKENEKFDTMTRLMDVDQPELSIVFGRTKRRVDELTRGLKLRGFRAEGIHGDLDQNKRLRVIRDFKNDHIDILVATDVAARGLDISGVTHVYNYDIPQDPESYVHRIGRTGRAGKSGQSITFVSPNEMGYLTIIENLTKKRMTGMKPATASEAFQAKKKVALKRIARDFEDQELVSKFDKFKADALELATQYTPEELALYVLSLTVQDPESLPEVEITREKPLPFKPSGGGFKGKGGRGNGRGGDRRRNDRGDRRGNRDRDDRGSRCDFKRRDDKFKKDNRRQENKKPHKNTSSEKQTGFVIRNKGDK

SEQ ID NO: 6733 - DNA, 1617 bp, Streptococcus pyogenes
ttgaaatttacagaatttaacttatcacaagacatccaatcagctgttgttaccgctggttttgagaaagcatctcctatccaggaaatgacgattcctctcgcactagaagggaaggatgttattggtcaagcacaaacaggaactggtaaaacagcagcgtttggtctaccaaccttgaataagattcgtactaacgaaaatatcatccaagcattggtcattgcaccaacgcgtgaattggctgtacaaagtcaggaagaattgttccgttttggacgtgaaaaaggggttaaggttcgctctgtttacggtggatcaagtattgaaaaacaaatcaaagcccttaaatcaggtgcccacattgtcgtgggaacaccgggtcgcttgttagatttgattaagcgcaaggctcttattttagatcatgtggaaaccttaatccttgatgaagcagatgaaatgcttaacatgggattcttggaagacattgaagctattattagtcgtgtcccagcagaccgtcaaaccttgctcttctccgcaacgatgccggcacctattaaacaaatcggggttaaattcatgaaagaccctgaacatgttcaaattaagaacaaagaattaacaaacgtcaatgttgatcaatactatgttcgtgtgaaagaacaagaaaaatttgatactatgacccgtctgatggatgttaaccagccagaattatccatcgtttttgggcggactaagcgccgagttgatgaaattacacgtggcttgaaacttcgtggtttccgtgccgaaggaatccatggtgatcttgaccaaaataaacgcttacgtgttatccgtgatttcaaaaacgaccaaattgatattcttgttgccactgatgtagcagcgcgtggccttgatatttcaggagttacccacgtttataactacgatattacccaagatccagaaagttatgttcaccgtattggtcgtacaggtcgtgccggtaaatctggtgagtctatcacttttgtctcaccaaatgagatgggctacctctcaatgattgagaacttaacgaaaaaacagatgaaacctcttcgtccagcaactgctgaagaggcctttcaagccaagaaaaaagtagccctcaagaaaattgaacgcgactttgcggatgagactattcgttcaaactttgataaattcaaaggcgatgctgtccaattggctgccgaattcactcctgaagaattagctttatatattttgagcttaacggttcaagatccagatagcttaccggaagttgaaattgcacgtgaaaaaccattaccattcaaatatgtgggtggtggtcacggcaataaaaatggcaaaggtggtcgtggacgtgacaaccgtaaccgtggtgatcgccgtggcggctatcgtggtgaccgtaacagagatgagcgtgatggtgaccgtcgtcgtcaaaaacgtgataagcgtgatggtcacgatggcagtggcaaccgcgatttcaaacgtaaatcaaaacgtaatagtaaagactttttcaataaagagaaaaaatcaagtgctaaaaatactggttttgtgattcgtcacaaaggtgaa

SEQ ID NO: 6734 - protein, 539 aa, Streptococcus pyogenes
LKFTEFNLSQDIQSAVVTAGFEKASPIQEMTIPLALEGKDVIGQAQTGTGKTAAFGLPTLNKIRTNENIIQALVIAPTRELAVQSQEELFRFGREKGVKVRSVYGGSSIEKQIKALKSGAHIVVGTPGRLLDLIKRKALILDHVETLILDEADEMLNMGFLEDIEAIISRVPADRQTLLFSATMPAPIKQIGVKFMKDPEHVQIKNKELTNVNVDQYYVRVKEQEKFDTMTRLMDVNQPELSIVFGRTKRRVDEITRGLKLRGFRAEGIHGDLDQNKRLRVIRDFKNDQIDILVATDVAARGLDISGVTHVYNYDITQDPESYVHRIGRTGRAGKSGESITFVSPNEMGYLSMIENLTKKQMKPLRPATAEEAFQAKKKVALKKIERDFADETIRSNFDKFKGDAVQLAAEFTPEELALYILSLTVQDPDSLPEVEIAREKPLPFKYVGGGHGNKNGKGGRGRDNRNRGDRRGGYRGDRNRDERDGDRRRQKRDKRDGHDGSGNRDFKRKSKRNSKDFFNKEKKSSAKNTGFVIRHKGE

SEQ ID NO: 6735 - DNA, 828 bp, Streptococcus agalactiae
atgaaaaaattactttccctaacatgtctaatcatgatgtctttatgtttagtggcatgtactaagcaagcaatgtcgtctaagaaaattaaagataagaatagtaaagaaaaggtgattactgttgcaacttacagcaaacctacatctacctttttagatttggttaaagataatgtaaaagaaaaaggatatactttaaaggttgtcatggtctctgactatattcaggctaacattgctttagaaaacaaagaacatgatgctaaccttttacaacatgaatttttcatgagtatctttaataaggaaaatgatggtcatctagtatcaattacaccaatttatcattcattggctggtttttatggtcaacatttgaaaaatattgccgagcttaaagacggtgctaaggtagcgattccgtctgatcctgccaatatgactagagctctgctattattgcaagaaaagaaacttatcaccttaaagaatacgtccaaaaagaccaaggctatcgaagatattattactaaccctaaaaaattacgaattgaacctgtagcattacttaacctcaatcaggcctattttgaatatgaccttgtctttaatttccctggatatgtgacaaaaatcaatctagttcctaaaagggatagattattatatgagaaaaaaccagatatccgttttgcaggtgccttggtagctcgtgaagataataaaaatagtgataaaataaaagtacttaaagaagtactaacaagtaaagagattcgtcactatatcactaaggagattccaagtgaagcagccgttgcgttc

SEQ ID NO: 6736 - protein, 276 aa, Streptococcus agalactiae
MKKLLSLTCLIMMSLCLVACTKQAMSSKKIKDKNSKEKVITVATYSKPTSTFLDLVKDNVKEKGYTLKVVMVSDYIQANIALENKEHDANLLQHEFFMSIFNKENDGHLVSITPIYHSLAGFYGQHLKNIAELKDGAKVAIPSDPANMTRALLLLQEKKLITLKNTSKKTKAIEDIITNPKKLRIEPVALLNLNQAYFEYDLVFNFPGYVTKINLVPKRDRLLYEKKPDIRFAGALVAREDNKNSDKIKVLKEVLTSKEIRHYITKEIPSEAAVAF

SEQ ID NO: 6737 - DNA, 660 bp, Streptococcus agalactiae
atgattgacattattgaaaaacatggcgaaggtatcttaaaatcattttgggaaaccaatttaatgttagggttaaccttgattctttgttttctaattgcttttccaacaggtattttattgttttcattgagaaagtcttacttgattaaacattctttagcctatcaactactaaatttatttttaggtacgttacggagtgtccctttccttatttttatttttatcttaatccctctcaatcgattaatttttgggacctcatttggaacgatagcggcaatcttacctcttactttggtttcagtcagtttgtatgcacgttatgtggaacaagctttattaaatatacctcaagttgttgtagatcgagctctcagtctaggggctaacaagagacagataatttattattttttaatcccctccatcaagattgaccttgttttatcatttactgcaacggctataagtattcttggctactcgacaataatgggagttattggtgcaggaggtttgggtgaatatgcctatcgttttggctatcaagagtatgactacccagttatgtacttgattgttgtcttatttataatatatgtgtttatcttacagagtttgggctattttatagcaaaccgctactcaagaaaa

SEQ ID NO: 6738 - protein, 220 aa, Streptococcus agalactiae
MIDIIEKHGEGILKSFWETNLMLGLTLILCFLIAFPTGILLFSLRKSYLIKHSLAYQLLNLFLGTLRSVPFLIFIFILIPLNRLIFGTSFGTIAAILPLTLVSVSLYARYVEQALLNIPQVVVDRALSLGANKRQIIYYFLIPSIKIDLVLSFTATAISILGYSTIMGVIGAGGLGEYAYRFGYQEYDYPVMYLIVVLFIIYVFILQSLGYFIANRYSRK

SEQ ID NO: 6739 - DNA, 597 bp, Streptococcus agalactiae
ttgaagatgattaatggcttaatcccttatgataaaggaaatatttattatcaaggaaaagaagtgaagtctttttctgataataagttacgtcagatgcgtaaagatattgcttatatttttcaaaatcataatttgttagcaggagaaagtgtatattatcatctagctttagtttataaattaaatcatcaaaaagtaaatcatgacgcaattaatgatatcttagattttttaggtttgatggatttaaaacaggtgaaatgccatagtttgagtggtgggcagcaacaaaaagttgcaatcgctatggctgttttgcaaaaaccgaaacttattctatgtgatgagatcagctctgccttagatactaatagtgaaaaagagatatttaacttgttgtctgatcttcgtgaaaaatatggtatctctatcttgatgattgctcatcacctatctcttttaaaacaatattgtgatcgtgtaatgattttggatcaccagactattgtagatactgttgttccagtgaaagcaactctgaatcaattaaagtcaaactacgtagatcaagtaaaggagtttttgttacatgat

SEQ ID NO: 6740 - protein, 199 aa, Streptococcus agalactiae
MKMINGLIPYDKGNIYYQGKEVKSFSDNKLRQMRKDIAYIFQNHNLLAGESVYYHLALVYKLNHQKVNHDAINDILDFLGLMDLKQVKCHSLSGGQQQKVAIAMAVLQKPKLILCDEISSALDTNSEKEIFNLLSDLREKYGISILMIAHHLSLLKQYCDRVMILDHQTIVDTVVPVKATLNQLKSNYVDQVKEFLLHD

SEQ ID NO: 6741 - DNA, 108 bp, Streptococcus agalactiae
gtgattttggaaaaatttttccaacactctttaattctattatcattatttaatactcctcaaaaaaatatcttatcaaaaaaatacagcgttttcaaaatatatgct

SEQ ID NO: 6742 - protein, 36 aa, Streptococcus agalactiae
MILEKFFQHSLILLSLFNTPQKNILSKKYSVFKIYA

SEQ ID NO: 6743 - DNA, 390 bp, Streptococcus agalactiae
ttggagattaacatgggaattttttcgggattaatgggaaatgcttcacaaatggataccgataaagtcgagaatcagttatctgatattctgatttcagatgaacaggttgatttagcttataccttaattcgtgatttgattgtttttactaattatcgtttaattttagtcgataaacagggggtgacaggtaaaaaggtttcttataattctataccttatgcttctatatcacgttttacagtggaaactagtggtcattttgatttagatgctgagttaaagatttggatatcatcagcaatagaaccagcagaagtacttcagtttaagaacgaccgtaacatagtgagtatacagaaagctttggcgacagctgttttaaaa

SEQ ID NO: 6744 - protein, 130 aa, Streptococcus agalactiae
MEINMGIFSGLMGNASQMDTDKVENQLSDILISDEQVDLAYTLIRDLIVFTNYRLILVDKQGVTGKKVSYNSIPYASISRFTVETSGHFDLDAELKIWISSAIEPAEVLQFKNDRNIVSIQKALATAVLK

SEQ ID NO: 6745 - DNA, 1374 bp, Streptococcus agalactiae
atggatattgaaaagcaacggggtatctctgttacttcatctgttatgcaatttgattacgcgggtaaacgtgttaatattttggatacacctggacatgaggatttctcggaagatacataccggaccttaatggctgtggatgcagctgtcatggttgtagattcggctaaaggtattgaggctcaaactaaaaaactttttgaagttgttaagcatcgtaatattccggtttttacgtttattaataaattggaccgtgatggacgtgagccattggatttgcttgaagagttagaagaagtactaggtattgcttcttatccaatgaattggccgattggtatggggaaatcatttgaagggctttatgatttacataataaacgtttagaactctataagggagacgagcgttttgcaagtattgaagacggtgatcagctgtttgccaataatccattttatgaacaagtcaaagaagatattgaacttcttcaagaagcaggtaatgacttttcagaacaagctattcttgatggtgacctaactccagtattctttggctctgcccttacgaactttggagttcagacttttcttgatactttcttggagtttgctccagaacctcatggtcacaagactacagaaggtaatgttattgaccccttggctaaagatttttcaggttttgtctttaaaattcaagctaacatggacccacgtcatcgcgaccgtattgcttttgttcgtattgtttctggtgaatttgagcgcggtatgggagttaatttgacacgtactggtaaaggtgctaagctctccaatgttactcaatttatggcagaatcacgtgaaaatgtgacgaatgctgttgctggggatattatcggggtttatgatacaggaacttatcaagttggggataccttaacagttgggaaaaataaatttgaatttgaaccattaccaacttttaccccagaattatttatgaaagtatcagcaaaaaatgttatgaagcagaaatcattccacaaaggtattgagcaattagtacaagaaggagcaatccagctttataagaattatcagacaggcgaatacatgctgggtgctgtgggtcaacttcagtttgaagtttttaaacatcgtatggaaggtgaatacaatgctgaagttgttatgacaccaatgggtaaaaagactgtacgttggattaactcagacgatttagacgaacgcatgtcttcaagccgaaatattttagcaaaagatcgttttgaccaaccagttttcctatttgaaaatgattttgcacttcgctggtttgctgataagtatcctgatgtgaagcttgaagaaaaaatg

SEQ ID NO: 6746 - protein, 458 aa, Streptococcus agalactiae
MDIEKQRGISVTSSVMQFDYAGKRVNILDTPGHEDFSEDTYRTLMAVDAAVMVVDSAKGIEAQTKKLFEVVKHRNIPVFTFINKLDRDGREPLDLLEELEEVLGIASYPMNWPIGMGKSFEGLYDLHNKRLELYKGDERFASIEDGDQLFANNPFYEQVKEDIELLQEAGNDFSEQAILDGDLTPVFFGSALTNFGVQTFLDTFLEFAPEPHGHKTTEGNVIDPLAKDFSGFVFKIQANMDPRHRDRIAFVRIVSGEFERGMGVNLTRTGKGAKLSNVTQFMAESRENVTNAVAGDIIGVYDTGTYQVGDTLTVGKNKFEFEPLPTFTPELFMKVSAKNVMKQKSFHKGIEQLVQEGAIQLYKNYQTGEYMLGAVGQLQFEVFKHRMEGEYNAEVVMTPMGKKTVRWINSDDLDERMSSSRNILAKDRFDQPVFLFENDFALRWFADKYPDVKLEEKM

SEQ ID NO: 6747 - DNA, 1542 bp, Streptococcus pyogenes
atgtcacttacagaagaaattaaaaaacgccgtacttttgccatcatttctcacccggatgctggtaagacgactattactgagcaactattatattttggtggtgaaattagagaagcagggacagtaaaaggcaaaaaatcaggtacgtttgcaaagtccgactggatggatattgaaaagcaacgtggtatctctgttacttcatctgttatgcaatttgattacgcgggtaaacgtgttaatattttggatacacctggacatgaggatttctcggaagatacataccgtaccttaatggctgtggatgcggctgtcatggttgtagattcggctaaaggtattgaggcgcaaacgaaaaaactttttgaagttgtcaaacatcgtaatattcctgtcttcacctttattaacaagttagaccgtgatgggcgtgagcctttagaactcttggaagaattagaagaagttttagggattgcttcttatccgatgaactggccgattggtatgggacgcgcctttgagggcttatatgatttacataataaacgtttagaactctataagggagacgagcgttttgcaagtattgaagacggtgatcagctgtttgccaataatcccttttatgaacaagtcaaagaagatattgaacttcttcaagaagcaggtaatgacttttcagaacaagctattcttgatggtgacctaactccagtcttttttggctctgcccttacgaactttggagttcagacttttcttgatactttcttggagtttgccccagaacctcatggtcacaagactacagaaggtaatgttgttgaccccttagctaaagatttttcaggttttgtctttaaaattcaagctaacatggaccctaaacaccgtgaccgtattgcttttgtgcgtattgtttctggtgaatttgagcgcggtatgggagttaatttgacacgcactggcaaaggcgctaagctctccaatgttactcaatttatggcagaatcacgggaaaatgtgacgaatgctgttgctggggatattatcggggtttatgatacaggaacttatcaagttggggataccttaacagttgggaaaaataaatttgaatttgaacccttaccaacttttaccccagaaatcttcatgaaggtttctccgaaaaatgttatgaagcagaaatccttccacaaaggtattgaacaattagtacaagaaggagcaattcagctttataagaattatcagacaggcgaatacatgctgggtgctgtgggtcaactgcagtttgaagtctttaaacatcgtatggaaggtgaatacaacgctgaagttgtgatgacaccaatgggtaaaaagactgttcgctggatttcagaagatgatttggatcaacgcatgtcttcaagccgaaacattttagctaaggatcgttttgaccaaccagttttcctatttgaaaatgattttgcccttcgctggtttgcagacaaatacccagatgtcactttagaagagaaaatg

SEQ ID NO: 6748 - protein, 514 aa, Streptococcus pyogenes
MSLTEEIKKRRTFAIISHPDAGKTTITEQLLYFGGEIREAGTVKGKKSGTFAKSDWMDIEKQRGISVTSSVMQFDYAGKRVNILDTPGHEDFSEDTYRTLMAVDAAVMVVDSAKGIEAQTKKLFEVVKHRNIPVFTFINKLDRDGREPLELLEELEEVLGIASYPMNWPIGMGRAFEGLYDLHNKRLELYKGDERFASIEDGDQLFANNPFYEQVKEDIELLQEAGNDFSEQAILDGDLTPVFFGSALTNFGVQTFLDTFLEFAPEPHGHKTTEGNVVDPLAKDFSGFVFKIQANMDPKHRDRIAFVRIVSGEFERGMGVNLTRTGKGAKLSNVTQFMAESRENVTNAVAGDIIGVYDTGTYQVGDTLTVGKNKFEFEPLPTFTPEIFMKVSPKNVMKQKSFHKGIEQLVQEGAIQLYKNYQTGEYMLGAVGQLQFEVFKHRMEGEYNAEVVMTPMGKKTVRWISEDDLDQRMSSSRNILAKDRFDQPVFLFENDFALRWFADKYPDVTLEEKM

SEQ ID NO: 6749 - DNA, 429 bp, Streptococcus agalactiae
ttgttagagtttgcagcacaaaaaacaggtaaagagaataaagaaatggctgtaacgtttgtcactaatgaacgtagccatgaattgaatttagagtatcgagataccgatcgtccgactgatgttatcagtttagaatataagcctgaggttgatatttcttttgatgaagaagatctggctgaaaatcctgaacttgctgagatgctagaagattttgattcttatattggtgaactttttatttctattgataaagctaaagaacaagcagaagagtacggtcactcttatgaacgtgaaatgggttttttagctgtacatggttttttgcatattaacggttatgatcattatacacccgaagaagaaaaagagatgttcagcttacaggaagaaattttaactgcttatggacttaaacgacaa

SEQ ID NO: 6750 - protein, 143 aa, Streptococcus agalactiae
MLEFAAQKTGKENKEMAVTFVTNERSHELNLEYRDTDRPTDVISLEYKPEVDISFDEEDLAENPELAEMLEDFDSYIGELFISIDKAKEQAEEYGHSYEREMGFLAVHGFLHINGYDHYTPEEEKEMFSLQEEILTAYGLKRQ

SEQ ID NO: 6751 - DNA, 396 bp, Streptococcus agalactiae
atggacttaaacgacaataatcacaaaaaatggaaaaatcgcaccttaacatcaagcatggaatttgctgttacagggatttttacagcttttaaagaagaaagaaatatgcgtaagcatttggtttctgccattttagtaatacttgctggtcttactttccaagtatctatggtggagtggttatttcttttattgagtatttttttggtaattacttttgaaattatcaattcagctattgaaaatgtagttgatttggcaagtaattaccatttctcgatgctggctaaaaatgctaaagatatggcagcaggagcggttttagttgtttccttatttgccgtattggtgggattgattatttttatacccaagatacttgctttactttta

SEQ ID NO: 6752 - protein, 132 aa, Streptococcus agalactiae
MDLNDNNHKKWKNRTLTSSMEFAVTGIFTAFKEERNMRKHLVSAILVILAGLTFQVSMVEWLFLLLSIFLVITFEIINSAIENVVDLASNYHFSMLAKNAKDMAAGAVLVVSLFAVLVGLIIFIPKILALLL

SEQ ID NO: 6753 - DNA, 405 bp, Streptococcus pyogenes
atggccttacacgacaataataccaccaaacggaaatggaaaaacagaaccattacctcaagcttggagtttgccttgacaggggttttcacagcttttaaggaagaacgcaatctcagaagccaccttttgtctgcctgtttagcttgtgttgctggtttattttttagcatttcagccatcgaatggttatttttacttctagccatttttttggtcattaccttagaaattgtcaattctgctattgaaaatgtagttgatttggctagtgactatcacttttctatgctagctaaaaatgccaaggatatggcagcaggtgctgttttgatgatttctggctatgctgtcttgacaggacttattatttttattcctaaaatttggaatattttcgttcat

SEQ ID NO: 6754 - protein, 135 aa, Streptococcus pyogenes
MALHDNNTTKRKWKNRTITSSLEFALTGVFTAFKEERNLRSHLLSACLACVAGLFFSISAIEWLFLLLAIFLVITLEIVNSAIENVVDLASDYHFSMLAKNAKDMAAGAVLMISGYAVLTGLIIFIPKIWNIFVH

SEQ ID NO: 6755 - DNA, 942 bp, Streptococcus agalactiae
atgatgagaagtattacgaataaattgaatggagaaagaaaagaaatgacatttaagtcaggatttgtagcaattttaggtcgtccaaatgttggaaaatcaaccttcctaaaccatgttatgggacaaaaaattgctatcatgagtgataaagctcaaacaacacgtaataaaattatggggatttatacaacagaaactgagcaaattgttttcattgataccccaggaattcataaaccaaagaccgcccttggtgattttatggttgaatctgcttatagtactttacgtgaagttgaaacagttcttttcatggttcctgccgatgaaaagcgaggcaaaggcgatgatatgattattgaacgtcttaaggctgccaagattcctgttattttagtaatcaacaaaattgataaggttcatccagaccaacttttggaacagattgatgacttccgtagtcaaatggattttaaagaagtagtgccaatttctgcccttcaaggaaataatgtgccaaccctaatcaagttattgactgataatcttgaagaaggtttccaatatttcccagaagatcagattactgatcatccggaacgatttttagtatcagaaatggttcgtgagaaggtacttcatttaacgcaacaagaggttcctcactcagtagctgttgttgtcgaatccatgaaacgtgatgaagaaactgataaagtgcatattcgtgcaactatcatggttgaacgtgatagtcaaaaaggcattatcattggaaaacaaggtgctatgctcaagaaaataggaaaaatggcgcgccgtgatattgaacttatgttaggtgataaagtttacctagagacttgggtaaaagtcaagaaaaactggcgtgataaaaagcttgatttagctgattttggctataatgaaaaagagtat

SEQ ID NO: 6756 - protein, 314 aa, Streptococcus agalactiae
MMRSITNKLNGERKEMTFKSGFVAILGRPNVGKSTFLNHVMGQKIAIMSDKAQTTRNKIMGIYTTETEQIVFIDTPGIHKPKTALGDFMVESAYSTLREVETVLFMVPADEKRGKGDDMIIERLKAAKIPVILVINKIDKVHPDQLLEQIDDFRSQMDFKEVVPISALQGNNVPTLIKLLTDNLEEGFQYFPEDQITDHPERFLVSEMVREKVLHLTQQEVPHSVAVVVESMKRDEETDKVHIRATIMVERDSQKGIIIGKQGAMLKKIGKMARRDIELMLGDKVYLETWVKVKKNWRDKKLDLADFGYNEKEY

SEQ ID NO: 6757 - DNA, 894 bp, Streptococcus pyogenes
atgtttaaatcaggctttgtagccattcttggtcgtccaaatgttggcaaatccacctttttaaatcacgtcatggggcaaaaaattgccatcatgagtgacaaggctcagaccacccgtaataaaattatgggcatttacaccacagaaacagaacaaattgtctttattgatacgccaggtattcataaaccaaagaccgcccttggtgattttatggttgaatctgcttatagtactttacgtgaagttgagacggttcttttcatggttcctgccgatgaaaagcgtggtaagggtgacgacatgattatcgagcggctaaaagcagctaagattcccgttattttagtcatcaacaaaattgataaggttcatccagaccaacttttggaacagattgatgacttccatagccaaatggattttaaagaagtggtcccaatttctgccctagaaggtaataatgtgccaactttgatcaagttattaactgataatcttgaagaaggtttccaatattttccagaagatcagattactgatcatccagaacgtttccttgtgtcagaaatggttcgtgagaaggtactgcatttgacgcaacaagaggttccacattccgtagctgttgttgtcgaatccatgaagcgagatgaagagactgataaagtgcatatccgtgcaaccattatggtggagcgcgatagccaaaaaggcatcatcattggaaaacaaggagccatgctcaaaaaaatcggaaaaatggcgcgccgtgatattgaactcatgttaggcgacaaggtctacttagaaacgtgggtcaaagtcaagaaaaactggcgggataaaaagcttgatttagctgattttggctataatgagaaagaatac

SEQ ID NO: 6758 - protein, 298 aa, Streptococcus pyogenes
MFKSGFVAILGRPNVGKSTFLNHVMGQKIAIMSDKAQTTRNKIMGIYTTETEQIVFIDTPGIHKPKTALGDFMVESAYSTLREVETVLFMVPADEKRGKGDDMIIERLKAAKIPVILVINKIDKVHPDQLLEQIDDFHSQMDFKEVVPISALEGNNVPTLIKLLTDNLEEGFQYFPEDQITDHPERFLVSEMVREKVLHLTQQEVPHSVAVVVESMKRDEETDKVHIRATIMVERDSQKGIIIGKQGAMLKKIGKMARRDIELMLGDKVYLETWVKVKKNWRDKKLDLADFGYNEKEY

SEQ ID NO: 6759 - DNA, 111 bp, Streptococcus agalactiae
ttggtaaaaatcgaaaagttaccagactttaaaggggagttttttatttgtcaacagttagtagaaaaacgatatattgctccatttagattaattatggagataaccaaa

SEQ ID NO: 6760 - protein, 37 aa, Streptococcus agalactiae
MVKIEKLPDFKGEFFICQQLVEKRYIAPFRLIMEITK

SEQ ID NO: 6761 - DNA, 1590 bp, Streptococcus agalactiae
atgaagattaaaaaaattattagtggccttgccgcagctttaattatcagttcactatcaactattaactatgaggttaaagctgatgacaccaccagtgagtatcactatatcagtaagcaaaataatgaagagcagcttattagttacatcaaggaacaacatcgtttgctcaatcaatttgttgttgataatgtcaactcattcactcaactaaatgctaatccaactattgaacagttaaatagagctataacattatttaaacaaaaagatgagcaattatttaaccaggtgaaagctggtcatctctctcccagtaactataatgctatcgttaatcaacgtaatgtcattaaccaaactgttcaaaatctgattgaccaaaatcataataagcttcagacaagtcaaaataaagcagctcagctcgtggggcaacgtaatcaggttgttaacaaaattcaagctattttagcaactgtaaactacaactctgtgaattctatacaagaagctgaaaatttatttcattcactcagaaatcaaattgaacctcttgtagctgaagttaataattacaaagctgctatggcaatccttcaacaagaagtagatgccctatcaacagcggctattgaaactgagacttctaaacttgctactctcaaagttagcgaaaatacttctgttcctgcaaacaaagtagaagaaaaaactactcaatcagaagcgtcaggcaataaacaagaagtaactaagagtgaggaaaaacaggctacctctgatgcaaaggcatcacagcctgagtcagctaatattgccgattacgatagtttaaaagaagttttacgaaataatattagcaaccaagtaccacacatcagtgttcaaatggagtttaaaactcaagaacaagttgacgaataccaaaaaaatctcggaagcatcatccgggaaattggagatacacttggaacagcaactgaattcaatgccaaaagtaacattagcacttatactcttggtggacaaatccaacgcattattgtaaaaagcgacatcacaatcacctatactcttaaaggtgacatggtaggattacataaagaatataaacagtttgtagattcttttgtcaaagaaaatattactaacaaaaatatcacaagtgattatgaaaaagctaaagtaattcatgaccacttggttaataattacacttacgcgactgaagaactggcaaccactcgtgaaactgctagtggtatcagtatccatgctcctgaagcactctacaaagataaacgtggtgtttgtcaagcctttgcagtaatgtttaaagatatggctgctactgctggcttatcagtatggtatgtaactggtcaagctggaggtggaaatcacgcttggaacattgttactattaatggcgttaaatattatgttgatacaacatgggataataatataaaaagcaataaatatttccttgttggtaaaacaataatggatgctgatcatcttttggatagtcaatacaatgcattagctaaagatattccagctgatcgccatcaaggtgca

SEQ ID NO: 6762 - protein, 530 aa, Streptococcus agalactiae
MKIKKIISGLAAALIISSLSTINYEVKADDTTSEYHYISKQNNEEQLISYIKEQHRLLNQFVVDNVNSFTQLNANPTIEQLNRAITLFKQKDEQLFNQVKAGHLSPSNYNAIVNQRNVINQTVQNLIDQNHNKLQTSQNKAAQLVGQRNQVVNKIQAILATVNYNSVNSIQEAENLFHSLRNQIEPLVAEVNNYKAAMAILQQEVDALSTAAIETETSKLATLKVSENTSVPANKVEEKTTQSEASGNKQEVTKSEEKQATSDAKASQPESANIADYDSLKEVLRNNISNQVPHISVQMEFKTQEQVDEYQKNLGSIIREIGDTLGTATEFNAKSNISTYTLGGQIQRIIVKSDITITYTLKGDMVGLHKEYKQFVDSFVKENITNKNITSDYEKAKVIHDHLVNNYTYATEELATTRETASGISIHAPEALYKDKRGVCQAFAVMFKDMAATAGLSVWYVTGQAGGGNHAWNIVTINGVKYYVDTTWDNNIKSNKYFLVGKTIMDADHLLDSQYNALAKDIPADRHQGA

SEQ ID NO: 6763 - DNA, 1230 bp, Streptococcus pyogenes
atgggagttatgatgaaacaaaagattaaaatcttaacagtaattggccttatgacagttggtatgtctgcgtgtcacaacactagcaaaccttctaataccgattctgttttttctttaaccggaaaaaagcgccaacaaatcgtcaaacaagtaagacaacggtattatttccaacaattatccaaaaccgaacaagaaaattacctcactttatacgatagtttagcacaatttcgtgaaatcatcagtttgacgccggcttctaaaaaaagcttaattaaaacaattgacgcctttgtgatggataatcccgaattttactggattacatctgccgattatcgatttgagttttctgatcaaacggtctttgtcacctttcctatcccagaagatgccaagaacatttatcaagacttgcaagcaatcggtaatgatatcgtcgcaaacacgccatcaaaggatcgctatgagcaggtcaaatatttttatgaggtcatcattcgagacacagactacaataaaaaagcctttgaagcctatcaatcaggcagtcaagcccaggtcgcttctaatcaagacattaaaagtgtttttattgatcatttatctgtttgtaatggctatgcccaagcctttcagtttctttgtcaaaaagctggcattccagtcgcctatatccgtggaactggtacatctcagcaacctcagcaatcttttgcacatgcatggaatgctgttcaaattaataacacttattatggcgttgatgtcacttggggtgaccctgtttttgataaccatctctcacatcaaaagcaaggaactatcaattacagttttctatgcctgccagattatctaatggccttatcacatcagccaagcaaagacattgcttttaatactaaagaacgttttgaaaatgtttggactataccttcttgtacagatgattctttgctttattctaaacgtcatcaaagctatatctcaacgtttgacagtgacgccatccttgcaagccttgaaaatcagttgttaaatagacaagagccactgtctctacaatttgctcatcaagatgattatcaacaaatggtaactgatttaacgacgaatcaaacaggttatcataaccttttcaatcagtattggaataattatacgggctttacctatggactcttaccagagactcttagtatttcatttgctagtaggaac

SEQ ID NO: 6764 - protein, 410 aa, Streptococcus pyogenes
MGVMMKQKIKILTVIGLMTVGMSACHNTSKPSNTDSVFSLTGKKRQQIVKQVRQRYYFQQLSKTEQENYLTLYDSLAQFREIISLTPASKKSLIKTIDAFVMDNPEFYWITSADYRFEFSDQTVFVTFPIPEDAKNIYQDLQAIGNDIVANTPSKDRYEQVKYFYEVIIRDTDYNKKAFEAYQSGSQAQVASNQDIKSVFIDHLSVCNGYAQAFQFLCQKAGIPVAYIRGTGTSQQPQQSFAHAWNAVQINNTYYGVDVTWGDPVFDNHLSHQKQGTINYSFLCLPDYLMALSHQPSKDIAFNTKERFENVWTIPSCTDDSLLYSKRHQSYISTFDSDAILASLENQLLNRQEPLSLQFAHQDDYQQMVTDLTTNQTGYHNLFNQYWNNYTGFTYGLLPETLSISFASRN

SEQ ID NO: 6765 - DNA, 861 bp, Streptococcus agalactiae
gtgaaagtgggaaaaatggaaaaagaattaggaaaaacactaagaagattacgtaaaggaaaaaaagttagtatttcttctttagcagatgagcacctatccaagtcacaaatctcaaggtttgagagaggagagtcagaaattacttgtagtcgtttgcttaatattttagacaaactcaacatcactattgatgaatttgtgtcgattcattctaaggcgcacactcatttttttatccttttaaatcgagtaagaaaatattgtgctgaaaaaaatgtaactaaattagtggctctcttagaggatcataaccataaagactatgaaaagattatgattaaggctcttattttttcaattgatcaatcaatagagcctaatcaagaagaattagcacgcttaacagactatctttttacggtggagcagtggggatattatgaaattattctcttaggaaattgctcacgtctcattaattacaatactttatttttattgaccaaagaaatggttaattcgtttgcttattcagaacaaaataaaaccaataaaatcctagttacacaattagcaattaattgtctaatcatcagcattgatcactcttactttgagcatagccactacttaattgataaggttagatcattgttacaggatgaagttaatttctatgaaaaaactgttttcttatatgtaactggatactatcatttaaaacttggtgatacttcttcaggaaaagaagatatgaggaaagctttacagatttttaaatatttaggtgaagattcattttacaatacttataatgaacattattgtcaaaaagtacttggcaataataaagaatgc

SEQ ID NO: 6766 - protein, 287 aa, Streptococcus agalactiae
MKVGKMEKELGKTLRRLRKGKKVSISSLADEHLSKSQISRFERGESEITCSRLLNILDKLNITIDEFVSIHSKAHTHFFILLNRVRKYCAEKNVTKLVALLEDHNHKDYEKIMIKALIFSIDQSIEPNQEELARLTDYLFTVEQWGYYEIILLGNCSRLINYNTLFLLTKEMVNSFAYSEQNKTNKILVTQLAINCLIISIDHSYFEHSHYLIDKVRSLLQDEVNFYEKTVFLYVTGYYHLKLGDTSSGKEDMRKALQIFKYLGEDSFYNTYNEHYCQKVLGNNKEC

SEQ ID NO: 6767 - DNA, 819 bp, Streptococcus agalactiae
atgccagaattaccagaagtagaaaccgttagaaaaggactagaaagacttgtagttaatcaagaaatagcttctataacgattaaagtccctaaaatggtgaaaactgatttgaatgactttatgataagtctaccaggaaaaacaattcaacaggtattgagacgagggaagtatcttctttttgattttggtgaaatggttatggtatcacatttacgcatggaaggaaaatatctactcttcccaaataaagtaccagataacaaacattttcacctttatttcaaattgactaatggcagcacattggtttaccaagatgtccgtaaatttgggacatttgagttggttcgtaaatcatctctcaaagattattttactcaaaaaaaattaggtcctgagccaactgctgacacatttcaatttgagcctttttcaaaaggcttagcaaactccaaaaagccaataaaacctttactattagatcagagattagtagcaggacttggaaatatttacgtagatgaagtcttgtgggcagcaaaaattcacccacagcgtttggctaatcaattgaccgaatctgaaacaagcttattacacaaggaaattattcgcattttaactttaggcatcgaaaaaggtggctccacgattagaacatataagaatgctcttggagaggacggtacgatgcaaaagtatttacaggtctatggtaaaactgggcaaccgtgtccaaggtgtggttgtttaattaagaagataaaagtaggagggagagggacgcattattgccctcggtgtcaatgctta

SEQ ID NO: 6768 - protein, 273 aa, Streptococcus agalactiae
MPELPEVETVRKGLERLVVNQEIASITIKVPKMVKTDLNDFMISLPGKTIQQVLRRGKYLLFDFGEMVMVSHLRMEGKYLLFPNKVPDNKHFHLYFKLTNGSTLVYQDVRKFGTFELVRKSSLKDYFTQKKLGPEPTADTFQFEPFSKGLANSKKPIKPLLLDQRLVAGLGNIYVDEVLWAAKIHPQRLANQLTESETSLLHKEIIRILTLGIEKGGSTIRTYKNALGEDGTMQKYLQVYGKTGQPCPRCGCLIKKIKVGGRGTHYCPRCQCL

SEQ ID NO: 6769 - DNA, 825 bp, Streptococcus pyogenes
atgccagaattaccagaagttgaaacggtccgacgaggacttgagactttagtgcttggccaagaaattgtggctgttacgcttaaagtgccaaaaatggttaaaaccgacttagagacgtttgccctgaccctacctggtcaaatcattcagtcagttggccgtcggggaaaatatttattaattgatttggggcaattagtgttggtatcacatttgcggatggaaggcaaatatttgctttttccagatgaggtccctgataacaaacactttcatgtcttttttgaattgaaaaatggttcgaccttggtttaccaagatgtgcgtaaatttggaacctttgatttgatagcaaaatctcaattatcagcgttttttgccaaacgaaaactaggccctgaaccaaagaaagagacctttaagttaaaaacctttgaggctgctctgctatcctcccaaaaacccataaaaccacatcttttagaccagaccttggttgctggtttagggaatatttatgtggacgaggtactttgggctgctaaggttcatccagaaactgcgtcttctaggttgaataaggcggagataaaacggctgcatgatgaaaccatacgaatcctagctttaggaattgaaaagggcggttcgaccgtccgtacttaccgtaatgctttgggagctgatggcaccatgcaggactatttgcaggtttatggtcaaactgggaaaccgtgtcctcgttgtggacaggctattgtcaaattaaaagttggaggaagggggacgcacatttgtccaaaatgccagaaaaaaagacta

SEQ ID NO: 6770 - protein, 275 aa, Streptococcus pyogenes
MPELPEVETVRRGLETLVLGQEIVAVTLKVPKMVKTDLETFALTLPGQIIQSVGRRGKYLLIDLGQLVLVSHLRMEGKYLLFPDEVPDNKHFHVFFELKNGSTLVYQDVRKFGTFDLIAKSQLSAFFAKRKLGPEPKKETFKLKTFEAALLSSQKPIKPHLLDQTLVAGLGNIYVDEVLWAAKVHPETASSRLNKAEIKRLHDETIRILALGIEKGGSTVRTYRNALGADGTMQDYLQVYGQTGKPCPRCGQAIVKLKVGGRGTHICPKCQKKRL

SEQ ID NO: 6771 - DNA, 606 bp, Streptococcus agalactiae
ttgccctcggtgtcaatgcttatgacaaaaataataggactgacaggagggatagcttctggaaagtcaacggtaacaaaaataatacgagaatcaggttttaaagtcatagatgcggatcaagtggttcataaattgcaagctaagggtgggaaactttaccaagctttattagaatggttgggtcccgagatacttgatgctgatggtgagttggatagaccaaagctttctcaaatgatttttgctaatccagacaatatgaagacatcagctaggctacaaaatagtatcattcgtcaagagttagcatgtcagcgcgaccaattaaaacaaacagaagagatatttttcatggatattcctttattgattgaagaaaagtatataaaatggtttgatgagatttggttggtatttgttgataaagaaaaacaattacaacgattaatggcccgtaacaactacagtcgagaagaagcagaattacgactttcacaccaaatgcctttaacagataaaaaaagtttcgctagtcttattattgacaataatggtgatttaataactttaaaagagcaaatattggatgctcttcaacgttta

SEQ ID NO: 6772 - protein, 202 aa, Streptococcus agalactiae
MPSVSMLMTKIIGLTGGIASGKSTVTKIIRESGFKVIDADQVVHKLQAKGGKLYQALLEWLGPEILDADGELDRPKLSQMIFANPDNMKTSARLQNSIIRQELACQRDQLKQTEEIFFMDIPLLIEEKYIKWFDEIWLVFVDKEKQLQRLMARNNYSREEAELRLSHQMPLTDKKSFASLIIDNNGDLITLKEQILDALQRL

SEQ ID NO: 6773 - DNA, 618 bp, Streptococcus pyogenes
ttgtccaaaatgccagaaaaaaagactatgattattggcatcacaggaggcattgcatcaggaaaatcgactgtggttaaggtcattagaaaagctggttatcaggtgattgatgcggatcaagtggtccatgacttgcaagaaaaaggcggtcgtctttacgaggctcttagagaagcttttgggaatcagattttaaaagcagatggtgagttagatcgcacaaagctgtcagaaatgcttttttcaaacccagataatatggcaacatcctcagccattcaaaatcaaatcattaaggaagaattggcggctaagcgtgaccacttagcacagagccaagccatttttttcatggatattccccttttaatggaattgggctaccaagactggtttgatgcgatttggctggtttatgtagatgctcagacacaattgcagcgcttaatggctagaaatcgtttagacaaaggaaaagcaaggcagcgaatagccagtcagttaccaatagaggaaaaaaagccctatgccagtctagtgattgataatagtggggatattgcagccttaataaagcaagtacaatctgcgttgttgttattagccaatccgagg

SEQ ID NO: 6774 - protein, 206 aa, Streptococcus pyogenes
LSKMPEKKTMIIGITGGIASGKSTVVKVIRKAGYQVIDADQVVHDLQEKGGRLYEALREAFGNQILKADGELDRTKLSEMLFSNPDNMATSSAIQNQIIKEELAAKRDHLAQSQAIFFMDIPLLMELGYQDWFDAIWLVYVDAQTQLQRLMARNRLDKGKARQRIASQLPIEEKKPYASLVIDNSGDIAALIKQVQSALLLLANPR

SEQ ID NO: 6775 - DNA, 699 bp, Streptococcus agalactiae
atggagttagtaattagagatattcgtaagcggtttcaggaaacagaggtcttgagaggagcaagttaccgattttattcaggtaaaataacaggggtcttaggtaggaatggtgctgggaaaacaactttatttaatatactttatggggatcttgcagctgacaacgggaccatttgtttattgaaggataatcacgagtatcctcttaccgataaggatattggtattgtttattccgaaaactaccttccagaatttttaacagggtatgaatttgtaaaattttacatggatttacatccttcagatgatttaatgacaatagatgattatttagattttatggaaataggacaaacagagcgtcatagaattatcaaaggatattctgatggaatgaagagtaagctctcattaatttgcctgatgatttctaagccaaaagtaattttactagatgagccactgactgcagttgatgttgtatcaagtattgcaataaaacgccttttgttggaattaagtgaggatcatattattatattatcaactcatataatggccttagcagaagatctatgtgatattgtggctgtattagacaaaggaaaactccaaacattagatattgatcgtaaacatgaacaattcgaagagcgtcttcttcaagtgttgaagggagatgaatatgacaag

SEQ ID NO: 6776 - protein, 233 aa, Streptococcus agalactiae
MELVIRDIRKRFQETEVLRGASYRFYSGKITGVLGRNGAGKTTLFNILYGDLAADNGTICLLKDNHEYPLTDKDIGIVYSENYLPEFLTGYEFVKFYMDLHPSDDLMTIDDYLDFMEIGQTERHRIIKGYSDGMKSKLSLICLMISKPKVILLDEPLTAVDVVSSIAIKRLLLELSEDHIIILSTHIMALAEDLCDIVAVLDKGKLQTLDIDRKHEQFEERLLQVLKGDEYDK

SEQ ID NO: 6777 - DNA, 111 bp, Streptococcus agalactiae
atgataagtcctgcaataccggtgtaccatgaaaaaaatggatatggagagaactgtttgccaagaagaaggaaaaagagagaaaggaagactcctataccaatccctaag

SEQ ID NO: 6778 - protein, 37 aa, Streptococcus agalactiae
MISPAIPVYHEKNGYGENCLPRRRKKRERKTPIPIPK

SEQ ID NO: 6779 - DNA, 1650 bp, Streptococcus agalactiae
atgaatatgacaagtaaagcattaatatggtctatattacagattgatagtgctagagcttataatagttttttatattaccttcagaaaatcccctggttgggaagaaaaatccctaaccgatggtttaaaaccgatgatataaaaggtgtagtactatttattcgtatcattttctttttcttaagaggttttggtcgttccataggttacgtactatattgttatgttttatcattttttgttagaagtggcatgaagcagttaaatattttaccgcaagaaggttttaccctaactttaacattgatggtgattacctctcttttaattgtcataaatttctatataaaacttatagaacctaatgatatgcaacaaactcatatgattcgccttttcagaattgagccatcgaggtatttccaatccgctgaacttttagaagccagtagtgaactattttttagaagtttgagctttggcatatttttccatttaaatcactttgctttttggcatggtttgacttttgctttatttttagcaggtagtcgccttggaatcaaggtgctctgtttacctttatatggtagaggtaaagaccaagagaatccagagtctttactaaatattttattttacttagggattggtataggagtcttcctttctctctttttccttcttcttggcaaacagttctctccatatccatttttttcatggtacaccggtattgcaggacttatcatatggttagttagttactatcgattaaaaacttattctaaacttaaccacttgacctaccttaccctaacgcatgagacgatgaaggagaaaattgcaaagattgataatatagagctgcttgggattgaaatgaaagatagggatataaatgtcagtgaactttctcccctgctatttgaaaatttatcaggtatttcatatttaaacgctatctttttaaaacggatgagtatatacttgcaaaggaaaattttggtacgtttagctgttttaagtgttctgtttggaatagaactccttttcctgctattttttaaagaaaagataaatattccgatgaatgagcatagtttttcaaaattcctatttttgagtgcagttccaggatatctaatatatatcggtgaatcctattcaaaattttgtttctatcatttggatcgtccattattaagatataatttctatcgtgaaagagaaaatatcttagcaaccttaaaaatacgtttcctttatagtataaaacttaatttccccatttttgtagctttaaacatatgttttggaacctattattttaattttttcacccctaagattgatcagattatcatattagtaattacacaagctatatcaatgattttatttagtttttactttttgtatctttatttcttcttacagccttttacagaaggattaaaatcaaagagtgctatgtataatattttaacctttattatatactatatgggatataagctatttacctttactaaatctataacgatgccaatattattagtaagcctaggaattatagttgttattttaattattggctatttagcagttgtagtatttgctccaaaaactttccgtttaaaaagt

SEQ ID NO: 6780 - protein, 550 aa, Streptococcus agalactiae
MNMTSKALIWSILQIDSARAYNSFLYYLQKIPWLGRKIPNRWFKTDDIKGVVLFIRIIFFFLRGFGRSIGYVLYCYVLSFFVRSGMKQLNILPQEGFTLTLTLMVITSLLIVINFYIKLIEPNDMQQTHMIRLFRIEPSRYFQSAELLEASSELFFRSLSFGIFFHLNHFAFWHGLTFALFLAGSRLGIKVLCLPLYGRGKDQENPESLLNILFYLGIGIGVFLSLFFLLLGKQFSPYPFFSWYTGIAGLIIWLVSYYRLKTYSKLNHLTYLTLTHETMKEKIAKIDNIELLGIEMKDRDINVSELSPLLFENLSGISYLNAIFLKRMSIYLQRKILVRLAVLSVLFGIELLFLLFFKEKINIPMNEHSFSKFLFLSAVPGYLIYIGESYSKFCFYHLDRPLLRYNFYRERENILATLKIRFLYSIKLNFPIFVALNICFGTYYFNFFTPKIDQIIILVITQAISMILFSFYFLYLYFFLQPFTEGLKSKSAMYNILTFIIYYMGYKLFTFTKSITMPILLVSLGIIVVILIIGYLAVVVFAPKTFRLKS

SEQ ID NO: 6781 - DNA, 1125 bp, Streptococcus agalactiae
atgccttttatggtattatatgtagaacaattaggagcacctagcaacaaagtagagtggtatgcaggcctatcagtatccttatcagccttgtcttcagctttagttgccccattatgggggcgcttagctgataaatatggtagaaaaccgatgatggtaagagcagggttgatgatgacttttactatgggaggtcttgctttcattcatagtgttacaggacttctgattttacgtatattaaacggcatttttgcaggctatgtacctaactctacagctttgatagcaagtcaagctcctcaagaggaatcaggatatgccttaggaaccttagcgacaggagtgactggaggtatgttaattggtccacttttagggggacttttagcagagtggtttggtattagggaagtttttttattagtgggaaccatattgttaatatctactttaatgaccatttttatggtaaaggaagatttcaaacccatttctaacgaagaaaccatgccaactacagaagtgttcaaaagcgttaaaagcttacaaattttaatagggctgtttgtaacaagcatgattattcaaatttctgcacaatcaattgcacctattttaacactttacattcgtcatttaggacagactgaaaacttgatgtttgtttccggattaattgtttctggtatgggattctctagtattctgagtagtccaaagctaggaagaatcggggatcgcataggcaatcatcgtttgctattattagctctactgtatagtttcctcatgtatgtcttatgttcattggcacagacttcattacagctaggggttattagattcctgtatggttttggaacaggtgccttgatgccgagtattaattcaatcttgactaaaattgctccaagacaaggtttatcaaggattttcagttataaccaaatgtttagcaatttaggacaagtattaggtccttttgtcggttcagcagtttctattcatttaggattccgatgggttttctttgtgactagcttcatcgttttagctaattttgtttggtgttttattaattttagaaaatatattagagttaaggaaattgttgagagt

SEQ ID NO: 6782 - protein, 375 aa, Streptococcus agalactiae
MPFMVLYVEQLGAPSNKVEWYAGLSVSLSALSSALVAPLWGRLADKYGRKPMMVRAGLMMTFTMGGLAFIHSVTGLLILRILNGIFAGYVPNSTALIASQAPQEESGYALGTLATGVTGGMLIGPLLGGLLAEWFGIREVFLLVGTILLISTLMTIFMVKEDFKPISNEETMPTTEVFKSVKSLQILIGLFVTSMIIQISAQSIAPILTLYIRHLGQTENLMFVSGLIVSGMGFSSILSSPKLGRIGDRIGNHRLLLLALLYSFLMYVLCSLAQTSLQLGVIRFLYGFGTGALMPSINSILTKIAPRQGLSRIFSYNQMFSNLGQVLGPFVGSAVSIHLGFRWVFFVTSFIVLANFVWCFINFRKYIRVKEIVES

SEQ ID NO: 6783 - DNA, 1191 bp, Streptococcus pyogenes
gtgaactggcgacaaaatctaaaagtggcttggcttggtaacttctttactggggcaagcttttcacttgttatgccttttatggctctatatgtggaaaatttaggtactccgacagaattagtagaatactatgctggtctggcagttgctgtgacggcacttgcttcagctttatttgctcctgtttgggggaagttggctgatcgttatggccgaaaacctatgatgctgcgagccagttttgttatgacatttacaatgggtggtttagctattattcctaatgtgttttggttactcattttgagattattaacaggtgtctctgcgggctatgtgccaaatgccactgccttgattgccagccaagccccaaaagaggagtcaggttatgctttaggcacattagcaacaggagtgacagcaggcgctttaattggtcctttactagggggaattttggcagagctattaggaattcgacaagttttcttattagttggtgtgatattatttttatgttctttaatgacagctgtttatgttaaagaagagtttaagccggttaggcgctttgagatgatacctacaaaagtcattttaaaacaggtaaaaagtccccagattatgcttggtttatttgtgactagtatgattattcaaatttcagctcaatcagtggcccccattttatcattgtatattcgtcatcttggtcaaactcacaacttaatgtttacttcaggcctggtagtttcggccatggggttttctagcttatttagcagttcttacttaggaaaattaggagatcgatttggcaatcatcggttattgttagccgctttgtgttatagctttatcatgtattttagcagtgccttagcgcagaccagttttcaattaggagtactacgctttgcttatgggtttggtgtgggcgctttgatgccaagtattaactctttactaactaagttaacaccaaaagaaggtatttctagagtatttgcctataatcaaatgtttagtaaccttggtcaagtcattggcccttttattggatcaaatgtggctgtagtgttaggctaccgttctgttttttatgtgactagtttgattgtgtttgttaatttaatatggagtttgattatatttcgaaaatatattaaagttaaggatattgtg

SEQ ID NO: 6784 - protein, 397 aa, Streptococcus pyogenes
VNWRQNLKVAWLGNFFTGASFSLVMPFMALYVENLGTPTELVEYYAGLAVAVTALASALFAPVWGKLADRYGRKPMMLRASFVMTFTMGGLAIIPNVFWLLILRLLTGVSAGYVPNATALIASQAPKEESGYALGTLATGVTAGALIGPLLGGILAELLGIRQVFLLVGVILFLCSLMTAVYVKEEFKPVRRFEMIPTKVILKQVKSPQIMLGLFVTSMIIQISAQSVAPILSLYIRHLGQTHNLMFTSGLVVSAMGFSSLFSSSYLGKLGDRFGNHRLLLAALCYSFIMYFSSALAQTSFQLGVLRFAYGFGVGALMPSINSLLTKLTPKEGISRVFAYNQMFSNLGQVIGPFIGSNVAVVLGYRSVFYVTSLIVFVNLIWSLIIFRKYIKVKDIV

SEQ ID NO: 6785 - DNA, 582 bp, Streptococcus agalactiae
atgtcttcagaagaaaaatacattatggcgattgaccagggaacaacaagctctcgagcaattatttttaataaaaaaggtgaaaaaattgcgagtagccaaaaagaatttccccaaatttttcctcaagcaggctgggtagagcataatgctaatcagatttggaattctgttcaatctgtcattgctggagcttttattgaatcaagcatcaaacctggacagatagaggctattgggattaccaatcaacgtgaaacaactgttgtttgggataaaaaaacaggtcttccaatttataatgctattgtatggcaatcgcgacaaacagccccgattgctgatcaattgaagcaagaaggtcatactaacatgattcatgaaaaaactggtcttgtcattgatgcttacttctcagcaacaaaagttcgttggattttagaccacgttcctggagcacaggaacgtgctgaaaaaggagagttgctttttggaacaattgatacttggttagtttggaagttaactgatggtctcgtccatgttacagactattcaaatgctggctcgtacgatgcttta

SEQ ID NO: 6786 - protein, 194 aa, Streptococcus agalactiae
MSSEEKYIMAIDQGTTSSRAIIFNKKGEKIASSQKEFPQIFPQAGWVEHNANQIWNSVQSVIAGAFIESSIKPGQIEAIGITNQRETTVVWDKKTGLPIYNAIVWQSRQTAPIADQLKQEGHTNMIHEKTGLVIDAYFSATKVRWILDHVPGAQERAEKGELLFGTIDTWLVWKLTDGLVHVTDYSNAGSYDAL

SEQ ID NO: 6787 - DNA, 2037 bp, Streptococcus agalactiae
atgactaaagatttattattggagcttggccttgaagagttgccagcttatgttgtgacaccgagtgagaagcaattgggccaaaaaatggtcaagtttttagaggatcatcgtttatcatttgaaactgttcaaattttttcaactccacgtcgtttggctgttcgtgtgaaaggattggcagaccagcagacagatttaacagaagatttcaagggtccttctaagaaaattgctttggatgcagaagggaatttttctaaagcagcccaaggttttgttcgcggaaaaggtttaagtgttgatgatatcgaatttcgtgaagttaagggagaagaatatgtttatgtcactaagcatgaaactggaaaaagtgcgattgatgttttagcgagtgtgacagaggtattaacagaattgactttcccagtgaacatgcattgggcaaataatagttttgaatatattcgtccagttcacactttagtggtattattagatgatcaagccttagagctagacttccttgatattcattcagggcgtattagtcgaggacaccgtttcttgggttctgacactgaaatttcatctgccagttcgtatgaagatgacttgcgacaacaatttgttattgctgatgcaaaagaacgccagcaaatgattgttaatcaaattcatgctatcgaagaaaagaaaaatatttcagttgaaattgacgaagatttactaaatgaagtgcttaatttagttgagtatccgacagcattcttgggttcttttgacgagaaataccttgatgtacctgaagaagttttagtcacttcaatgaaaaatcatcaacgctattttgttgttcgcgacagggatggaaaattgttaccaaactttatttctgtgcgtaatggaaatgctgagcatatcgaaaatgttataaaaggtaatgaaaaagttttagtggctcgtcttgaagatggtgaattcttctggcaagaagatcagaaacttaatattgcagatttagttgagaaattaaaacaagtaactttccatgaaaaaattggttcactttatgaacatatggatcgtgtaaaagttatttcacaatatttggctgagaaggcagatctttctgatgaagaaaaattagctgtgcttcgagctgcaagtatttataaatttgacctcttaactggaatggttgatgagtttgatgaattacaaggtattatgggtgagaaatatgccttacttgcaggggaacagcccgcagtagcagcagcgatacgtgaacattatatgccgacatctgcagatggagagcttccagaaaccagagttggtgcaattctagctttagctgataaatttgacaccttactttcattcttctcagttggtttgattccaagtggttcaaatgatccatatgctcttcgtcgagctactcaggggattgtccgtattttggaagcttttggttgggatatcccacttgatgaattagtaactaacctttatggtctatcgtttgctagtttagattatgctaatcaaaaagaggtcatggcctttatttcagctcgtattgaaaagatgattggctctaaggtccctaaagatattcgagaagccgttttagaatcagacacttatattgttagccttattctagaagctagtcaagcattggtgcaaaagagcaaggatgctcaatataaagtttccgttgaaagtttgtcacgtgcatttaatttagctgaaaaagttactcattctgtattggtggactcttcattgtttgaaaataatcaagagaaggcgctatatcaagctattttgtcacttgaactgactgaggatatgcatgacaacttagataagcttttcgcacttagtccaattattaatgatttctttgataatacaatggtaatgacagatgatgaaaaaatgaaacaaaatcgtctggctatactcaatagccttgttgcaaaggcaagaacagtcgctgcttttaacttattaaacacaaaa

SEQ ID NO: 6788 - protein, 679 aa, Streptococcus agalactiae
MTKDLLLELGLEELPAYVVTPSEKQLGQKMVKFLEDHRLSFETVQIFSTPRRLAVRVKGLADQQTDLTEDFKGPSKKIALDAEGNFSKAAQGFVRGKGLSVDDIEFREVKGEEYVYVTKHETGKSAIDVLASVTEVLTELTFPVNMHWANNSFEYIRPVHTLVVLLDDQALELDFLDIHSGRISRGHRFLGSDTEISSASSYEDDLRQQFVIADAKERQQMIVNQIHAIEEKKNISVEIDEDLLNEVLNLVEYPTAFLGSFDEKYLDVPEEVLVTSMKNHQRYFVVRDRDGKLLPNFISVRNGNAEHIENVIKGNEKVLVARLEDGEFFWQEDQKLNIADLVEKLKQVTFHEKIGSLYEHMDRVKVISQYLAEKADLSDEEKLAVLRAASIYKFDLLTGMVDEFDELQGIMGEKYALLAGEQPAVAAAIREHYMPTSADGELPETRVGAILALADKFDTLLSFFSVGLIPSGSNDPYALRRATQGIVRILEAFGWDIPLDELVTNLYGLSFASLDYANQKEVMAFISARIEKMIGSKVPKDIREAVLESDTYIVSLILEASQALVQKSKDAQYKVSVESLSRAFNLAEKVTHSVLVDSSLFENNQEKALYQAILSLELTEDMHDNLDKLFALSPIINDFFDNTMVMTDDEKMKQNRLAILNSLVAKARTVAAFNLLNTK

SEQ ID NO: 6789 - DNA, 639 bp, Streptococcus agalactiae
atgaacacactcattgttaatagtcatcctgatttttcgaatccgtactcatttacaactattctacaagaaaagtttattgaactttataatgagcattttcctaaccatcagttatctattttaaatttatatgattgtgttttgccagaaattacgaaagaagtactactttcgatttggtctaaacaaagaaagggtttggaattaacagccgatgagattgttcaagctaaaatctctaaagatttacttgaacagtttaagtcacatcaccgtattgtctttgtttctccaatgcacaattacaatgtgactgctagagcaaaaacttatattgataatatttttattgcaggtgagactttcaagtacactgaaaatggttcagtcggattaatgacagatgactatcgtctgcttatgttagaatctgcgggttctatttattctaaaggacagtatagtccatatgaatttcctgttcattatttaaaagctatctttaaagattttatggcttttgatgatttctgtgttgttcgtgcagaaggtaccgatattttagataggcaagttgttcttgataagatgaatcaggatttaagagaagcatttgaagcgttttacagtaaggag

SEQ ID NO: 6790 - protein, 213 aa, Streptococcus agalactiae
MNTLIVNSHPDFSNPYSFTTILQEKFIELYNEHFPNHQLSILNLYDCVLPEITKEVLLSIWSKQRKGLELTADEIVQAKISKDLLEQFKSHHRIVFVSPMHNYNVTARAKTYIDNIFIAGETFKYTENGSVGLMTDDYRLLMLESAGSIYSKGQYSPYEFPVHYLKAIFKDFMAFDDFCVVRAEGTDILDRQVVLDKMNQDLREAFEAFYSKE

SEQ ID NO: 6791 - DNA, 915 bp, Streptococcus agalactiae
atgatgtctaagaaattaacttttcaagaaattattctaactttacaacagttttggaatgaccaaggctgtatgttaatgcaagcttatgataatgagaaaggagcagggacaatgagcccttatactttcttacgtgctataggccctgagccttggaatgctgcatacgttgaaccatcacgtcgtccagctgacggccgctatggcgaaaatccaaaccgtctttaccaacatcatcaatttcaagtggtaatgaagccttcgccgtcaaatattcaagaactttatttgaagtctttggaattactaggtatcaatccacttgagcatgatatccgttttgttgaagataactgggaaaatccatctacaggttcagctggattaggttgggaagtttggcttgatggaatggaaataacacaatttacttatttccaacaagtaggtggacttcaaacaggtcctgtaacttctgaagttacttatggactagagcgtttagcctcttatattcaagaggtagattctgtttatgatattgagtgggcaccaggtgttaaatatggtgaaatctttactcagccagagtatgagcattcaaaatattcatttgagatatcagaccaagtaatgttacttgaaaactttgagaaatttgaaagagaagcaaaacgtgctttagaagaaggacttgttcatccagcttatgactacgtccttaaatgttcacacacctttaatttattagatgcacgtggagcagtatctgttactgagcgtgcaggctatattgcacgtatccggaatttagcacgtgttgttgctaaaacctttgttgccgaacgtaaaaaacttggtttcccacttttggatgaggaaactcgtatcaaattacttgctgaggaagac

SEQ ID NO: 6792 - protein, 305 aa, Streptococcus agalactiae
MMSKKLTFQEIILTLQQFWNDQGCMLMQAYDNEKGAGTMSPYTFLRAIGPEPWNAAYVEPSRRPADGRYGENPNRLYQHHQFQVVMKPSPSNIQELYLKSLELLGINPLEHDIRFVEDNWENPSTGSAGLGWEVWLDGMEITQFTYFQQVGGLQTGPVTSEVTYGLERLASYIQEVDSVYDIEWAPGVKYGEIFTQPEYEHSKYSFEISDQVMLLENFEKFEREAKRALEEGLVHPAYDYVLKCSHTFNLLDARGAVSVTERAGYIARIRNLARVVAKTFVAERKKLGFPLLDEETRIKLLAEED

SEQ ID NO: 6793 - DNA, 915 bp, Streptococcus pyogenes
atgtctaaaaaacttacctttcaagaaatcatcttgaccttacaacaatattggaatgatcagggttgtatgctcatgcaagcctatgacaatgaaaaaggagctgggaccatgagtccttacacgttcttacgtgctataggtcctgagccatggaatgcggcttatgtagagccatcacgtcgtcctgcagatggccgttacggagaaaacccaaatcgtctttaccaacaccaccaatttcaagtggtcatgaaaccatcaccatcaaatattcaagaactttaccttgcttctttggaaaaattgggcatcaatcctttagaacatgatattcgttttgttgaagataactgggaaaacccatcaacaggatcagcagggcttggttgggaagtttggcttgatggaatggaaatcacacaatttacgtatttccaacaagttggtggccttgcgacatctccagtgacagcagaagtaacttatggtcttgagcgcttagcttcctatattcaagaagtggattcggtctatgatattgagtgggcaccaggtgttaaatatggtgaaatcttcttacaacctgagtatgaacattcaaaatattccttcgaaatatcagaccaagacatgctgcttgaaaactttgaaaagtttgaaaaagaagcctcgcgtgccctagaagaaggtttggttcacccagcttatgattacgtgctcaaatgttctcatacgtttaacctgctggatgcccgtggcgctgtttccgtcacagaacgtgcaggctacattgctcgtatccgtaatttggcacgtgtcgttgctaagacctttgttgcagaacgcaagaagcttggatttccactgttggatgaagcaacacgcgcaatcttgctagctgaagatgacgaa

SEQ ID NO: 6794 - protein, 305 aa, Streptococcus pyogenes
MSKKLTFQEIILTLQQYWNDQGCMLMQAYDNEKGAGTMSPYTFLRAIGPEPWNAAYVEPSRRPADGRYGENPNRLYQHHQFQVVMKPSPSNIQELYLASLEKLGINPLEHDIRFVEDNWENPSTGSAGLGWEVWLDGMEITQFTYFQQVGGLATSPVTAEVTYGLERLASYIQEVDSVYDIEWAPGVKYGEIFLQPEYEHSKYSFEISDQDMLLENFEKFEKEASRALEEGLVHPAYDYVLKCSHTFNLLDARGAVSVTERAGYIARIRNLARVVAKTFVAERKKLGFPLLDEATRAILLAEDDE

SEQ ID NO: 6795 - DNA, 2328 bp, Streptococcus agalactiae
atggcaggcgcaaaagcatttccaaaattaatcaaaacaatctcaaatttggagagccacaggcaattaagatttgacgataatggaagtctttctcttcaaaagaaagaagctaagaaaaaggaaatcacagtaaggggtctttttagagcaaataaagcaggatttggttttcttagtattgaccaagacgaagatgatatgtttatcggaaaaaacgatattgcttatgctattgatggtgacacggtagaagctgttgtaaagaaaccagcggaccgtcttaacgggactgcagcagaagcgcgtgttgttaatattgttgaacgtagtttaaagacgcttgttggtaagtttgtcttagacgatgagcgccctaaatacgcaggatatatcaaatcgaaaaatcaaaaaatcaatcaaaagatttatatacgcaaagaaccggtcgttttagacggaacagaaattatcaaagtagatattgataaatatccgacacgaggacatgattacttcgtagcaagtgttcgtgatatcgttggacatcaaggagatgttggtattgatgttttagaagtcttggaaagtatggatatcgtctcagaatttcctgaggacgttattgcagaagccaatgctatcccagatgctccaacggagaaagatttaattgggcgtgttgatttacgtcaagaggtcactttcactattgatggagcggacgccaaagatttagacgatgctgtgcatattaaattactggataatggtcattttgaacttggagttcatatcgcagatgtatcatactacgttactgaaggctctgccttaaatcgtgaagcacttagtcgtggtacgtccgtatatgtcacagatcgcgttgtaccaatgttaccagagcgtctatctaacggtatatgttcattaaatccaaatcttgatcgtttaacgcagtcttgtattatggaaattgaccaaaatgggagagttgttaatcatcaaattacacagtcagtgattaataccacttatcgtatgacttataccgctgtaaatgatattattgctggcgatgaggaaatctgctcagaatatgagtctattgtgtcctcagtacagcatatggtcactttacaccatactttggaagctatgcgtacgcgtcgtggagcgctgaattttgacacatctgaagcaaaaattatggttaatgataagggaatgccagttgatattgttattcgcaacagaggcattgctgaacgcatgattgagtcatttatgttggcggcaaatgaaacggttgctgaacattatgctcgtctaaaactgccatttatttatcgtatacacgaagagcctaaagctgaaaaattacaaaaattcatcgattatgcttctgttttcggtgttcagattcaaggaacagcaactaaaatcacccaatctgctttacaggactttatgaaaaaagtacaagggcagccaggaagtgaagtgttatctatgatgttattgcgctcgatgcaacaagctagatattctgaacacaaccatggacattatggacttgctgcggaatattacactcactttactagccccattcgacgttatccagacttgttagttcatcgtatgattcgtgattatgatgataaagcgatggataaagctgatcattttgctaaccttatcccagaaattgcaactcaaacgtctagtcttgagagacgtgccattgatgctgaacgtattgtagaggcaatgaagaaagccgaatatatggaagaatatgttggtgaggaatttgaaggtgtggttgcaagcgttgttaaatttggtatgtttgtagaattaccaaatactattgaaggattgattcacgtaacgaccttgcctgaatattatcactttaatgaacgtacgctgacgcttcaaggtgagaaatctgggaaagttttccgtgttggtcaacaaattaaggttaagttgattcgttctgataaggaaactggtgatatcgattttgattatttaccatcagattttgatattgttgaaaaggtaagtaaaagttcgcgtgagggtcgtcctaatagaagttctaaacgagaacatcagcatagaatttctgatcgtgataataagaataaaaatacatctaagaaaaaagcatctcgaaaacccaaaaggaactcggatagcaaatcacatcatcataaagacgatagaacaacaggttcaaccaagaaaaaaacgaaaaaacctttctataaaggcgttgctaagaaaggtcagaaacggaaatctaagaaaggt

SEQ ID NO: 6796 - protein, 776 aa, Streptococcus agalactiae
MAGAKAFPKLIKTISNLESHRQLRFDDNGSLSLQKKEAKKKEITVRGLFRANKAGFGFLSIDQDEDDMFIGKNDIAYAIDGDTVEAVVKKPADRLNGTAAEARVVNIVERSLKTLVGKFVLDDERPKYAGYIKSKNQKINQKIYIRKEPVVLDGTEIIKVDIDKYPTRGHDYFVASVRDIVGHQGDVGIDVLEVLESMDIVSEFPEDVIAEANAIPDAPTEKDLIGRVDLRQEVTFTIDGADAKDLDDAVHIKLLDNGHFELGVHIADVSYYVTEGSALNREALSRGTSVYVTDRVVPMLPERLSNGICSLNPNLDRLTQSCIMEIDQNGRVVNHQITQSVINTTYRMTYTAVNDIIAGDEEICSEYESIVSSVQHMVTLHHTLEAMRTRRGALNFDTSEAKIMVNDKGMPVDIVIRNRGIAERMIESFMLAANETVAEHYARLKLPFIYRIHEEPKAEKLQKFIDYASVFGVQIQGTATKITQSALQDFMKKVQGQPGSEVLSMMLLRSMQQARYSEHNHGHYGLAAEYYTHFTSPIRRYPDLLVHRMIRDYDDKAMDKADHFANLIPEIATQTSSLERRAIDAERIVEAMKKAEYMEEYVGEEFEGVVASVVKFGMFVELPNTIEGLIHVTTLPEYYHFNERTLTLQGEKSGKVFRVGQQIKVKLIRSDKETGDIDFDYLPSDFDIVEKVSKSSREGRPNRSSKREHQHRISDRDNKNKNTSKKKASRKPKRNSDSKSHHHKDDRTTGSTKKKTKKPFYKGVAKKGQKRKSKKG

SEQ ID NO: 6797 - DNA, 2331 bp, Streptococcus pyogenes
atgatgaaagaaagaattatgacttacctcaaggagcatggcaagtccaatgtgaacgacttggctgcggccttggagatggctggagctaagcattttcccagccttattaaaaccatttccaaaatggaaagtcagagcctgttacggttttcagatgatggcagtctggctcttagaaaagagcgtgaaaagaaaaaagaacctactgttcagggtgtttttcgtgccaataaagcaggctttggtttcttacatgtggatgagaatgaagatgacatgtttatcggtcgtaatgatgttgggtatgctattgatggtgatactgtcgaagtagtggttaaaaagccagcagaccgtctcaaaggcacagcggctgaagctaaggtcgttgctattgttgaccgttctttaaaaacagctgttggaacctttattttagatgatgacaaaccaaaatatgctggttatatcaggtccaaaaaccaaaagattcaacaaaaaatctatatcaaaaaagaacctgttgtgcttaaaggcactgaaatcatcaaggttgatattgataaatacccgatacgcgggcacgattattttgtagccagtgtgcgtgatatcgtaggccatcaaggagacgttggaattgatgtcctagaagtccttgaatcgatggatatcgtgtcagaatttccagcagaagttttagctgaggccaatgctatttcagaagcaccaactgctaaagatttaataggccgtgtggatttgcgtcaagaaaccaccattactattgatggtgcggacgccaaagacttagatgatgctatccatattaagctattggataacgggaattatgaacttggggtacatattgcggatgtctcatattatgtgacagaaggatctgcccttgataaggaagctatcgcccgtggcacttctgtctatgtcaccgatcgtgtggttccgatgttaccagagcgtttgtcaaatggcatctgctctttgaaccctaacattgatcgtttgacccagtcagccttgatggaaattaattctcaagggcatgtggtcaattatcaaatctgtcaatcagtgattaagacaacttaccgaatgacgtatagtacggtcaatgacatgattgcaggagatgaagaagcgctccaagaattcgctagcattgctgatgatgtgaccctcatggtggctttgcataggattttggaagctatgcggtcaaaacgaggcgccttgaattttgatacgcaagaagcaaaaattattgttaatgacaaaggaatgccggttgatgtggtgcttcgtcaaaggggcattgcggagcggatgattgaatcctttatgctagcagccaatgagtgtgttgcggagcattttgcaaaagctaagttaccgtttatctaccgtattcacgaagaaccaaaggccgaaaaacttcaacaatttattgattacgctagcacctttggtattcacattcaaggaacagccaacaagatttctcaggaagccttgcaagcctttatggcaaaagtcgaaggtcaaccaggagcagaagtgctcaacatgatgcttctacgttccatgcaacaagcgaggtattctgaacataatcatggccattacggtttggccgcagaatattacactcactttaccagtccgattcgtcgttaccctgacttattggttcaccgcatggttcgtgagtacaatcaacctagtcaagaaaagcgcgaccattttgctcagatcattccagaattagcaacatcttcttcacagttagagcgtcgtgctattgatgctgaacgcgtggttgaagccatgaaaaaagctgagtatatggcagagtatgtcggcgaagaatttgacggtatcgtttccagtgtcgttaaatttggtttttttgtagaattgccaaatacgattgaaggtttggttcatatcactagcttaccggaatactatcactttaatgaaagaacgctaagccttcaaggtgaaaaatcaggtaaggtctttaaggtcggtcaacctattcgtgtgaaattggttaaggctgacaaggaaactggtgacattgactttgagtatttacctagcgactttgatgtggttgaaaaaatcaagatgtcggataaagctagtcgacgagatcgccgtaaatcctcaaaatcatctaaagggacaaagaaaaaagaacctaaagaagtagccaaggcaaaaaccaagggtaaaactaaaaaagggtctaaaaaaccattttacaaagaacaagcaaaaaagaagagtcgtaaaaggagt

SEQ ID NO: 6798 - protein, 777 aa, Streptococcus pyogenes
MMKERIMTYLKEHGKSNVNDLAAALEMAGAKHFPSLIKTISKMESQSLLRFSDDGSLALRKEREKKKEPTVQGVFRANKAGFGFLHVDENEDDMFIGRNDVGYAIDGDTVEVVVKKPADRLKGTAAEAKVVAIVDRSLKTAVGTFILDDDKPKYAGYIRSKNQKIQQKIYIKKEPVVLKGTEIIKVDIDKYPIRGHDYFVASVRDIVGHQGDVGIDVLEVLESMDIVSEFPAEVLAEANAISEAPTAKDLIGRVDLRQETTITIDGADAKDLDDAIHIKLLDNGNYELGVHIADVSYYVTEGSALDKEAIARGTSVYVTDRVVPMLPERLSNGICSLNPNIDRLTQSALMEINSQGHVVNYQICQSVIKTTYRMTYSTVNDMIAGDEEALQEFASIADDVTLMVALHRILEAMRSKRGALNFDTQEAKIIVNDKGMPVDVVLRQRGIAERMIESFMLAANECVAEHFAKAKLPFIYRIHEEPKAEKLQQFIDYASTFGIHIQGTANKISQEALQAFMAKVEGQPGAEVLNMMLLRSMQQARYSEHNHGHYGLAAEYYTHFTSPIRRYPDLLVHRMVREYNQPSQEKRDHFAQIIPELATSSSQLERRAIDAERVVEAMKKAEYMAEYVGEEFDGIVSSVVKFGFFVELPNTIEGLVHITSLPEYYHFNERTLSLQGEKSGKVFKVGQPIRVKLVKADKETGDIDFEYLPSDFDVVEKIKMSDKASRRDRRKSSKSSKGTKKKEPKEVAKAKTKGKTKKGSKKPFYKEQAKKKSRKRS

SEQ ID NO: 6799 - DNA, 465 bp, Streptococcus agalactiae
atggttaaaggtcaaggaaacgttgtagcacaaaataaaaaagcgcatcacgactatactatcgttgaaacaatagaagcaggaattgttttgacaggaacagaaatcaaaagtgtccgcgcagcgcgtattacattgaaagatggatatgcacaaataaaaaatggtgaagcgtggttgattaatgttcatattacaccatatgatcaaggtaacatatggaatcaagatcctgatcgtacacgaaagttattactaaaaaaacgtgagattgaaaaaatatcaaatgaactgaaagggactggtatgactctggtacctctaaaagtttacttaaaagatggttttgctaaagttctattgggtttggcaaaaggaaaacatgattatgataagcgagagtctatcaaacgtcgtgagcaaaaccgtgatattgcccgtcagttaaaaaactataattcacga

SEQ ID NO: 6800 - protein, 155 aa, Streptococcus agalactiae
MVKGQGNVVAQNKKAHHDYTIVETIEAGIVLTGTEIKSVRAARITLKDGYAQIKNGEAWLINVHITPYDQGNIWNQDPDRTRKLLLKKREIEKISNELKGTGMTLVPLKVYLKDGFAKVLLGLAKGKHDYDKRESIKRREQNRDIARQLKNYNSR

SEQ ID NO: 6801 - DNA, 465 bp, Streptococcus pyogenes
atggcaaaaggtgaaggtcatatactggcgcaaaataaaaaggctagacatgattatcacattgttgaaaccgttgaagcagggattgtcttaacgggaactgagattaaaagtgttcgtgcagctcgtattcaactgaaagatggctttgcccaaattaagaatggggaagcgtggttggtcaacgtgcatattgcaccttttgaacaaggtaatatttggaacgctgatcctgaacgaacccgcaaactgctgctcaaaaaacgtgagattacgcatctagcaaatgaacttaaaggatctggcatgaccttagttcctctcaaagtttacctcaaggatggctttgctaaagttctgattggtctagctaaagggaaacacgagtatgacaaacgcgaaaccattaaacgccgtgatcaggaaagagatattaaaaaacaaatgaaacactacaatgcaagg

SEQ ID NO: 6802 - protein, 155 aa, Streptococcus pyogenes
MAKGEGHILAQNKKARHDYHIVETVEAGIVLTGTEIKSVRAARIQLKDGFAQIKNGEAWLVNVHIAPFEQGNIWNADPERTRKLLLKKREITHLANELKGSGMTLVPLKVYLKDGFAKVLIGLAKGKHEYDKRETIKRRDQERDIKKQMKHYNAR

SEQ ID NO: 6803 - DNA, 99 bp, Streptococcus agalactiae
atggttgctccaatagccccgatgtatgttgaatcttgcaagaagagagaaacgaatacaaagaggaagaagagaagtgtgattggtgaaaggattttg

SEQ ID NO: 6804 - protein, 33 aa, Streptococcus agalactiae
MVAPIAPMYVESCKKRETNTKRKKRSVIGERIL

SEQ ID NO: 6805 - DNA, 1101 bp, Streptococcus agalactiae
ttggggatttttctaacactttcttattggatttccctaatatttatcggtatggcagagattacagccgtaggagagtatgttcaattttggttccctgaatggccatcctggattatccaaattgtttttttagctatcctaagttctatcaacttaattgctgtaaaagcattcggagaaaccgagttttggtttgctatgataaaagttattgcaattcttggtttaatagcaaccggtatctttatggtattgacaaactttgacaccggtcacggataccatgcttcaatctcaaatatcaccaatcattttgaatggttccctaaaggtaaattgaatttcttcatggctttccaaatggtattctttgcttatttagctattgaatttgtcggagtaacaacttctgaaacagctaatccacgtaaagttttaccaaaagcaatccaagaaattccgatgcgtattattttattctacgcaggttcattattagcaattatggccatcttcccatggcaacagttaccagttaatgagtcacctttcgttacagtattcaaactagctgggattaagtgggctgccgctttgattaactttgttgtcctaacgtctgcagcatctgctcttaattctactttgtactcaacagggcgtcatttattccaattggctaatgaatcaccaaatgctcttacaaaagcgttaaaattagaccaattatctcgtcaaagcgttccaagtcgagctattattgcatcagctgtaatcgttggagcttcagcacttatcagtgttttacctggtatttcagatgccttctccttaattactgcatcatcttctggtgtttacatttctatctatgttcttattatgattgcacattggaaatatcgtaaatcacctgattttatggaagatggttataaaatgcctgcctacaaaatcctttcaccaatcacacttctcttcttcctctttgtattcgtttctctcttcttgcaagattcaacatacatcggggctattggagcaaccatctggattattggatttggtttatatagtcacttcaaacataaatcacat

SEQ ID NO: 6806 - protein, 367 aa, Streptococcus agalactiae
MGIFLTLSYWISLIFIGMAEITAVGEYVQFWFPEWPSWIIQIVFLAILSSINLIAVKAFGETEFWFAMIKVIAILGLIATGIFMVLTNFDTGHGYHASISNITNHFEWFPKGKLNFFMAFQMVFFAYLAIEFVGVTTSETANPRKVLPKAIQEIPMRIILFYAGSLLAIMAIFPWQQLPVNESPFVTVFKLAGIKWAAALINFVVLTSAASALNSTLYSTGRHLFQLANESPNALTKALKLDQLSRQSVPSRAIIASAVIVGASALISVLPGISDAFSLITASSSGVYISIYVLIMIAHWKYRKSPDFMEDGYKMPAYKILSPITLLFFLFVFVSLFLQDSTYIGAIGATIWIIGFGLYSHFKHKSH

SEQ ID NO: 6807 - DNA, 684 bp, Streptococcus agalactiae
atgatagaattcttttctaatatcagaacagagattccgcagatgcctttacttatccatagtttgattttatctgtcttaccttttctgatgtggctgactttggttaatagagataagcctttgtataaaactatttggagtatccttttaggacttcagttaattacgatttatacttggtttttctgggcaaaattgcctttatctgaaagtcttcccctttaccattgtcgaataggcatgtttgtcgttctcttggcgaggcctggaatattaaaggattatttcgcattgttaggagtagtaggtggagtattggcaatgattcacccagacttttacccttaccagtttctacatgtgactaatattttcttctttattggacattttgctttatttgtccttagtttactacatctgatgacacagtccaatttggacaaattaaatccaaaattgattatacaactaacgcttctcattaatatgtctttgatttttattaacctcttgactggggggaattatggctttatgatgaagacaccaatactaggaataacaaatccctttttaaacctttttatagtgacaactctattaagttttctcgtcctatttgttaaacaaattttccaaaaagtgagaatgagagctagtcttaaaacagaagaatct

SEQ ID NO: 6808 - protein, 228 aa, Streptococcus agalactiae
MIEFFSNIRTEIPQMPLLIHSLILSVLPFLMWLTLVNRDKPLYKTIWSILLGLQLITIYTWFFWAKLPLSESLPLYHCRIGMFVVLLARPGILKDYFALLGVVGGVLAMIHPDFYPYQFLHVTNIFFFIGHFALFVLSLLHLMTQSNLDKLNPKLIIQLTLLINMSLIFINLLTGGNYGFMMKTPILGITNPFLNLFIVTTLLSFLVLFVKQIFQKVRMRASLKTEES

SEQ ID NO: 6809 - DNA, 693 bp, Streptococcus pyogenes
atggatttttttgcaattgaccccatcggactgcctcatacctcacttatcttttacttgtcgtcactcttgatagcgcttttgcttgtttttttgacttttcaagcatataggttaaaatctcatcgttattttttcttgtttttacagttatctcaggtgattggcttatacacatggtacgtgttaagggggtttcctttagatgaagctttgccgttgtatcattgtcgcatcgctatgttagctatcttttttctacctgatcgtaacaagtttaagcaattatttatggttttggggataggtggaacattccttgcacttttatcgccagatctttatccgtttagattatggcatgtagcaaatgtctcgttttattttggtcattatgctttgttagtgaatggtttgatttacctcttgcgtttttacgatgccagtcagttaagactgctatcagtagtacgctatttagcaactgttaactttcttcttctgttggtcagtttagccacgaaaggaaattatggttttgtgatggatattccagtgattcatacgcgtcatttgctacttaattttgtgatcgttacaagtggcttgacttttatggttaaaataaccgaatatttttaccttaaatttggtgaagctcaacagctggcacttgctttctctaaagaaaag

SEQ ID NO: 6810 - protein, 231 aa, Streptococcus pyogenes
MDFFAIDPIGLPHTSLIFYLSSLLIALLLVFLTFQAYRLKSHRYFFLFLQLSQVIGLYTWYVLRGFPLDEALPLYHCRIAMLAIFFLPDRNKFKQLFMVLGIGGTFLALLSPDLYPFRLWHVANVSFYFGHYALLVNGLIYLLRFYDASQLRLLSVVRYLATVNFLLLLVSLATKGNYGFVMDIPVIHTRHLLLNFVIVTSGLTFMVKITEYFYLKFGEAQQLALAFSKEK

SEQ ID NO: 6811 - DNA, 102 bp, Streptococcus agalactiae
gtgtggcttaggtttaatatcagcagcttcaccaatggcacaagatttagcaggctattccgcagaatctgcagccttattagtaggggtactagggatatt

SEQ ID NO: 6812 - protein, 34 aa, Streptococcus agalactiae
MWLRFNISSFTNGTRFSRLFRRICSLISRGTRDI

SEQ ID NO: 6813 - DNA, 1218 bp, Streptococcus agalactiae
ttgaaaaatttaaatcgttatgtagttgcggtttctggagtcgttttacatttaatgctaggatcaacttatgcttggagtgtgtttcgtaacccaatcatctcagagactggttgggatatttcatcagtttcattcgcttttagtttggctattttttgtctaggaatgtctgcagcttttatgggacacttagtagagcgttttggtcctaggataatgggaatgatttctgctattttatatggagcagggaatgtgttaacaggtttagccattgaaactcagcagttatggttactgtatgttgcatacggtattttaggaggaatcggacttggttcaggttatattactccagtatcgactattattaaatggtttcctgataggaggggactagcaacaggattcgctattatgggatttggctttgcttctttagtaacaagtccgcttgcacaatccttaatgattaggattggtgtaggtaaaacattttatattttgggattagtatatttttttgtcatgatgattgcctcacaatttattaaacaaccacctcaggaaaaaataactattttgactcacgacggtaaaaagaatgctatgaattcacaaattattactggattaaaagcaaatgctgctataaaatcaaaaaccttttacatcatttggttgactttgtttattaatatttcgtgtggcttaggtttaatatcagcagcttcaccaatggcacaagatttagcaggctattccgcagaatctgcagccttattagtaggggtactagggatatttaacggttttggacgtctgttatgggcaagtctctctgactacattggacgcccgttgacctttataatattatttattgtgaactttattatgacttctagtttatttttgtcattcaatgctattgtatttgcaatagcaatgtctattttaatgacttgttatggtgcaggcttttccttattacctgcttatctaagtgatatttttggaacaaaggaattagctactttacatggttatagtttaacagcatgggcaatagcaggtctgtttgggcccctattgttatcaaagacatattcatggggaaattcctatcaattgacattaatggtttttggttttttattcttattcggattattgttatctctatatttaagaaaattaacaactaaagttgtg

SEQ ID NO: 6814 - protein, 406 aa, Streptococcus agalactiae
MKNLNRYVVAVSGVVLHLMLGSTYAWSVFRNPIISETGWDISSVSFAFSLAIFCLGMSAAFMGHLVERFGPRIMGMISAILYGAGNVLTGLAIETQQLWLLYVAYGILGGIGLGSGYITPVSTIIKWFPDRRGLATGFAIMGFGFASLVTSPLAQSLMIRIGVGKTFYILGLVYFFVMMIASQFIKQPPQEKITILTHDGKKNAMNSQIITGLKANAAIKSKTFYIIWLTLFINISCGLGLISAASPMAQDLAGYSAESAALLVGVLGIFNGFGRLLWASLSDYIGRPLTFIILFIVNFIMTSSLFLSFNAIVFAIAMSILMTCYGAGFSLLPAYLSDIFGTKELATLHGYSLTAWAIAGLFGPLLLSKTYSWGNSYQLTLMVFGFLFLFGLLLSLYLRKLTTKVV

SEQ ID NO: 6815 - DNA, 1194 bp, Streptococcus pyogenes
atggaaaaaacaaaacgttatatcattgcaacagcagggatacttctccacttaatgttgggatcgacctatgcttggagtgtttatcgtaatccaattttacaagagaccggttgggaccaagctcctgtcgcttttgccttttctttagctattttttgtttaggtttatctgctgcttttatgggaaatttagttgaacaatatggtcctcgtctaaccggaacggtgtcagctattctttatgcttctggaaatatgctgactggtttagcgattgatcgtaaagaaatttggcttttatatattggttatggtgttattggtggcttaggacttggagcgggatatatcacaccgatatcaactattataaaatggtttccagataaaagaggcatggcaacagggtttgctattatggggtttggttttgcgtctttattaacaagtccgattgcccagtggctaattgaaacagaaggtttggtagcaacattttaccttttagggctgatttatctaatagttatgctttttgcttctcaattgataataaaaccaactgctgctgagatagctatactagataaaaaaagattacaaaataacagttatttaatcgaaggaatgaccgctaaagaagcacttaaaacaaaatcattttattgtctttgggtaattttatttatcaatatcacatgtggcttaggacttatctcagttgttgcgccaatggcacaagatctaactggtatgagtccagaaatgtcagcaattgtggttggtgctatggggatttttaacggtttcggtcgtttagtgtgggctagtttgtcagactatattggacgccgtgtgacagtaatacttttatttttagtaagcataattatgactattagtttaatatttgcacatagttccctaattttcatgataagcattgccacccttatgacttgttatggtgcgggtttttctctcattccgccttatttaagtgatctttttggggcaaaggaactggctacattacatgggtatatattgacagcttgggcaatagctgcattaactggacctatgttattatctatcactgttgaatggactcataattatcttcttaccttatgtgtttttattgtcttatacattttaggattaatggtagcattaaggttaaagaaa

SEQ ID NO: 6816 - protein, 398 aa, Streptococcus pyogenes
MEKTKRYIIATAGILLHLMLGSTYAWSVYRNPILQETGWDQAPVAFAFSLAIFCLGLSAAFMGNLVEQYGPRLTGTVSAILYASGNMLTGLAIDRKEIWLLYIGYGVIGGLGLGAGYITPISTIIKWFPDKRGMATGFAIMGFGFASLLTSPIAQWLIETEGLVATFYLLGLIYLIVMLFASQLIIKPTAAEIAILDKKRLQNNSYLIEGMTAKEALKTKSFYCLWVILFINITCGLGLISVVAPMAQDLTGMSPEMSAIVVGAMGIFNGFGRLVWASLSDYIGRRVTVILLFLVSIIMTISLIFAHSSLIFMISIATLMTCYGAGFSLIPPYLSDLFGAKELATLHGYILTAWAIAALTGPMLLSITVEWTHNYLLTLCVFIVLYILGLMVALRLKK

SEQ ID NO: 6817 - DNA, 1458 bp, Streptococcus agalactiae
atgaaagtgtgttataatttaggagtatattcgtttataagggatagcatactatctacaacattgttgctaaataatagaaaaggaaatgatatgaagcttagtttgcatgaagttgctaaagtagttggcgctaaaaatcaagtatcagagtttgaagacgttcccctgggaaatattgaatttgatagtcgtaatatcagtgaaggtgacttatttcttcccttaaaaggagcaagagatggacatgagtttatagagatggcttttgataatggagcaatagcaaccatttcagagaaggaaatagagggtcatccttatcttttagtgtctgatgcacttaaagcatttcaagtcttggcacagtattatattgaaaagatgaacgttgatgttattgcagtaactggctcaaatggtaagacaacaactaaagatatgatagctgcaatcttatcaaccacatataagacttataaaacacaaggaaactacaataacgagattggcttaccctatactgtgctacacatgccagaagatactgaaaaaattattttggagatgggacaggatcatcttggagatatccatgtgttatctgaaattgcaaaaccacgtattgctgttgttactttgattggtgaagcacacttagaattttttggtagtcgagaaaagattgcagaagggaaaatgcaaatcacagatggtatgagttcagatggcatattaattgcaccgggagatccaattattgatccatatcttccagcaaaccagatgactattcgttttggtcatgaccaagaattgcaagtgacagaactcaaagaagaaaaacattccttaacttttaaaactaatgctttggagcaccaattacgtataccagtacctggtaagtacaatgcaactaatgcgatggtcgctgcctatgttggaaaattattagcagtagcagaagaagatatagtggatgctctagaaaatcttcaactaactcgtaatcgcaccgaatggaagaaatcagccaatggagcagatattttatcagatgtttacaatgctaacccaacggctatgcgattgatactagaaaccttttcagctattcccaataatgatggtggaaagaagattgctcttttagctgatatgaaagaactgggagaacaatctgtggatttacataatcaaatgattatgagtatcagacctgactctattgatactttgatttgttatggccaggatattgaggggttggctcaattagcaagccagatgttcccaattggtaaagtgtatttctttaaaaagaatcaagaagtagatcagtttgatcaattgcttgcaaaagtaaaagatactcttaaggagaaagatcaaatattattaaaaggttctaactcaatgaatctttctaaaatagttgatattcttgaagtagga

SEQ ID NO: 6818 - protein, 486 aa, Streptococcus agalactiae
MKVCYNLGVYSFIRDSILSTTLLLNNRKGNDMKLSLHEVAKVVGAKNQVSEFEDVPLGNIEFDSRNISEGDLFLPLKGARDGHEFIEMAFDNGAIATISEKEIEGHPYLLVSDALKAFQVLAQYYIEKMNVDVIAVTGSNGKTTTKDMIAAILSTTYKTYKTQGNYNNEIGLPYTVLHMPEDTEKIILEMGQDHLGDIHVLSEIAKPRIAVVTLIGEAHLEFFGSREKIAEGKMQITDGMSSDGILIAPGDPIIDPYLPANQMTIRFGHDQELQVTELKEEKHSLTFKTNALEHQLRIPVPGKYNATNAMVAAYVGKLLAVAEEDIVDALENLQLTRNRTEWKKSANGADILSDVYNANPTAMRLILETFSAIPNNDGGKKIALLADMKELGEQSVDLHNQMIMSIRPDSIDTLICYGQDIEGLAQLASQMFPIGKVYFFKKNQEVDQFDQLLAKVKDTLKEKDQILLKGSNSMNLSKIVDILEVG

SEQ ID NO: 6819 - DNA, 1389 bp, Streptococcus pyogenes
atgaaattaaccttacacgaagtggctaaaatagttgacgcccaaaataatgtgtctgacttagacgacgttcctctgcatcacattgaatttgatagccgaaagattacaaaaggagacctctttttacccttaaaaggtcaaagggatggtcatgagtttattgatttagcctttcaaaatggagctgtcgctactttttcagaaaaagaattgccggggaaacctcaccttcttgttgaagactgcctaaaagcttttcaaaagctagcccattattatattgataagatgcgcgtggatgttattgctgtgacaggctcaaatggtaaaacttccaccaaagatatgataggagctgtcctatcaaccacttacaaaacttacaaaacgcaaggaaattacaataatgagattggtttgccttacaccgttctccacatgcctgacgatacggaaaaaattgttcttgaaatgggacaagatcacatgggagatattcgtcttctgtctgaaattgcaaggcctcgtattgcagttttaaccttagtcggcgaagctcatttagaatattttggaagccgagacaaaatagcccaaggcaaaatgcagattgttgacggcatgaattcagatgggattttaattgctccgggagatccgattattgacccatatcttccagaaaatcagatggttatccgttttggaaatcagcaggaaattgacgttactggtattcaagaagacaaagatagcttaacgtttacaacaaatgtgttagcaacacctgtgtccctacctctaccaggaaaatacaacgcgaccaatgctatggtagcagcctatgtaggaaaactattggcagtaacagacgaggatattatagctgctttacagactgtgacgttgacaggtaatcgtacggagtggaaaaaagcagccaatggtgctgatattttgtcagatgtctacaatgccaacccaacagccatgcgtctgattttagaaacatttgctaacatagcaaagaaccccggaggaaaaaagattgcagtgctagcagatatgaaagaacttggaaaggattcagtgatacttcattctcagttaattgacagcttaacatcaggtaatattgatcagcttgttttttatggggatcatattaaagaattagcacggttggcaagtcaggtttatcctgctgagcaagtacattattttttaaaaactgaacaagaagaccagtttgaagccatggcacaatatgttcaaaacattcttaatccctttgatcaaattcttttaaaaggcagccactcgatgtcgctagaaaagttagtagatcgattagtgactgacaagaattgtgacagctatcagcct

SEQ ID NO: 6820 - protein, 463 aa, Streptococcus pyogenes
MKLTLHEVAKIVDAQNNVSDLDDVPLHHIEFDSRKITKGDLFLPLKGQRDGHEFIDLAFQNGAVATFSEKELPGKPHLLVEDCLKAFQKLAHYYIDKMRVDVIAVTGSNGKTSTKDMIGAVLSTTYKTYKTQGNYNNEIGLPYTVLHMPDDTEKIVLEMGQDHMGDIRLLSEIARPRIAVLTLVGEAHLEYFGSRDKIAQGKMQIVDGMNSDGILIAPGDPIIDPYLPENQMVIRFGNQQEIDVTGIQEDKDSLTFTTNVLATPVSLPLPGKYNATNAMVAAYVGKLLAVTDEDIIAALQTVTLTGNRTEWKKAANGADILSDVYNANPTAMRLILETFANIAKNPGGKKIAVLADMKELGKDSVILHSQLIDSLTSGNIDQLVFYGDHIKELARLASQVYPAEQVHYFLKTEQEDQFEAMAQYVQNILNPFDQILLKGSHSMSLEKLVDRLVTDKNCDSYQP

SEQ ID NO: 6821 - DNA, 1044 bp, Streptococcus agalactiae
atgtcaaaagaaacattgatcttgctttacggtggtcgctctgcggaacgtgaagtatctgtactgtctgcagaaagcgtcatgcgtgctattaattatgataaattttttgttaaaacttattttatcacgcaagtaggtcaatttattaaaacacaagaatttgatgaaatgccatcttcagatgaaaagttaatgacaaaccaaactgttgatttagacaaaatggttcgtccaagtgatatctatgatgataatgcaattgttttccccgttttacatggaccaatgggggaagatggttctatccaaggatttttagaagttttaaggatgccttatgttgggactaatattctatcttcaagcgtggctatggataaaattacaacaaaacaagtccttgcaacagtaggtgtacctcaggttgcatatcaaacttattttgagggtgatgatttggaacatgcgattaaactctctttagaaactttaagtttcccaatttttgtaaaaccggctaatatggggtcatcagtaggtatttcaaaagcgacagatgaatcctcacttcgctctgcaattgacttagctctcaagtatgatagccgtattttgattgaacaaggcgtgacagctcgtgaaattgaagtaggtattttaggcaataatgatgttaagacaacttttcctggcgaagtcgttaaagacgtcgatttctatgactatgacgccaaatatattgataataaaattactatggatattccagctaaagttgatgaagcaactatggaagcaatgcgtcaatatgcaagtaaagcttttaaagcaatcggggcttgtggtttatcacgctgtgatttctttttgacgaaagatggacaaatcttcttaaacgaactgaatacaatgcccggttttactcagtggtcaatgtatcccctgctttgggaaaatatggggctaacttatagtgatttgattgaaaagttagttatgttagctaaagaaatgtttgaaaaacgtgagagtcatttaatt

SEQ ID NO: 6822 - protein, 348 aa, Streptococcus agalactiae
MSKETLILLYGGRSAEREVSVLSAESVMRAINYDKFFVKTYFITQVGQFIKTQEFDEMPSSDEKLMTNQTVDLDKMVRPSDIYDDNAIVFPVLHGPMGEDGSIQGFLEVLRMPYVGTNILSSSVAMDKITTKQVLATVGVPQVAYQTYFEGDDLEHAIKLSLETLSFPIFVKPANMGSSVGISKATDESSLRSAIDLALKYDSRILIEQGVTAREIEVGILGNNDVKTTFPGEVVKDVDFYDYDAKYIDNKITMDIPAKVDEATMEAMRQYASKAFKAIGACGLSRCDFFLTKDGQIFLNELNTMPGFTQWSMYPLLWENMGLTYSDLIEKLVMLAKEMFEKRESHLI

SEQ ID NO: 6823 - DNA, 594 bp, Streptococcus agalactiae
atgctttacccaacaccaattgctaaattgattgacagcttttcaaaattaccgggtataggtactaaaacagcaacacgtttagctttttacaccattggtatgagtgatgaagatgttaatgaatttgctaagaatttattagctgctaagcgggaattaacctattgttctgtttgtggtaatttgactgatgatgatccttgcttaatttgtacagataagacgcgtgaccagtctgttatcttggttgttgaagatagtaaagatgtgtcagctatggaaaaaattcaagagtataatggtttgtatcatgtcttacatggcttaatttcacctatgaatggtattagccctgatgacattaatttgaaaagtttaattactcgattgatggatggtcaggtgacagaagttattgttgctaccaatgcgactgctgatggtgaagctacatcaatgtatatttcacgagtcttaaaaccagctggtatcaaagtgacacgattagcgagaggtttagctgttggttcagatatcgaatatgcagatgaagtaaccttgcttcgagcaatcgaaaatcgtacagagtta

SEQ ID NO: 6824 - protein, 198 aa, Streptococcus agalactiae
MLYPTPIAKLIDSFSKLPGIGTKTATRLAFYTIGMSDEDVNEFAKNLLAAKRELTYCSVCGNLTDDDPCLICTDKTRDQSVILVVEDSKDVSAMEKIQEYNGLYHVLHGLISPMNGISPDDINLKSLITRLMDGQVTEVIVATNATADGEATSMYISRVLKPAGIKVTRLARGLAVGSDIEYADEVTLLRAIENRTEL

SEQ ID NO: 6825 - DNA, 594 bp, Streptococcus pyogenes
gtgctttatccaacacccattgcaaagttaattgacagttactctaaacttccaggaattggtatcaagacggcgacgagattagccttttatactattggaatgtcaaatgaagatgtcaatgattttgctaaaaacttattagcagctaaaagagaactgacctattgttcgatttgtggaaaccttaccgatgacgatccttgtcacatttgcacagacacgagtcgtgatcagacgaccattctggtagtagaagatgctaaagatgtttctgccatggaaaaaatccaagagtatcatggctattatcatgtgcttcacggcttgatttcgcctatgaatggtgtggggccagatgacatcaaccttaaaagtttaattacccgtctaatggatggtaaggtgagcgaagttatcgtagctaccaatgccacagcagatggggaagcaacgtccatgtatatttcacgtgtcttgaaaccagccgggattaaggtaactcgtttggcaagaggtctcgcagtaggttcagatattgagtatgctgatgaagtaacattattgagagctattgagaatcgtactgaactt

SEQ ID NO: 6826 - protein, 198 aa, Streptococcus pyogenes
VLYPTPIAKLIDSYSKLPGIGIKTATRLAFYTIGMSNEDVNDFAKNLLAAKRELTYCSICGNLTDDDPCHICTDTSRDQTTILVVEDAKDVSAMEKIQEYHGYYHVLHGLISPMNGVGPDDINLKSLITRLMDGKVSEVIVATNATADGEATSMYISRVLKPAGIKVTRLARGLAVGSDIEYADEVTLLRAIENRTEL

SEQ ID NO: 6827 - DNA, 102 bp, Streptococcus agalactiae
gtgcgacgctatcatcaggatgggaaaataaagttcttagaggaaatgaagtgctttatgaccaagaaattgctaatatacggtcatggtttacacgaggtt

SEQ ID NO: 6828 - protein, 34 aa, Streptococcus agalactiae
MRRYHQDGKIKFLEEMKCFMTKKLLIYGHGLHEV

SEQ ID NO: 6829 - DNA, 2043 bp, Streptococcus agalactiae
atgttgaatcgtaaaaaaaggtatcgtctcactgtaaaaaagcaaaatgctagcatacctagacgattaaatcttctattttttattattgttttattatttactgttctaattcttcgtttagagcaaatgcagattgggcaacaatcattttacatgaaaaaactgacagctcttacgagttatacagtgaaagaatcaaaagcgagaggtcagatttttgatgctaagggagttgtcttagttgaaaatgatgaacgtcctactgtggcgttttctagaggaaacaatatttcatctcagtctatcaaagagttagcgaataaattatcacattacattaccttaaccgaagttgcttcaagcgatagagcaaagagagattattatttagcagataaagccaactacaaaaaagttgttgaaagtttaccagattctaaacgttacgataaatttggtaaccatctagccgaatcaaccgtatatgcaaatgcagttgctgcagttccagtgagcgctattaactattctgaagatgagttaaaagtggttgccttatttaaccaaatgaatgcgacaccaacgtttggttcagtgaaattaagtacaggcgaattaagtgatgatcaaatcaagaaactggatgctgataagaaggaactgttaggaatttctgtaacaagtaattggcatcgtcgtaaaaaaggaacttctttatcggatatattaggtactatttctacagaaaaggcaggtttaccaagagaagaagttaaaaaatatttgaaaaaaggctattcactgaatgaccgagtgggaacttcttaccttgaaaaacaatatgaagatgacttacaaggaatcagacaaattcgcaaagtagttgttaataaaaaaggtaaagttgtttcagataatattacgcaagaaggtaagtcaggaagaaatcttaaattaacgattgatcttaattaccaaaacaaagtagaaagtatcttgaaacaatactatggcagtgaattatctagtggacgcgctagtttttccgaagggatgtatgcagttgctatagaaccttcaactggtaaagtgttagcaatggctggtctgaaaaatgatcatgggaatttagttgatgacagcctaggcactattgctaagaatttcacgccaggatctgttgtgaaaggtgcgacgctatcatcaggatgggaaaataaagttcttagaggaaatgaagtgctttatgaccaagaaattgctaatatacggtcatggtttacacgaggtttgactccaatatctgcggcacaagcgctagagtattcatctaatacttatatggttcaagtagcacttcgtttaatgggacaagactataatacaggagatgctttaactgatcgaggctatcaagaagcaatggctaaactaaggaaaacttacggcgaatatggtttaggggtttctacaggattagatttacctgaatcagaaggttatgtacctggaaaatacagcttaggaacaactctaatggaatcgttcggtcagtatgatgcctatacaccaatgcaacttggtcagtatatctcaactattgcgaataatgggaatcgtttagcacctcacgtggtttcagatatctatgaagggaatgattctaataagttcgctcaattggttcgttcaatcactcctaaaacactaaataagatagctatctcagatcaagagttagccattattcaagaaggtttttataacgttgtcaatagtggaagtggctatgcaactggtacgtcaatgagggggaatgtgacaaccattagtggtaaaactggtaccgctgaaacatttgctaaaaatgtaaatggacaaacagtttctacctacaacttaaacgctattgcctacgatactaatcgtaaaatagcagtagcggtaatgtatccgcatgttacaactgatacaacaaaatcccatcaattagttgcacgagatatgattgatcaatatatttcacagttcacaggacaa

SEQ ID NO: 6830 - protein, 681 aa, Streptococcus agalactiae
MLNRKKRYRLTVKKQNASIPRRLNLLFFIIVLLFTVLILRLEQMQIGQQSFYMKKLTALTSYTVKESKARGQIFDAKGVVLVENDERPTVAFSRGNNISSQSIKELANKLSHYITLTEVASSDRAKRDYYLADKANYKKVVESLPDSKRYDKFGNHLAESTVYANAVAAVPVSAINYSEDELKVVALFNQMNATPTFGSVKLSTGELSDDQIKKLDADKKELLGISVTSNWHRRKKGTSLSDILGTISTEKAGLPREEVKKYLKKGYSLNDRVGTSYLEKQYEDDLQGIRQIRKVVVNKKGKVVSDNITQEGKSGRNLKLTIDLNYQNKVESILKQYYGSELSSGRASFSEGMYAVAIEPSTGKVLAMAGLKNDHGNLVDDSLGTIAKNFTPGSVVKGATLSSGWENKVLRGNEVLYDQEIANIRSWFTRGLTPISAAQALEYSSNTYMVQVALRLMGQDYNTGDALTDRGYQEAMAKLRKTYGEYGLGVSTGLDLPESEGYVPGKYSLGTTLMESFGQYDAYTPMQLGQYISTIANNGNRLAPHVVSDIYEGNDSNKFAQLVRSITPKTLNKIAISDQELAIIQEGFYNVVNSGSGYATGTSMRGNVTTISGKTGTAETFAKNVNGQTVSTYNLNAIAYDTNRKIAVAVMYPHVTTDTTKSHQLVARDMIDQYISQFTGQ

SEQ ID NO: 6831 - DNA, 690 bp, Streptococcus agalactiae
atggtaaaattagtattcgcacgccacggtgaatctgagtggaataaagctaaccttttcactggatgggctgacgtagatctttcagaaaaaggtacacaacaagctattgatgctgggaaattaattcaagcagcaggtattgagttcgaccttgcttttacatcagttcttaaacgtgccatcaaaacaactaaccttgcccttgaagcagctgatcaactttgggtaccagttgaaaaatcatggcgcttgaacgaacgtcattacggtggattgacaggaaaaaataaagcagaagcagctgaacaatttggtgatgagcaagttcatatttggcgtcgttcatatgatgtattgcctccagatatggctaaagatgatgaacattcagcacatactgatcgtcgctatgcttcactagatgattctgttattccagatgcagaaaacctaaaagttactttagagcgtgctcttcctttctgggaagataaaattgctcctgctcttaaagatggtaaaaatgtgtttgttggtgcacacggtaactcaatccgtgctcttgtaaaacatatcaaacaattgtcagatgatgaaatcatggacgttgaaattcctaacttcccaccacttgttttcgaatttgatgaaaaattaaaccttgtttcagaatattacttaggtaaa

SEQ ID NO: 6832 - protein, 230 aa, Streptococcus agalactiae
MVKLVFARHGESEWNKANLFTGWADVDLSEKGTQQAIDAGKLIQAAGIEFDLAFTSVLKRAIKTTNLALEAADQLWVPVEKSWRLNERHYGGLTGKNKAEAAEQFGDEQVHIWRRSYDVLPPDMAKDDEHSAHTDRRYASLDDSVIPDAENLKVTLERALPFWEDKIAPALKDGKNVFVGAHGNSIRALVKHIKQLSDDEIMDVEIPNFPPLVFEFDEKLNLVSEYYLGK

SEQ ID NO: 6833 - DNA, 693 bp, Streptococcus pyogenes
atggtaaaattggttttcgctcgccacggtgagtcagaatggaacaaagctaacctcttcactggttgggcagatgttgatctttcagaaaaagggacacaacaagcgattgatgcaggtaaattgatcaaagaagcaggtattgaatttgaccttgctttcacttcagtattgacacgtgctatcaaaacaactaaccttgcccttgaaaatgcaggtcaattgtgggttccaactgaaaaatcatggcgcttgaacgagcgtcactatggtgctttgactggcaaaaacaaagctgaagctgcagaacaattttgtgatgaacaagttcatatctggcgtcgttcatacgacgtgttgccgccagctatggctaaagatgatgagtattcagcacacaaagaccgtcgttatgctgatcttgacccagcccttattccagatgctgaaaacttaaaagtcactcttgaacgcgcaatgccttactgggaagaaaaaattgctccagctcttcttgacggtaaaaacgtctttgttggcgcacatggtaactcaatccgcgctcttgtgaaacacattaaaggtctttcagatgacgaaatcatggatgtggaaattccaaacttcccaccacttgtttttgaattagatgaaaaacttaacattgttaaagaatactaccttggtggtgaa

SEQ ID NO: 6834 - protein, 231 aa, Streptococcus pyogenes
MVKLVFARHGESEWNKANLFTGWADVDLSEKGTQQAIDAGKLIKEAGIEFDLAFTSVLTRAIKTTNLALENAGQLWVPTEKSWRLNERHYGALTGKNKAEAAEQFCDEQVHIWRRSYDVLPPAMAKDDEYSAHKDRRYADLDPALIPDAENLKVTLERAMPYWEEKIAPALLDGKNVFVGAHGNSIRALVKHIKGLSDDEIMDVEIPNFPPLVFELDEKLNIVKEYYLGGE

SEQ ID NO: 6835 - DNA, 756 bp, Streptococcus agalactiae
atgtcacgtaaaccatttatcgctggtaactggaaaatgaataaaaatccagaagaagcaaaagcattcatcgaagcagtagcttctaaattaccatcatcagaacttgttgaagcagggattgctgctccagcgcttactttatcaacagttcttgaagcagctaaaggttcagaattgaaaatcgctgctcaaaatagctattttgagaattcaggtgcattcactggtgaaaacagccctaaagtattggctgaaatgggtacagactacgttgttatcggtcactcagaacgtcgtgattatttccatgaaactgaccaagatatcaacaaaaaagcaaaagctatctttgctaatggtttgactccaatcatttgttgcggtgagtctcttgaaacttacgaagctggtaaagcggttgaattcgtaggtgctcaagtttcagcagctcttgcaggtttgtcagaagagcaagtatcatcacttgttatcgcttacgaaccaatctgggctattggtactggtaaatcagcaactcaagacgacgcacaaaacatgtgtaaagcagttcgtgacgttgttgcagcagacttcggtcaagcagttgctgacaaagttcgcgttcaatacggtggttcagttaaacctgaaaacgttgcagaatatatggcttgcccagacgttgacggtgcccttgtaggtggagcttcacttgaagcagaaagcttccttgccttattagattttgttaaa

SEQ ID NO: 6836 - protein, 252 aa, Streptococcus agalactiae
MSRKPFIAGNWKMNKNPEEAKAFIEAVASKLPSSELVEAGIAAPALTLSTVLEAAKGSELKIAAQNSYFENSGAFTGENSPKVLAEMGTDYVVIGHSERRDYFHETDQDINKKAKAIFANGLTPIICCGESLETYEAGKAVEFVGAQVSAALAGLSEEQVSSLVIAYEPIWAIGTGKSATQDDAQNMCKAVRDVVAADFGQAVADKVRVQYGGSVKPENVAEYMACPDVDGALVGGASLEAESFLALLDFVK

SEQ ID NO: 6837 - DNA, 756 bp, Streptococcus pyogenes
atgtcacgtaaaccaattattgctggtaactggaaaatgaacaaaaaccctcaagaagcaaaagcattcgttgaggctgtagcaagcaaattaccttcaactgaccttgttgatgttgccgtagcagccccagctgttgatttggtaaccactattgaagctgctaaagattcagttcttaaagttgctgcacaaaactgctactttgaaaacacaggggcattcactggtgaaacatcaccaaaagtgcttgctgaaatgggagctgactatgttgtgattggtcactcagaacgccgtgattacttccatgaaacagatgaagacattaataaaaaagccaaagcaatctttgctaacggtttaactccaattgtttgttgtggtgagtctcttgaaacttatgaagctggtaaagccgttgagtttgtaggtgcgcaagtttcagcagcacttgcaggtctttcagcagagcaagtagcttcacttgttttagcttatgagccaatctgggctatcggtactggtaaatcagctactcaagatgatgctcaaaacatgtgtaaagctgttcgtgatgtggtagcagcagactttgggcaagaagttgctgataaagttcgcgttcaatacggtggttctgtaaaacctgaaaacgttaaagattacatggcttgtccagatgttgacggtgcccttgtaggtggtgcatcacttgaagctgatagcttccttgctttgcttgatttccttaac

SEQ ID NO: 6838 - protein, 252 aa, Streptococcus pyogenes
MSRKPIIAGNWKMNKNPQEAKAFVEAVASKLPSTDLVDVAVAAPAVDLVTTIEAAKDSVLKVAAQNCYFENTGAFTGETSPKVLAEMGADYVVIGHSERRDYFHETDEDINKKAKAIFANGLTPIVCCGESLETYEAGKAVEFVGAQVSAALAGLSAEQVASLVLAYEPIWAIGTGKSATQDDAQNMCKAVRDVVAADFGQEVADKVRVQYGGSVKPENVKDYMACPDVDGALVGGASLEADSFLALLDFLN

SEQ ID NO: 6839 - DNA, 135 bp, Streptococcus agalactiae
atggttatgcctggtgataacgttactatcgaagttgaattgattcacccaatcgccgtagaacaaggtactactttctcaatccgtgaaggtggacgtactgttggttcaggtatcgtttcagaaatcgaagct

SEQ ID NO: 6840 - protein, 45 aa, Streptococcus agalactiae
MVMPGDNVTIEVELIHPIAVEQGTTFSIREGGRTVGSGIVSEIEA

SEQ ID NO: 6841 - DNA, 291 bp, Streptococcus agalactiae
ttgacatgggaagtttattttctaagaaaagagagcatgttgaaaaaatatgtaaaatggttaattcccatatctattattgggatgttactagcaggctgtcaaatgaatagtgaatctaaaagtcagtcaaacgaagtaaaaaatagcaaacagtcagcagtaaagaaaggtaaaaaagtaataaaaaaagaacaagtagcttatctcaaaaagcatgaaaaagaattaactgaatatgtcaaaatccagatattagtgaaattaagtatgattggaatagtgtgcgca

SEQ ID NO: 6842 - protein, 97 aa, Streptococcus agalactiae
MTWEVYFLRKESMLKKYVKWLIPISIIGMLLAGCQMNSESKSQSNEVKNSKQSAVKKGKKVIKKEQVAYLKKHEKELTEYVKIQILVKLSMIGIVCA

SEQ ID NO: 6843 - DNA, 177 bp, Streptococcus agalactiae
gtgcgcatagtggaagctagtagtggaacccctcaaggcggagagcaactattattaattttgggttatgcaaatggcagtgaattaaccaattttactctaaatttcacattgggtgataatcaaatgcctaatattgactcagttggctcagataatttatcaactattgaagat

SEQ ID NO: 6844 - protein, 59 aa, Streptococcus agalactiae
MRIVEASSGTPQGGEQLLLILGYANGSELTNFTLNFTLGDNQMPNIDSVGSDNLSTIED

SEQ ID NO: 6845 - DNA, 168 bp, Streptococcus agalactiae
atggcagaaagtgctaatacaggtcgatcgaattcttttgttttagaagaattaactgaatttcaaagagaaaagttaaaaaatggggagtcagttaagtttaatttttctaaagatgttaagaaagaaaataaggttatcgaaggagggcacccccaagtcataggg

SEQ ID NO: 6846 - protein, 56 aa, Streptococcus agalactiae
MAESANTGRSNSFVLEELTEFQREKLKNGESVKFNFSKDVKKENKVIEGGHPQVIG

SEQ ID NO: 6847 - DNA, 549 bp, Streptococcus agalactiae
atgactaaaatttatcatatgattttatgtaattctgatataatgaagattttagctataataaaatctcttccactgaatgattgttggctgtgtgctggcacattgagaaactttgtatggaataaactttctggaataaatgagacattgacatcagatattgatgttgtattttttgataaaaatatttcttatgaagaaacggtggtattagaacaacaattaaaggataactatccacagtacgattgggaacttaaaaatgaattttacatgaacactcattctcctaataccccaaagtatactagctctaaagatgctatttcaaaatttcctgaaaagtgtactgcagtgggagcaaggttagatgatagaaatcaactcgaactttacctcccttatggtgaagaggaaatattaaatttcattgttagtcctacgccatattttgaagaggatctattacgttataatgtttatttgaagcgagtggataagaagaaatggaataatatttggcctcgtttaacaatcataaaaaaa

SEQ ID NO: 6848 - protein, 183 aa, Streptococcus agalactiae
MTKIYHMILCNSDIMKILAIIKSLPLNDCWLCAGTLRNFVWNKLSGINETLTSDIDVVFFDKNISYEETVVLEQQLKDNYPQYDWELKNEFYMNTHSPNTPKYTSSKDAISKFPEKCTAVGARLDDRNQLELYLPYGEEEILNFIVSPTPYFEEDLLRYNVYLKRVDKKKWNNIWPRLTIIKK

SEQ ID NO: 6849 - DNA, 417 bp, Streptococcus agalactiae
atgaaaatgacagtctattttgatggtaatttttggttgggtttgattgagtacgatgatgatggtgattacaaagtttttcggtatttttttggaaaagaacctaaagatgatgatgtttttaattttataaatcataaacttaatgatttgataaaaaaatatgagtttgttaaaacggatatttctctaaagcgtacgaatgaacacaaaaaaagtcctaaaagaatgcaaagagaaattaatagagaaaaacgtaagccagtagtatctacaaaagcgcaattggcgatgaaaactattcatatgagtataaaaaacgaacgtcaattaagtcagaaatgtaagaaaaatgagttaagaaaacatcggtaccaattaaaacaagaaaaacgttaccaaaagaaaaaaggacat

SEQ ID NO: 6850 - protein, 139 aa, Streptococcus agalactiae
MKMTVYFDGNFWLGLIEYDDDGDYKVFRYFFGKEPKDDDVFNFINHKLNDLIKKYEFVKTDISLKRTNEHKKSPKRMQREINREKRKPVVSTKAQLAMKTIHMSIKNERQLSQKCKKNELRKHRYQLKQEKRYQKKKGH

SEQ ID NO: 6851 - DNA, 477 bp, Streptococcus agalactiae
ttgagagattttgaggagttgtttgataaagtaaagccaatcgtaatgaagctgagaagaaattattttgttcaactttgggaatatgatgattggattcaagaaggacgtattgtactttttaggttgcttgaagagcatccgtatttattggataatgaaagcaaactattcatttactttaaaacaaaattttcaaattatttaaacgatgtattaagacaccaagattgtcaaaagcgacaatttaataaaatgccttatgaagaaataagtgaagttagtcactatgttaagagtaaaggactagttttagatgactatattgcttatcgtgatactttaacaaaagtggaagaaactttgtcagatattgataaagaaaaatttgaaaaactgattagtggtgaacgttttgcggggaagaaacaattcatacgagatattcaaccctttttcaatgcttttaaagcggat

SEQ ID NO: 6852 - protein, 159 aa, Streptococcus agalactiae
MRDFEELFDKVKPIVMKLRRNYFVQLWEYDDWIQEGRIVLFRLLEEHPYLLDNESKLFIYFKTKFSNYLNDVLRHQDCQKRQFNKMPYEEISEVSHYVKSKGLVLDDYIAYRDTLTKVEETLSDIDKEKFEKLISGERFAGKKQFIRDIQPFFNAFKAD

SEQ ID NO: 6853 - DNA, 579 bp, Streptococcus pyogenes
gtgcataatgaaaaaaacaacaggacattaatgtcctgttgtttttttgtggttctctttatactagggatagttaaaaagaaaaggagactcaaaatgtcgatagagacaagagcagcgtttgaaaaagttaagcccattattttgaaattaaagcgacactattatattcaattgtgggatagagatgactggttacaagaaggacatattatcttattacagttactagaaaggtacccagagttaattgaggaagaagagcgtttatatcgctattttaaaacaaaattttcatcttatttgaaagatttattacgccgtcaagaaagtcaaaagcgtcagttccataagttagcatatgaagagataggggaggttgcacatgccattccatcgagagggttatggctagacgactatgtggcttatcaagaggtaatagctagcttagagaaccaattaaattcgcaagagcgtatgcagtttcaagcacttatcaggggcgaacgtttcaagggaagacgtgctctacttaggaagatcagtccctattttaaggaatttgcacagcagttg

SEQ ID NO: 6854 - protein, 193 aa, Streptococcus pyogenes
VHNEKNNRTLMSCCFFVVLFILGIVKKKRRLKMSIETRAAFEKVKPIILKLKRHYYIQLWDRDDWLQEGHIILLQLLERYPELIEEEERLYRYFKTKFSSYLKDLLRRQESQKRQFHKLAYEEIGEVAHAIPSRGLWLDDYVAYQEVIASLENQLNSQERMQFQALIRGERFKGRRALLRKISPYFKEFAQQL

SEQ ID NO: 6855 - DNA, 690 bp, Streptococcus agalactiae
atgagtaaagttcgtttatatatcgctcgtcatggtaaaacaatgtttaatacaattggtcgcgctcaggggtggagtgatactcctttaactacttttggagaactcgggattaaagagcttggtttgggactaaaggcttcaaatattagttttaaagaggctttttctagtgatagtggacgtactttacaaactatggaaattattctcagggaagtgcaacaagaaaatattccctatacgagagataaacgaatccgcgagtggtgctttggtagtttggatggaggatatgatggcgacctttttaatggcgttctgcctcgagtttcaaacggagatatgagccatttgacacacgaagaaattgctaatttgatttgtcaagttgatacggctggctgggcagaaccgtgggcaatattgagtaaccgtattctgtcaggcttcactgctatagctaaaaaaatagaggatattgggggaggtaatgcgattgttgtcagtcatgggatgactattgcgacttttttatggttaatcgaccatagtacccctcgtagtttaggcttagataatggtagtgtctcagtcgttgattttgaagatggaacattttctattcaatctattggggatatgtcctatcgagaaaaaggaagagaaattttagaaaaaacattgcaa

SEQ ID NO: 6856 - protein, 230 aa, Streptococcus agalactiae
MSKVRLYIARHGKTMFNTIGRAQGWSDTPLTTFGELGIKELGLGLKASNISFKEAFSSDSGRTLQTMEIILREVQQENIPYTRDKRIREWCFGSLDGGYDGDLFNGVLPRVSNGDMSHLTHEEIANLICQVDTAGWAEPWAILSNRILSGFTAIAKKIEDIGGGNAIVVSHGMTIATFLWLIDHSTPRSLGLDNGSVSVVDFEDGTFSIQSIGDMSYREKGREILEKTLQ

SEQ ID NO: 6857 - DNA, 705 bp, Streptococcus pyogenes
atgacaaaaacaaggttgtatattgccagacatggaaaaacgatgtttaataccattggtcgcgctcagggttggagtgacacacctcttacaaaaaaaggagaagaaggtattcgagaacttggcctaggtttaaaagatgcaactataccatttaaggctgcgttttcaagtgattcaggtcgaaccatgcagacaatagaaattattttaagagaatcagaaaacgaatttttgccttatactaaagataatcgtattcgtgagtggtgttttgggagtctagaagggacttatgattcagaattatttctaggtgtccttccaagaacaaaagcctttgaaaatcgtgataacctacgtgatgttccctattctgaactggcagaaagcatcgtggaagtagataccgctaattgggcagaaccatgggaagttcttcgtaagcgcatttgggaggggtttgaagctattgccttgtctattcaaaatgctggcggcggaaatgctcttgtggttagccatggtatgacaattggaacgtttctgtggttgattgatccagatcgagacaaacagtatattgataatgggagcgttacagttgttgaatttgatgatggccaatttacgataaagactattggagatatgagttaccgctaccgcggtcgtgaaataatagaagaacggtcagatgaaata

SEQ ID NO: 6858 - protein, 235 aa, Streptococcus pyogenes
MTKTRLYIARHGKTMFNTIGRAQGWSDTPLTKKGEEGIRELGLGLKDATIPFKAAFSSDSGRTMQTIEIILRESENEFLPYTKDNRIREWCFGSLEGTYDSELFLGVLPRTKAFENRDNLRDVPYSELAESIVEVDTANWAEPWEVLRKRIWEGFEAIALSIQNAGGGNALVVSHGMTIGTFLWLIDPDRDKQYIDNGSVTVVEFDDGQFTIKTIGDMSYRYRGREIIEERSDEI

SEQ ID NO: 6859 - DNA, 750 bp, Streptococcus agalactiae
atgaaaaaaaataaaattatccgattcagtttagttggtgttctacttgcgatactatgctttagtctttttgctttattgaagcctaacagtcaacaatcatcatctcaaaagttgaggaatgaggatataaaaaagatatcctctcaaaaaagaaataagaaattacaattaccagctgtatcatcaaaagattggaacttgattttggtcaatcgtgaccataaacatgaagaattaagtccagatgtggttcctgttgaaaatatttatttggataaacgtattacgaagcaagctactcagtttttagaggctgctagagcaattgattcacgagaacatttaatttcgggttatcgtagtgttgcctatcaggagaagttgttcaattcttatgttactcaagagatgactagtaaccctaatttgacgaggggacaagcagaaaagttggtaaaaacttactctcagcctgcaggtgctagtgaacaccagactggattagcgatggatatgagtactgtagattctttgaatgagagcgatcctagagtagtcagtcagttgaaaaagatagctccacaatatggttttgtcttacggtttccggatggtaaaacagcagaaacaggggtaggttatgaagattggcattaccgctatgttggggtagagtctgcaaaatatatggccaaacatcatttaacattagaagaatacataactttattaaaggagaataaccaa

SEQ ID NO: 6860 - protein, 250 aa, Streptococcus agalactiae
MKKNKIIRFSLVGVLLAILCFSLFALLKPNSQQSSSQKLRNEDIKKISSQKRNKKLQLPAVSSKDWNLILVNRDHKHEELSPDVVPVENIYLDKRITKQATQFLEAARAIDSREHLISGYRSVAYQEKLFNSYVTQEMTSNPNLTRGQAEKLVKTYSQPAGASEHQTGLAMDMSTVDSLNESDPRVVSQLKKIAPQYGFVLRFPDGKTAETGVGYEDWHYRYVGVESAKYMAKHHLTLEEYITLLKENNQ

SEQ ID NO: 6861 - DNA, 741 bp, Streptococcus pyogenes
atgaaatataattcgttaaactatttagtgcaattgctaattgttattgtttttttaggagggctttacctctttataaaaccagaagagtcagtaacaccaactcagttgaataaaaaagaaatccaacaaaaagatatcaaaaaaacggaccgtttacgagctttacctaaggtatctgttgaagattgggagttggttttagtaaaccgcgatcacattacaaaagaaatgagtcctgaattagctgacattaatggtatttctgtggataaacgcattgagcaagccactagtgactttttagcagcagcacaagctatcgacttgcaagaacatcttatctctgggtaccgttccgtagactaccaaacagagctttaccaatcttatattaaaaaagagatggctaacgatccaacattgacacaagaagctgcggaggctttggtgcaaacctattcacagccgccaggggctagtgaacatcacactggtcttgctattgacatgagcactgtagatactttaaatgccagtgatccatcagtagctaaagcagttcaaaaaattgcacctgattatgggtttgtcttgcgctttccagaaggaaaaaagactagtacaggggttgattatgaggattggcattaccgctatgtaggcaaggcgtctgctcgttatatggctcagcacaacctaacgttggaagagtacattgctgctttaaaggagaaacga

SEQ ID NO: 6862 - protein, 247 aa, Streptococcus pyogenes
MKYNSLNYLVQLLIVIVFLGGLYLFIKPEESVTPTQLNKKEIQQKDIKKTDRLRALPKVSVEDWELVLVNRDHITKEMSPELADINGISVDKRIEQATSDFLAAAQAIDLQEHLISGYRSVDYQTELYQSYIKKEMANDPTLTQEAAEALVQTYSQPPGASEHHTGLAIDMSTVDTLNASDPSVAKAVQKIAPDYGFVLRFPEGKKTSTGVDYEDWHYRYVGKASARYMAQHNLTLEEYIAALKEKR

SEQ ID NO: 6863 - DNA, 573 bp, Streptococcus agalactiae
atgaggaaacgtttttccttgctaaattttattgttgttacttttattttctttttctttattctttttccgcttttaaaccataagggaaaagtagatgctaattctaggcagagtgttacctacaccaaagaagaatttatacaaaaaattgtgccagatgcgcaagatctaggaaagtcgtacggtattcgtccttcatttattattgcacaggcggctttggattctgatttcggagagaaaatattagctaataagtatcataatctgtttggtttgcttgcagaaccaggaacgccctcaattaccttaaatgatagtagtacaggaaaaaaacaggaaaagcaatttactcattataaatcttggaagtattcaatgtatgattaccttgctcatataaaatctggagcgacaggcaaaaaagattcatatactataatggtgtctgttaaaaatccaaaaactttagtgcaaaaattacaagatagtggttttgataatgacaaaaagtacgctaaaaaaatgacggaaatcattgatttgtatgatttaacaagatatgataag

SEQ ID NO: 6864 - protein, 191 aa, Streptococcus agalactiae
MRKRFSLLNFIVVTFIFFFFILFPLLNHKGKVDANSRQSVTYTKEEFIQKIVPDAQDLGKSYGIRPSFIIAQAALDSDFGEKILANKYHNLFGLLAEPGTPSITLNDSSTGKKQEKQFTHYKSWKYSMYDYLAHIKSGATGKKDSYTIMVSVKNPKTLVQKLQDSGFDNDKKYAKKMTEIIDLYDLTRYDK

SEQ ID NO: 6865 - DNA, 567 bp, Streptococcus pyogenes
atgagaaaacgactaaagtttccgtattttttaacgcttctagcttgctttttattgctgattgtttgtcccttactgagtagccaaaggatagctagtgcagataaagaagtaagggtgaactacagccaaaaacaatttattacaaaaatgggtaaagaagttaaaccattggcaaaatattatggcattagaccatctattttgattgctcaaattcttttggaaacccatgatggaaaaacattactagcgtctaagtatcataatctttttagcaagaaagcaactccaggacaagtggccattaccctaaagtcccctaaacaaaccaaccaaaacgtgagatatgctatttataaagatgacgctagtgcaattagagattatttacgaatgcttcggcagggaaaagaagtcgataagcgtttgtatcgtaatcttgctacagaaaaagggtataaagcaccagctaaaagtttacaaaagtatttgcattatactgataaaacctatgctaggcgactaattcaggtcattgaaagtaacgatttaacaaactatgac

SEQ ID NO: 6866 - protein, 189 aa, Streptococcus pyogenes
MRKRLKFPYFLTLLACFLLLIVCPLLSSQRIASADKEVRVNYSQKQFITKMGKEVKPLAKYYGIRPSILIAQILLETHDGKTLLASKYHNLFSKKATPGQVAITLKSPKQTNQNVRYAIYKDDASAIRDYLRMLRQGKEVDKRLYRNLATEKGYKAPAKSLQKYLHYTDKTYARRLIQVIESNDLTNYD

SEQ ID NO: 6867 - DNA, 1080 bp, Streptococcus agalactiae
atgtgtaagagtgctaatttcagaaagaccgagaggggtgatgtttttgtgattacacaacgtcaaaatgatattttgaatttaatcgttgagttatttacacaaactcatgaaccagtagggtctaaagctttacagagaacgattgattctagtagcgccactattcgtaatgatatggcaaaactagagaagttggggttattggaaaaagcacacacttctagtggacggatgccgagtccagctggttttaagtattttgtagagcactcccttagactagatagtattgatgagcaagatatttatcatgttataaaagcttttgactttgaagcattcaaattagaagacatgcttcaaaaagctagtcatattttatcggagatgacgggctatacatccgttattttagatgtggagccagctcgtcaacgtttgacagggtttgatgttgttcagcttagcaaccatgatgctctagcagtcatgactttagatgaatctaagccagtgacagtgcagtttgctattccaagaaactttttgacacgtgacttgatagcatttaaagctatcgtagaggagcgcttgctggatggtagtgtcatggatattcattataagttgaggacagaaattcctcagatcgttcagaagtattttgtaactacggataatgttttacaactatttgattatgttttttcagagctgtttctggaaacggtatttgtagctggcaaggtaaattctttaacgtattcagatctatcaacgtatcagtttttggataatgagcagcaagtagcgatttctttgaggcaaagtctgaaagagggtgagatggcttctgtccaagtggcagatagtcaagaagccgcacttgcagatgtgtcagttttaactcacaaatttttgattccttaccgtggatttggactcctgagtttgattggtcctattgatatggattatcgtaggtctgttagtttggtaaacattatcggaaaggtattggctgctaaattaggtgattattatcgatacctaaattctaaccattatgaagttcac

SEQ ID NO: 6868 - protein, 360 aa, Streptococcus agalactiae
MCKSANFRKTERGDVFVITQRQNDILNLIVELFTQTHEPVGSKALQRTIDSSSATIRNDMAKLEKLGLLEKAHTSSGRMPSPAGFKYFVEHSLRLDSIDEQDIYHVIKAFDFEAFKLEDMLQKASHILSEMTGYTSVILDVEPARQRLTGFDVVQLSNHDALAVMTLDESKPVTVQFAIPRNFLTRDLIAFKAIVEERLLDGSVMDIHYKLRTEIPQIVQKYFVTTDNVLQLFDYVFSELFLETVFVAGKVNSLTYSDLSTYQFLDNEQQVAISLRQSLKEGEMASVQVADSQEAALADVSVLTHKFLIPYRGFGLLSLIGPIDMDYRRSVSLVNIIGKVLAAKLGDYYRYLNSNHYEVH

SEQ ID NO: 6869 - DNA, 1032 bp, Streptococcus pyogenes
gtgattacacaacgtcaaaatgatattttgaatttaatcgttgagctatttacacaaactcatgaaccagtagggtctaaagctttacagagaacgattgattctagtagcgccactattcgtaatgatatggcaaaactagagaagttgggattgttggaaaaagcgcacacttctagtggacggatgccaagtccagctggttttaagtattttgtagagcactccctcaggctagatagtattgatgagcaagatatttatcatgtcataaaagcttttgattttgaagcattcaaattagaagacatgcttcaaaaagctagtcacattttagcggagatgacgggctatacatccgttattttagatgtggagccagctcgtcaacgtttaacagggtttgatgttgttcagcttagcaaccatgatgctctagcagtcatgactttagatgaatctaagccagtgacagtgcagtttgctattccaagaaactttttgacacgtgacttgatagcatttaaagctatcgtagaggagcgcttgctggataatagtgtcatagatattcattataagttgaggacagaaattcctcagatcgttcaaaagtattttgtgactacggataatgttttacaactatttgattatgttttttcagagctgtttttggaaacggtatttgttgctggcaaggtaaattctttaacgtattcagatctatcaacgtatcagtttttggataatgaacagcaagtagcaatttctttgaggcaaagtctgaaagaaggtgagatggcttctgtccaagtggcagatagtcaagaagccgcacttgcagatgtgtcagttttaactcacaaatttttgattccttaccgtgggtttggactcctgagtttgattggtcctattgatatggattatcgtaggtctgttagtttggtaaacattattggaaaggtattggctgctaaattaggtgattattatcgatacctaaattctaaccattatgaagttcac

SEQ ID NO: 6870 - protein, 344 aa, Streptococcus pyogenes
VITQRQNDILNLIVELFTQTHEPVGSKALQRTIDSSSATIRNDMAKLEKLGLLEKAHTSSGRMPSPAGFKYFVEHSLRLDSIDEQDIYHVIKAFDFEAFKLEDMLQKASHILAEMTGYTSVILDVEPARQRLTGFDVVQLSNHDALAVMTLDESKPVTVQFAIPRNFLTRDLIAFKAIVEERLLDNSVIDIHYKLRTEIPQIVQKYFVTTDNVLQLFDYVFSELFLETVFVAGKVNSLTYSDLSTYQFLDNEQQVAISLRQSLKEGEMASVQVADSQEAALADVSVLTHKFLIPYRGFGLLSLIGPIDMDYRRSVSLVNIIGKVLAAKLGDYYRYLNSNHYEVH

SEQ ID NO: 6871 - DNA, 570 bp, Streptococcus agalactiae
atggcagtattcaataagttatttaaaaggaggcactcagtgtcagaagaaattaaaaaagacgatttacaggaagaagtggaagccactgaaactgaagagacagttgaggaagttattgaagaaattcctgaaaaatcagagttagaactcgcaaacgagcgtgctgatgagtttgaaaataaatacttgcgagctcatgcagaaatgcagaatatacaacgtcgctctagtgaagaacgtcaacaacttcaacgctatcgttctcaggatctggcaaaagcaatcttaccatcgcttgacaatctagaacgtgccttggctgttgaagggttgacagatgatgttaaaaaaggtttagaaatgactcgtgatagccttattcaagcactaaaggaagaaggcgtagaagaagtagaagtcgactcatttgaccacaactttcatatggcagttcagactctcccagccgatgatgaacatccagccgatagcattgcagaagtctttcaaaagggatataaattgcacgagcgtctgctaagaccagcgatggtagttgtctataac

SEQ ID NO: 6872 - protein, 190 aa, Streptococcus agalactiae
MAVFNKLFKRRHSVSEEIKKDDLQEEVEATETEETVEEVIEEIPEKSELELANERADEFENKYLRAHAEMQNIQRRSSEERQQLQRYRSQDLAKAILPSLDNLERALAVEGLTDDVKKGLEMTRDSLIQALKEEGVEEVEVDSFDHNFHMAVQTLPADDEHPADSIAEVFQKGYKLHERLLRPAMVVVYN

SEQ ID NO: 6873 - DNA, 570 bp, Streptococcus pyogenes
atggcagtattcaataagttatttaaaaggaggcactcagtgtcagaagaaattaaaaaagacgatttacaagaagaagtggaagccactgaaactgaagagacagttgaggaagttattgaagaaactcctgaaaaatcagagttagaacttgcaaacgaacgtgctgatgagtttgaaaataaatacttgcgagctcatgcagaaatgcagaatatacagcgtcgctctagtgaagaacgtcaacaacttcaacgctatcgttctcaggatctggcaaaagcaatcttaccatcgcttgacaatctagaacgtgccttggctgttgaagggttgacagatgatgttaaaaaaggtttagaaatgactcgtgatagccttattcaagcactaaaggaagaaggcgtagaagaagtagaagtcgactcgtttgaccacaactttcatatggcagttcagaccctcccagccgatgatgaacatccagccgatagcattgcagaagtctttcaaaagggatataaattgcacgagcgtctgctaagaccagcgatggtagttgtttataac

SEQ ID NO: 6874 - protein, 190 aa, Streptococcus pyogenes
MAVFNKLFKRRHSVSEEIKKDDLQEEVEATETEETVEEVIEETPEKSELELANERADEFENKYLRAHAEMQNIQRRSSEERQQLQRYRSQDLAKAILPSLDNLERALAVEGLTDDVKKGLEMTRDSLIQALKEEGVEEVEVDSFDHNFHMAVQTLPADDEHPADSIAEVFQKGYKLHERLLRPAMVVVYN

SEQ ID NO: 6875 - DNA, 1827 bp, Streptococcus agalactiae
atgtctaaaattattggtattgacttaggtacaacaaactcagcagtagcagttcttgaagggactgaatcaaaaatcattgctaacccagaaggcaatcgtacaactccttcagtagtatcattcaaaaatggtgaaattatcgtgggtgatgctgcaaaacgtcaagcggtaacaaatccagatactgttatctctatcaaatcaaagatgggaacttctgaaaaagtttctgcaaatggtaaagaatatactcctcaagaaatttcagcaatgattcttcaataccttaaaggttatgctgaagactatcttggagaaaaagtagaaaaagcagttattactgttccagcttacttcaacgatgcacaacgtcaggcaactaaagacgctggtaaaattgcaggtcttgaagtagaacgtatcgttaacgaaccaacagcagccgcacttgcttatggtatggacaagactgacaaggatgaaaaaatcttagtttttgaccttggtggtggtacatttgacgtatcaatccttgaattaggtgatggtgtcttcgacgttcttgcaacagcaggtgataacaaacttggtggtgacgactttgaccagaaaattattgatttcttggtagaagaattcaagaaagaaaatggtattgatctttctcaagacaaaatggctcttcaacgcttgaaagatgctgctgaaaaagctaaaaaagacctttcaggtgtaactcaaactcaaatttcattaccgttcatcactgctggttctgctggtcctcttcacttggagatgagcttatcacgtgctaaatttgacgatctcactcgtgaccttgttgaacgtacgaaaactccagttcgtcaagctctttcagatgcaggcttgtcattgtcagaaattgatgaagttatcctcgttggtggatcaacacgtatcccagcagttgttgaagctgtaaaagctgaaactggtaaagaaccaaataaatctgttaaccctgatgaagtggttgctatgggtgctgctatccaaggtggtgttatcactggggatgtgaaagacgttgtacttcttgacgtaacaccattgtcacttggtatcgaaacaatgggtggtgtcttcactaaattgatcgaccgcaacacaacaatcccaacatctaaatcacaagtcttctcaacagcagcagacaaccaaccagccgttgatatccatgttcttcaaggtgaacgcccaatggcagcagataacaaaacactcggtcgcttccaattgactgatatcccagctgcacctcgtggaatcccacaaattgaagtaacatttgatatcgataaaaatggtattgtatctgttaaagctaaagatctcggtactcaaaaagaacaacacattgttatccaatctaattcaggattaactgatgaagaaattgataaaatgatgaaagatgctgaagcaaatgctgaagcagatgcaaaacgtaaagaagaagttgatcttaaaaatgaagttgaccaagccatctttgcaacagaaaaaactattaaagaaactgaaggcaaaggctttgatacagaacgtgatgcagcgcaatcagcacttgatgagttgaaaaaagctcaagaatcaggtaaccttgacgacatgaaagctaaacttgaagctcttaacgaaaaagcacaagctcttgcagttaaactttacgaacaagcggctgcagcacaacaagcagctcaaggggctgaaggtgcacaatcagctgattcatcaagcaagggtgatgatgttgtagatggcgaattcactgagaaa

SEQ ID NO: 6876 - protein, 609 aa, Streptococcus agalactiae
MSKIIGIDLGTTNSAVAVLEGTESKIIANPEGNRTTPSVVSFKNGEIIVGDAAKRQAVTNPDTVISIKSKMGTSEKVSANGKEYTPQEISAMILQYLKGYAEDYLGEKVEKAVITVPAYFNDAQRQATKDAGKIAGLEVERIVNEPTAAALAYGMDKTDKDEKILVFDLGGGTFDVSILELGDGVFDVLATAGDNKLGGDDFDQKIIDFLVEEFKKENGIDLSQDKMALQRLKDAAEKAKKDLSGVTQTQISLPFITAGSAGPLHLEMSLSRAKFDDLTRDLVERTKTPVRQALSDAGLSLSEIDEVILVGGSTRIPAVVEAVKAETGKEPNKSVNPDEVVAMGAAIQGGVITGDVKDVVLLDVTPLSLGIETMGGVFTKLIDRNTTIPTSKSQVFSTAADNQPAVDIHVLQGERPMAADNKTLGRFQLTDIPAAPRGIPQIEVTFDIDKNGIVSVKAKDLGTQKEQHIVIQSNSGLTDEEIDKMMKDAEANAEADAKRKEEVDLKNEVDQAIFATEKTIKETEGKGFDTERDAAQSALDELKKAQESGNLDDMKAKLEALNEKAQALAVKLYEQAAAAQQAAQGAEGAQSADSSSKGDDVVDGEFTEK

SEQ ID NO: 6877 - DNA, 1824 bp, Streptococcus pyogenes
atgtctaaaattattggtattgacttaggtacaacaaactcagcagtagcagttcttgaagggactgaatcaaaaatcattgctaacccagaaggcaatcgtacaactccttcagtagtatcattcaaaaatggtgaaattatcgtgggtgatgctgcaaaacgtcaagcagtgacaaacccagaaacagtaatctctattaaatctaaaatgggaacttctgaaaaagtttctgcaaatggtaaagaatatactcctcaagaaatttcagcaatgattcttcaataccttaaaggttatgctgaagactatcttggagaaaaagtagaaaaagcagttattactgttccagcttacttcaacgatgcacaacgtcaggcaactaaagacgctggtaaaattgcaggtcttgaagtagaacgtatcgttaacgaaccaacagcagccgcacttgcttatggtatggataagactgacaaggatgaaaaaatcttagtttttgaccttggtggtggtacatttgacgtatcaatccttgaattaggtgatggtgtcttcgacgttcttgcaacagcaggtgataacaaacttggtggtgacgactttgaccaaaaaattattgatttcttagtggctgaatttaagaaagaaaatggcattgacttatcacaagataagatggcacttcaacgcttgaaagatgctgctgaaaaagctaaaaaagatctttcaggtgtgacacaaacacaaatttcattaccgttcatcactgctggttctgccggtcctcttcacttggagatgagcttatctcgtgctaaatttgacgatctcactcgcgaccttgtagaacgtacgaaaactccagttcgtcaagccctttcagatgcaggattgtcattgtcagaaattgatgaagttatccttgttggtggatcaactcgtatcccagcagttgtcgaagctgtaaaagctgaaactggtaaagaaccaaataaatctgtaaaccctgatgaagtggttgctatgggtgctgctatccaaggtggtgttatcactggggatgtgaaagacgttgtccttcttgacgtaacaccattgtcacttggtattgaaacaatgggtggtgtcttcactaaattgatcgaccgcaatacaactatcccaacatctaaatcacaagtcttctcaacagcagcagacaaccaaccagctgttgatatccatgttcttcaaggtgaacgcccaatggcagcagataacaagactcttggtcgcttccaattgactgatatcccagctgcacctcgtggaatcccacaaattgaagtaacatttgatatcgataaaaacggtattgtttctgtaaaagctaaagaccttggtacgcaaaaggaacaacacatcgttatcaaatcaaacgacggactttctgaagaagaaattgatcgcatgatgaaagacgctgaagctaatgccgaagccgatgcgaaacgtaaagaagaagttgaccttaaaaacgaagttgaccaagctatctttgctactgaaaaaacaatcaaagaaactgaaggtaaaggctttgatacagaacgcgatgcagcgcaatcagctcttgacgagttaaaagctgcgcaagaatctggcaaccttgacgacatgaaagctaaacttgaagcattaaatgaaaaagcgcaagctttggctgttaaaatgtacgagcaagctgcagcagctcaacaagcagcacaaggtgcagaaggtgcacaagctaatgattcagcaaataatgatgatgttgtagatggcgaatttacagaaaag

SEQ ID NO: 6878 - protein, 608 aa, Streptococcus pyogenes
MSKIIGIDLGTTNSAVAVLEGTESKIIANPEGNRTTPSVVSFKNGEIIVGDAAKRQAVTNPETVISIKSKMGTSEKVSANGKEYTPQEISAMILQYLKGYAEDYLGEKVEKAVITVPAYFNDAQRQATKDAGKIAGLEVERIVNEPTAAALAYGMDKTDKDEKILVFDLGGGTFDVSILELGDGVFDVLATAGDNKLGGDDFDQKIIDFLVAEFKKENGIDLSQDKMALQRLKDAAEKAKKDLSGVTQTQISLPFITAGSAGPLHLEMSLSRAKFDDLTRDLVERTKTPVRQALSDAGLSLSEIDEVILVGGSTRIPAVVEAVKAETGKEPNKSVNPDEVVAMGAAIQGGVITGDVKDVVLLDVTPLSLGIETMGGVFTKLIDRNTTIPTSKSQVFSTAADNQPAVDIHVLQGERPMAADNKTLGRFQLTDIPAAPRGIPQIEVTFDIDKNGIVSVKAKDLGTQKEQHIVIKSNDGLSEEEIDRMMKDAEANAEADAKRKEEVDLKNEVDQAIFATEKTIKETEGKGFDTERDAAQSALDELKAAQESGNLDDMKAKLEALNEKAQALAVKMYEQAAAAQQAAQGAEGAQANDSANNDDVVDGEFTEK

SEQ ID NO: 6879 - DNA, 1137 bp, Streptococcus agalactiae
atgaacaatacagaattttatgatcgtcttggcgtttcaaaagatgcttctcaggacgaaataaaaaaagcttaccgtaggatgtctaagaaataccatccagatattaataaggagacgggagcagaggaaaaatataaagaggttcaagaagcttatgaaaccttgagtgatacacaaaaacgtgctgcctatgatcaatatggcgctgctggggcaaatggcggttttggtggcttcgatggtggcggttttggtggcttcgatggtggtggctttggtggttttgaagacatcttctcaagcttttttggtggaggagggatgcgcaatcctaatgcaccacgtcaaggagatgacctacaatatcgtgttaatttaagttttgaagaagctatctttggagctgaaaaagaagtatcttataatcgggagtcatcatgtcatacttgttcaggaagtggagctaagccaggtactagccctgtgacttgtcaaaagtgtcatggttcgggtgtgattaatgttgatacacaaacacctctaggaacaatgcgtcgccaagtgacttgtgatgtttgtcagggtagtggtcaagaaatcaaagagaaatgtccaacatgtcatggaactggtcatgagaagaagacgcataaagtatcagttaaaatacctgcaggagttgaaactgggcaacaaattcgtttaacaggacaaggtgaagctggcttcaatggtggtccttatggtgatctctttgttattattaacgttctcccaagccaacagtttgagcgtaatggatcaacaatttattatactttgaatattagctttgtccaagctgctttgggtgatacaattgatatacctactgtccatggagcggtagaaatgtcaattcctgctggtactcagacaggaaaaacgtttcgtcttcgcggaaaaggtgcccctaaacttcgagggggtggacaaggtgatcagcatgttactgttaacatcgtaactcctactaaattgaatgatgctcaaaaagaggcattgcacgcttttgcagaggcaagtggagataagatggtacatccgaagaagaaaggtttctttgataaagtcaaagatgctttagatgttgat

SEQ ID NO: 6880 - protein, 379 aa, Streptococcus agalactiae
MNNTEFYDRLGVSKDASQDEIKKAYRRMSKKYHPDINKETGAEEKYKEVQEAYETLSDTQKRAAYDQYGAAGANGGFGGFDGGGFGGFDGGGFGGFEDIFSSFFGGGGMRNPNAPRQGDDLQYRVNLSFEEAIFGAEKEVSYNRESSCHTCSGSGAKPGTSPVTCQKCHGSGVINVDTQTPLGTMRRQVTCDVCQGSGQEIKEKCPTCHGTGHEKKTHKVSVKIPAGVETGQQIRLTGQGEAGFNGGPYGDLFVIINVLPSQQFERNGSTIYYTLNISFVQAALGDTIDIPTVHGAVEMSIPAGTQTGKTFRLRGKGAPKLRGGGQGDQHVTVNIVTPTKLNDAQKEALHAFAEASGDKMVHPKKKGFFDKVKDALDVD

SEQ ID NO: 6881 - DNA, 1188 bp, Streptococcus pyogenes
ttgtcggatttcctatttttcattaagtcgttttacagcttggtatcttacattatgaacaatacagaatattacgatcgtctgggggtttctaaggacgcttctcaggacgatatcaaaaaagcttatcgaaaaatgtctaaaaaatatcatccagatatcaataaagaagctggagcggagcaaaagtataaggatgttcaagaagcttacgaaaccttaagtgattcacaaaagcgtgctgcttatgatcaatacggcgctgcaggtgctcaaggcggctttggtggcggagcaggcggctttggtggttttgacggaggtggctttggtggttttgaagatatcttctcaagcttctttggtggcggtggaagccgaaacccaaatgcccctcgtcaaggtgacgatttgcaatatcgtgttaatttatcttttgaagaggctgtatttggtgttgaaaaagaagttagctataatcgcgaagcaacctgcggcacttgtttaggctcaggtgcaaaacctggtaccgctccagtaacttgtcgtaagtgccatggttcaggtgtaatgacaattgacacccaaacaccacttggtatgatgcgtcgacaagtcacctgcgatatttgtcatggtagtggtaaggaaattaaagaaccctgtcaaacctgtcacggtactggtcatgaaaagcaagctcataaagtgtctgttaagattccagctggtgtagagactggtcagcaaatccgtttacaaggtcaaggagaagctggctttaatggcggaccttatggtgatttatttgttattttgaatgtcttaccaagtaagcaatttgaacgcaatggttccactatttactacaacttagatatttcttttactcaagcagccttaggagatactgttgaaattccaacggttcatggcgatgttgagatggctatccctgctgggacacaaacaggtaaaaccttccgcctcaaaggcaaaggagcaccaaaactccgtggtggaggtcaaggggatcaacatgttaccgttaatattgtgaccccaaccaaactcaatgacgctcaaagggaagccttgcaagcatttgcagaagcgagtggtgaaaaaatgttacatccaaagaaaaaaggtttttttgataaagtgaaagatgccttagaggatatt

SEQ ID NO: 6882 - protein, 396 aa, Streptococcus pyogenes
LSDFLFFIKSFYSLVSYIMNNTEYYDRLGVSKDASQDDIKKAYRKMSKKYHPDINKEAGAEQKYKDVQEAYETLSDSQKRAAYDQYGAAGAQGGFGGGAGGFGGFDGGGFGGFEDIFSSFFGGGGSRNPNAPRQGDDLQYRVNLSFEEAVFGVEKEVSYNREATCGTCLGSGAKPGTAPVTCRKCHGSGVMTIDTQTPLGMMRRQVTCDICHGSGKEIKEPCQTCHGTGHEKQAHKVSVKIPAGVETGQQIRLQGQGEAGFNGGPYGDLFVILNVLPSKQFERNGSTIYYNLDISFTQAALGDTVEIPTVHGDVEMAIPAGTQTGKTFRLKGKGAPKLRGGGQGDQHVTVNIVTPTKLNDAQREALQAFAEASGEKMLHPKKKGFFDKVKDALEDI

SEQ ID NO: 6883 - DNA, 1245 bp, Streptococcus agalactiae
atggtaaccaaagttgaagagattcgctcatatttgatagcttctatacaaaatggtaagttggctccaggagatcgcctaccatctataagacagttagctaatcaattttcctgtaacaaagatacagtccaacgagttttgatggaattgcgttttgataattatatctatgcaaagcctaggtcaggctattacgtctttgattctcatcaagaggaagttgaagaaggggttagtttaccaaactctgagattgcaaatatagcttatgatgattttagattgtgtttgaatgagacccttattggtagggaagattaccttttcaattattactatcgtcaagaaggtcttcttgatttaagtaaagcagtggctaaattaatggaagaaacaggggtctatgttccccttgatgatattgttattacggctggtactcaacaggcattatttattttgacacaggttacctttccaaatcgaaaatctcgagttttaatagaagaaccgacctatcctcgtatgattgaactaatcaaaacacaaaatttaccctatgaaactatttctcgaggtactcatggaattgattttcagcgtttagaggagattttccagacacaatcaattaagtttttttatgttatacctcgcatgcataatcctttgggaacatcctataatccggtagagatgaaaagattaatagagatggcagagaagtatgatgtttatattgtggaagatgactatatgtctgattttgcaagtcagtcaccattacattattatgatactcacgggcgtgttatttatctaaaatctttttcaaaggctattttccctgctttaagattagctgcgatttgtttaccacaagctttaaaatcaacatttatggcttacaagaagttgatggattatgatactaatctgattttacaaaaagcattagcgctttatattgaaaatggcctttatgctaagaatagtcaatatttgaaatatcgttatcagaaagaccttgcaaattcaaaatctattttagctgatcaccctaatctaccctcatatagtttacatcacgatagtgtattatttgattgttcgaaactcgataactttaaaatattacggcaatacggcgatactttggaaaattatttttgtcaaaaatcgcatcaatctctcttacaagtaaaaaatgattcctgcttaaagcagttcttgggatcgttg

SEQ ID NO: 6884 - protein, 415 aa, Streptococcus agalactiae
MVTKVEEIRSYLIASIQNGKLAPGDRLPSIRQLANQFSCNKDTVQRVLMELRFDNYIYAKPRSGYYVFDSHQEEVEEGVSLPNSEIANIAYDDFRLCLNETLIGREDYLFNYYYRQEGLLDLSKAVAKLMEETGVYVPLDDIVITAGTQQALFILTQVTFPNRKSRVLIEEPTYPRMIELIKTQNLPYETISRGTHGIDFQRLEEIFQTQSIKFFYVIPRMHNPLGTSYNPVEMKRLIEMAEKYDVYIVEDDYMSDFASQSPLHYYDTHGRVIYLKSFSKAIFPALRLAAICLPQALKSTFMAYKKLMDYDTNLILQKALALYIENGLYAKNSQYLKYRYQKDLANSKSILADHPNLPSYSLHHDSVLFDCSKLDNFKILRQYGDTLENYFCQKSHQSLLQVKNDSCLKQFLGSL

SEQ ID NO: 6885 - DNA, 1266 bp, Streptococcus pyogenes
atgacaacaaaatatcaaacaatcatttccaatatcgaacaagatatccagaaacagcgactaaaaaaaggggacaagctaccttcaattagggtactaagtaaggtttattattgtagcaaagatactgttcagcgggctcttttagaattaaaatatcgtcacttaatttatgctgttcctaaaagtggttattatgttttgggtaacgtaagcatgcccgataatgttcttaatctaagtcttgaagattataataatatggcttatgaagatttccgactctgcttaaatgaggccttaagtgctaaagacaaatacctctttcattattatcacaaaaccgaaggactagaagaactaagggaagctttgcttctttacttagctgaaaatagtgtttacagtaacaaagaccaactattaatcacctctgggacgcaacaagcgctttatattttatcacaaatgccttttcctaatacgggcaaaacaattctccttgaaaagcctacttatcatcggatggaagctattgttgctcagttaggattaccctatcaaactatctctagacactttaatggccttgatttagaactcttagaatctttatttcaaactggcgatattaaatttttttacacgatttcacgattttcacatcctctgggactttcttatagcactaaggaaaaggaagctattgttcgtctagcacaacgataccaggtttatattttagaagatgattatttaggagattttgtgaaacttaaagagccaccaattcattattatgacactcatcaccgaatcatctacctaaaatctttttcaatgagtgtttttcctgcactccgtatcggagctctagttttaccgtcaggtttaaaacctcattttttaacccaaaaatcattgattgatttagacacgaacttactaatgcaaaaagcattagctctttatttagaaaatgggatgtttcaaaaaaatcttcgctttattaagcgttatctaaaacagcgggaacgtcaattggctctctttttaaaacaaaattgccctgatattcactatcaactaacccctactcatttagtgattgattacacgacatcagactcttatagaaactttacattagataaatctgatagaataataataactggaaaaaaacgctatctctctattactatcaatcaacaaatacaaagcaaattaaactcactaatcaaaaatacttgtggaaagagcaac

SEQ ID NO: 6886 - protein, 422 aa, Streptococcus pyogenes
MTTKYQTIISNIEQDIQKQRLKKGDKLPSIRVLSKVYYCSKDTVQRALLELKYRHLIYAVPKSGYYVLGNVSMPDNVLNLSLEDYNNMAYEDFRLCLNEALSAKDKYLFHYYHKTEGLEELREALLLYLAENSVYSNKDQLLITSGTQQALYILSQMPFPNTGKTILLEKPTYHRMEAIVAQLGLPYQTISRHFNGLDLELLESLFQTGDIKFFYTISRFSHPLGLSYSTKEKEAIVRLAQRYQVYILEDDYLGDFVKLKEPPIHYYDTHHRIIYLKSFSMSVFPALRIGALVLPSGLKPHFLTQKSLIDLDTNLLMQKALALYLENGMFQKNLRFIKRYLKQRERQLALFLKQNCPDIHYQLTPTHLVIDYTTSDSYRNFTLDKSDRIIITGKKRYLSITINQQIQSKLNSLIKNTCGKSN

SEQ ID NO: 6887 - DNA, 774 bp, Streptococcus agalactiae
atgacaaggtataaggcacagatttcttatgatggttcagctttttcaggcttccaaagacaaccaaattgtaggacagttcaagaagaaattgagagaactcttaagcgcctaaatagcgggaacgatgtgataatccatggtgctggtcgcacagatgttggtgttcatgcttatggacaagttatccattttgatttaccacaggcgcgtgatgtagaaaaattacgctttggtttagatacacagtgtccagacgatattgatattgtcaaagtagagcaagtgtctgatgattttcattgtcgatatgataaacacattaaaacttatgagtttttagtggatatcggtaggccgaaaaatcctatgatgagaaactatgcaacacattacccttatcctgtcattattgagcttatgcaagaagctattaaagatttagtaggtacccatgactttacaggctttactgcttcaggtacgagtgtagaaaataaagtacgtactatttttgatgcgaaaattcagtttgaagcgtctaaaaatcttttaatttttacctttacaggaaatggttttttgtataaacaggtgcgtaatatggttggtaccctgctaaaaattggtaatggacgcatgcctattagccaaatcaaaacaattttacaggctaaaaatcgggatttagcaggtccaactgcggcaggaaatggtttatatttgaaggagattatttatgaagacgaggaatgttttagcaatttcaggaaa

SEQ ID NO: 6888 - protein, 258 aa, Streptococcus agalactiae
MTRYKAQISYDGSAFSGFQRQPNCRTVQEEIERTLKRLNSGNDVIIHGAGRTDVGVHAYGQVIHFDLPQARDVEKLRFGLDTQCPDDIDIVKVEQVSDDFHCRYDKHIKTYEFLVDIGRPKNPMMRNYATHYPYPVIIELMQEAIKDLVGTHDFTGFTASGTSVENKVRTIFDAKIQFEASKNLLIFTFTGNGFLYKQVRNMVGTLLKIGNGRMPISQIKTILQAKNRDLAGPTAAGNGLYLKEIIYEDEECFSNFRK

SEQ ID NO: 6889 - DNA, 747 bp, Streptococcus pyogenes
atggtaagatacaaagcaacgatttcctatgatgggactcttttttcgggttttcaaagacaaagacatttacgtacggttcaagaagagattgaaaaaacactctataaattaaataacggtacaaaaattataattcatggtgcaggacgtacggatgcaggagtacatgcttatggacaggtgatccattttgatttgcctcaagaacaagaagttgaaaaattgcgatttgctcttgatacacagactcctgaagatattgatgttgttaatatagaaaaagtggctgatgattttcattgtcgttatcagaagcatttaaaaacttatgaatttttagttgataatggtcgacctaaaaatccgatgatgcgacactataccactcattacccttatactcttaatattaaacttatgcaagaagctattaacggtctggtaggtacacacgattttactggttttacagcagcaggaacttcggtacaaaataaggtgcgaacgattaccaaagcaacggtatctcgggatgaaaaaactgattttttggtgtttactttttcaggaaatggttttctctataagcaggtgaggaatatggtgggaactttgctgaaaattggtaatggtcaaatgccagttgaacaagttaaagtgattttgagctccaaaaatcgtcagctagctggaccaacgatatctggaaatgggctttacttgaaggagatttgttatgaaaac

SEQ ID NO: 6890 - protein, 249 aa, Streptococcus pyogenes
MVRYKATISYDGTLFSGFQRQRHLRTVQEEIEKTLYKLNNGTKIIIHGAGRTDAGVHAYGQVIHFDLPQEQEVEKLRFALDTQTPEDIDVVNIEKVADDFHCRYQKHLKTYEFLVDNGRPKNPMMRHYTTHYPYTLNIKLMQEAINGLVGTHDFTGFTAAGTSVQNKVRTITKATVSRDEKTDFLVFTFSGNGFLYKQVRNMVGTLLKIGNGQMPVEQVKVILSSKNRQLAGPTISGNGLYLKEICYEN

SEQ ID NO: 6891 - DNA, 756 bp, Streptococcus agalactiae
atgaagacgaggaatgttttagcaatttcaggaaatgatattttctctggcggcggcttgcatgcagatttagcaacttacgttgttaataaattacatggttttgtggcagtaacatgcttaacagcaatgtcagataaagggtttgaagtcattcctatagaggcatctatactaaagcagcaactagaaagtttaaaagatgtagagtttgggtctattaaactaggattgcttcccaatgtagaaacagcacaagttgttttggaatttgtaaaatcaaaacaagaatgtccagtagtcttagacccagtcttagtttgtaaagaaaatcatgatttagaagttagccaattacgtgagcagctaattgcgtttttcccatatgctgatgtgattactcctaatttagtagaggctcaattattgacgggtctttcgattgaaaacttagatcaaatgaaaattgctgctgagaaactttacgatatgggagctaaacatgttgttatcaaagggggcaaccgtttaaatgctgaagaggctacagacctttactatgatggtgaacgttttgaaacctatgtttttcctgtagtagatgccaataatacaggtgctggatgtacatttgcgtcaagtattgccagccaattagctatgggtaaaaatgtagaagatgcagtcaaaatgtctaaaggtttcgtctatcaagctattaaagcatcggataagtacggagttgtccaacatttt

SEQ ID NO: 6892 - protein, 252 aa, Streptococcus agalactiae
MKTRNVLAISGNDIFSGGGLHADLATYVVNKLHGFVAVTCLTAMSDKGFEVIPIEASILKQQLESLKDVEFGSIKLGLLPNVETAQVVLEFVKSKQECPVVLDPVLVCKENHDLEVSQLREQLIAFFPYADVITPNLVEAQLLTGLSIENLDQMKIAAEKLYDMGAKHVVIKGGNRLNAEEATDLYYDGERFETYVFPVVDANNTGAGCTFASSIASQLAMGKNVEDAVKMSKGFVYQAIKASDKYGVVQHF

SEQ ID NO: 6893 - DNA, 462 bp, Streptococcus agalactiae
atgaggaaagagaaaactagtcaattggttcaattggcaattgtaacagctatatctattgtattggggatgtttataagtattccgacaccaacaggttttttgacattactagatgctggaatattctttgctgccttttactttggcaaaaaagaaggggctgtggtaggtgccttagctggttttttaattgatttattgaaaggttatcccaattggatgttctttagtttattgattcatgggacgcaagggtatttagcgggtttaccaggtagaagacgtcttttaggtcttattagtgcaactcttgttatggtattaggttatgctatagctagtggattgatgtatggttggggagctgttctaccagatattcctggcaatattatgcaaaatatggttggtatggttgttggttttgctcttaataagtctctagaaagagtgaagaaa

SEQ ID NO: 6894 - protein, 154 aa, Streptococcus agalactiae
MRKEKTSQLVQLAIVTAISIVLGMFISIPTPTGFLTLLDAGIFFAAFYFGKKEGAVVGALAGFLIDLLKGYPNWMFFSLLIHGTQGYLAGLPGRRRLLGLISATLVMVLGYAIASGLMYGWGAVLPDIPGNIMQNMVGMVVGFALNKSLERVKK

SEQ ID NO: 6895 - DNA, 468 bp, Streptococcus pyogenes
atgcaaaatagtaagatacgacaaatgagtttaacagggatattgacagcattggttgttgttttaggaagatttgtcatgctacctactccaacaggttttttaacgctgttggatgcaggaatttatgctgtcagcttttcctttggatcagctcaaggagctattgtgggagggttatcaggttttttaatcgatttagtggcaggataccctcagtggatgtttcatagtttgattgctcacagtgtccaagggtattttgcgggatggagagggcgcaagcgttggcttggtgttgtgataggttcttttatcatgattttttggtactttttaggctctcttatgcttggttatggcctttcgggatctttagccggtatttggggaaacgtcatgcaaaatacattagggctttttgttggttttattatctttaaggccatattaaggcaaaaaaagaga

SEQ ID NO: 6896 - protein, 156 aa, Streptococcus pyogenes
MQNSKIRQMSLTGILTALVVVLGRFVMLPTPTGFLTLLDAGIYAVSFSFGSAQGAIVGGLSGFLIDLVAGYPQWMFHSLIAHSVQGYFAGWRGRKRWLGVVIGSFIMIFWYFLGSLMLGYGLSGSLAGIWGNVMQNTLGLFVGFIIFKAILRQKKR

SEQ ID NO: 6897 - DNA, 567 bp, Streptococcus agalactiae
atgatactagattataataagttaaagcaggaaactaaagctattgtagttgatattattgaacgtagcgctcttaaaaaaggtcaaatttttgtactaggtctatcatctagtgaggtttctggtggtttaattggaaaaaattctagttctgaaattggtgaaattatcgttgaagttatcctcaaagagttacattcacgcggcatctatttagcagttcaaggttgtgaacatgttaatagggcgttggttgttgaagcagaattggctgaacgtcaacagttggaagtcgttaatgttgttcctaatctacatgctggcggtagtggtcaggttgcagcttttaagttgatgacatcaccagttgaggttgaagaaattgtggcacatgctggaattgatattggagatacttctattggaatgcatatcaagagagtacaagttcccttgattccaattagtcgtgagttgggaggagcacacgttacagcactagctagtcgtcctaaattaattggcggtgctagagcaggatatacgagcgatccaatccgtaaattt

SEQ ID NO: 6898 - protein, 189 aa, Streptococcus agalactiae
MILDYNKLKQETKAIVVDIIERSALKKGQIFVLGLSSSEVSGGLIGKNSSSEIGEIIVEVILKELHSRGIYLAVQGCEHVNRALVVEAELAERQQLEVVNVVPNLHAGGSGQVAAFKLMTSPVEVEEIVAHAGIDIGDTSIGMHIKRVQVPLIPISRELGGAHVTALASRPKLIGGARAGYTSDPIRKF

SEQ ID NO: 6899 - DNA, 558 bp, Streptococcus pyogenes
ttgttgaataatttagagaaacaaacaagggaaatcgtcattgatgttgtagaacgctctgctattcaaccaggtaatctttttgttctaggtctttcatctagcgaaattttgggtagtagaattggaaaacaatctagtctagaagtaggtcaaatagttgttgaagttgtgttagatgaattaaataagcgtggtgttcatttggctgtacaaggttgtgaacacgtcaatcgtgccttggtagtagagaggcatgtggcagaatctaagcagttagagattgtcaatgtggttccgaatcttcatgctggtggcagtgctcagatggctgcttttcaacttatgtcagaccctgtcgaagtagaagaagttattgcacacgctggacttgatataggtgatactgctataggaatgcatattaagcgtgttcagatccctctgattccttgtcaacgagagctaggaggtgctcatgtgacagctttggctagtcgaccaaaattaattggtggagctagggctgattacaatatggatattatccgtaaatcc

SEQ ID NO: 6900 - protein, 186 aa, Streptococcus pyogenes
LLNNLEKQTREIVIDVVERSAIQPGNLFVLGLSSSEILGSRIGKQSSLEVGQIVVEVVLDELNKRGVHLAVQGCEHVNRALVVERHVAESKQLEIVNVVPNLHAGGSAQMAAFQLMSDPVEVEEVIAHAGLDIGDTAIGMHIKRVQIPLIPCQRELGGAHVTALASRPKLIGGARADYNMDIIRKS

SEQ ID NO: 6901 - DNA, 840 bp, Streptococcus agalactiae
atgattactttagaaaaatttatagaccatcttaatgtagaggaagttttatttactttcttcaccaaactaatatcaatcttattattaatcattgcattcgttatcgttaggcaagtcatcaattatcttttcgaaaagactgttaatcgctcactcgccttttctagacaaaaagtagctcgtcaaaaaacattagctaaactttctcacaatgttttaaactataccctttatttctttctattctattggattttaagtatattgggcgttccaatttctagtttattagctggggctggtattgctggggttgctattggacttggtgctcaaggcttcttatcagatgttgtcaatggcttttttattctgctagaaaaccaatttgatgttggtgatattattaatgttggtactgtatcaggcactgttactaatgttgggatacgcaccacacaaattcatgatttcgatggaaccttgcacttcattcctaatcgtaatattacaattgtcagcaataagtctcgtagcaatatgcgtgctcaaattgatattcctttatttgttcatacaaaccttgatcagatttctgatattgtaacaaaaatcaatgaagagtatgtttcaaaacaccctgctatcgttggagagcctactgtttttggtcctacaaccaatgctaatggtcaatttgtttatcgtattaatatcttcacgcaaaacggtgctcagtttgacatctatgctgaattttacaaactttatcaaaaagctattcttgaagaaggtattgacttaccaacgtacaatttctccaataaccactctcgt

SEQ ID NO: 6902 - protein, 280 aa, Streptococcus agalactiae
MITLEKFIDHLNVEEVLFTFFTKLISILLLIIAFVIVRQVINYLFEKTVNRSLAFSRQKVARQKTLAKLSHNVLNYTLYFFLFYWILSILGVPISSLLAGAGIAGVAIGLGAQGFLSDVVNGFFILLENQFDVGDIINVGTVSGTVTNVGIRTTQIHDFDGTLHFIPNRNITIVSNKSRSNMRAQIDIPLFVHTNLDQISDIVTKINEEYVSKHPAIVGEPTVFGPTTNANGQFVYRINIFTQNGAQFDIYAEFYKLYQKAILEEGIDLPTYNFSNNHSR

SEQ ID NO: 6903 - DNA, 843 bp, Streptococcus pyogenes
atgacatttatattacattacctagagcagtctcatatcgaaaatattggcttaacgatttttaaaaagctagtgtctctcattattctattactcttttttgctattttaaaacgtgttactaactatctttttgaaaaaaccattaacaaatcgtttgcttattcaagacaaagtgaagctcgcaaaaaaacactctctaagctcactcacaacattttaaattacttattatattttcttctcatttattggatacttagcttatttggcatacctgtctctagtcttctagcaggagctggaattgctggagtagcaatcgggttaggtgcacaaggatttttatctgacgttgtcaatggcttttttatcttatttgagaatcaatttgaagtaggagataacgttactatctctgacatagaaggcagtgtctttggtgttggaattagaactactcaaattcgtggattcgatggaacactacatttcatcccaaaccgtagcatcaccgttgtcagcaacaaatctcgtggtaatatgcgtgccttaattgaaattcctctttattccactgttaatttgagccaagtcactcgaatcattgatgaagtgaatcaaaaggaattgccaaaccatcctcaaatcgttggcaaaccaaatattttagggcctcaaaataactctaatggacagttcacttttagaattgctattttcacagaaaatggagaacaatttaagatttaccatactttttatagactttatcaagaagctttactcaaagaaggcattcaattaccgactgcaatcagctattctatcacctcaaaatct

SEQ ID NO: 6904 - protein, 281 aa, Streptococcus pyogenes
MTFILHYLEQSHIENIGLTIFKKLVSLIILLLFFAILKRVTNYLFEKTINKSFAYSRQSEARKKTLSKLTHNILNYLLYFLLIYWILSLFGIPVSSLLAGAGIAGVAIGLGAQGFLSDVVNGFFILFENQFEVGDNVTISDIEGSVFGVGIRTTQIRGFDGTLHFIPNRSITVVSNKSRGNMRALIEIPLYSTVNLSQVTRIIDEVNQKELPNHPQIVGKPNILGPQNNSNGQFTFRIAIFTENGEQFKIYHTFYRLYQEALLKEGIQLPTAISYSITSKS

SEQ ID NO: 6905 - DNA, 1068 bp, Streptococcus agalactiae
  misc_feature (1)..(1068): n = a, c, g, or t
atgtctacatcatttgaaaataaagctacaaaccgtggtattatcacatttacaattagtcaagatgagatcaagccagctcttgatcaagcattcaacaaagtaaaaaaagatttgaacgttccaggattccgtaaaggacatatgcctcgtacagttttcaaccaaaaatttggtgaagaagcactctacgaaaatgcattgaatttagtgttgccaaaggcttacgaagcagctgttgcagaacttggtttagacgttgttgctcaaccaaaaattgatgttgtatcaatggaaaaaggtcaagattggaagttgacagctgaagttgttacaaaaccagaagttaaacttggagattacaaagacctttcagtagaagttgatgcttcaaaagaagtttcagatgaagaagttgatgctaaagttgaacgtgagcgtaacaaccttgcagaattgactgttaaagatggtgaagcagcacaaggtgatacagttgttattgactttgtaggttcagttgatggtgttgaatttgatggtggtaaaggagataacttctcacttgaacttggttcaggtcaatttatcccaggatttgaagaacaattagtaggttctaaagctggtcaaactgtagacgttaatgtaacattcccagaagattatcaagcagaagatcttgctggtaaagatgctaaatttgttacaacaattcacgaagtaaaaactaaagaagttccagcacttgatgatgaacttgcaaaagatattgatgatgaagttgaaacacttgatgagttgaaagcgaaatatcgcaaagagctagaatcagcaaaagaaattgcatttgatgatgcagttgaaggtgcagcaatcgaattagctgttgccaatgcagaaattgttgaattaccagaagaaatggtccatgatgaagtacatcgtgctatgaatgagttcatgggtaatatgcaacgtcaaggaatttcaccagaaatgtacttccaattaacaggtacaactgaagaagaccttcataagcaataccaagcagatgctnnnnnt

SEQ ID NO: 6906 - protein, 356 aa, Streptococcus agalactiae
  MISC_FEATURE (1)..(356): Xaa = Any Amino Acid
MSTSFENKATNRGIITFTISQDEIKPALDQAFNKVKKDLNVPGFRKGHMPRTVFNQKFGEEALYENALNLVLPKAYEAAVAELGLDVVAQPKIDVVSMEKGQDWKLTAEVVTKPEVKLGDYKDLSVEVDASKEVSDEEVDAKVERERNNLAELTVKDGEAAQGDTVVIDFVGSVDGVEFDGGKGDNFSLELGSGQFIPGFEEQLVGSKAGQTVDVNVTFPEDYQAEDLAGKDAKFVTTIHEVKTKEVPALDDELAKDIDDEVETLDELKAKYRKELESAKEIAFDDAVEGAAIELAVANAEIVELPEEMVHDEVHRAMNEFMGNMQRQGISPEMYFQLTGTTEEDLHKQYQADAXX

SEQ ID NO: 6907 - DNA, 1368 bp, Streptococcus pyogenes
ttgatttcacgcataaaaagctttaaaaacgctttaaattatgataaaatgaactgtatcgaaattattttaaggagaaatgacttaatgtctacatcatttgaaaacaaagctacaaatcgtggcgtgattacatttacaatcagtcaagataaaataaaaccagctcttgataaagcttttaataaaatcaaaaaagacttgaatgcaccaggtttccgtaaaggacacatgcctcgtccagtcttcaaccaaaaatttggtgaagaagttctttatgaagatgctttgaatattgtattgccagaagcttatgaagcagctgtgacggaacttggtcttgatgtggttgcacaaccaaaaatcgatgttgtgtcaatggaaaaagggaaagagtggacactttctgctgaagttgtgacaaaacctgaagtgaaacttggtgattacaaaaacctagttgtagaagttgatgcttcaaaagaagtttcagatgaagacgtggatgctaaaattgagcgcgaacgtcaaaaccttgcggaactcattattaaagacggtgaagcagctcaaggtgacactgttgtgattgactttgttggttcagttgatggtgttgagtttgatggcggtaaaggagataacttctctcttgaacttggttcaggacaatttatcccaggttttgaagatcaactagttggtgctaaagctggcgatgaagtagaagttaatgtcacattcccagaatcttaccaagcagaagatcttgcaggtaaagccgctaaatttatgacaactattcacgaagtcaaaacaaaagaagtaccagagcttgatgatgagcttgcaaaagatattgatgaagatgttgacacacttgaagacttaaaagtaaaatatcgtaaagaacttgaagcagctcaagaaactgcttatgatgatgctgttgaaggagctgcgattgaattagcagttgcaaatgctgaaattgttgatttacccgaagaaatgattcatgaagaagtcaaccgttcagtgaatgaatttatgggcaacatgcaacgtcaaggaatctcacctgaaatgtacttccaattgactggtacaactcaagaagatttacataaccaatattcagctgaagctgacaaacgtgttaaaacacaccttgttattgaagcaattgctaaagcagaaggttttgaagcaacagatagtgaaattgaacaagaaattaatgaccttgcaacagaatataacatgccagctgaccaagttcgttctcttctttcagcagatatgttgaaacatgatattgcaatgaaaaaagcagttgaagtgattacaagcacagcaagcgttaag

SEQ ID NO: 6908 - protein, 456 aa, Streptococcus pyogenes
LISRIKSFKNALNYDKMNCIEIILRRNDLMSTSFENKATNRGVITFTISQDKIKPALDKAFNKIKKDLNAPGFRKGHMPRPVFNQKFGEEVLYEDALNIVLPEAYEAAVTELGLDVVAQPKIDVVSMEKGKEWTLSAEVVTKPEVKLGDYKNLVVEVDASKEVSDEDVDAKIERERQNLAELIIKDGEAAQGDTVVIDFVGSVDGVEFDGGKGDNFSLELGSGQFIPGFEDQLVGAKAGDEVEVNVTFPESYQAEDLAGKAAKFMTTIHEVKTKEVPELDDELAKDIDEDVDTLEDLKVKYRKELEAAQETAYDDAVEGAAIELAVANAEIVDLPEEMIHEEVNRSVNEFMGNMQRQGISPEMYFQLTGTTQEDLHNQYSAEADKRVKTHLVIEAIAKAEGFEATDSEIEQEINDLATEYNMPADQVRSLLSADMLKHDIAMKKAVEVITSTASVK

SEQ ID NO: 6909 - DNA, 423 bp, Streptococcus agalactiae
atgacaattattattggggcggatgcgcatggtgttgaacttaaggaagtgattagacaacaccttacaagtttaggtaaggaaattattgatttaacggatactagcaaagatttcgttgataataccttagcaatcgttgctaaagtgaatcaaaaagaagataacttaggaataatggttgatgcttacggtgttggtccttttatggtagccactaaggttaaggggatgattgcagcagaagtttcagatgaacgctcagcttatatgactagagctcataataacgctaggatgattactttaggttcagagattgttggtccaggagttgctaaacatatagtagagggttttgttgatgggacttacgatgcaggtcgtcatcaaattcgggtcgatatgttgaataaaatgtgc

SEQ ID NO: 6910 - protein, 141 aa, Streptococcus agalactiae
MTIIIGADAHGVELKEVIRQHLTSLGKEIIDLTDTSKDFVDNTLAIVAKVNQKEDNLGIMVDAYGVGPFMVATKVKGMIAAEVSDERSAYMTRAHNNARMITLGSEIVGPGVAKHIVEGFVDGTYDAGRHQIRVDMLNKMC

SEQ ID NO: 6911 - DNA, 423 bp, Streptococcus pyogenes
atggctattattttaggtgcagatgcacacggaaatgcattaaaagaattgatcaaaagttttcttcaagaagaaggctatgacattattgacgtgactgatattaacagtgattttattgataacacattagcggtggcgaaagccgttaatgaagcagaaggtcgtttaggcattatggtggatgcttacggagcaggtccctttatggtagccacaaaattaaaaggaatggttgctgctgaagtgtcagatgaacgctctgcttacatgacgcgcggtcacaacaatgcccgcatgatcacaataggggcagagattgtaggtccagaattagcgaagaatatcgtcaaaggttttgtgactggtccctacgatggtggtcgtcatcaaattcgtgttgacatgctcaataaaatggcc

SEQ ID NO: 6912 - protein, 141 aa, Streptococcus pyogenes
MAIILGADAHGNALKELIKSFLQEEGYDIIDVTDINSDFIDNTLAVAKAVNEAEGRLGIMVDAYGAGPFMVATKLKGMVAAEVSDERSAYMTRGHNNARMITIGAEIVGPELAKNIVKGFVTGPYDGGRHQIRVDMLNKMA

SEQ ID NO: 6913 - DNA, 540 bp, Streptococcus agalactiae
gtgctaagcgtaagagaggtaaagcagatgaaaattgcggtcggttgtgatcatattgtaacttatgacaaaattgcagttgtggattatttaaaaacaaaagggtatgaggttattgattgtggaacttatgataatatccgtactcactatcctatttatggtaagaaagtaggagaagctgtcgctagtggaaaagccgacttaggtgtatgtatttgtggaactggagttggtattaataatgctgttaataaagttccaggaattcgctcagctctggtacgtgatttgacatcagctatctatgccaaagaagaattaaatgctaacgttatcggatttggtgggaaaattactggtgggctgttaatgacagatatcatcgaggcgtttataagagctaaatataaaccaacaaaagaaaacaaagtattaattgaaaagatagccgaggttgagactcataatgcccatcaagaagagaatgactttttcacagagttcttagataaatggaatcgtggtgaatatcacgac

SEQ ID NO: 6914 - protein, 180 aa, Streptococcus agalactiae
MLSVREVKQMKIAVGCDHIVTYDKIAVVDYLKTKGYEVIDCGTYDNIRTHYPIYGKKVGEAVASGKADLGVCICGTGVGINNAVNKVPGIRSALVRDLTSAIYAKEELNANVIGFGGKITGGLLMTDIIEAFIRAKYKPTKENKVLIEKIAEVETHNAHQEENDFFTEFLDKWNRGEYHD

SEQ ID NO: 6915 - DNA, 516 bp, Streptococcus pyogenes
gtgatgaaaattgcgattggttgtgaccatattgtcaccaacgaaaaaatggctgtttctgattttttgaaatctaaaggctatgacgttattgactgtggcacttatgaccatacaagaacccattaccctatttttggaaaaaaagtcggcgaagctgtggttaatggtcaagcagacttgggtgtttgtatttgtggaactggagttggcattaataatgccgtgaacaaggtaccaggtattcgttcagcccttgttcgagatatgacaacagcgctttatgccaaggaagaattgaatgccaatgtgattggctttggtggtaaaatcacgggtgaacttcttatgtgtgatattatagatgcttttatcaaggcagaatacaaagaaactgaagagaataagaagctaattgctaaaatagcccacttggaaagtcatcatgccaaccaagaagatcctgatttttttacagaatttttggaaaaatgggatcgtggtgagtatcacgat

SEQ ID NO: 6916 - protein, 172 aa, Streptococcus pyogenes
VMKIAIGCDHIVTNEKMAVSDFLKSKGYDVIDCGTYDHTRTHYPIFGKKVGEAVVNGQADLGVCICGTGVGINNAVNKVPGIRSALVRDMTTALYAKEELNANVIGFGGKITGELLMCDIIDAFIKAEYKETEENKKLIAKIAHLESHHANQEDPDFFTEFLEKWDRGEYHD

SEQ ID NO: 6917 - DNA, 960 bp, Streptococcus agalactiae
gtggtgaatatcacgactaaggagatatctatgattttaacagtaactttgaacccttctattgatatttcgtactgcttagaaaactttaacatggatactgtaaatcgagttaccgacgtctccaaaacacctgggggtaaggggttaaatgtgactcgtgttctttctcaacttggcgataatgtagtggcaactggtctattagggggggattttggagatttcatccgaagtggcttagatgcattggaaatcagacaccaatttttaagtattggtggagaaacacgtcattgtattgcagttttacatgagggtcagcagactgaaattctagaaaaaggtccacatattactaaagatgaagcagacgcctttttgaatcatctaaaacttatctttgatgctgcaactatcataacagtatcaggaagtttaccaaagggactcccctcagattattatgctaggttaatctccctagcgaatcactttaataagaaagttgttttagactgttcaggagaagcattacgttcggttttaaaatctagtgctaagccgaccgtcattaaacctaaccttgaagaattaacacaattaattggaaaaccaattagctatagtttagacgaattaaaatctaccttacagcaagatctttttagaggaattgattgggttattgtttctttaggtgctaggggagcttttgctaaacatgggaatcactactatcaagtgacgattccaaaaatagaagttattaatccagttggttcaggggatgcaacggttgcaggaatcgcgtctgctttggaacatcaactagatgatacaaatttgcttaagagagctaatgtcttgggtatgcttaatgcacaagaaacattaacagggcatatcaatctgacctactatcaagaattaatcagtcaaatccaagtgaaagaggta

SEQ ID NO: 6918 - protein, 320 aa, Streptococcus agalactiae
MVNITTKEISMILTVTLNPSIDISYCLENFNMDTVNRVTDVSKTPGGKGLNVTRVLSQLGDNVVATGLLGGDFGDFIRSGLDALEIRHQFLSIGGETRHCIAVLHEGQQTEILEKGPHITKDEADAFLNHLKLIFDAATIITVSGSLPKGLPSDYYARLISLANHFNKKVVLDCSGEALRSVLKSSAKPTVIKPNLEELTQLIGKPISYSLDELKSTLQQDLFRGIDWVIVSLGARGAFAKHGNHYYQVTIPKIEVINPVGSGDATVAGIASALEHQLDDTNLLKRANVLGMLNAQETLTGHINLTYYQELISQIQVKEV

SEQ ID NO: 6919 - DNA, 927 bp, Streptococcus pyogenes
gtgattttaacagttactttaaatccagctattgatgtctcctaccctttggatgagctaaaatgcgatactgtcaatcgagttgtagacgttacaaagacacccggtggtaaaggcttgaatgtttcccgagttcttaatgaattcggtgagacagtcaaagctacaggttgtgtaggtggagaaagcggtgattttatcattaatcatcttcctgattcgattttaagtcgcttctataaaatttcaggtgatactagaacttgtatagccattttacacgaaggtaatcaaacggagattttagaaaaaggaccgatgttaagtgtagatgaaattgatggatttactcatcattttaagtatttactgaatgatgttgacgtagtgacgctctcaggcagtttgcctgctggtatgccagatgattactatcagaagttaatcaagattgccaatcttaatggtaagaaaacggttctggattgttctggaaatgctctagaagcagtactaaaaggtgatagtaaaccaacagttatcaaacctaatcttgaagaactttctcaacttctaggtaaagaaatgacaaaagattttgatgccttaaaagaagtcttacaagatgaactatttgatggaattgaatggataatcgtttctcttggtgctgatggtgtatttgcaaagcacaaggatacgttttataacgttgacattcctaaaatcaaaattgtaagcgctgtaggttcaggggattctacagtggcaggtattgcttcaggtttagcgaatgatgaagatgatcgagctttattaacaaaagcaaatgtcttagggatgttaaatgcgcaagaaaaaacaactgggcatgttaacatggcaaattacgataagttatatcaatctattaaagtcaaagaggta

SEQ ID NO: 6920 - protein, 309 aa, Streptococcus pyogenes
VILTVTLNPAIDVSYPLDELKCDTVNRVVDVTKTPGGKGLNVSRVLNEFGETVKATGCVGGESGDFIINHLPDSILSRFYKISGDTRTCIAILHEGNQTEILEKGPMLSVDEIDGFTHHFKYLLNDVDVVTLSGSLPAGMPDDYYQKLIKIANLNGKKTVLDCSGNALEAVLKGDSKPTVIKPNLEELSQLLGKEMTKDFDALKEVLQDELFDGIEWIIVSLGADGVFAKHKDTFYNVDIPKIKIVSAVGSGDSTVAGIASGLANDEDDRALLTKANVLGMLNAQEKTTGHVNMANYDKLYQSIKVKEV

SEQ ID NO: 6921 - DNA, 975 bp, Streptococcus agalactiae
atgggattaacagaacaaaaacaaaaacatatggaacaattgagtgataaaaatggtattatttcggccttggcttttgaccaacgtggagcattgaagcgattaatggcaaaatatcaatctgaggagcccactgtttctcaaatagaagcacttaaagttttggtagctgaagaattaaccccttacgcttcatcaatgttgttagatccagaatatgggttgccagctacgaaagttttagatgacaatgccggtcttttacttgcgtacgaaaaaacgggttatgataccagtagtaccaagcgactcccagactgtttagacatttggtctgcgaaacgcattaaagaagagggagcagacgcagttaagttcttactttattatgatgttgatagttcggatgaagtaaacgaagaaaaagaagcttatattgaacggattggttctgaatgtgttgcagaagacattccttttttccttgaaattttgtcatatgatgaaaagattacggatagctcaggtattgagtatgccaaaattaagccacgtaaggttattgaagctatgaaagttttttcaaatcctcgatttaatattgatgtcttgaaggtggaagtgcctgtcaatatggactatgtagaaggttttgcgcaaggagagactgcttataataaagcgacagctgcggcatattttagagaacaagatcaggcgacactactcccctacatttttttgagtgcaggagttcctgctcagctttttcaagagactcttgtgtttgctaaagaagctggtgctaaatttaacggtgtcctttgtggtagagcaacttgggctggaagtgttaaagagtatgttgaaaaaggagaagctggtgcacgtcaatggttacgtacaataggttttcaaaatattgatgaactaaataaaattttgcaaaaaacagcaacttcttggaaggaaaga

SEQ ID NO: 6922 - protein, 325 aa, Streptococcus agalactiae
MGLTEQKQKHMEQLSDKNGIISALAFDQRGALKRLMAKYQSEEPTVSQIEALKVLVAEELTPYASSMLLDPEYGLPATKVLDDNAGLLLAYEKTGYDTSSTKRLPDCLDIWSAKRIKEEGADAVKFLLYYDVDSSDEVNEEKEAYIERIGSECVAEDIPFFLEILSYDEKITDSSGIEYAKIKPRKVIEAMKVFSNPRFNIDVLKVEVPVNMDYVEGFAQGETAYNKATAAAYFREQDQATLLPYIFLSAGVPAQLFQETLVFAKEAGAKFNGVLCGRATWAGSVKEYVEKGEAGARQWLRTIGFQNIDELNKILQKTATSWKER

SEQ ID NO: 6923 - DNA, 981 bp, Streptococcus pyogenes
atgacaattactttaactgaaaacaaacgcaaaagcatggaaaaactaagtgtagatggtgttatttctgccttagcttttgaccaacgtggagctctcaaacgtatgatggctcaacatcaaacaaaagagccaacagtagaacaaattgaagagcttaaaagtttagtttctgaagaactaacaccatttgcatcctcaattctacttgatcctgaatatggcttgccagcaagtcgtgttcgttcagaagaagcaggcttgttgttggcatatgagaaaacaggatacgatgcaacaacaactagtcgcttacctgattgtttagatgtttggtctgcaaaacgtattaaagaagctggagcagaagcagttaaattccttctttactatgatattgatggagatcaagatgttaacgagcagaaaaaagcttacattgaacgtattggttctgaatgccgtgcagaagatattccattctacttagaaattctaacttatgatgagaaaattgctgacaatgcaagccctgagtttgcaaaagttaaagctcataaagttaacgaagcaatgaaagttttctcaaaagagcgctttggagttgacgtgttgaaagttgaagttccagtaaatatgaaatttgtagaaggctttgcagatggtgaggttctctttacaaaagaagaagcagctcaagctttccgtgaccaagaagcttctactgatttaccatacatttatttgagtgctggtgtttctgccaaattgttccaagatactttggtgtttgcagcagaatcaggtgctaaattcaacggtgtcttatgtggacgtgctacctgggcaggatctgtaaaagtctatatcgaagaaggaccacaagcagctcgtgaatggttgcgtacagaaggttttaaaaatattgacgaattaaacaaagtactagataaaactgcaagtccttggactgaaaaaatg

SEQ ID NO: 6924 - protein, 327 aa, Streptococcus pyogenes
MTITLTENKRKSMEKLSVDGVISALAFDQRGALKRMMAQHQTKEPTVEQIEELKSLVSEELTPFASSILLDPEYGLPASRVRSEEAGLLLAYEKTGYDATTTSRLPDCLDVWSAKRIKEAGAEAVKFLLYYDIDGDQDVNEQKKAYIERIGSECRAEDIPFYLEILTYDEKIADNASPEFAKVKAHKVNEAMKVFSKERFGVDVLKVEVPVNMKFVEGFADGEVLFTKEEAAQAFRDQEASTDLPYIYLSAGVSAKLFQDTLVFAAESGAKFNGVLCGRATWAGSVKVYIEEGPQAAREWLRTEGFKNIDELNKVLDKTASPWTEKM

SEQ ID NO: 6925 - DNA, 963 bp, Streptococcus agalactiae
ttggaaggaaagataattgctagagaaaagctggtaaagcaattattgttctttatgaaaggaaaaataatggctattacgatacaaaatcatgagttgcaagtgacattaaaagcgttaggtgcaacaatgacttctattacagatagtcaaggcgttgagtacctttggcaaggggacgccacttattggggtgggcaagctcctattttatttcctatatgcggaagtgttcgaaatgattgcgtcatttacagaccagctcaagctccacattttacgggtatcataccaaggcatggctttgtacgtcacaaaacattcgactatgattacatatcggattcttctgttcgttttacaattaaaagtagtaaagaaatgttgataaattatccttatcgttttagtttagaaataacttacaccttaagaaataaaagcattgccattacatatattgtcaaaaacttagaatcagaaaaaaatatgccatatgctatcggagctcacccaggctttaattgccctttgtttgaaaaggaagtatttagtgattactatctagagtttgaacagtttgaaacttgcacaattcctgagtcgtttccggatacaggcttgttagatttacaagctagacatccttttttagaaaatcaaaaacaattatctcttaatcatgctttatttgaaaaagatgctattactttagaccaactacgatctaagacggtttacttaaaatctagaaatcatgcaaaaggaatccaacttgactttgatgattttgagaatcttattctttggacaagtaacaatggtggtccttttttggctttggaaccctggagttctttgtcaacttctattgaagagtctgatattttagaagataaacaaaatatcgtacggcttaatccaaagcagtcgaaacagcattctattcggatcactatttta

SEQ ID NO: 6926 - protein, 321 aa, Streptococcus agalactiae
MEGKIIAREKLVKQLLFFMKGKIMAITIQNHELQVTLKALGATMTSITDSQGVEYLWQGDATYWGGQAPILFPICGSVRNDCVIYRPAQAPHFTGIIPRHGFVRHKTFDYDYISDSSVRFTIKSSKEMLINYPYRFSLEITYTLRNKSIAITYIVKNLESEKNMPYAIGAHPGFNCPLFEKEVFSDYYLEFEQFETCTIPESFPDTGLLDLQARHPFLENQKQLSLNHALFEKDAITLDQLRSKTVYLKSRNHAKGIQLDFDDFENLILWTSNNGGPFLALEPWSSLSTSIEESDILEDKQNIVRLNPKQSKQHSIRITIL

SEQ ID NO: 6927 - DNA, 876 bp, Streptococcus agalactiae
atgaacaaaactgtagtggaggatgccatggattttaaggaactgtttccagaagttattactaaacaggaagttaaacagagtgaggattatatcatcgttgagcaagatggtcatgtcctccactttccaaaatcttcgctaactaagcgtgaactatacttattacaaatgacaccaagcctggaagatgcgagttcagtggattctcagaatccttggtaccgctatctagttgaaggtcgtggaaggttgccccaatctcattcggcagtccaatttatttttattgagcatcaatttaccttatcagaagaacttaaggatttcttgtcgcctttagtaataaacgtagaaacaattatgacaattaatcaaacccaaagtgtcatgattttaaatcaggataatttctttaatgctacggaattactaacagatattttaccaacgattgaaaatgactttaacacgcgtttaaggtgctattttggaaatagttggacgcatctacaagcagtggactggaaagaattatatgaagaagaatataaactttttacgctttttcttagtcacaaggccgaacaacattactgtcgatttccaaagatggctttatgggctttggcaaatcaatcgcccatgccttctattaaagcaaaatgtttacaacatatccttgatacgagtgatacttcggctataataaaagccctgtggcaagagcaaggaaatcttgctaaaacggctaaggcacttttcattcatcggaattcattgcaatataaattagataaatttacccaatcttcgggacttaatttaaaaatattagatgatttagcctatgcctatttgatttcgatggatacc

SEQ ID NO: 6928 - protein, 292 aa, Streptococcus agalactiae
MNKTVVEDAMDFKELFPEVITKQEVKQSEDYIIVEQDGHVLHFPKSSLTKRELYLLQMTPSLEDASSVDSQNPWYRYLVEGRGRLPQSHSAVQFIFIEHQFTLSEELKDFLSPLVINVETIMTINQTQSVMILNQDNFFNATELLTDILPTIENDFNTRLRCYFGNSWTHLQAVDWKELYEEEYKLFTLFLSHKAEQHYCRFPKMALWALANQSPMPSIKAKCLQHILDTSDTSAIIKALWQEQGNLAKTAKALFIHRNSLQYKLDKFTQSSGLNLKILDDLAYAYLISMDT

SEQ ID NO: 6929 - DNA, 888 bp, Streptococcus pyogenes
atgtgttataatggtttaaagaccgtcatgaaaggaatggctatggagctaaaagactattttccagagatgcaagtaggccctcatccgttaggagataaagattggatgagtatcaaagaaggggaccaatatgtgcattttcccaaatcatgtttatccgaaaaagagcgcttattacttgaggtggggctgggtcagtgtgaggtcttgcagccgctagggtcaccttggcagcggtatttgcttgatcatcagggcaatccccctcagctgtatgagacttctcagttcatttaccttaatcatcagcaggctttaccagatgacttagttgagttgctccaacaaatgattgcagggcttgaagtcattttgcctatcagtgcaacccaaacggcatttttatgccgacaagcaatctcaataaaggtcttgcgctggcttgaagatctcctgccaacgctagaaagtgattttggtttggccttaaccatgtttgttggaaatgcctggtatcaggtagctgcgggtacattgagagagtgttttgaggaggaatgtcagctgttaacggcctatttaaggcaacaatcaggcagaaaattattaacattttcaggactgatgctgtggtctttgctgtcgcaccacacttttttggcattgacgcgtcagtttcaccaattcctaagtcctcaaagtgatatggccgatgtggttcacgcgctatggtcagaacacggcaatctggtgcagacagcgcagcgcttgtatattcaccgtaactccttgcaatacaaacttgataaatttgctcagcaatcaggactccacttgaagcaattggatgatttagcctttgctcatctctttttgttgaaatat

SEQ ID NO: 6930 - protein, 296 aa, Streptococcus pyogenes
MCYNGLKTVMKGMAMELKDYFPEMQVGPHPLGDKDWMSIKEGDQYVHFPKSCLSEKERLLLEVGLGQCEVLQPLGSPWQRYLLDHQGNPPQLYETSQFIYLNHQQALPDDLVELLQQMIAGLEVILPISATQTAFLCRQAISIKVLRWLEDLLPTLESDFGLALTMFVGNAWYQVAAGTLRECFEEECQLLTAYLRQQSGRKLLTFSGLMLWSLLSHHTFLALTRQFHQFLSPQSDMADVVHALWSEHGNLVQTAQRLYIHRNSLQYKLDKFAQQSGLHLKQLDDLAFAHLFLLKY

SEQ ID NO: 6931 - DNA, 1131 bp, Streptococcus agalactiae
atggtagaattaaatttaaatcatatttacaaaaaatatccaagtgcatcgcattattctgttgaagactttgacttggatattaaagacaaagaatttattgtttttgttggaccatcaggttgtgggaaatcaacaacacttcgtatgatcgcaggtcttgaagatattagtgaaggtgagctcaagattgatggcgaagttgtcaatgacaaatcacctaaagatcgtgatattgctatggttttccaaaactatgctctttatccacatatgactgtttacgataatatggcttttgggctcaaattgcgtaaattctcaaaacaagaaattgataagcgcgttcgtgaagcagcagctaatattggccttactgaattcttagagcgcaaacctgcggatttgtcaggtggacaacgccaacgtgttgctatgggacgtgctattgtgcgtgatgccaaagtgttcttaatggatgagcctttatctaacttagatgctaaattacgtgtttcaatgcgtgctgaaattgcaaaaattcatcaacgtattggttcaacaactatttatgttacccacgaccaaacagaagcgatgactttggcagaccgtattgtcattatgtcagctactaagaaccctgatggtgatggtacaattggtaaaattgagcaagttggttcaccacaagaactctataatcttcctgccaataaatttgttgcgggattcattggtagcccatctatgaacttcttcaaagttaaagttgaaaatggtatgattattagtgaagatggtcttcgaatcgctatccctgaaggtcaagaaaaacttttagaatcacgaggctataaaggaaaagaattgatttttggtattcgtccagaagacatttcaagcaatcttcttgtccaagatacttatccaaatgccaatgttgaagcagaagttttagtttctgaattactcggtagcgaaactatgctttatgttaagttaggtcaaacagaatttgcttctcgtgttgaagcgcgtgacttccataatccaggagaaaaagttaacctaacgtttaatgttgctaaggggcatttctttgatgcagatactgaacaagctattcgt

SEQ ID NO: 6932 - protein, 377 aa, Streptococcus agalactiae
MVELNLNHIYKKYPSASHYSVEDFDLDIKDKEFIVFVGPSGCGKSTTLRMIAGLEDISEGELKIDGEVVNDKSPKDRDIAMVFQNYALYPHMTVYDNMAFGLKLRKFSKQEIDKRVREAAANIGLTEFLERKPADLSGGQRQRVAMGRAIVRDAKVFLMDEPLSNLDAKLRVSMRAEIAKIHQRIGSTTIYVTHDQTEAMTLADRIVIMSATKNPDGDGTIGKIEQVGSPQELYNLPANKFVAGFIGSPSMNFFKVKVENGMIISEDGLRIAIPEGQEKLLESRGYKGKELIFGIRPEDISSNLLVQDTYPNANVEAEVLVSELLGSETMLYVKLGQTEFASRVEARDFHNPGEKVNLTFNVAKGHFFDADTEQAIR

SEQ ID NO: 6933 - DNA, 1131 bp, Streptococcus pyogenes
atggttgaattaaatctaaatcacatctataaaaaatacccaaatactactcattatgccgttgaagattttgacttagacattaaagacaaagaatttatcgtctttgttggaccttcaggatgtggtaaatcgactactcttcgtatgattgcaggtcttgaggacatttctgaaggagagttaaaaatcggtggcgaagtggtgaatgacaagtctcctaaagaccgtgatattgccatggtctttcaaaactacgccctttacccacacatgactgtgtatgataacatggcctttggtttgaaattacgtaagtacaaaaaagatgatattgaccgtcgtgtcaaggaagctgcgcagattcttggtttgaccgaatttttagagcgtaaaccggctgacctgtctggtggtcaacgtcagcgtgttgccatggggcgtgctattgtccgtgatgctaaggtattcttgatggatgagcctttgtcaaacttggatgcgaagcttcgtgtgtctatgcgtgctgaaattgctaaaattcaccgtcgtatcggctcaacaactatttacgttacccatgaccaaaccgaagccatgactttggcagaccgtatcgttatcatgagtgccactaaaaaccctcaaggtaatggaacgattggtaaaattgagcaagtcggctcgccacaagaattgtacaaccttccagctaataaattcgttgccggttttatcggaagccctgccatgaacttttttgaagtggaagttaaagatggccgcattgtgagtgaagatggtcttgacattgctattccagaaggacaagcaaaaatgcttgaagctgctggttacaagggggaaaaagtcacttttggtattcgtccagaagacatttctagtagacaaatcgtgcatgatacttatccaagtgcaactgtcacagcagaagttttggtttctgagttactgggctctgagacgatgctctatgtcaagcttggacaaactgagtttgcttctcgtgtagatgcgcgtgatttccatagtccaggggagcaagttagcttgacctttaatgtggctaaggggcatttctttgacagagataccgaacaagctattcgt

SEQ ID NO: 6934 - protein, 377 aa, Streptococcus pyogenes
MVELNLNHIYKKYPNTTHYAVEDFDLDIKDKEFIVFVGPSGCGKSTTLRMIAGLEDISEGELKIGGEVVNDKSPKDRDIAMVFQNYALYPHMTVYDNMAFGLKLRKYKKDDIDRRVKEAAQILGLTEFLERKPADLSGGQRQRVAMGRAIVRDAKVFLMDEPLSNLDAKLRVSMRAEIAKIHRRIGSTTIYVTHDQTEAMTLADRIVIMSATKNPQGNGTIGKIEQVGSPQELYNLPANKFVAGFIGSPAMNFFEVEVKDGRIVSEDGLDIAIPEGQAKMLEAAGYKGEKVTFGIRPEDISSRQIVHDTYPSATVTAEVLVSELLGSETMLYVKLGQTEFASRVDARDFHSPGEQVSLTFNVAKGHFFDRDTEQAIR

SEQ ID NO: 6935 - DNA, 1605 bp, Streptococcus agalactiae
atgaagaaacactggtggcataaagctacgatttatcaaatttacccacgttcatttatggattcagatggtgatggtgtgggggacattaaagggattactagcaaactagactaccttgaaaaattagggattactgctatctggttatcacctgtttatcaaagtccaatggatgacaatggttatgatatttcagattatcaagccattgcagatatttttggtgatatgaatgatatggaccaactgttacaagaggcaaatcaacgcgggattaaaatcatcatggatttggtagtgaatcatacctctgatgaacatgcttggttcgtagaagcgcgagaaaaccctaatagtcctgaacgtgatttttatatttggcgagatgaacctaacgatttgacttctatttttagtggctcagcttgggaatatgataaagtatcaggtcaatattatttgcacctttttagcaaacgtcagccagatctcaactgggagaatgaagctttacgtcataaaatttatgatatgatgaatttctggattgataagggtattggtggtttccgtatggatgtcattgatttaattgggaaaattccagataagggcattactggtaatggaccaaaacttcatgattatcttaaagaaatgaacagagctagttttggaaagcatgacttattgacggtgggtgaaacttggggagcaacgccagacattgcaaaacaatactcaaatcccgataatgaagaattatctatggtctttcaatttgaacatgtaggtcttcaacataaacctgacgctcctaagtgggattacagtgacggattagatgttccagcattgaaagatatttttacaaaatggcaaacacaattggagcttggccaaggttggaattctttattctggaataatcatgaccttcctcgagtgctctcgatctggggaaatgatagtgataacagaaaacaatctgccaaggctctagcaatcctactacatttgatgcgtggaacgccttatatctatcaaggtgaagaaattggtatgactaattatccatttgagtgtttagcagatgtagatgatattgaatcccttaactatgctaaagaagccatggataatggggtatctgaagcaacaattttagatagtattcgtaaagtcggtcgtgataatgctcgtactccaatgcagtggagtcaagaacatcaagctggttttactaaaggtaccccatggctagcagtcaatcccaattatcaggaaattaatgtggaggcagcgttaaatgatacggaaagtattttttatacttatcaaaaattagttgctttacgtaaagaacacgactggttagttgatgctgattttaaacttttggaaacagcagataaggtatttgcttatgttcgtcaaacagataaagaacgttatttaatagttgcgaacttatccgatcaaaaccaatcttttgaatttccagaagctgttaaagaaactattatttcaaatacagaggttcaagaagtactatcaagtaacactctcaagccgtgggatgccttctgcatagagctattc

SEQ ID NO: 6936 - protein, 535 aa, Streptococcus agalactiae
MKKHWWHKATIYQIYPRSFMDSDGDGVGDIKGITSKLDYLEKLGITAIWLSPVYQSPMDDNGYDISDYQAIADIFGDMNDMDQLLQEANQRGIKIIMDLVVNHTSDEHAWFVEARENPNSPERDFYIWRDEPNDLTSIFSGSAWEYDKVSGQYYLHLFSKRQPDLNWENEALRHKIYDMMNFWIDKGIGGFRMDVIDLIGKIPDKGITGNGPKLHDYLKEMNRASFGKHDLLTVGETWGATPDIAKQYSNPDNEELSMVFQFEHVGLQHKPDAPKWDYSDGLDVPALKDIFTKWQTQLELGQGWNSLFWNNHDLPRVLSIWGNDSDNRKQSAKALAILLHLMRGTPYIYQGEEIGMTNYPFECLADVDDIESLNYAKEAMDNGVSEATILDSIRKVGRDNARTPMQWSQEHQAGFTKGTPWLAVNPNYQEINVEAALNDTESIFYTYQKLVALRKEHDWLVDADFKLLETADKVFAYVRQTDKERYLIVANLSDQNQSFEFPEAVKETIISNTEVQEVLSSNTLKPWDAFCIELF

SEQ ID NO: 6937 - DNA, 1611 bp, Streptococcus pyogenes
atgaacaaccactggtggcataaagctacgatttatcagatttacccaaggtcctttaaagacaccagcggcaatggtattggtgatttaaaaggcattaccagtcaactggactacttgcaaaaacttggcattacagccatttggttatctcctgtttaccaaagtccaatggatgacaatggttatgacatctctgactatgaagcgattgctgatgtttttggagacatggcagatatggatgagctcttagcagcagctaatgagcgaggcattaagattatcatggacttggtggtcaaccatacgtctgatgagcatgcttggtttgttgaagctagagaaaatcccaatagtcctgagcgtgattactatatttggcgtgacgagccaaacaacctcatgtctattttttcaggatctgcttgggaattggatgaggcatcaggacaatattacctgcatttgtttagcaagaaacagcctgatttgaactgggaaaatgctcagctgcgccaaaaaatttacgatatgatgaatttctggattgccaaaggcatcggtggttttcgtatggatgtgattgacctgattgggaaggttcctgacttggagatcacgggtaacgggccgcgcttacacgattacctcaaagaaatgaatcaagcaacctttggcaaccatgacgtgatgacagtcggtgagacttggggagcaacgcctgaaattgctcgccagtattctcgccctgaaaacaaagagttatccatggtcttccaatttgagcatgtgggtcttcaacataaacctgacgctcccaagtgggattatgccaaagaattagacgtgcctgctctgaaagctatttttagcaagtggcagacagaattaaagttaggagaaggctggaattcgcttttttggaataaccatgacttgccacgggtcttatccatttggggcaatgacagcacttaccgagaaaaatcagccaaggctttagctattttactgcatttgatgcgaggaaccccttacatttaccaaggagaagagattggcatgaccaattatccttttaaagacttaaccgaggttaatgatattgagtcccttaactatgctaaggaagctatgggaaatggagtgtcagctgcgcgtgtgatggatagcatccgtaaggtaggacgagacaatgctagaacgccgatgcagtggtctaaggacacacatgctggcttttctgaagcaaaagagacttggttgccggtcaaccccaactaccaagacatcaatgtggccgatgcccttgctgatccagactctattttttacacctaccaaaaattgattgccttgcgtaaggagcaagactggctagttgaagcggattatcacctcttgccaacagctgataaagtgtttgcttatcagcgtcagcttggagaagagacgtatgtgattgttgtcaatgtgtctgatgaggagcaagtctttgccacagacttagcaggtgcacaagtgatcatcgccaatacagatgtggacacggtattagagaccaagcacttacaaccttgggatgccttttgtctcaaactgaaggcc

SEQ ID NO: 6938 - protein, 537 aa, Streptococcus pyogenes
MNNHWWHKATIYQIYPRSFKDTSGNGIGDLKGITSQLDYLQKLGITAIWLSPVYQSPMDDNGYDISDYEAIADVFGDMADMDELLAAANERGIKIIMDLVVNHTSDEHAWFVEARENPNSPERDYYIWRDEPNNLMSIFSGSAWELDEASGQYYLHLFSKKQPDLNWENAQLRQKIYDMMNFWIAKGIGGFRMDVIDLIGKVPDLEITGNGPRLHDYLKEMNQATFGNHDVMTVGETWGATPEIARQYSRPENKELSMVFQFEHVGLQHKPDAPKWDYAKELDVPALKAIFSKWQTELKLGEGWNSLFWNNHDLPRVLSIWGNDSTYREKSAKALAILLHLMRGTPYIYQGEEIGMTNYPFKDLTEVNDIESLNYAKEAMGNGVSAARVMDSIRKVGRDNARTPMQWSKDTHAGFSEAKETWLPVNPNYQDINVADALADPDSIFYTYQKLIALRKEQDWLVEADYHLLPTADKVFAYQRQLGEETYVIVVNVSDEEQVFATDLAGAQVIIANTDVDTVLETKHLQPWDAFCLKLKA

SEQ ID NO: 6939 - DNA, 993 bp, Streptococcus agalactiae
atggcagttctgattttaggtggcgccggctacattggctcgcatatggttgatcagttaatcacacaaggaaaagagaaagttattgttgttgataacttggtaacaggtcatcgtcaagcggtgcattcagatgcgattttttatgaaggagatttatccgataaaacgtttatgcgtcaagtttttagggaaaatcctgatgtagatgctgttatccattttgcggcattttcactagttgctgagtcaatggaaaatcctttaaaatattttgataataacactgctggaatgataaaacttttagaagtaatgaatgaatgtgatatcaaaaatattgtcttttcatcaacagctgcaacatatggtattccagaacaagttcctattttagaaacagctcctcaaaatcctattaatccttatggcgaaagtaagcttatgatggaaacaattatgaaatgggctgatcaagcctacggtattaagtttgtcgctctacgttacttcaacgttgctggagataaaccggatggctcaattggggaagatcataaaccagaaacacatttgttaccaatcattcttcaagttgctcaaggagtacgtgacaaaataatgatttttggagatgattacaatactccagatggaactaatgttcgagattatgtgcatccatttgatttggcagatgctcatatattagcagttgattaccttcgccaagggaatgaatcaaacgtgtttaatctcggatcttcgacaggtttttctaaccttcagatgttagaggcagctcgtcgtattactgggaaagaaattcctgctcaaaaggcagctcgtcgtccaggagatccagatacgcttattgcttcctcagagaaagctcgtcaaatccttgggtgggagcctaaatttgataatattgataaaattatttcatcggcatgggcatggcattctagtcatccaaatggctacgaagat

SEQ ID NO: 6940 - protein, 331 aa, Streptococcus agalactiae
MAVLILGGAGYIGSHMVDQLITQGKEKVIVVDNLVTGHRQAVHSDAIFYEGDLSDKTFMRQVFRENPDVDAVIHFAAFSLVAESMENPLKYFDNNTAGMIKLLEVMNECDIKNIVFSSTAATYGIPEQVPILETAPQNPINPYGESKLMMETIMKWADQAYGIKFVALRYFNVAGDKPDGSIGEDHKPETHLLPIILQVAQGVRDKIMIFGDDYNTPDGTNVRDYVHPFDLADAHILAVDYLRQGNESNVFNLGSSTGFSNLQMLEAARRITGKEIPAQKAARRPGDPDTLIASSEKARQILGWEPKFDNIDKIISSAWAWHSSHPNGYED

SEQ ID NO: 6941 - DNA, 687 bp, Streptococcus agalactiae
atggacgtattaattatcgaagatgatcctatggtggaatttatccaccgcaattaccttgaaaaactcaattattttcaaaacatctattcaactgctagtcaaacacaagctattgcttatcttaatgacattaaaatccaacttgttcttttagatattcatattaaagaaggcaatggtctagaattattaaagttattacgcaatcaacaccaaaataccgaagtcattgttatttcagcagccaacgaggcgcacactgtcaaagaagcatttcatttaggtattgtagattacctgataaaaccatttacatttgaacgctttgagtctagtattgaaaaattcctaaatcattatcatacatttgaagctgataaaatctatcaagacaacatcgatcactttcaaaaaatagattctggatggctagagggagaggttaaacttgatgagaaagggctctctgaaattacctatcagcatattcttgatgccattcaagagttagagcagcctttcactatccaagagttagcaaaatgcagtcaattttctcatgtctctgttaggaaatatattgcctatatggaagaaaaaggccttctgacaagtcagcaaatttatactaaggtcggtcgtccttacaaagtttataagcttataaaaaaaaacttaggcctg

SEQ ID NO: 6942 - protein, 229 aa, Streptococcus agalactiae
MDVLIIEDDPMVEFIHRNYLEKLNYFQNIYSTASQTQAIAYLNDIKIQLVLLDIHIKEGNGLELLKLLRNQHQNTEVIVISAANEAHTVKEAFHLGIVDYLIKPFTFERFESSIEKFLNHYHTFEADKIYQDNIDHFQKIDSGWLEGEVKLDEKGLSEITYQHILDAIQELEQPFTIQELAKCSQFSHVSVRKYIAYMEEKGLLTSQQIYTKVGRPYKVYKLIKKNLGL

SEQ ID NO: 6943 - DNA, 663 bp, Streptococcus pyogenes
atgaacgttttaatcattgaagatgatcctatggtggattttatccatcgcaattacctcgaaaaactaaatctttttgatcgcattatatccagcgactctatgaaagctgttcaaagcatacttactgattacgcaattgacctcattttactggatattcatattacagatggcaatgggattcaatttttggagaaatggcgtactcagcatattccttgcgaagtcattattatttcagccgcaaatgatgggaatattatccgagatggttttcatttaggaattatcgactacctcatcaagccctttacctttgaacgctttcaagaaagcatccaacagtttgttacacatcgagaacatttggccaatcagcaactagagcaggcccaaattgaccaactgaaatgtttgactagcaaaaaagacactaaaaacaaacaattgttagaaaaaggcttatctgaatccactttccagtggattatggaaaatatcaaagtctttgatcaaccttttactatccaagaattagcttccgcttgtcacttatcccatgtctctgtccgtaaatacattgcttatttagaagaaaataagcaactgaacagccaacaaatttttacaaaggttggccgcccctatcgcgtgtactgg

SEQ ID NO: 6944 - protein, 221 aa, Streptococcus pyogenes
MNVLIIEDDPMVDFIHRNYLEKLNLFDRIISSDSMKAVQSILTDYAIDLILLDIHITDGNGIQFLEKWRTQHIPCEVIIISAANDGNIIRDGFHLGIIDYLIKPFTFERFQESIQQFVTHREHLANQQLEQAQIDQLKCLTSKKDTKNKQLLEKGLSESTFQWIMENIKVFDQPFTIQELASACHLSHVSVRKYIAYLEENKQLNSQQIFTKVGRPYRVYW

SEQ ID NO: 6945 - DNA, 1530 bp, Streptococcus agalactiae
gtgctgatgaaaaaaaaactatctctttgggcatttctatcattgattttagtcactatgaccatttgtatattttctattttttattatgtcactatacatcagtcctatcgtatggtaagggtacaggaagaaaaaatcttaaaaaatactggttatgctttatcgagaaatccacaagttatacaaacactcaaagataatcactatgatcaaagtctccaaaaacaaatgttattccttagcaaaaaatcaaatttagactatattgtccttataaatttaaaagggatccgttttacccaccctgactccactaagattggtaaaccatttcaagggggtgatgaacaagctgtttttaagggaaaagctattatgtctactgcagaaggttctttaggaaaatctttacgatacttaattccagtatatgatcaccaaaaacaggttggggcaattgcagttggcttaaaattaacgacacttggagacttatctcaaagtagcataaaagagtttagtaagcctctcttgattagtattttgattagcttagtcgtcacaagtataatttcttatggcttaaaaaaacaacttcacaacctccatccaagtgatatttttcaacatttagaagagcgcaatgcaacactggaccaaattcaagccgctgtatttgttattgaccagaggcatatcatcaaaagaaataatcctgcagctagtttattattcaaaaaagaggggcaacgagacctattttcaggtaaattattagaatctttaattcctcaactcaagcaggatcatttttcaaaaaaaactgaacaagtattacattttcaaggacaagactatttactatctatctcgccaattacggttaaaacacaaaatagaggctatgttgtcttcttaaggaatgttactgaaacacttttcactttggatcaattagcacacactacagcttatgcttctgcgctacaggcccaaacacatcaatttatgaatcaacttcatgttatttatggacttgcagacattgaatactacgacgagttgaaaatttatttaaaagaattattggagccacaaaatgaatttttagcacgcttatcaatgttagttagagagcctcgactggctagtttcattattggcgaaagagaaaaattcgcagaaaaacacatcaatctatccacagaaattttagtagaaatccctaccaagtcaactgttgaggatgttaataactatctcttgctccacagatatattaatacgaagatactcacgctattaaattcaacgactttagtttctttacgtttaaattatcaaaataacctcattgaaacagattatcaatgggagaatgagaagtggttactcaatgactaccatcagtatttcaacgacgcttattttcaacagttacttgtagattcaagagctacttataagatctctttaaaacaaaataaggttattataagaacaaatattatctactcagaagggcct

SEQ ID NO: 6946 - protein, 510 aa, Streptococcus agalactiae
MLMKKKLSLWAFLSLILVTMTICIFSIFYYVTIHQSYRMVRVQEEKILKNTGYALSRNPQVIQTLKDNHYDQSLQKQMLFLSKKSNLDYIVLINLKGIRFTHPDSTKIGKPFQGGDEQAVFKGKAIMSTAEGSLGKSLRYLIPVYDHQKQVGAIAVGLKLTTLGDLSQSSIKEFSKPLLISILISLVVTSIISYGLKKQLHNLHPSDIFQHLEERNATLDQIQAAVFVIDQRHIIKRNNPAASLLFKKEGQRDLFSGKLLESLIPQLKQDHFSKKTEQVLHFQGQDYLLSISPITVKTQNRGYVVFLRNVTETLFTLDQLAHTTAYASALQAQTHQFMNQLHVIYGLADIEYYDELKIYLKELLEPQNEFLARLSMLVREPRLASFIIGEREKFAEKHINLSTEILVEIPTKSTVEDVNNYLLLHRYINTKILTLLNSTTLVSLRLNYQNNLIETDYQWENEKWLLNDYHQYFNDAYFQQLLVDSRATYKISLKQNKVIIRTNIIYSEGP

SEQ ID NO: 6947 - DNA, 1539 bp, Streptococcus pyogenes
atgaaaaaaccactacgtttatgggccagtttatcgttgattttggtatctatgattgttgtcacaacctctctattttacgggattatgctacatgatacgcaccaatccatcaaaaatcaggaaacccatttgctaacgtcaactggaaaaatgttagcaagtcatcaagcgattaaagaattactcctaaacaaccaaccaaatgctaaaacaacagcctataccaactccattgcctccatctataaccttgattatgtggtcgtgatgaacatgaaagggattcgactcacccatcctaacccgaaaaatatcggaaaaccttttcaaggaggtgatgaggaggctgttctagcaggaaaaaaggttatctctaccgccaagggcactttaggaaagtcacttcgctatctagtacctgtgtttgacggtgacaaacagattggtgctattgcggttggcattaaactaactaccctaaatgatgtggctttaacgtcaaaacgcaattataccctgtctttactcctttgtcttcttattagtttactggtcaccagttttatttcttttcgactcaagcgtcaactgcaccagttagaaccaagtgaaatttatcagctctttgaagagcgtaatgccatgttggatcaaatcgaagccgccgtatttgtggtagataaagctggtatcttacagctctgcaatcaggctggacaaaaattaattgctcggaaatgccagttgggaaaacctactggcaacagtttcaattacctctttcctgattttccaaaacttagtttgcaagaggggcatgaacaactctttcggtatggtgaggaagactacttgttagccatttcacccatctgtgtcaaaaacgatcaccgaggccatattattttcatgcgagaagcagttaaggctattgataccttggatcagctagcctataccactgcctatgcttctgctctacaagcccaaactcataaattcatgaatcaattgcatgttatttatggcttagtggatattgcttattatgaccaattgaaaatttatttagacagtattttggaacccgaaaatgaaattctcactagcttatctgtccttgttaaggagcctcttctagctagttttctcattggagagcaagagaaataccaagaattaaatgtccatctcaagattgatgttttaagcgagattcctcattctgccaccaagaatcaacttaataatggtttgatgatttaccgctttatccatactaatcttctaaccacactgagacccaaatcactcgttttgagtattcaacatgaccagaatcatttaatcagccattacaccttgacagacaattggattgatttggagcgggtacagcctatttttgacttaccttattttcaacagctcttgaccgatacaaattcccaattccatcaacatcaaaccgtaaccgagttacagttctcagtgacaacaccttatgtaggagggcaacatgaacgttttaatcat

SEQ ID NO: 6948 - protein, 513 aa, Streptococcus pyogenes
MKKPLRLWASLSLILVSMIVVTTSLFYGIMLHDTHQSIKNQETHLLTSTGKMLASHQAIKELLLNNQPNAKTTAYTNSIASIYNLDYVVVMNMKGIRLTHPNPKNIGKPFQGGDEEAVLAGKKVISTAKGTLGKSLRYLVPVFDGDKQIGAIAVGIKLTTLNDVALTSKRNYTLSLLLCLLISLLVTSFISFRLKRQLHQLEPSEIYQLFEERNAMLDQIEAAVFVVDKAGILQLCNQAGQKLIARKCQLGKPTGNSFNYLFPDFPKLSLQEGHEQLFRYGEEDYLLAISPICVKNDHRGHIIFMREAVKAIDTLDQLAYTTAYASALQAQTHKFMNQLHVIYGLVDIAYYDQLKIYLDSILEPENEILTSLSVLVKEPLLASFLIGEQEKYQELNVHLKIDVLSEIPHSATKNQLNNGLMIYRFIHTNLLTTLRPKSLVLSIQHDQNHLISHYTLTDNWIDLERVQPIFDLPYFQQLLTDTNSQFHQHQTVTELQFSVTTPYVGGQHERFNH

SEQ ID NO: 6949 - DNA, 1335 bp, Streptococcus agalactiae
atggcagacgtgaaggtagtgaataatgaggattctagaggtcaaaagcaagacttaaaggctaaactatttcatattaagatagggtcagttcccctaccagtatatgtttgtttagcattattgattcttctagcaggctttttacaaaaattgccagtcaatatgctaggaggatttgcagttatcttaacaatggggtggttcttagggactatcggagctagcattcctggttttaaaaacttcggtggcccagctattttatctttattagtaccatctattttggtgtttttcaacctcattaataaaaatgttttagaatcaacaaatatgttgatgaagcaagctaactttctttatttttatattgcttgtttagtgtccggtagtattttagggatgaatcggaaaatgttgattcagggattgctaagaatgattttccccatgttattaggaatggtttgtgcgatgatggtagggacatttgtcggtgttattttaggcttagagtggcgacacactttgttttatatcgtaacacccgttttagctggtggtattggtgaaggtattttaccattatcgttaggctatagttcaattaccggtgtagctagtgaacaactagttgctcaactcatcccagccactattattggtaatttctttgccattttatgtactgcactattgaatcgtttgggagaaaagaaaccacacttgtctggtcaagggcaattagtaaggttaaataaaggagaggacatgtcagatattattgctgatcattctggcccaattgacgttaagaaaatgggtggaggtgttttaacagcatgtagtctctttatttttggacatttgttgcagcaattaactggatttcctggtcccgtattaatgattgttgcagcagctattttgaaatatattaatgttattcctagagaaacacaaaatggagctaagcaactttataaatttatttctggtaattttacatttcctctaatggcaggtctaggattgctttatatcccgttaaaagatgttgtggcaacgcttagcatacaatatttcatagttgttattagtgttgtatttacagttatttctgttggattctttgtatcgcgattccttaatatgaatcctgttgaagcaggtattatttcagcttgtcaaagtggtatgggaggaacaggagatgttgccattttaagtacagcagaccgaatgaacttgatgccatttgctcaagttgctacgcgtttaggaggagctattactgttatcacaatgacagccattttacgcatgttattc

SEQ ID NO: 6950 - protein, 445 aa, Streptococcus agalactiae
MADVKVVNNEDSRGQKQDLKAKLFHIKIGSVPLPVYVCLALLILLAGFLQKLPVNMLGGFAVILTMGWFLGTIGASIPGFKNFGGPAILSLLVPSILVFFNLINKNVLESTNMLMKQANFLYFYIACLVSGSILGMNRKMLIQGLLRMIFPMLLGMVCAMMVGTFVGVILGLEWRHTLFYIVTPVLAGGIGEGILPLSLGYSSITGVASEQLVAQLIPATIIGNFFAILCTALLNRLGEKKPHLSGQGQLVRLNKGEDMSDIIADHSGPIDVKKMGGGVLTACSLFIFGHLLQQLTGFPGPVLMIVAAAILKYINVIPRETQNGAKQLYKFISGNFTFPLMAGLGLLYIPLKDVVATLSIQYFIVVISVVFTVISVGFFVSRFLNMNPVEAGIISACQSGMGGTGDVAILSTADRMNLMPFAQVATRLGGAITVITMTAILRMLF

SEQ ID NO: 6951 - DNA, 1329 bp, Streptococcus pyogenes
atggaaacaataagcaagaaaatgcctcaaaaagacttgtctgagcattcaaaagcatggcaaaataggcgaataggctccgttcccttgcctgtttatctggttttagctaccttaattttagtcacaggctggctccaacaattgcctgttaatatgctgggtggctttgctgttattttaacccttggttggctactaggaaccattggagcgaccattccaggcctcaaacattttggtggcccagctattttatcactcttagtcccttcgattttggttttttttaatctcctcaatcccaatgtcttagaagcgacgaatgtcttgatgaagcaagccaattttctttatttttatattgcctgcctggtctgcggtagtattttaggcatgaatcgaaaaatcttgattcaaggtctttttcggatgattattcccatgttacttggaatggtttgtgcaatgggtgtagggactttggttggcgtcattttaggattagactggcaacataccctcttttatgttgtgacgccagtccttgctggaggaattggtgaaggtattttacccttatctcttggttacagtgccattacaggagtcggaagtgagcaattagtggctcaactgattccagccaccattattgggaatttctttgctatcttgtgcacggctttgctcaatcgttttggagagaagcacccaagttattctggtcaagggcaactggttaaaattggtcacagcgaagacatgtctgatgccctaaaagacaattctggagccctagatgttaaattaatgggggcaggcgttttaacagcttgttcactttttattgctggtggcttgttacagcatttaacagattttccaggaccggtgttgatgattattctggcagccttcttgaaatacctgaatgttattccccaagaaacccaaaatggtgccaagcaactttataaattcatttccagcaactttacttttccgttaatggcagggcttggtctactttatatccccttaaaagaggttgtggcaacccttagctggcaatattttattgtggtgattagtgtggtgttaacggttgtcagtgtcggtttttttgtctctcgtttccttaacatgagcccagtggaagcagctattatttcagcttgtcaaagtggtatgggtggaaccggtgatgtggctattttgagtacggctgaccgcatgaatctaatgccgtttgcccaagtcgctacccgtttaggtggggctattaccgttatcactatgacagctattttaagaattatttttagt

SEQ ID NO: 6952 - protein, 443 aa, Streptococcus pyogenes
METISKKMPQKDLSEHSKAWQNRRIGSVPLPVYLVLATLILVTGWLQQLPVNMLGGFAVILTLGWLLGTIGATIPGLKHFGGPAILSLLVPSILVFFNLLNPNVLEATNVLMKQANFLYFYIACLVCGSILGMNRKILIQGLFRMIIPMLLGMVCAMGVGTLVGVILGLDWQHTLFYVVTPVLAGGIGEGILPLSLGYSAITGVGSEQLVAQLIPATIIGNFFAILCTALLNRFGEKHPSYSGQGQLVKIGHSEDMSDALKDNSGALDVKLMGAGVLTACSLFIAGGLLQHLTDFPGPVLMIILAAFLKYLNVIPQETQNGAKQLYKFISSNFTFPLMAGLGLLYIPLKEVVATLSWQYFIVVISVVLTVVSVGFFVSRFLNMSPVEAAIISACQSGMGGTGDVAILSTADRMNLMPFAQVATRLGGAITVITMTAILRIIFS

SEQ ID NO: 6953 - DNA, 1161 bp, Streptococcus agalactiae
atgagtgaaaatttaggtcaattagctatcaaccaagctagagaaaatggtggaaaattagaagtaatttcaaaagttaaggtggaagataagagggatcttagtattgcctataccccaggggtggcgtcagtatcatcagctattgcagaggatgtggagcttgcatatgagttgacgactaaaaaaaatacagtagccgtagtgagtgatggttcagctgttcttggattaggagatattggtcctgaggcagcaatgccagtcatggaaggtaaagcagcactctttaaacgttttgcaaatgtagatgctgtgccaattgtgttgaaaacaaatgatacagaggaaattatttctatagtaaaagctatttcgccgacttttggagggattaatttagaggatatttcagcaccacgttgtttcgaaattgaacaacgcctaattgaagaatgtgatataccagttttccatgatgaccaacatggtacagcaatcgtagtattagcggctttgtttaacagtttgaagctagttaaaaaagacattgaagacatcagagtagttgttaatggtggaggttcagcgggcttatctataacaaggaagcttctatcagcaggagcaaaacatgtaacggtagttgatcgatttggcattattaacgataaagatcgggagtcattagcccctcatcacaaagcgattgcaaaattgactaatagagaattccaatctggatccttagaagatgctttggagaatgccgatgtttttataggtgtttctgctccggaagcattacatgcagaatggatttccaagatggctgataaacctattgtatttgcaatggcgaatcctattccagaaatttatccagatcaagccttaaaagccggagcttacatagttggaactggtcgtagtgattttccaaatcaaattaataatgttttagcatttccgggtattttcagaggagcattagatgctagagcaaaaacgataactgttgaaatgcaaattgcggcagcgagaggcatagctagtttaataccggaggaagaattaagcacaactcacatcattccaaatgcttttcaaaatgatgtggccgatgtagttgctaaaagcgtcagtaatgctgtacaaaaa

SEQ ID NO: 6954 - protein, 387 aa, Streptococcus agalactiae
MSENLGQLAINQARENGGKLEVISKVKVEDKRDLSIAYTPGVASVSSAIAEDVELAYELTTKKNTVAVVSDGSAVLGLGDIGPEAAMPVMEGKAALFKRFANVDAVPIVLKTNDTEEIISIVKAISPTFGGINLEDISAPRCFEIEQRLIEECDIPVFHDDQHGTAIVVLAALFNSLKLVKKDIEDIRVVVNGGGSAGLSITRKLLSAGAKHVTVVDRFGIINDKDRESLAPHHKAIAKLTNREFQSGSLEDALENADVFIGVSAPEALHAEWISKMADKPIVFAMANPIPEIYPDQALKAGAYIVGTGRSDFPNQINNVLAFPGIFRGALDARAKTITVEMQIAAARGIASLIPEEELSTTHIIPNAFQNDVADVVAKSVSNAVQK

SEQ ID NO: 6955 - DNA, 1164 bp, Streptococcus pyogenes
atgaaaaatcaattaggtcaacttgcccttgaacaagccaaaacgttcggcggtaaattggaagttcaaccaaaagttgacattaaaactaaacatgatttgagtattgcctacacaccaggtgtagcgagtgtgtcatctgccatcgcaaaagataaaacattagcatatgacttaaccaccaagaaaaatacagtagccgttatcagtgatggtactgcggttcttggtctgggggatattggccctgaagcagccatgccagttatggaaggaaaagcagccctttttaaagcatttgcgggtgttgatgctattccgattgtattagataccaaagatactgaagaaattattagtattgtcaaggcgcttgcaccaacctttggtggtattaatttagaggatattagtgcgccccgctgttttgaaattgagcagcgcttgattaaggaatgtcatattcctgttttccatgacgatcagcatggaacagctattgtggtgttagcagccatcttcaatagtttgaaacttcttaaaaaatcccttgatgaggtatccattgtggtgaatggtggtggatctgctggattatccattacccgtaaattattagcagcaggtgctacgaaagtgacagtagtggataaatttggcattatcaatgaacaagaagccgctcaattagcgccacatcatttggatatagcgaaagtcactaatcgtgagtttaaatcaggtaccttagaagatgctcttgaaggagcagatatcttcattggcgtatcagcaccaggagtcttaaaagcagagtggattagtaaaatggcagcgcgcccagtaatttttgccatggccaaccctattccagagatttaccctgatgaagcccttgaagcgggggcttacattgtaggtactggccgcagtgattttcctaaccagattaataatgtccttgcctttccaggtatttttaggggagcattagatgcacgggcaaaaaccattactgttgagatgcaaattgctgccgcaaaaggtattgccagtcttgtcccagatgacgctttgagcactactaatattattccagatgcctttaaagaaggagtcgctgagattgtcgctaaaagcgtcaggtcggtagtccttaaatca

SEQ ID NO: 6956 - protein, 388 aa, Streptococcus pyogenes
MKNQLGQLALEQAKTFGGKLEVQPKVDIKTKHDLSIAYTPGVASVSSAIAKDKTLAYDLTTKKNTVAVISDGTAVLGLGDIGPEAAMPVMEGKAALFKAFAGVDAIPIVLDTKDTEEIISIVKALAPTFGGINLEDISAPRCFEIEQRLIKECHIPVFHDDQHGTAIVVLAAIFNSLKLLKKSLDEVSIVVNGGGSAGLSITRKLLAAGATKVTVVDKFGIINEQEAAQLAPHHLDIAKVTNREFKSGTLEDALEGADIFIGVSAPGVLKAEWISKMAARPVIFAMANPIPEIYPDEALEAGAYIVGTGRSDFPNQINNVLAFPGIFRGALDARAKTITVEMQIAAAKGIASLVPDDALSTTNIIPDAFKEGVAEIVAKSVRSVVLKS

SEQ ID NO: 6957 - DNA, 342 bp, Streptococcus agalactiae
atgtattcttttgaagaacttttggcaaccatgactttgataacggctgccgaaattgaagataaaattgattcaaatcaagattttgtactgttcattggtcgtatttcttgtccattttgtcacctctttgttcctaaaattgtagaagtagctgatgaagatgaatttgaattattccatttagatagtgaagattttgatcattggactgcaaataaagaatttcgaaataaatatgacattcctacagtgccaggtttgatggttgttaaaaacggaactatcaaggtgaagtgcgattcaaaaatgacaaaagaagaaatccgtgaatttattggc

SEQ ID NO: 6958 - protein, 114 aa, Streptococcus agalactiae
MYSFEELLATMTLITAAEIEDKIDSNQDFVLFIGRISCPFCHLFVPKIVEVADEDEFELFHLDSEDFDHWTANKEFRNKYDIPTVPGLMVVKNGTIKVKCDSKMTKEEIREFIG

SEQ ID NO: 6959 - DNA, 372 bp, Streptococcus pyogenes
atgagaccaaaagagaaggagacatccatgacatttgaagaaatcgttgcgaattttataccgtcgagtgttgcagaagtcacatcagctatcgctagtggcaaagacatgattgtctttttaggacgttcgagctgtccttattgtcgccgctttgctcccaagttggcacaagtagcaacagataatcaaaaagaagtctattttgtggatagcgaaaacgctgctgatgctgctgagcttgctgcctttcgtgagaactaccaattagtgacagttccagctttgctggttagttacgatcagcaccaaagggctgtatgtgattcaagtttgacaccagatgacatcttagcttttttgactcgtgag

SEQ ID NO: 6960 - protein, 124 aa, Streptococcus pyogenes
MRPKEKETSMTFEEIVANFIPSSVAEVTSAIASGKDMIVFLGRSSCPYCRRFAPKLAQVATDNQKEVYFVDSENAADAAELAAFRENYQLVTVPALLVSYDQHQRAVCDSSLTPDDILAFLTRE

SEQ ID NO: 6961 - DNA, 297 bp, Streptococcus agalactiae
  misc_feature (1)..(297): n = a, c, g, or t
atgagcttacctattattatgcttgttgttatggttggtatgatgttcttcatgcaacgtcagcaaaagaaacaagcacaagaacgtcaaaaacaattgaatgctgttcaaaaaggtgatgaaattgtcacaattggtggtctttttggagtagttgatgaagttaatactgaagcacaacgaatggttttagatgttgatggtgtctatttgacgtttgagttggcagctatcaaatctgttgtctctaaggcagcaacaccaacagaaccagttgaagatgttaagattnnnnnt

SEQ ID NO: 6962 - protein, 99 aa, Streptococcus agalactiae
  MISC_FEATURE (1)..(99): Xaa = Any Amino Acid
MSLPIIMLVVMVGMMFFMQRQQKKQAQERQKQLNAVQKGDEIVTIGGLFGVVDEVNTEAQRMVLDVDGVYLTFELAAIKSVVSKAATPTEPVEDVKIXX

SEQ ID NO: 6963 - DNA, 363 bp, Streptococcus pyogenes
atgggatttccaccaattttaatgtttgtagtgatgcttggattgatttggtttatgcaacgtcaacaaaaaaaacaagcgcaagaacgccaaaatcagttaaacgctattgaaaaaggagacgaagtcgtaacgattggtggcatgtttgcgattgttgacgaagtcgatacaacagctaaaaagattgtgttagatgtggatggcgtctttttgacatttgagctattagctattaagcgtattgtaacaaaagctactacagaaacgacactggttgaaacagaagaaaccagtgttgttaatgagcctgctgttgagacagtagatagcactgacactgacagtgccattgaaagccat

SEQ ID NO: 6964 - protein, 121 aa, Streptococcus pyogenes
MGFPPILMFVVMLGLIWFMQRQQKKQAQERQNQLNAIEKGDEVVTIGGMFAIVDEVDTTAKKIVLDVDGVFLTFELLAIKRIVTKATTETTLVETEETSVVNEPAVETVDSTDTDSAIESH

SEQ ID NO: 6965 - DNA, 222 bp, Streptococcus agalactiae
gtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgat

SEQ ID NO: 6966 - protein, 74 aa, Streptococcus agalactiae
MARKEGKKAKGAGARALASVAVTLRVTTTPAALNAPLQGASIRHSGCATVGKGDRCGPLRYYASWRKGDVLQGD

SEQ ID NO: 6967 - DNA, 714 bp, Streptococcus agalactiae
ttgggcaacgcttggaaccggcgttatgccaacgaattagcccaagcactagaagcacgtggacaaaaattatattctgtagctaatagaacttacgacaaaggacttgaatttgctaccaaatatggtatccaaaaagtttatgatcacatagatcaagtatttgaagaccctgaagtggatatcatttatatctctactccccacaatactcacatctcatttttacgaaaggctttagcaaatggtaagcacgttctttgcgaaaaatctattactttaaacagcactgaacttaaagaagccatagatttagccgaaactaaccatgttgtcttagctgaagccatgactatttttcatatgccaatttatcgccaattaaaaacattagttgatagtggaaaattaggaccgttaaaaatgattcaaatgaatttcggaagttataaagaatatgatatgactaaccgttttttcagtcgtgacctagcaggcggtgctttgctggacattggtgtttatgcactttcttgtattcgctggtttatgtcagaagcacctcacaacattacctctcaagttacatttgcaccaacaggagttgatgaacaagttggtatcctactaaccaatcctgcaaatgagatggcgactgtcagccttagtttacatgcaaaacaacctaaacgaggccaaactattcgccttttt

SEQ ID NO: 6968 - protein, 238 aa, Streptococcus agalactiae
MGNAWNRRYANELAQALEARGQKLYSVANRTYDKGLEFATKYGIQKVYDHIDQVFEDPEVDIIYISTPHNTHISFLRKALANGKHVLCEKSITLNSTELKEAIDLAETNHVVLAEAMTIFHMPIYRQLKTLVDSGKLGPLKMIQMNFGSYKEYDMTNRFFSRDLAGGALLDIGVYALSCIRWFMSEAPHNITSQVTFAPTGVDEQVGILLTNPANEMATVSLSLHAKQPKRGQTIRLF

SEQ ID NO: 6969 - DNA, 774 bp, Streptococcus agalactiae
ttgtcgatccaacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaag

SEQ ID NO: 6970 - protein, 258 aa, Streptococcus agalactiae
LSIQRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVK

SEQ ID NO: 6971 - DNA, 702 bp, Streptococcus agalactiae
  misc_feature (1)..(702): n = a, c, g, or t
gtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaakkatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaannnnnt

SEQ ID NO: 6972 - protein, 234 aa, Streptococcus agalactiae
  MISC_FEATURE (1)..(234): Xaa = Any Amino Acid
MTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKXXPAGKDQQVNVGETPKAEDSIGNLPDLPKGTTVAFETPVDTATPGDKXX

SEQ ID NO: 6973 - DNA, 606 bp, Streptococcus agalactiae
atggagctaaacatgaccaaaaagatattcttatttatctgcgctactcttttagtaggaatagccttatatacaccaacaacttctatttttaatcataacaacgtttatgctgccaccaagaaagcaaaaattaaatttaataaaactcaaaaaaaaattgtcaaaaaagcaagagaatatgctaagtctggccatatgtctaaagatagtatcattgaaaaattaaaaaaggattctaagaaatatcgtcaagaagacatcaactttgtgattaataacctcaaggttgattacaaaaaaaatgccttgatttctgccaaaatttattcaaagaccatgaatttatctaaacaatctatctttgaacagctctattcggagtctccagataaggcaacccactctgataaatttacaaaagaagaatcccaatatgctatagaccatctcaaagtagatttcaaagaaaatgctcttgagactgctaaaagttatcaaagtagttcttctttatccaaagaagaaatctataaacaattgacatctacgctgggcgataaattcacaaatgatgaagcccaatatgctgtagatcatttgaaa

SEQ ID NO: 6974 - protein, 202 aa, Streptococcus agalactiae
MELNMTKKIFLFICATLLVGIALYTPTTSIFNHNNVYAATKKAKIKFNKTQKKIVKKAREYAKSGHMSKDSIIEKLKKDSKKYRQEDINFVINNLKVDYKKNALISAKIYSKTMNLSKQSIFEQLYSESPDKATHSDKFTKEESQYAIDHLKVDFKENALETAKSYQSSSSLSKEEIYKQLTSTLGDKFTNDEAQYAVDHLK

SEQ ID NO: 6975 - DNA, 288 bp, Streptococcus agalactiae
atgtctagaaaagtacgtcgtcacttcaccgatgattttaagcaacaaattgttgacctttacaatgttggtagaaagcgtagcagtctcatcaaggtatatgagctaaccccttccaccttcgataagtgggttagacaagccaaaacaactggttcattcaagtctattgataatctgacagatgaacagcgggagctaattgaactcagaaaacacaataaagaactcgaaatgcaattagatatcctaaagcaagcagcggtgattatggcacaaaaagggaaa

SEQ ID NO: 6976 - protein, 96 aa, Streptococcus agalactiae
MSRKVRRHFTDDFKQQIVDLYNVGRKRSSLIKVYELTPSTFDKWVRQAKTTGSFKSIDNLTDEQRELIELRKHNKELEMQLDILKQAAVIMAQKGK

SEQ ID NO: 6977 - DNA, 777 bp, Streptococcus agalactiae
atgtgtcgctggctgaatatgccacactcaagttattactatcaagccgtggagtcagtatctgaaacggagtttgaagaaactattaaaagaattttcctcgatagcgagtccagatacggatccagaaaaatcaaaatatgcttgaataacgaaggtatcacactttcacgtcgtcggattcgacgcattatgaagcgactcaatttggtttctgtttatcagaaagccaccttcaaaccacattctagaggcaagaatgaagcccctattcccaaccacttagacaggcaatttaagcaagaaagaccactacaggccttagtcactgacttaacctatgttcgwgtaggcaatcgttgggcttatgtttgcctcatcattgacctatacaaccgtgaaatcatcggcctgtctcttggttggcacaagaccgctgaactcgttaagcaagccatacaaagcatcccttacgccctgaccaaagtcaagatgttccattcagatcgtggcaaagagtttgataatcagttaattgatgaaatattggaagcctttggaatcacacgttcgcttagtcaggctggttgtccttatgacaatgccgtagctgaaagtacgtatcgtgctttcaaaattgaatttgtttatcaagaaacctttcaattgctggaagaactagctcttaagactaaagactatgttcattggtggaattaccaccgcattcatggtagtctcaactaccaaacaccaatgactaaaagattaattgcc

SEQ ID NO: 6978 - protein, 259 aa, Streptococcus agalactiae
MCRWLNMPHSSYYYQAVESVSETEFEETIKRIFLDSESRYGSRKIKICLNNEGITLSRRRIRRIMKRLNLVSVYQKATFKPHSRGKNEAPIPNHLDRQFKQERPLQALVTDLTYVRVGNRWAYVCLIIDLYNREIIGLSLGWHKTAELVKQAIQSIPYALTKVKMFHSDRGKEFDNQLIDEILEAFGITRSLSQAGCPYDNAVAESTYRAFKIEFVYQETFQLLEELALKTKDYVHWWNYHRIHGSLNYQTPMTKRLIA

SEQ ID NO: 6979 - DNA, 288 bp, Streptococcus agalactiae
atggttaaaaaagcatattcatgggaaactaagctggcttgcatcgatatgaagaaagcaggcaagtctaacagagttattatggagactttaggcatcaaaaataatagtcaaatctatacttggatgaaatggtacgaaaacgaggagctttatcgttttcatcaaggtgttggcaagcaatatacctacggtaaaggcttggaacatctgtctgaagtggaacaattacaattacaggttgacctcttaaaaaagtatcgaggcttgataaggaaatcgataaag

SEQ ID NO: 6980 - protein, 96 aa, Streptococcus agalactiae
MVKKAYSWETKLACIDMKKAGKSNRVIMETLGIKNNSQIYTWMKWYENEELYRFHQGVGKQYTYGKGLEHLSEVEQLQLQVDLLKKYRGLIRKSIK

SEQ ID NO: 6981 - DNA, 126 bp, Streptococcus agalactiae
gtggaagactataaaaacaactacccgatagttttcattctagactgttttaaggtcaagcggtcgacctattaccgttggaaaaaggagtatgagaagccgcaaaaaaagatgaccttattgaat

SEQ ID NO: 6982 - protein, 42 aa, Streptococcus agalactiae
MEDYKNNYPIVFILDCFKVKRSTYYRWKKEYEKPQKKMTLLN

SEQ ID NO: 6983 - DNA, 2466 bp, Streptococcus agalactiae
gtgaagaaaacatatggttatatcggctcagttgctgctattttactagctactcatattggaagttaccagcttggtaagcatcatatgggtctagcaacaaaggacaatcagattgcctatattgatgatagcaaaggtaaggtaaaagcccctaaaacaaacaaaacgatggatcaaatcagtgctgaagaaggcatctctgctgaacagatcgtagtcaaaattactgaccaaggttatgttacctcacacggtgaccattatcatttttacaatgggaaagttccttatgatgcgattattagtgaagagttgttgatgacggatcctaattaccattttaaacaatcagacgttatcaatgaaatcttagacggttacgttattaaagtcaatggcaactattatgtttacctcaagccaggtagtaagcgcaaaaacattcgaaccaaacaacaaattgctgagcaagtagccaaaggaactaaagaagctaaagaaaaaggtttagctcaagtggcccatctcagtaaagaagaagttgcggcagtcaatgaagcaaaaagacaaggacgctatactacagacgatggctatatttttagtccgacagatatcattgatgatttaggagatgcttatttagtacctcatggtaatcactatcattatattcctaaaaaagatttgtctccaagtgagctagctgctgcacaagcctactggagtcaaaaacaaggtcgaggtgctagaccgtctgattaccgcccgacaccagccccaggtcgtaggaaagccccaattcctgatgtgacgcctaaccctggacaaggtcatcagccagataacggtggttatcatccagcgcctcctaggccaaatgatgcgtcacaaaacaaacaccaaagagatgagtttaaaggaaaaacctttaaggaacttttagatcaactacaccgtcttgatttgaaataccgtcatgtggaagaagatgggttgatttttgaaccgactcaagtgatcaaatcaaacgcttttgggtatgtggtgcctcatggagatcattatcatattatcccaagaagtcagttatcacctcttgaaatggaattagcagatcgatacttagccggccaaactgatgacaacgactcaggttcagatcactcaaaaccatcagataaagaagtgacacatacctttcttggtcatcgcatcaaagcttacggaaaaggcttagatggtaaaccatatgatacgagtgatgcttatgtttttagtaaagaatccattcattcagtggataaatcaggagttacagctaaacacggagatcatttccattatataggatttggagaacttgaacaatatgagttggatgaggtcgctaactgggtgaaagcaaaaggtcaagctgatgagcttgttgctgctttggatcaggaacaaggcaaagaaaaaccactctttgacactaaaaaagtgagtcgcaaagtaacaaaagatggtaaagtgggctatattatgccaaaagatggcaaggactatttctatgctcgttatcaacttgatttgactcagattgcctttgccgaacaagaactaatgcttaaagataagaagcattaccgttatgacattgttgatacaggcattgagccacgacttgctgtagatttgtcaagtctgccgatgcatgctggtaatgctacttacgatactggaagttcgtttgttatcccacatattgatcatatccatgtcgttccgtattcatggttgacgcgcaatcagattgcaacaatcaagtatgtgatgcaacaccccgaagttcgtccggatgtatggtctaagccagggcatgaagagtcaggttcggtcattccaaatgttacgcctcttgataaacgtgctggtatgccaaactggcaaattatccattctgctgaagaagttcaaaaagccctagcagaaggtcgttttgcagcaccagacggctatattttcgatccacgagatgttttggcaaaagaaacttttgtatggaaagatggctcctttagcatcccaagagcagatggcagttcattgagaaccattaataaatctgatctatcccaagctgagtggcaacaagctcaagagttattggcaaagaaaaatgctggtgatgctactgatacggataaacctgaagaaaagcaacaggcagataagagcaatgaaaaccaacagccaagtgaagccagtaaagaagaaaaagaatcagatgactttatagacagtttaccagactatggtctagatagagcaaccctagaagatcatatcaatcaattagcacaaaaagctaatatcgatcctaagtatctcattttccaaccagaaggtgtccaattttataataaaaatggtgaattggtaacttatgatatcaagacacttcaacaaataaaccct

SEQ ID NO: 6984 - protein, 822 aa, Streptococcus agalactiae
MKKTYGYIGSVAAILLATHIGSYQLGKHHMGLATKDNQIAYIDDSKGKVKAPKTNKTMDQISAEEGISAEQIVVKITDQGYVTSHGDHYHFYNGKVPYDAIISEELLMTDPNYHFKQSDVINEILDGYVIKVNGNYYVYLKPGSKRKNIRTKQQIAEQVAKGTKEAKEKGLAQVAHLSKEEVAAVNEAKRQGRYTTDDGYIFSPTDIIDDLGDAYLVPHGNHYHYIPKKDLSPSELAAAQAYWSQKQGRGARPSDYRPTPAPGRRKAPIPDVTPNPGQGHQPDNGGYHPAPPRPNDASQNKHQRDEFKGKTFKELLDQLHRLDLKYRHVEEDGLIFEPTQVIKSNAFGYVVPHGDHYHIIPRSQLSPLEMELADRYLAGQTDDNDSGSDHSKPSDKEVTHTFLGHRIKAYGKGLDGKPYDTSDAYVFSKESIHSVDKSGVTAKHGDHFHYIGFGELEQYELDEVANWVKAKGQADELVAALDQEQGKEKPLFDTKKVSRKVTKDGKVGYIMPKDGKDYFYARYQLDLTQIAFAEQELMLKDKKHYRYDIVDTGIEPRLAVDLSSLPMHAGNATYDTGSSFVIPHIDHIHVVPYSWLTRNQIATIKYVMQHPEVRPDVWSKPGHEESGSVIPNVTPLDKRAGMPNWQIIHSAEEVQKALAEGRFAAPDGYIFDPRDVLAKETFVWKDGSFSIPRADGSSLRTINKSDLSQAEWQQAQELLAKKNAGDATDTDKPEEKQQADKSNENQQPSEASKEEKESDDFIDSLPDYGLDRATLEDHINQLAQKANIDPKYLIFQPEGVQFYNKNGELVTYDIKTLQQINP

SEQ ID NO: 6985 - DNA, 918 bp, Streptococcus agalactiae
atgaaaaaagttttttttctcatggctatggttgtgagtttagtaatgatagcagggtgtgataagtcagcaaaccccaaacagcctacgcaaggcatgtcagttgtaaccagcttttacccaatgtatgcgatgacaaaagaagtatctggagacctaaatgatgtgaggatgatccaatcaggtgcaggcattcattcctttgaaccgtctgtaaatgatgtggcagctatttatgacgcggatttgtttgtttaccattcacataccttagaagcttgggcaagggatctagaccctaatttaaaaaaatcaaaggttaatgtgtttgaagcgtcaaaacctctgacactagatagagtcaaagggctagaagatatggaagtcacacaaggcattgaccctgcgacactttatgacccacatacctggacggatcccgttttagctggtgaggaagctgttaatatcgctaaagagctaggacatttggatcctaaacacaaagacagttacactaaaaaggctaaggctttcaaaaaagaagcagagcaactaactgaagaatacactcaaaaatttaaaaaggtgcgctcaaaaacatttgtgacgcaacacacggcattttcttatctggctaaacgattcggcttgaaacaacttggtatctcgggtatttctccagagcaagagccctctcctcgccaattgaaagaaattcaagactttgttaaagaatacaacgtcaagactatttttgcagaagacaacgtcaaccccaaaattgctcatgctattgcgaaatcaacaggagctaaagtaaagacattaagtccacttgaagctgctccaagcggaaacaagacatatctagaaaatcttagagcaaatttggaagtgctctatcaacagttgaag

SEQ ID NO: 6986 - protein, 306 aa, Streptococcus agalactiae
MKKVFFLMAMVVSLVMIAGCDKSANPKQPTQGMSVVTSFYPMYAMTKEVSGDLNDVRMIQSGAGIHSFEPSVNDVAAIYDADLFVYHSHTLEAWARDLDPNLKKSKVNVFEASKPLTLDRVKGLEDMEVTQGIDPATLYDPHTWTDPVLAGEEAVNIAKELGHLDPKHKDSYTKKAKAFKKEAEQLTEEYTQKFKKVRSKTFVTQHTAFSYLAKRFGLKQLGISGISPEQEPSPRQLKEIQDFVKEYNVKTIFAEDNVNPKIAHAIAKSTGAKVKTLSPLEAAPSGNKTYLENLRANLEVLYQQLK

SEQ ID NO: 6987 - DNA, 963 bp, Streptococcus agalactiae
  misc_feature (1)..(963): n = a, c, g, or t
ttgaatctgtggaaacagctggcgcagaggtacaaaaaagggaatgccatcgaagaacgtaagattcacgcctttttccgtgatggtaatgtcactcgccctaatcaagaaatcaaaatgacttcgggtgcaggtggtgtctgtgttgccatcggtgaattagctgatggtcttgaaatcgatttggacaaggtgccacttaaataccaaggtcttaatggtactgaaattgctatctcagaatctcaagaaaggatgtcagttgttgttggtccaagtgatgtggatgccttcatcgcagcctgtaacaaggaaaatatcgatgcagttgttgttgcgacagttactgaaaaaccaaatcttgtcatgacttggaatggtgaaacaattgttgatttggaacgctgtttccttgataccaacggtgttcgtgtcgtagttgatgccaaagtcgttgacaaggacttaacagttccagaagcgcgcacaacatcagcagagacacttgaagcagatatgcttaaggtcttgtctgacctcaatcacgctagtcaaaaaggtcttcaaactatctttgactcatctgttggtcgttcaaccgttaaccacccaatcggtggtcgttaccaaatcacaccgacagaaagttctgttcaaaaattgccagttcaatatggtgtgacaacaacagcatctgttatggctcaaggttacaatccttatattgcagagtggtcaccttatcacggtgctgcctatgctgttattgaagcgacagctcgcttggtagcaacgggtgctgactggtctcgtgcacgtttctcttaccaagagtatttcgagcgtatggataaacaggcagagcgttttggtcagccagtatcagctcttcttggttctattgaggctcagattcaattttggtttgccatcaatcgggcggtaaggactctnnnnnttaat

SEQ ID NO: 6988 - protein, 321 aa, Streptococcus agalactiae
  MISC_FEATURE (1)..(321): Xaa = Any Amino Acid
MNLWKQLAQRYKKGNAIEERKIHAFFRDGNVTRPNQEIKMTSGAGGVCVAIGELADGLEIDLDKVPLKYQGLNGTEIAISESQERMSVVVGPSDVDAFIAACNKENIDAVVVATVTEKPNLVMTWNGETIVDLERCFLDTNGVRVVVDAKVVDKDLTVPEARTTSAETLEADMLKVLSDLNHASQKGLQTIFDSSVGRSTVNHPIGGRYQITPTESSVQKLPVQYGVTTTASVMAQGYNPYIAEWSPYHGAAYAVIEATARLVATGADWSRARFSYQEYFERMDKQAERFGQPVSALLGSIEAQIQFWFAINRAVRTLXXN

SEQ ID NO: 6989 - DNA, 279 bp, Streptococcus agalactiae
gtgcatggtaacgctcttgcatggtcatcagctggtgctcttggatttaaaggttctcgtaaatctactccatttgctgctcaaatggctgctgaagctgctgctaaatctgcacaagaacacggtcttaaaactgttgaagttactgtaaaaggtcctggttcaggtcgtgaatctgctatccgtgcccttgctgcagctggtcttgaagtaactgcaattcgtgatgtgactcctgtaccacataatggtgctcgtcctccaaaacgtcgtcgtgta

SEQ ID NO: 6990 - protein, 93 aa, Streptococcus agalactiae
MHGNALAWSSAGALGFKGSRKSTPFAAQMAAEAAAKSAQEHGLKTVEVTVKGPGSGRESAIRALAAAGLEVTAIRDVTPVPHNGARPPKRRRV

SEQ ID NO: 6991 - DNA, 381 bp, Streptococcus pyogenes
ttggctaaaccaacacgtaaacgtcgtgtgaaaaaggacatcgaatctggtgttgcacacattcacgctacatttaataacactattgttatgattacagatgtgcatggtaatgctcttgcatggtcatcagctggtgctcttggtttcaaaggttctcgtaaatctactccatttgctgctcaaatggctgcagaagctgctgcaaaatctgcacaagaacacggactaaaaactgttgaagtgactgtaaaaggtcctggttcaggtcgtgaatcagctattcgtgctctagcagctgcaggtcttgaagtaactgcaattcgtgatgtgacccctgtgccacataatggtgctcgtcctccaaaacgtcgtcgtgta

SEQ ID NO: 6992 - protein, 127 aa, Streptococcus pyogenes
LAKPTRKRRVKKDIESGVAHIHATFNNTIVMITDVHGNALAWSSAGALGFKGSRKSTPFAAQMAAEAAAKSAQEHGLKTVEVTVKGPGSGRESAIRALAAAGLEVTAIRDVTPVPHNGARPPKRRRV

SEQ ID NO: 6993 - DNA, 936 bp, Streptococcus agalactiae
atgattgagtttgaaaaaccaataataacaaaaattgatgaaaataaagattacggcagatttgtcatcgaaccactagaacgtggctacggtacaactctaggaaactctcttcgtcgtgtgcttctgtcttcacttccaggtgcagcagtcacatcaatcaaaattgatggagtattacacgaatttgatactatcccaggtgtacgtgaagatgtgatgcaaatcatccttaatgtaaaaggacttgctgtgaaatcttacgtcgaagacgaaaagattatcgaactagacgttgaaggtcctgcagaaattactgccggagatattttaacagatagtgatatcgaaattgtaaaccctgaccattatcttttcacaattgctgaaggtcacagtttgaaagcaacaatgacagttgctaaaaaccgaggttatgttccagcagaaggaaataaaaaagatgatgcaccagtgggaacattggctgtagattcaatctatacaccagtgaaaaaagttaattatcaagttgaacctgctcgtgtaggtagtaacgatggctttgataaattaactattgaaatcatgacaaatggcacaatcattcctgaggatgctcttggtctttcagctcgcgtcttaattgaacacttaaacttgtttactgatttaacagaggttgctaaagcaactgaagtaatgaaggaaacagagaaagtgaacgatgagaaagtgcttgaccggacaattgaggaacttgatttgtcagtgcgctcatataactgtttaaaacgtgctggaattaatacagtatttgatttaacagaaaaaactgagcctgaaatgatgaaagtccgaaacttaggacgtaagagtcttgaagaagttaaaatcaaacttgccgatctaggtcttggattaaaaaacgataaa

SEQ ID NO: 6994 - protein, 312 aa, Streptococcus agalactiae
MIEFEKPIITKIDENKDYGRFVIEPLERGYGTTLGNSLRRVLLSSLPGAAVTSIKIDGVLHEFDTIPGVREDVMQIILNVKGLAVKSYVEDEKIIELDVEGPAEITAGDILTDSDIEIVNPDHYLFTIAEGHSLKATMTVAKNRGYVPAEGNKKDDAPVGTLAVDSIYTPVKKVNYQVEPARVGSNDGFDKLTIEIMTNGTIIPEDALGLSARVLIEHLNLFTDLTEVAKATEVMKETEKVNDEKVLDRTIEELDLSVRSYNCLKRAGINTVFDLTEKTEPEMMKVRNLGRKSLEEVKIKLADLGLGLKNDK

SEQ ID NO: 6995 - DNA, 936 bp, Streptococcus pyogenes
atgattgagtttgaaaaaccaataataacaaaaattgatgaaaataaagattacggtagatttgtcatcgaaccacttgaacgtggctacggaacaactctaggtaattctcttcgtcgtgtactcttgtcttcacttccaggtgcagcagtaacatcaattaaaattgatggagtactacacgaatttgatacaatcccaggtgtacgtgaagatgtcatgcaaattatccttaatgttaagggacttgctgtgaaatcatacgtcgaagacgaaaagattatcgaacttgaagtagaaggaccagcagaggtaacagctggtgatattcttactgacagtgatatcgaacttgttaacccggatcattatctttttacaatcgctgaaggacattctctacgtgcaacaatgactgttgctaaaaaacgtggttatgtgccagcagaaggcaacaaaaaagatgatgcacctgtgggtacattggcagtagattcaatctatacgccagttaaaaaagttaattatcaagttgaacctgcccgtgtaggtagcaatgatggctttgataaattaacgattgaaatcatgacaaacggaacaattattcctgaagatgctttaggtctatctgctcgagttttgatcgaacacttaaacctgtttactgatttaacagaggttgcaaaagctaccgaagtaatgaaagaaactgaaaaagtgaacgatgaaaaggtacttgaccgcaccatcgaggagcttgatttatccgtacgctcatataactgtttaaaacgtgcaggcattaacactgtcttcgatttaacagaaaaatctgagcctgaaatgatgaaagtccgtaatcttggacgtaagagccttgaagaagttaaggttaaacttgctgacttaggtctcggactaaaaaacgataaa

SEQ ID NO: 6996 - protein, 312 aa, Streptococcus pyogenes
MIEFEKPIITKIDENKDYGRFVIEPLERGYGTTLGNSLRRVLLSSLPGAAVTSIKIDGVLHEFDTIPGVREDVMQIILNVKGLAVKSYVEDEKIIELEVEGPAEVTAGDILTDSDIELVNPDHYLFTIAEGHSLRATMTVAKKRGYVPAEGNKKDDAPVGTLAVDSIYTPVKKVNYQVEPARVGSNDGFDKLTIEIMTNGTIIPEDALGLSARVLIEHLNLFTDLTEVAKATEVMKETEKVNDEKVLDRTIEELDLSVRSYNCLKRAGINTVFDLTEKSEPEMMKVRNLGRKSLEEVKVKLADLGLGLKNDK

SEQ ID NO: 6997 - DNA, 384 bp, Streptococcus agalactiae
atggcttaccgtaaactaggacgcactagctcacaacgtaaggcaatgcttcgtgatttgacaaccgatcttcttatcaacgaatcaattgtaactactgaagcacgtgctaaagaaatccgtaaaacagttgaaaaaatgattactctaggtaaacgtggtgatttacatgctcgtcgtcaagctgctgcttatgtacgtaatgaaattgcatcagaaaactatgatgaagcttctgataaatatacatcaacaacagctcttcaaaaactttttgacgacatcgcacctcgttatgctgaacgtaacggaggatacactcgtattcttaaaacagaaccacgccgtggcgatgctgccccaatggcaattattgaattagta

SEQ ID NO: 6998 - protein, 128 aa, Streptococcus agalactiae
MAYRKLGRTSSQRKAMLRDLTTDLLINESIVTTEARAKEIRKTVEKMITLGKRGDLHARRQAAAYVRNEIASENYDEASDKYTSTTALQKLFDDIAPRYAERNGGYTRILKTEPRRGDAAPMAIIELV

SEQ ID NO: 6999 - DNA, 384 bp, Streptococcus pyogenes
atggcttaccgtaaactaggacgcactagctcacaacgtaaagcaatgcttcgtgatttgacgacagatcttttgatcaacgaatcaattgtaacgacagaagcacgtgcaaaagaaatccgtaaaacagttgaaaaaatgattactcttggtaaacgtggtgatcttcatgctcgtcgccaagcagctgcatacgttcgtaacgaaatcgcatcagaaaattatgatgaagctaccgataaatacacatcaacgacagctcttcaaaaacttttctcagaaattgcacctcgttatgcagaacgtaacggtggatacactcgtattcttaaaacagaaccacgccgtggagatgctgctccaatggcaattattgaattagtt

SEQ ID NO: 7000 - protein, 128 aa, Streptococcus pyogenes
MAYRKLGRTSSQRKAMLRDLTTDLLINESIVTTEARAKEIRKTVEKMITLGKRGDLHARRQAAAYVRNEIASENYDEATDKYTSTTALQKLFSEIAPRYAERNGGYTRILKTEPRRGDAAPMAIIELV

SEQ ID NO: 7001 - DNA, 126 bp, Streptococcus agalactiae
ttgcaacsggttggtttaacagaagaacaagcaaaagagaaagggtatgatgtgaagacatctgtattacctttagrtgctgttccaagagcaattgtaaaccgtgaacaaccggtgtatttaaac

SEQ ID NO: 7002 - protein, 42 aa, Streptococcus agalactiae
  MISC_FEATURE (1)..(42): Xaa = Any Amino Acid
MQXVGLTEEQAKEKGYDVKTSVLPLXAVPRAIVNREQPVYLN

SEQ ID NO: 7003 - DNA, 639 bp, Streptococcus agalactiae
ttgccccaaatttcaggacttgaaaaaatggactatttaactagtacaacacttcttgagttaaagaaaataccaaaacgattaactgtaattggttcaggatacattggaatggagcttggacaactatttcatcatttaggttcagaaataacgcttatgcaaagaagtgagcgacttttaaaggagtatgatcctgagatttcagagtcagttgaaaaagcgttaattgaacagggtataaaccttgtcaaaggggcaacttttgagcgtgttgaacaaagtggagagataaaaagggtttacgtaacagtaaatggcagtagagaagtcattgaatcagatcagttacttgttgccactggaagaaaaccaaatacggattctttaaatttaagtgcagcaggtgttgaaactggaaaaaataatgaaatcctgatcaatgattttggtcaaacaagtaatgaaaagatttatgcagcaggagatgtgactttaggaccacaatttgtatatgtagcagcctatgaaggtggaattattactgataatgctattggtggattaaacaaaaaaatagatttattcggtagttcctgctgttacgtttacgaatccgacggttgcaacsggttggtt

SEQ ID NO: 7004 - protein, 213 aa, Streptococcus agalactiae
  MISC_FEATURE (1)..(213): Xaa = Any Amino Acid
MPQISGLEKMDYLTSTTLLELKKIPKRLTVIGSGYIGMELGQLFHHLGSEITLMQRSERLLKEYDPEISESVEKALIEQGINLVKGATFERVEQSGEIKRVYVTVNGSREVIESDQLLVATGRKPNTDSLNLSAAGVETGKNNEILINDFGQTSNEKIYAAGDVTLGPQFVYVAAYEGGIITDNAIGGLNKKIDLFGSSCCYVYESDGCNXLV

SEQ ID NO: 7005 - DNA, 276 bp, Streptococcus agalactiae
ttggcgtgtcgttatcccacatggctcgcggggcgacggcggcaagcaattcggccatgtcggtggcggattctctcaggtctttttcaagcgtggcacgcagttgcgcctgctcttctttcaggcgcgtcgacagcccgacactcagacgctggcgggtactggcagacagggcgtcgaggctcgacgtcacttcgctactcgccagttcaagctccgaggacaggtgttgcgaatctatccccaggcgattggcaagatccgcctcaagcgccg

SEQ ID NO: 7006 - protein, 92 aa, Streptococcus agalactiae
MACRYPTWLAGRRRQAIRPCRWRILSGLFQAWHAVAPALLSGASTARHSDAGGYWQTGRRGSTSLRYSPVQAPRTGVANLSPGDWQDPPQAP

SEQ ID NO: 7007 - DNA, 174 bp, Streptococcus agalactiae
ttgccatggcagaatctgctccatgcgggacaagaaaatctcttttctggtctgacggcgcttactgctgaattcactgtcggcgaaggtaagttgatgactcatgatgaaccctgttctatggctccagatgacaaacatgatctcatatcagggacttgttcgcaccttccc

SEQ ID NO: 7008 - protein, 58 aa, Streptococcus agalactiae
MPWQNLLHAGQENLFSGLTALTAEFTVGEGKLMTHDEPCSMAPDDKHDLISGTCSHLP

SEQ ID NO: 7009 - DNA, 897 bp, Streptococcus agalactiae
atggagcagattctgccatggcaaaacatggtggaagtcatcgagccgttttaccccaaggctggtaatggccggcgaccttatccgctggaaaccatgctacgcattcactgcatgcagcattggtacaacctgagcgatggcgcgatggaagatgctctgtacgaaatcgcctccatgcgtctgtttgcccggttatccctggatagcgccttgccggaccgcaccaccatcatgaatttccgccacctgctggagcagcatcaactggcccgccaattgttcaagaccatcaatcgctggctggccgaagcaggcgtcatgatgactcaaggcaccttggtcgatgccaccatcattgaggcacccagctcgaccaagaacaaagagcagcaacgcgatccggagatgcatcagaccaagaaaggcaatcagtggcactttggcatgaaggcccacattggtgtcgatgccaagagtggcctgacccacagcctggtcaccaccgcggccaacgagcatgacctcaatcagctgrgtaatctgctgcatggagaggagcaatttgtctcagccgatgcckgctaccaaggggcgccacagcgcgaggagctggccgaggtggatgtggactggctgatcgccgagcgccccggcaaggtaagaaccttgaaacagcatccacgcaagaacaaaacggccatcaacatcgaatacatgaaagccagcatccgggccagggtggagcacccatttcgcatcatcaagcgacagttcggcttcgtgaaagccagatacaaggggttgctgaaaaacgataaccaactggcgatgttattcacgctggccaacctgtttcgggcggaccaaatgatacgtcagtgggagagatctcac

SEQ ID NO: 7010 - protein, 299 aa, Streptococcus agalactiae
  MISC_FEATURE (1)..(299): Xaa = Any Amino Acid
MEQILPWQNMVEVIEPFYPKAGNGRRPYPLETMLRIHCMQHWYNLSDGAMEDALYEIASMRLFARLSLDSALPDRTTIMNFRHLLEQHQLARQLFKTINRWLAEAGVMMTQGTLVDATIIEAPSSTKNKEQQRDPEMHQTKKGNQWHFGMKAHIGVDAKSGLTHSLVTTAANEHDLNQLXNLLHGEEQFVSADAXYQGAPQREELAEVDVDWLIAERPGKVRTLKQHPRKNKTAINIEYMKASIRARVEHPFRIIKRQFGFVKARYKGLLKNDNQLAMLFTLANLFRADQMIRQWERSH

SEQ ID NO: 7011 - DNA, 636 bp, Streptococcus agalactiae
  misc_feature (1)..(636): n = a, c, g, or t
atgaaattattctttgcactctgtgttgtaggaataattgtatttgcttataaaattttagtaagtcctacgactattcgtgttccagatgttagcaacaaaacagtagctcaagcaaaaatgacattggaaaattctggattgaaagtaggagctattcgtaatattgagagtgatagtgtttcagaaggacttgtcgtaaaaacagaccctgctgcaggacgttctcgcagagaaggggctaaagttaatctttatattgccactccaaacaagagtttcactctaggtaattataaggaacataattacaaagatatcctcaaagatcttcaaggcaaaggtgttaaaaaatctttaatcaaggttaagcgtaaaattaataatgattatactactggtacaatcttagcacagtcgcttccagaaggaacatcttttaatcctgatggtaataagaaattaacacttacggttgctgttaatgatccaatgattatgcctgatgtaacaggtatgactgttggagaagtaatagaaaccttgacagacctcggattagatgcagataatcttgtcttctatcaaatgcaaaatggcgtttatcaaacaggtagtaacannnnnttaattaat

SEQ ID NO: 7012 - protein, 212 aa, Streptococcus agalactiae
  MISC_FEATURE (1)..(212): Xaa = Any Amino Acid
MKLFFALCVVGIIVFAYKILVSPTTIRVPDVSNKTVAQAKMTLENSGLKVGAIRNIESDSVSEGLVVKTDPAAGRSRREGAKVNLYIATPNKSFTLGNYKEHNYKDILKDLQGKGVKKSLIKVKRKINNDYTTGTILAQSLPEGTSFNPDGNKKLTLTVAVNDPMIMPDVTGMTVGEVIETLTDLGLDADNLVFYQMQNGVYQTGSNXXLIN

SEQ ID NO: 7013 - DNA, 657 bp, Streptococcus agalactiae
ttggatattcatcaaggagaagtagtggttattattggcccttctggctctggtaagtcaacatttttaagaacaatgaatctcttggaagtaccaacaaagggaacagtgacttttgaagggattgatataacagacaaaaagaatgatatttttaaaatgcgcgaaaaaatgggcatggtttttcaacagttcaatctatttcccaatatgactgtactagaaaatattactttatcacctattaagacaaaggggctttctaatcttgatgctcagacaaaagcatatgagctacttgaaaaagttggactcaaagagaaggctaatacttatccagctagcttatctggaggacaacaacaacgaattgctattgcaagaggtcttgcaatgaatcctgatgtccttctttttgatgaacctacttcagctcttgatcctgaaatggtaggtgaagtcttgactgttatgcaagatttagctaaatctggtatgacgatggttattgtcactcatgaaatgggttttgcacgtgaagtagcggatcgtgtcatttttatggatgcaggaattattgttgagcaaggggcccctaaggaagtatttgagcagacaaaagaaatccgcacaagagatttcttaagtaaagtatta

SEQ ID NO: 7014 - protein, 219 aa, Streptococcus agalactiae
MDIHQGEVVVIIGPSGSGKSTFLRTMNLLEVPTKGTVTFEGIDITDKKNDIFKMREKMGMVFQQFNLFPNMTVLENITLSPIKTKGLSNLDAQTKAYELLEKVGLKEKANTYPASLSGGQQQRIAIARGLAMNPDVLLFDEPTSALDPEMVGEVLTVMQDLAKSGMTMVIVTHEMGFAREVADRVIFMDAGIIVEQGAPKEVFEQTKEIRTRDFLSKVL

SEQ ID NO: 7015 - DNA, 204 bp, Streptococcus agalactiae
ttgttgcaattaatgcaaggaaaaatagttgctgtcattcgtggaaatagccaagaagaagcttttcaagctgctcaagcatgcataaaaggtggtatttctgctatcgaaatcgcctatactaatagcaaagctagccaagtcattgaacaactagtcacacaatatactaaccaagaacaagttgtcgttatttccagatgc

SEQ ID NO: 7016 - protein, 68 aa, Streptococcus agalactiae
MLQLMQGKIVAVIRGNSQEEAFQAAQACIKGGISAIEIAYTNSKASQVIEQLVTQYTNQEQVVVISRC

SEQ ID NO: 7017 - DNA, 873 bp, Streptococcus agalactiae
  misc_feature (1)..(873): n = a, c, g, or t
gtgaattggatagtcgtcaatctggaaaattcgctacccctaatcaaccatcctattctgtcttkgttgtcagtagctggcattgaaacytggaaggagatggaagattttattgaaatgaatgaaccattgtttgcgacctacgttgatttgagtgaaggttgtccgtctcatgataccttagagcgtgtgattagtcttgttaattcagaccgtttaaaagagcttaaagttcaatttgagcaatcattgacaagcttagatgccgttcatcaactgatttcagtggacggtaaaacgattcgaggcaatcgaggtaaaaatcagaagcctgttcatattgtaacggcttatgatgggggtcatcatcttagtttgggacaggtagcggttgaggagaaaagtaatgaaattgttgccattcctcagttattgcggacaattgatatccgtaaaagcattgtaacgatagacgcaatgggcacgcagacggctatcgttgatacgattataaaaggtaaagcagactattgcttagccgtcaaaggaaatcaagaaacactttatgatgatattgctctttattttagtgatgtcaacttattggaagaactccaagaaaatgcgcagtattatcagactgttgaaaaatctaggggacagattgaagttagagaatactgggtgtcttccgatatcaaatggttgtgtcaaaaccatcccaaatggcataagttacgtggtattgggatgactcgtaacacgattgataaggatggtcagctgagtcaagagaatcgttattttatctttagctttaagccggatgtcctcacatttgccaatttgtacgaggtcannnnnttaattaat

SEQ ID NO: 7018 - protein, 291 aa, Streptococcus agalactiae
  MISC_FEATURE (1)..(291): Xaa = Any Amino Acid
MNWIVVNLENSLPLINHPILSXLSVAGIETWKEMEDFIEMNEPLFATYVDLSEGCPSHDTLERVISLVNSDRLKELKVQFEQSLTSLDAVHQLISVDGKTIRGNRGKNQKPVHIVTAYDGGHHLSLGQVAVEEKSNEIVAIPQLLRTIDIRKSIVTIDAMGTQTAIVDTIIKGKADYCLAVKGNQETLYDDIALYFSDVNLLEELQENAQYYQTVEKSRGQIEVREYWVSSDIKWLCQNHPKWHKLRGIGMTRNTIDKDGQLSQENRYFIFSFKPDVLTFANLYEVXXLIN

SEQ ID NO: 7019 - DNA, 615 bp, Streptococcus agalactiae
ttgaactttattgcctgtatttttattatttacgctataatggccattttttcaagagattttaacctttaccactttttacctgctttaccatttggtcttttgctaacgagtaataaaattactattctttaccaaaaagtgattgacagacgttcacatagacgtcagtatttctctggtaaatctcttatcgtagacctttttgtaaagaaaacatattatttgcccctcttactagtttccttatcgatagggttactagtttataatacttatcaaaatgttactcttagtaaagaaaggcgtgacatttcacattatttgactacaaaaattgatagagatggtaagatttatgtttgggacaaagttgctagcatttatagccagactcggttaaaatctgcttctcaatttgttttgccacatattaatacagcgcaaaaaaataatgagaaaattttgaaggacgagctgcttcagcatggggctaaatactttatcttaaataaaaatgagaagttaccaaatgaactgaaatctgatattaagaagcactaccaagaagttcctctatcaaatatcactcattttgttctatatcgtttcaaa

SEQ ID NO: 7020 - protein, 205 aa, Streptococcus agalactiae
MNFIACIFIIYAIMAIFSRDFNLYHFLPALPFGLLLTSNKITILYQKVIDRRSHRRQYFSGKSLIVDLFVKKTYYLPLLLVSLSIGLLVYNTYQNVTLSKERRDISHYLTTKIDRDGKIYVWDKVASIYSQTRLKSASQFVLPHINTAQKNNEKILKDELLQHGAKYFILNKNEKLPNELKSDIKKHYQEVPLSNITHFVLYRFK

SEQ ID NO: 7021 - DNA, 501 bp, Streptococcus agalactiae
atgccgggcaacagcccgcattatgggcgttggcctcaacacgattttacgtcacttaaaaaactcaggccgcagtcggtaacctcgcgcatacagccgggcagtgacgtcatcgtctgcgcggaaatggacgaacagtggggctatgtcggggctaaatcgcgccagcgctggctgttttacgcgtatgacagtctccggaagacggttgttgcgcacgtattcggtgaacgcactatggcgacgctggggcgtcttatgagcctgctgtcaccctttgacgtggtgatatggatgacggatggctggccgctgtatgaatcccgcctgaagggaaagctgcacgtaatcagcaagcgatatacgcagcgaattgagcggcataacctgaatctgaggcagcacctggcacggctgggacggaagtcgctgtcgttctcaaaatcggtggagctgcatgacaaagtcatcgggcattatctgaacataaaacactatcaa

SEQ ID NO: 7022 - protein, 167 aa, Streptococcus agalactiae
MPGNSPHYGRWPQHDFTSLKKLRPQSVTSRIQPGSDVIVCAEMDEQWGYVGAKSRQRWLFYAYDSLRKTVVAHVFGERTMATLGRLMSLLSPFDVVIWMTDGWPLYESRLKGKLHVISKRYTQRIERHNLNLRQHLARLGRKSLSFSKSVELHDKVIGHYLNIKHYQ

SEQ ID NO: 7023 - DNA, 108 bp, Streptococcus agalactiae
gtgcttttgccgttacgcaccaccccgtcagtagctgaacaggagggacagctgatagaaacagaagccactggagcacctcaaaaacaccatcatacactaaatcag

SEQ ID NO: 7024 - protein, 36 aa, Streptococcus agalactiae
MLLPLRTTPSVAEQEGQLIETEATGAPQKHHHTLNQ

SEQ ID NO: 7025 - DNA, 258 bp, Streptococcus agalactiae
  misc_feature (1)..(258): n = a, c, g, or t
ttggcagcatcacctatcgctggtaactggaaaatgaataaaaatccagaagaagcaaaagcattcatcgaagcagtagcttctaaattaccatcatcagaacttgttgaagcagggattgctgctccagcgcttactttatcaacagttcttgaagcagctaaaggttcagaattgaaaatcgctgctcaaaatagctattttgagaattcaggtgcattcactggtgaaaacagccctaaagtattnnnnnttaat

SEQ ID NO: 7026 - protein, 86 aa, Streptococcus agalactiae
  MISC_FEATURE (1)..(86): Xaa = Any Amino Acid
MAASPIAGNWKMNKNPEEAKAFIEAVASKLPSSELVEAGIAAPALTLSTVLEAAKGSELKIAAQNSYFENSGAFTGENSPKVXXXN

SEQ ID NO: 7027 - DNA, 354 bp, Streptococcus agalactiae
gtgtcaatttcatttgataactctttcttagagactgtctctgatgattcagcctttcaggcagatgtttaccttcaaatgaaacggattgcggctggtcaggtggagaatacctatctccatacagtgaatggctatgtcattagctcaaatacagttgtaacacatacacctcaacctgaagaaccaagtccaaatcaacccactccacctcaaccaccaattgagactattgaaccgcctgttccagcaagtattttgccaaatacaggggaacaggaatcccttttgggcttgattggagctggtattctacttggtacggcttatggactgaagaaaaaggaggagaag

SEQ ID NO: 7028 - protein, 118 aa, Streptococcus agalactiae
MSISFDNSFLETVSDDSAFQADVYLQMKRIAAGQVENTYLHTVNGYVISSNTVVTHTPQPEEPSPNQPTPPQPPIETIEPPVPASILPNTGEQESLLGLIGAGILLGTAYGLKKKEEK

SEQ ID NO: 7029 - DNA, 705 bp, Streptococcus agalactiae
  misc_feature (1)..(705): n = a, c, g, or t
ttgaaatttgaaggtcttgttgatcctgttattttaggtaaggctgacgaagttcacgattctttggcaagacttggttttgttgatcaagattatagcattattgaccctgaacaatacgaaaaatttgaagagatgaaagaagcttttgttgagattcgtaaaggcaaagctactatggaagatgcagatcgtcttttgaaggatgttaactattttggggttatgttagtaaaacttggtttggcagatggtatggtatcaggggccattcattcaacagctgatactgtacgtcctgctcttcaaattattaaaacaaaaccaggaatttcacgcacttcaggtgtattyttgatgaaccgtgaaaatacacaggaacgttatatttttgctgactgtgctattaacattgatcctaatgcacaagagctagcagaaattgcagtaaatactgcggatacagctaaaatatttgatattgatcccaagattgctatgcttagtttttcaacaaaaggaagtgcaaaagcgcctcaagctgaaaaagttcaagaagcagctaaaattgccaaagatttatctcccgaattagctgttgatggagaattacaatttgatgcagcttttgttccggaaactgcagaaattaaagctcctaatagtgatgttgctggaaagcaaatgtttttattnnnnnttaat

SEQ ID NO: 7030 - protein, 235 aa, Streptococcus agalactiae
  MISC_FEATURE (1)..(235): Xaa = Any Amino Acid
MKFEGLVDPVILGKADEVHDSLARLGFVDQDYSIIDPEQYEKFEEMKEAFVEIRKGKATMEDADRLLKDVNYFGVMLVKLGLADGMVSGAIHSTADTVRPALQIIKTKPGISRTSGVFLMNRENTQERYIFADCAINIDPNAQELAEIAVNTADTAKIFDIDPKIAMLSFSTKGSAKAPQAEKVQEAAKIAKDLSPELAVDGELQFDAAFVPETAEIKAPNSDVAGKQMFLXXXN

SEQ ID NO: 7031 - DNA, 993 bp, Streptococcus pyogenes
atgagtattcgtagtttattcggtggtttaagagaaaaaattcttggtaaaaacatgaagattgttttcccagaaggtaatgatgagcgcgtcgtccgtgcagctgctcgtttgaaatttgaaggactcttagaaccgattatccttggacagtcagaagaggtacgcaaccttttgacaaaattaggtttcgctgatcaagactatactatcattaatccaaatgaatatgcggattttgacaaaatgaaagaagcttttgttgaggtccgtaaaggaaaagcaacgcttgaagatgcagataaaatgcttcgtgatgttaattactttggtgttatgttggttaaaatgggattagcagatggaatggtatcaggggctattcattcaacagctgacactgttcgtccagctcttcaaatcatcaaaactaaaccaggtatctcaagaacttcaggtgtcttcttgatgaaccgcgaaaatacgagcgagcgttacgtgtttgctgattgtgctatcaatattgacccaacagcacaagaattggcagaaatcgctgttaacacagctgaaacagctaaaatctttgatattgatcctaaaattgctatgttaagcttctcaacaaaaggttctggtaaagcgcctcaagttgataaggtaagagaagcaacagaaattgctacagggttgaaccctgatttggcacttgatggcgagttgcaatttgatgcagcctttgttcctgaaacagcggctatcaaagcaccagattcagcggttgctggtcaagctaatactttcgttttccctgacttgcagtctggaaatattggttacaaaattgcacaacgtttaggaatgtttgatgctattggaccaatcttacaaggattgaacaaacctgttaatgatttatctcgtggctcaagcgctgaagatatttacaaactagccattattacagcagcacaagctattgaaagccaaggg

SEQ ID NO: 7032 - protein, 331 aa, Streptococcus pyogenes
MSIRSLFGGLREKILGKNMKIVFPEGNDERVVRAAARLKFEGLLEPIILGQSEEVRNLLTKLGFADQDYTIINPNEYADFDKMKEAFVEVRKGKATLEDADKMLRDVNYFGVMLVKMGLADGMVSGAIHSTADTVRPALQIIKTKPGISRTSGVFLMNRENTSERYVFADCAINIDPTAQELAEIAVNTAETAKIFDIDPKIAMLSFSTKGSGKAPQVDKVREATEIATGLNPDLALDGELQFDAAFVPETAAIKAPDSAVAGQANTFVFPDLQSGNIGYKIAQRLGMFDAIGPILQGLNKPVNDLSRGSSAEDIYKLAIITAAQAIESQG

SEQ ID NO: 7033 - DNA, 483 bp, Streptococcus agalactiae
atgaaagttttactgtatttagaggctgaagaatacttgaaaaagtcaggtatcggtcgtgctatcaaacatcaagagaaagctcttcaaattgctgggatagattataccactaatcctacagatgactttgaccttgttcatatgaatacctatggtattagaagttggcttttgatgagtaaagctaaaaaaactgggaaaaaagtaattatgcatggccattccactgaagaggactttagaaattcttttattggctcaaatttagtatccccgctttttaaatggtacctttgccgtttttatcaaaaagcagatgccattataaccccaactgattattctaaacaactaataaaagcatatggcatcaagaaaccaatttttgttttatctaacgggattgatctaagtcgctatcagargtcagaaaagaaagaatctgcatttcgtcactattttcacttaagtaaggatgat

SEQ ID NO: 7034 - protein, 161 aa, Streptococcus agalactiae
  MISC_FEATURE (1)..(161): Xaa = Any Amino Acid
MKVLLYLEAEEYLKKSGIGRAIKHQEKALQIAGIDYTTNPTDDFDLVHMNTYGIRSWLLMSKAKKTGKKVIMHGHSTEEDFRNSFIGSNLVSPLFKWYLCRFYQKADAIITPTDYSKQLIKAYGIKKPIFVLSNGIDLSRYQXSEKKESAFRHYFHLSKDD

SEQ ID NO: 7035 - DNA, 153 bp, Streptococcus agalactiae
atggaagtaggggaaatttatgcaggcaaaacgtttgttgattatttaggtaattgtgaacaagaggttgttataggagatgatggttggggtgattttttagttgaatctgcgtctatctcggcttgggttcctaaaatagaggaagctaac

SEQ ID NO: 7036 - protein, 51 aa, Streptococcus agalactiae
MEVGEIYAGKTFVDYLGNCEQEVVIGDDGWGDFLVESASISAWVPKIEEAN

SEQ ID NO: 7037 - DNA, 105 bp, Streptococcus agalactiae
atggaagctgaccaagtacgcggtctactttcagcagatatgcttaaacatgatattgcaatgaaaaaagcggttgacgttatcactagctcagctactgtaaaa

SEQ ID NO: 7038 - protein, 35 aa, Streptococcus agalactiae
MEADQVRGLLSADMLKHDIAMKKAVDVITSSATVK

SEQ ID NO: 7039 - DNA, 573 bp, Streptococcus agalactiae
ttggaattagaagtatttgctgggcaagaaaaaagtgaactttcgatgattgaagttgctcgcgctattttagagcaacgtggtcgtgataacgaaatgtacttcagcgatttggtaaatgatattcaaacctaccttggaaaatctgactcagcaatccgtgagtcattgccatttttctattcagatttgaatacagacggaagttttattccacttggcgaaaacaaatggggacttcgttcatggtatgctatcgatgaaattgacgaggaaatcatcactcttgaagaagatgaagatggcgctccaaaacgtaagaagaaacgtgtcaatgctttcatggatggtgatgaagatgctattgattacaatgatgatgatccagaagatgaagatttcacagaagaaacaccaagtttagaatatgatgaagaaaaccctgacgatgaaaaatcagaggtagaatcgtatgattctgagattaatgaaatcattcctgatgaagatttagatgaggatgtagaaatcaacgaagaagacgatgaagaggaagaagaggaagaagaggtt

SEQ ID NO: 7040 - protein, 191 aa, Streptococcus agalactiae
MELEVFAGQEKSELSMIEVARAILEQRGRDNEMYFSDLVNDIQTYLGKSDSAIRESLPFFYSDLNTDGSFIPLGENKWGLRSWYAIDEIDEEIITLEEDEDGAPKRKKKRVNAFMDGDEDAIDYNDDDPEDEDFTEETPSLEYDEENPDDEKSEVESYDSEINEIIPDEDLDEDVEINEEDDEEEEEEEEV

SEQ ID NO: 7041 - DNA, 606 bp, Streptococcus pyogenes
atggtagagaatgataaaataaggagaactgccttgaaattagacgtatttgcaggacaagaaaaaagcgagctttccatgattgaagtggcgcgtgccattttggaagaacgcggtcgcgacaatgagatgtactttagcgatttagtcaatgagattcaaaattacttaggaaaatctgatgcaggtattcgtcatgcattaccatttttctatactgacttaaatacggatggctcatttattcctctaggtgaaaacaaatggggacttcgttcgtggtatgctattgatgaaattgatgaagaaattattactctagaagaagatgaagatggcgcacaaaaacgtaagaaaaaacgcgttaatgctttcatggatggagatgaagacgctattgattatagagatgatgatccagaagatgaagatttcacagaagaatcagctgaggttgaatatgatgaagaagatccagatgatgaaaaatcagaagtggagtcatatgattcagaattgaatgaaattatccctgaagatgattttgaagaagttgatatcaatgaagaagacgaagaagatgaagaagatgaagaaccagttctc

SEQ ID NO: 7042 - protein, 202 aa, Streptococcus pyogenes
MVENDKIRRTALKLDVFAGQEKSELSMIEVARAILEERGRDNEMYFSDLVNEIQNYLGKSDAGIRHALPFFYTDLNTDGSFIPLGENKWGLRSWYAIDEIDEEIITLEEDEDGAQKRKKKRVNAFMDGDEDAIDYRDDDPEDEDFTEESAEVEYDEEDPDDEKSEVESYDSELNEIIPEDDFEEVDINEEDEEDEEDEEPVL

SEQ ID NO: 7043 - DNA, 1602 bp, Streptococcus agalactiae
atgacaaagtatatttttgttacaggtggtgtggtctcttctattggtaaggggattgttgcagcaagtcttgggcgcttactaaaaaaccgtgggctaaaggtgacaattcaaaaatttgatccatatattaatattgatccagggacaatgagcccttatcaacatggagaagtttatgttacagatgatggtgcagaaactgaccttgaccttggacactacgagcgttttattgatattaacttaaacaaatattcaaatgttacaacgggtaagatttatagtgaagttcttaaaaaagaacgccgtggagaataccttggtgcaactgttcaagttatcccacacgttacagatgctttgaaagaaaaaatcaaacgtgctgcgacaactacagattcagatgttattattactgaagttggcggtactgttggagatattgagagccttccgtttttagaagcacttcgtcaaatgaaggcagatgttggttctgataatgttatgtacattcatacaacgttattaccatacctaaaggctgccggcgaaatgaaaacaaaaccgactcaacattctgttaaagagttacgtggcctaggtatccaacctaatatgcttgttatccgtacagagcaaccagcaggtcaaagtattaagaataaattggcacaattttgtgatgttgcaccagaggctgttatagagtcccttgacgttgaccatatttatcaaattccacttaacatgcaagctcaaaatatggatcaaattgtttgtgatcacttgaagcttgagacacctgctgctgatatgacagaatggtcagcaatggttgataaagtaatgaaccttgagaaaaaagttaaaattgcattggttggtaaatatgttgaattacctgatgcctacctttcagttgtggaagcccttaagcactcagggtacgtcaacgatgttgctattgatctaaaatgggtaaatgctgctgaagtgacagaagataatattaaagaacttgtcggagatgcagatggtatcatcgttcctggtggatttggccaaagaggtagtgagggtaaaattgaagcaattcgctatgcacgtgaaaatgatgttccaatgcttggtgtttgtctcggaatgcagctaacttgtgtcgaatttgcgcgtaatgttttaaaccttcatggagctaattcagcagagcttgaccctaaaacaccgttcccaatcattgatatcatgcgtgatcaaatcgatattgaagatatgggtggtacacttcgccttggtctatatccatgtaaattgaaatcaggttcaagagctgcggcagcttataataatcaagaagttgtccaacgtcgtcaccgtcaccgttatgaatttaatacaaaattccgtgagcaatttgaggctgctggatttgtcttctcaggggtatcaccggataatcgtttgatggaagttgttgagttaccagagaaaaaattctttgttgcagcacaataccatccagaattacaatcacgtcctaaccatgctgaagagctttacacagcttttgtaaccgcagcagttgaaaatatgaaa

SEQ ID NO: 7044 - protein, 534 aa, Streptococcus agalactiae
MTKYIFVTGGVVSSIGKGIVAASLGRLLKNRGLKVTIQKFDPYINIDPGTMSPYQHGEVYVTDDGAETDLDLGHYERFIDINLNKYSNVTTGKIYSEVLKKERRGEYLGATVQVIPHVTDALKEKIKRAATTTDSDVIITEVGGTVGDIESLPFLEALRQMKADVGSDNVMYIHTTLLPYLKAAGEMKTKPTQHSVKELRGLGIQPNMLVIRTEQPAGQSIKNKLAQFCDVAPEAVIESLDVDHIYQIPLNMQAQNMDQIVCDHLKLETPAADMTEWSAMVDKVMNLEKKVKIALVGKYVELPDAYLSVVEALKHSGYVNDVAIDLKWVNAAEVTEDNIKELVGDADGIIVPGGFGQRGSEGKIEAIRYARENDVPMLGVCLGMQLTCVEFARNVLNLHGANSAELDPKTPFPIIDIMRDQIDIEDMGGTLRLGLYPCKLKSGSRAAAAYNNQEVVQRRHRHRYEFNTKFREQFEAAGFVFSGVSPDNRLMEVVELPEKKFFVAAQYHPELQSRPNHAEELYTAFVTAAVENMK

SEQ ID NO: 7045 - DNA, 1602 bp, Streptococcus pyogenes
atgacgaaatacatttttgtaactggtggtgttgtatcatcaattggcaaaggaattgttgcggcaagtcttggccgattgttaaaaaatcgtggacttaaggtgacgattcaaaaatttgatccttatattaatattgatccagggacgatgagcccctatcagcatggagaagtatatgtgacagatgacggtgctgaaaccgacttggatttgggtcactatgaacgttttattgatatcaatcttaataaatattccaatgttacaacaggtaaaatttatagtgaagtccttcgtaaagaacgtaaaggcgagtaccttggagcgactgttcaggtgattcctcatatcacagatgcccttaaagaaaaaatcaaacgcgcagcttcaacaacggactctgatgtaattattactgaggtcggggggactgttggcgatattgaaagtttaccgttcttagaagctcttcgtcagatgaaagctgatgttggttctgaaaatgtgatgtatattcacaccaccttgttgccatatttaaaggcagcgggtgaaatgaaaactaagccaacgcaacattccgttaaagaattgcgtggtttagggattcaaccgaatatgttggttattcgtacggaagagccagttgagcaggggattaaaaataaattggctcagttctgtgatgtgaattcagaagctgttatcgagtcacgtgatgtagaacacttgtatcaaattccattgaacttgcaagctcaatcaatggatcagattgtttgtgatcatttgaaattgaatgcgccacaagctgatatgaccgagtggtcagctatggttgacaaggtgatgaatttaagaaaaacaacaaaaattgccttggttggtaaatatgtggaattgccagatgcctacttatctgttgtggaagccttgaaacattctggttatgccaatgataccgcaattgacctaaaatgggtcaatgctaacgatgtgacggtggataatgcagctgacttgttgggagatgcggatgggattattgtaccaggtggttttggtcaacgtggtacagaaggcaagatccaagcgattcgctatgcccgcgaaaatgatgtgccaatgcttggtatttgtcttggcatgcagttgacttgtgttgaatttgcccgccatgtcctcaatatggaaggtgcaaactcttttgaattagagccaagtactaaataccccatcattgatatcatgcgtgatcaaattgatattgaagatatgggaggtacgcttcgtctgggattgtacccatgtaaattgaaaccaggttcaaaagcagcaatggcttacaataatcaagaggtggtgcaacgtcgtcatcgtcaccgttatgagttcaacaacaaattccgtccagaatttgaagcagctggttttgttttctcaggggtatcacctgacaaccgcttagttgaaattgtagaattgaaagagaaaaaattctttgtagcagctcaataccacccagaattgcaaagccgtccaaatcgtcctgaggagctatacaccgcttttgttacagctgctattaaaaatagcaat

SEQ ID NO: 7046 - protein, 534 aa, Streptococcus pyogenes
MTKYIFVTGGVVSSIGKGIVAASLGRLLKNRGLKVTIQKFDPYINIDPGTMSPYQHGEVYVTDDGAETDLDLGHYERFIDINLNKYSNVTTGKIYSEVLRKERKGEYLGATVQVIPHITDALKEKIKRAASTTDSDVIITEVGGTVGDIESLPFLEALRQMKADVGSENVMYIHTTLLPYLKAAGEMKTKPTQHSVKELRGLGIQPNMLVIRTEEPVEQGIKNKLAQFCDVNSEAVIESRDVEHLYQIPLNLQAQSMDQIVCDHLKLNAPQADMTEWSAMVDKVMNLRKTTKIALVGKYVELPDAYLSVVEALKHSGYANDTAIDLKWVNANDVTVDNAADLLGDADGIIVPGGFGQRGTEGKIQAIRYARENDVPMLGICLGMQLTCVEFARHVLNMEGANSFELEPSTKYPIIDIMRDQIDIEDMGGTLRLGLYPCKLKPGSKAAMAYNNQEVVQRRHRHRYEFNNKFRPEFEAAGFVFSGVSPDNRLVEIVELKEKKFFVAAQYHPELQSRPNRPEELYTAFVTAAIKNSN

SEQ ID NO: 7047 - DNA, 897 bp, Streptococcus agalactiae
  misc_feature (1)..(897): n = a, c, g, or t
atgaaaaagattcgattatcaaagtttattaaaatgattgttgttattttgtttttaattagtgtagcagctagtttttattttttccacgttgcccaagttcgagatgataaatcctttatttcaaatggtcaacgtaagcctggaaactctttatatgcttatgataaatcctttgataagctattaaagcaaaaaatagaaatgacaaaccaaaatataaagcaagttgcttggtatgttcctgctgttaagaaaactcataagacagctgttgtcgttcatggttttgcgaatagcaaagagaatatgaaggcatatggttggctgtttcataagttaggatacaatgttcttatgcctgacaatattgcacatggtgaaagtcatgggcagttgataggctatggctggaacgaccgcgagaacattatcaaatggacagaaatgatagttgataagaatccatcaagccaaattactttatttggtgtttcaatgggtggagcaacagtcatgatggctagtggtgaaaaattacctagtcaggttgttaatatcattgaagattgcggttattctagtgtttgggatgaattaaaatttcaggctaaagagatgtatggtttaccagccttcccactcttatatgaagtttcaacaatttctaaaatcagagcaggtttttcgtatggacaagcaagtagtgtcgaacaattgaaaaagaataatttaccagccctctttattcatggtgataaggataattttgttccaacaagtatggtttatgacaactataaagctacagcaggtaagaaagagctttatattgtaaaaggggcaaaacatgcgaaatcttttgaaacagagccagaaaaatnnnnnttaattaat

SEQ ID NO: 7048 - protein, 299 aa, Streptococcus agalactiae
  MISC_FEATURE (1)..(299): Xaa = Any Amino Acid
MKKIRLSKFIKMIVVILFLISVAASFYFFHVAQVRDDKSFISNGQRKPGNSLYAYDKSFDKLLKQKIEMTNQNIKQVAWYVPAVKKTHKTAVVVHGFANSKENMKAYGWLFHKLGYNVLMPDNIAHGESHGQLIGYGWNDRENIIKWTEMIVDKNPSSQITLFGVSMGGATVMMASGEKLPSQVVNIIEDCGYSSVWDELKFQAKEMYGLPAFPLLYEVSTISKIRAGFSYGQASSVEQLKKNNLPALFIHGDKDNFVPTSMVYDNYKATAGKKELYIVKGAKHAKSFETEPEKXXLIN

SEQ ID NO: 7049 - DNA, 924 bp, Streptococcus pyogenes
atgaaaactattcgaatagcaaagtatttaggaattctattccttttgataactcttattagcgtaggtgctagtttttatttctttcatgttgcacaaataagagaagagaaatcgtttattaataataagaaacggagtacaaataatccattatacccagctgaacagtcttttgacgctttaccttacgaaaaacgtcaactaacaaatcgtgggttaaaacaagtggggtggtacttaccagctgctcaaaaaacaaaaaagacagctattgttgttcatggttttacgaatgacaaagaagatatgaagccatatgccatgctttttcatgatttgggctataatgtcttaatgccagacaatgaggcccatggggaaagtgaagggaacttgattggttatggctggaatgaccgccttaatgtcatggcttggacagaccaactgattaaggaaaaccctgaaagccaaatcacactctttggcttatctatgggtgctgcaacagtaatgatggcaagtggtgagcgattgcctgcgcaagtcacctccctcatcgaagattgcggttatgccagtgtttgggacgaattgaagtttcaggccaaggctatgtacaacttgcctgcctttcctttactctatgaagtctctgccttatctaagattcgagcaggttttagttacggagaagcgagctcagtgaaacagctggctaaaaataaacgtccaactttatttatccacggtgataaggatgattttgttcctacaaaaatggtttatgacaattataaggccacgaaaggtcctaaggaaatcttgattgttaaaggggcaaaacacgccaaatcctttgaaacaaacccagaacaataccagaaaaaaattgccgcttttttgaaaaaagttgagaaa

SEQ ID NO: 7050 - protein, 308 aa, Streptococcus pyogenes
MKTIRIAKYLGILFLLITLISVGASFYFFHVAQIREEKSFINNKKRSTNNPLYPAEQSFDALPYEKRQLTNRGLKQVGWYLPAAQKTKKTAIVVHGFTNDKEDMKPYAMLFHDLGYNVLMPDNEAHGESEGNLIGYGWNDRLNVMAWTDQLIKENPESQITLFGLSMGAATVMMASGERLPAQVTSLIEDCGYASVWDELKFQAKAMYNLPAFPLLYEVSALSKIRAGFSYGEASSVKQLAKNKRPTLFIHGDKDDFVPTKMVYDNYKATKGPKEILIVKGAKHAKSFETNPEQYQKKIAAFLKKVEK

SEQ ID NO: 7051 - DNA, 912 bp, Streptococcus agalactiae
  misc_feature (1)..(912): n = a, c, g, or t
ttgattgataagttagaaatcgtcgaagtgcaaggacctattcttagtcaggtcggggatggtatgcaagataatttatctggtattgaacatcctgtatcggtgaaagtccttaatatacctgaagctgaatttgaagtcgttcactcattggctaaatggaaacgccatactttggcaagatttgggtttaatgagggagaaggtctttttgttcatatgaaagctcttcgtccagatgaagattctcttgatccaacacactcagtttacgtagatcagtgggactgggagaaggtcattcctgatggtagacgtaatttggactatctaaaagaaactgtggaaaaaatctacaaagctatccgcctaacagagcttgccgtggaagctcgttttgatattgaatccattttaccaaagcgtattacctttattcatacagaagaattggtagaaaaatacccagacttaagccctaaagagcgtgaaaatgccatcgctaaggagtatggcgcagtctttttgattggtattggtggagagttagcagatggtaaaccacatgatggtcgtgcaccggactatgatgactggacaacaccatcagaaaatggttttaaaggtctcaatggtgatattttagtgtggaacgaacagcttggaactgcctttgaactatcatcaatgggaattcgagttgatgaagatgctcttaaacgtcaagttgttctcaccggtgatgaagatcgtttagagtttgagtggcataagacgctattacgtggtttcttccctctgactattggtgggggaattggtcaatcacgattagctatgttcttgcttcgtaaaaamcatattggagaagtacagtcaagtgtctggccaaaagaagtcagagataccntt

SEQ ID NO: 7052 - protein, 304 aa, Streptococcus agalactiae
  MISC_FEATURE (1)..(304): Xaa = Any Amino Acid
MIDKLEIVEVQGPILSQVGDGMQDNLSGIEHPVSVKVLNIPEAEFEVVHSLAKWKRHTLARFGFNEGEGLFVHMKALRPDEDSLDPTHSVYVDQWDWEKVIPDGRRNLDYLKETVEKIYKAIRLTELAVEARFDIESILPKRITFIHTEELVEKYPDLSPKERENAIAKEYGAVFLIGIGGELADGKPHDGRAPDYDDWTTPSENGFKGLNGDILVWNEQLGTAFELSSMGIRVDEDALKRQVVLTGDEDRLEFEWHKTLLRGFFPLTIGGGIGQSRLAMFLLRKXHIGEVQSSVWPKEVRDTX

SEQ ID NO: 7053 - DNA, 990 bp, Streptococcus pyogenes
atgaagaaaagttttattcatcaacaagaggagatttcctttgttaagaatacgttcactcagtatttgattgctaagttagatgttgttgaagtgcaaggacccattttaagtcgggtcggggacggtatgcaagataatttgtccggtactgaaaatccagtatctgtcaatgtcttgaaaattcctaatgcaacctttgaagttgtgcattcattagcaaaatggaaacgtcacaccttagcccgttttgggtttaatgaaggtgaaggccttgttgttaatatgaaggctctccgacctgatgaggattcacttgaccaaacccattctgtctatgttgaccaatgggactgggaaaaagtcatccctgatggcaaacgtaatctcgcttacctcaaagaaaccgttgaaaccatttacaaggtcattcggttaactgaattagctgtagaagctcgttatgatattgaggctgttttacctaagaaaataaccttcattcataccgaagaattggtagctaaataccctgatttgacgcccaaagaacgtgaaaatgccattactaaagaatttggagcagtctttttaattggtattggcggggttttacctgacggtaaaccacacgatggccgcgctcctgactatgatgactggacaacagaaactgaaaatggctatcatgggcttaatggtgatattttggtttggaatgaccaacttggttcagcctttgaattatcctcaatggggatccgtgtggatgaagaggccctaaaacgtcaggtggaaatgactggtgaccaagaccgcttaggctttgattggcacaaatctttgttgaatggacttttccctctaacgattggtggaggaatcggtcaatcacgtatggtcatgtttttgttgcgtaaacaacatattggagaagttcagacctccgtttggccccaagaagttcgtgatagctacgataatatttta

SEQ ID NO: 7054 - protein, 330 aa, Streptococcus pyogenes
MKKSFIHQQEEISFVKNTFTQYLIAKLDVVEVQGPILSRVGDGMQDNLSGTENPVSVNVLKIPNATFEVVHSLAKWKRHTLARFGFNEGEGLVVNMKALRPDEDSLDQTHSVYVDQWDWEKVIPDGKRNLAYLKETVETIYKVIRLTELAVEARYDIEAVLPKKITFIHTEELVAKYPDLTPKERENAITKEFGAVFLIGIGGVLPDGKPHDGRAPDYDDWTTETENGYHGLNGDILVWNDQLGSAFELSSMGIRVDEEALKRQVEMTGDQDRLGFDWHKSLLNGLFPLTIGGGIGQSRMVMFLLRKQHIGEVQTSVWPQEVRDSYDNIL

SEQ ID NO: 7055 - DNA, 99 bp, Streptococcus agalactiae
ttgaaaatatattataaaaaatcagccaagcagttttgtttggctgattttaacaataagtttatttttggcttaagaaagtttggatttgttgaggtg

SEQ ID NO: 7056 - protein, 33 aa, Streptococcus agalactiae
MKIYYKKSAKQFCLADFNNKFIFGLRKFGFVEV

SEQ ID NO: 7057 - DNA, 447 bp, Streptococcus agalactiae
atgattaaaaaactattattaactttaatagccatattatgccttacaacgctaaaatcaaacttaagtagcgctgacaccatgactatttctcaacaacaataccaacacatgataacaaatagtgacttaatcgccatcacagataaggcgttagtaagcaaaagtcaacaatctgaagcgactatttttataggacgtccaacttgccaatattgtagagctttcttaccaaaattattaaaatctcaagccacacttcattcaaaaatttactaccttgatagtcaaaaatacaaagggaaacgattgaagagttttttcaaaaagcatcatattaccactgttccaaatttagcacattatcaacaaggaaaaatgactaaatatcttgttcaaggaagccaagctacacctcaacaaatccaaactttcttaagccaaaaa

SEQ ID NO: 7058 - protein, 149 aa, Streptococcus agalactiae
MIKKLLLTLIAILCLTTLKSNLSSADTMTISQQQYQHMITNSDLIAITDKALVSKSQQSEATIFIGRPTCQYCRAFLPKLLKSQATLHSKIYYLDSQKYKGKRLKSFFKKHHITTVPNLAHYQQGKMTKYLVQGSQATPQQIQTFLSQK

SEQ ID NO: 7059 - DNA, 633 bp, Streptococcus agalactiae
gtggttatgagagtagtagcaggaacatttggagggcgtcctttaaaaacgcttgatggaaaaacaactcgtccaacaactgataaggttaaaggcgctatttttaatatgattggtcctttttttgaaggtggtcgtgttttagaccttttttctggcagtggtagcttagctattgaggcgatctcaaggggaatggaccaagctgtcctagttgaaaaagataggcgtgcgcaggtcgttattcaagaaaatattgcaatgactaagagtccggagcaatttcaattattaaaaatggaagccaaccgtgctttagaacaattaacgggacaatttgatttggtcttgttggacccgccatatgctaaggaagaaattgtaaagcaaatccaaatcatggatagcaagggtttattaggcgatgatatcatgattgcttgtgaaacggacaaatcagttgatttacctgaagaaattgcttcttttgggatatggaaacagaaaatttatggcatttctaaagtaacgggtctacgttcgttaggagggctttggtatggattacaagttagtgatgattattctcatcttagtcatattgatttattttgttgttgcgccttcactatt

SEQ ID NO: 7060 - protein, 211 aa, Streptococcus agalactiae
MVMRVVAGTFGGRPLKTLDGKTTRPTTDKVKGAIFNMIGPFFEGGRVLDLFSGSGSLAIEAISRGMDQAVLVEKDRRAQVVIQENIAMTKSPEQFQLLKMEANRALEQLTGQFDLVLLDPPYAKEEIVKQIQIMDSKGLLGDDIMIACETDKSVDLPEEIASFGIWKQKIYGISKVTGLRSLGGLWYGLQVSDDYSHLSHIDLFCCCAFTI

SEQ ID NO: 7061 - DNA, 765 bp, Streptococcus agalactiae
atgctaaggcgtcatatttatagcatgctagaagaacatwatcatttgcagccagaaatcaaataccatcaaaaaacgaacttacgaaagaatcgtgtgtatactgtttttattgaagaaaaagttgatgttattcttgctgatttgaagttggctgatgctttttttggtattgaaactggtattgaacactctatattggacaatgatgaaaatggaagagcttatctcaggggagcattcttatcaacgggtactgttagagaacctgattctgggaaatatcaactagaaattttttctgtttatctagaccatgcacaagacttagctaatcttatgaaaaaatttatgttagatgcaaaggttattgaacataaacatggagcagtaacttatttgcaaaaagcagaagatattatggatttcttgatagtcattgatgccatggaagctagagatgcttttgaagagattaaaatgatacgtgagacacgtaatgatattaatcgtgctaacaacgttgaaacagctaatattgctagaacaatcacagctagtatgaagactatcaataatattatcaagattatggatactattggttttgatgcactgcctagtgatttaagacaagtagctcaggtgcgtgtggctcatccagattactctattcaacaaatagcagacagtttagaaacgcctctgagtaagagtggcgttaaccatcgcttacggaaaataaataaaattgcagatgaatta

SEQ ID NO: 7062 - protein, 255 aa, Streptococcus agalactiae
  MISC_FEATURE (1)..(255): Xaa = Any Amino Acid
MLRRHIYSMLEEHXHLQPEIKYHQKTNLRKNRVYTVFIEEKVDVILADLKLADAFFGIETGIEHSILDNDENGRAYLRGAFLSTGTVREPDSGKYQLEIFSVYLDHAQDLANLMKKFMLDAKVIEHKHGAVTYLQKAEDIMDFLIVIDAMEARDAFEEIKMIRETRNDINRANNVETANIARTITASMKTINNIIKIMDTIGFDALPSDLRQVAQVRVAHPDYSIQQIADSLETPLSKSGVNHRLRKINKIADEL

SEQ ID NO: 7063 - DNA, 93 bp, Streptococcus agalactiae
gtgttagggccctttccggggcttagtgccgcagctaacgcattaagcactccgcctggggagtacgaccgcawggttgaaactcaaaggaat

SEQ ID NO: 7064 - protein, 31 aa, Streptococcus agalactiae
  MISC_FEATURE (1)..(31): Xaa = Any Amino Acid
MLGPFPGLSAAANALSTPPGEYDRXVETQRN

SEQ ID NO: 7065 - DNA, 618 bp, Streptococcus agalactiae
  misc_feature (1)..(618): n = a, c, g, or t
gtgaggataaaaatggataaaataaaaattgtacttgttgatgaccatgagatggttcgtctcggtttaaaaagttttttaaacttacaagctgatgttgaagtaataggtgaggcctcaaatggtttagaaggcataaaaaaagcactggagttacgtccagacgttgttgttatggacttagtaatgcctgaaatggacggtgtagaagcaaccttagcattattgaaggattggccagaagctgccattttagtcttaacatcttacttggataatgaaaaaatttaccctgttattgaagcaggtgccaaaggctatatgttaaagacctcaagcgcagcagagattcttaatgccattcgtaaagtttcaaggggagaacaagctattgaaaatgaagtagataagaaaattaaggctcatgataaatgtccagctttacatgagggcttaacagcaagggaacgtgatatccttaatttattagccaaaggttatgacaatcaaaggattgctgatgaattatttatctcgttaaagactgttaaaactcatgtttctaatattttgggaaaactaaatggtagcagatcgaactcaagcagnnnnnttaat

SEQ ID NO: 7066 - protein, 206 aa, Streptococcus agalactiae
  MISC_FEATURE (1)..(206): Xaa = Any Amino Acid
MRIKMDKIKIVLVDDHEMVRLGLKSFLNLQADVEVIGEASNGLEGIKKALELRPDVVVMDLVMPEMDGVEATLALLKDWPEAAILVLTSYLDNEKIYPVIEAGAKGYMLKTSSAAEILNAIRKVSRGEQAIENEVDKKIKAHDKCPALHEGLTARERDILNLLAKGYDNQRIADELFISLKTVKTHVSNILGKLNGSRSNSSXXXN

SEQ ID NO: 7067 - DNA, 183 bp, Streptococcus agalactiae
atgattgataatggtattggatttgatatggattctgtctatgatttaagttatgggttaaaaaatattgaagatcgagtagaagatttagcaggaaatttacagcttctcagtcagcctggtaaaggagttgctatggatataagattacctttagtaaatcagagtgaggataaaaatgga

SEQ ID NO: 7068 - protein, 61 aa, Streptococcus agalactiae
MIDNGIGFDMDSVYDLSYGLKNIEDRVEDLAGNLQLLSQPGKGVAMDIRLPLVNQSEDKNG

SEQ ID NO: 7069 - DNA, 531 bp, Streptococcus agalactiae
  misc_feature (1)..(531): n = a, c, g, or t
ttgggacaggtagcggttgaggagaaaagtaatgaaattgttgccattcctcagttattgcggacaattgatatccgtaaaagcattgtaacgatagacgcaatgggcacgcagacggctatcgttgatacgattataaaaggtaaagcagactattgcttagccgtcaaaggaaatcaagaaacactttatgatgatattgctctttattttagtgatgtcaacttattggaagaactccaagaaaatgcgcagtattatcagactgttgaaaaatctaggggacagattgaagttagagaatactgggtgtcttccgatatcaaatggttgtgtcaaaatcatcccaaatggcataagttacgtggtattgggatgactcgtaacacgattgataaggatggtcagctgagtcaagagaatcgttattttatctttagctttaagccggatgtcctcacatttgccaattgtgtacgaggtcattggcagatagagagtatgcactggttactttccagnnnnnttaat

SEQ ID NO: 7070 - protein, 177 aa, Streptococcus agalactiae
  MISC_FEATURE (1)..(177): Xaa = Any Amino Acid
MGQVAVEEKSNEIVAIPQLLRTIDIRKSIVTIDAMGTQTAIVDTIIKGKADYCLAVKGNQETLYDDIALYFSDVNLLEELQENAQYYQTVEKSRGQIEVREYWVSSDIKWLCQNHPKWHKLRGIGMTRNTIDKDGQLSQENRYFIFSFKPDVLTFANCVRGHWQIESMHWLLSXXXN

SEQ ID NO: 7071 - DNA, 1140 bp, Streptococcus pyogenes
gtgactacgatgattgattttattatttctattgatgattgcgcagttgaattggatagtcgtcaatcttggaaaattcgctcccccttatcaaccattctatttcttgtcttcgtttgtcagttagctggcattgaaacctggaaggagatggaagattttattgaaatgaatgaaccattgtttgcgacctacgttgatttgagtgaaggttgctcgtctcatgataccttagagcgtgtgattagtcttgttaattcagaccgtttaaaagagcttaaagttcaatttgagcaatcattgacaagcttagatgccgttcatcaactgatttcagtggacggtaaaacgattcgaggcaatcgaggtaaaaatcagaagcctgttcatattgtaacggcttatgatgggggtcatcatcttagtttgggacaggtagcggttgaggagaaaagtaatgaaattgttgccatccctcagctattgcggacaattgatatccgtaaaagcattgtaacgatagacgcaatgggcacgcagacggctatcgttgatacgattataaaaggtaaagcagactattgcttagccgtcaaaggaaatcaagaaacactttatgatgatattgctctttattttagtgatgtcaacttattggaagaactccaagaaaatgcgcagtattatcagactgttgaaaaatctaggggacagattgaagttagagaatactgggtgtcttccgatatcaaatggttgtgtcaaaaccatcccaaatggcataagttacgtggtattgggatgactcgtaacacgattgataaggatggtcagctgagtcaagagaatcgttattttatctttagctttaagccggatgtcctcacatttgccaattgtgtacgaggtcattggcagatagagagtatgcactggttattggacgttgtttatcatgaagatcatcatcagacattggataaaagagccgcatttaacctaaatcttatccgaaaaatgtgcttatattttctcaaagtgatggtatttcctaaaaaagacctcagttatcgtcgcaaacaacggtatatttctgtccatttggaagattatttagtccaattatttggagaaagaggt

SEQ ID NO: 7072 - protein, 380 aa, Streptococcus pyogenes
VTTMIDFIISIDDCAVELDSRQSWKIRSPLSTILFLVFVCQLAGIETWKEMEDFIEMNEPLFATYVDLSEGCSSHDTLERVISLVNSDRLKELKVQFEQSLTSLDAVHQLISVDGKTIRGNRGKNQKPVHIVTAYDGGHHLSLGQVAVEEKSNEIVAIPQLLRTIDIRKSIVTIDAMGTQTAIVDTIIKGKADYCLAVKGNQETLYDDIALYFSDVNLLEELQENAQYYQTVEKSRGQIEVREYWVSSDIKWLCQNHPKWHKLRGIGMTRNTIDKDGQLSQENRYFIFSFKPDVLTFANCVRGHWQIESMHWLLDVVYHEDHHQTLDKRAAFNLNLIRKMCLYFLKVMVFPKKDLSYRRKQRYISVHLEDYLVQLFGERG

SEQ ID NO: 7073 - DNA, 528 bp, Streptococcus agalactiae
gtgaagatcatagctaaaaaagatctattcattaacgatgaaattcgcgttcgtgaagttcgtctggttggtctcgagggtgaacaattaggtattaaaccattgtctgaagctcaagcaattgcagatgatgctaatgttgatttagttttaattcagccacaagctacaccacctgttgcgaaaattatggactatggtaagttcaaatttgagtatcaaaagaaacaaaaagaacaacgtaaaaaacaaagcgttgttactgttaaggaagttcgtcttagcccagttattgataaaggggattttgaaacaaaacttcgtaacggtcgtaagttccttgaaaaaggtaacaaagttaaagtttctatccgattcaaaggacgtatgattactcataaagaaattggagcaaaggtattggcggaatttgctgaagcgacacaagatatcgctattattgagcaaagagctaagatggatggtcgccaaatgtttatgcagcttgcaccaattccagacaagaaa

SEQ ID NO: 7074 - protein, 176 aa, Streptococcus agalactiae
MKIIAKKDLFINDEIRVREVRLVGLEGEQLGIKPLSEAQAIADDANVDLVLIQPQATPPVAKIMDYGKFKFEYQKKQKEQRKKQSVVTVKEVRLSPVIDKGDFETKLRNGRKFLEKGNKVKVSIRFKGRMITHKEIGAKVLAEFAEATQDIAIIEQRAKMDGRQMFMQLAPIPDKK

SEQ ID NO: 7075 - DNA, 528 bp, Streptococcus pyogenes
gtgaagatcatagctaaaaaggatctattcattaatgatgaaattcgcgttcgcgaagttcgtctcgttggtcttgaaggtgaacaattaggtattaaaccattgtctgaagcgcaatcattggctgatgcttcaaatgttgatttggttttaatccagccacaagctgttcctcctgttgccaaacttatggactatggaaagttcaaatttgagtatcaaaagaaacagaaagaacaacgtaaaaaacaaagcgttgtgactgtgaaagaagttcgtctcagtccagttatcgataaaggtgactttgaaacaaaacttcgtaacggtcgtaaattccttgaaaaaggaaataaagttaaggtttctattcgtttcaaaggacgtatgattactcataaagagattggtgccaaggtactagctgactttgctgaagcgactcaagatattgctatcattgagcaacgagcaaaaatggatggacgccaaatgtttatgcaacttgcaccaatttcagacaagaag

SEQ ID NO: 7076 - protein, 176 aa, Streptococcus pyogenes
VKIIAKKDLFINDEIRVREVRLVGLEGEQLGIKPLSEAQSLADASNVDLVLIQPQAVPPVAKLMDYGKFKFEYQKKQKEQRKKQSVVTVKEVRLSPVIDKGDFETKLRNGRKFLEKGNKVKVSIRFKGRMITHKEIGAKVLADFAEATQDIAIIEQRAKMDGRQMFMQLAPISDKK

SEQ ID NO: 7077 - DNA, 894 bp, Streptococcus agalactiae
  misc_feature (1)..(894): n = a, c, g, or t
atggctgctaaagttgttaaagcgggcgttgaggaagtamctatccgatcagtatttacatgtaacactcgccatggtgtttgtcgtcactgttacggtattaacttggcaacaggtgatgctgttgaggttggtgaagcagttggtactattgcagctcaatctatcggtgaaccagggacacagcttacaatgcgtaccttccataccggtggtgttgcttcaaatactgatattacacaaggtctcccacgtatccaagaaatctttgaagcacgtaaccctaaaggtgaggcagttattactgaagttaagggtgaagtcgttgcaattgaagaagactcttcaacacgtactaagaaagtattcgttaaaggtcagacaggtgagggagaatacgttgttccatttacagcacgtatgaaagttgaagttggtgatgaagtagctcgtggtgcggccttaactgaaggatctatccaaccaaaacgtctccttgaagttcgtgatactttatctgttgaaacgtacctacttgctgaagtacaaaaagtttaccgtagccaaggggtagaaatcggagataaacacgttgaggtaatggttcgtcaaatgctccgtaaagttcgtgtcatggatccaggagatacagatcttcttccaggtacacttatggatatttcagactttacagatgctaacaaagatattgttatttctggtggaatccctgcgacaagccgtcctgtccttatgggtattactaaggcttcccttgaaactaattcattcttatcagctgcatccttccaagaaacaacacgtgtccttacagatgctgctatccgtggtaagaaaagaatcacttttttcccagcaannnnnttaattaat

SEQ ID NO: 7078 - protein, 298 aa, Streptococcus agalactiae
  MISC_FEATURE (1)..(298): Xaa = Any Amino Acid
MAAKVVKAGVEEVXIRSVFTCNTRHGVCRHCYGINLATGDAVEVGEAVGTIAAQSIGEPGTQLTMRTFHTGGVASNTDITQGLPRIQEIFEARNPKGEAVITEVKGEVVAIEEDSSTRTKKVFVKGQTGEGEYVVPFTARMKVEVGDEVARGAALTEGSIQPKRLLEVRDTLSVETYLLAEVQKVYRSQGVEIGDKHVEVMVRQMLRKVRVMDPGDTDLLPGTLMDISDFTDANKDIVISGGIPATSRPVLMGITKASLETNSFLSAASFQETTRVLTDAAIRGKKRITFFPAXXLIN

SEQ ID NO: 7079 - DNA, 93 bp, Streptococcus agalactiae
gtgacggtaactaaccagaaagggacggctaactacgtgccagcagccgcggtaatacgtaggtcccgagcgttgtccggatttattggggcg

SEQ ID NO: 7080 - protein, 31 aa, Streptococcus agalactiae
MTVTNQKGTANYVPAAAVIRRSRALSGFIGA

SEQ ID NO: 7081 - DNA, 252 bp, Streptococcus agalactiae
  misc_feature (1)..(252): n = a, c, g, or t
atgttagaagagtttggtgctaagcgcgttcgcgacacaccaatctcagaggctgcgattgcaggttcagctatcggtgctgcacaaacaggtttgcgtcctatcgttgatttgacattcatggattttgtaacaatcgcaatggatgctatcgttgatgattgtatcagagctaatgctgatttccactttaaaacgggactgaaaccaactatagaacgtatatcaacaggtaagtgctgnnnnnttaat

SEQ ID NO: 7082 - protein, 84 aa, Streptococcus agalactiae
  MISC_FEATURE (1)..(84): Xaa = Any Amino Acid
MLEEFGAKRVRDTPISEAAIAGSAIGAAQTGLRPIVDLTFMDFVTIAMDAIVDDCIRANADFHFKTGLKPTIERISTGKCXXXN

SEQ ID NO: 7083 - DNA, 417 bp, Streptococcus agalactiae
  misc_feature (1)..(417): n = a, c, g, or t
atggcagaatcaattaaagcaggaacgttatttaaaccagaactagtaacagaaattatgagtaaagtgaaaggtcactctacgcttgcgaaattatctggtcaaacaccaatcccgttcaacggagtagaacaatttgttttcaacttggatggtaatgctcagattgttggtgaaggtgagcaaaaattagggaataccgcaaaggtcacttctaaaattattaaaccgctgaagtttgtttatcaggcacgtatgactgacgaatttaagtacgcctcagaagaaaaacgattgaatttcttaaaacattatgctgacggttttgctaaaaaaatggcggaggcttttgatattgcagctattcatggccttgaacctcgcacaatgacagatgcctcatnnnnnttaattaat

SEQ ID NO: 7084 - protein, 139 aa, Streptococcus agalactiae
  MISC_FEATURE (1)..(139): Xaa = Any Amino Acid
MAESIKAGTLFKPELVTEIMSKVKGHSTLAKLSGQTPIPFNGVEQFVFNLDGNAQIVGEGEQKLGNTAKVTSKIIKPLKFVYQARMTDEFKYASEEKRLNFLKHYADGFAKKMAEAFDIAAIHGLEPRTMTDASXXLIN

SEQ ID NO: 7085 - DNA, 117 bp, Streptococcus agalactiae
gtgacttacccagatggttcaaaagatactgtagatgtgactgttaaggttgtcgatccacgtacagatgccgataagaatgatccagcaggtaaagatcagcaagtcaatggtagg

SEQ ID NO: 7086 - protein, 39 aa, Streptococcus agalactiae
MTYPDGSKDTVDVTVKVVDPRTDADKNDPAGKDQQVNGR

SEQ ID NO: 7087 - DNA, 486 bp, Streptococcus agalactiae
atggaagggatacgctatggttgcgaacaaggattatatggttggaatgtgacggattgtaaaatctgttttaagtatggcttatactatagccctgttagtaccccagcagattttcggatgcttgctcctattgtattggaacaagtcttaaaaaaagctggaacagaattgttagagccatatcttagttttaaaatttatgcgccacaggaatatctttcacgagcatacaacgatgctcctaaatattgtgcgaacatcgtagacactcaattgaaaaataatgaggtcattcttagtggagaaatccctgctcggtgtattcaagaatatcgtagtgatttaactttctttacaaatggacgtagtgtttgtttaacagagttaaaagggtaccatgttactaccggtgaacctgtttgccagccccgtcgtccaaatagtcggatagataaagtacgatatatgttcaataaaataact

SEQ ID NO: 7088 - protein, 162 aa, Streptococcus agalactiae
MEGIRYGCEQGLYGWNVTDCKICFKYGLYYSPVSTPADFRMLAPIVLEQVLKKAGTELLEPYLSFKIYAPQEYLSRAYNDAPKYCANIVDTQLKNNEVILSGEIPARCIQEYRSDLTFFTNGRSVCLTELKGYHVTTGEPVCQPRRPNSRIDKVRYMFNKIT

SEQ ID NO: 7089 - DNA, 702 bp, Streptococcus agalactiae
  misc_feature (1)..(702): n = a, c, g, or t
gtgacactagataaaaattctagtcaagctcagaaaaaagctggtttaatattgcaggaaaagattgaagataggctcgctatcagaaatcactcagaaatgacttacggagaacttaaaaaggaatatctaaagcaatggataccgaccgtcaaagactccacaaaacgtggttatttagtatctgacagtcatatagcaaccgtgttaccagatgatacaattatcaacaagttgactaaacgtgatattagactaatcattgataaactattaaaacacaattcgtatcatgttacgcataaatgtagaaagagattgcatgccatattttcttatgcgatacaaatggactatatgacaagtaatccgacggagaacgtcttagttcccaaaccaaaggatgattacaagcctgaaaaggtgctttatttaacatctaacgaggtttacgacctgtgcaatagaatgatagacaatgacgaacaaacgctcgcagacatcgttttattcatgtttttgacgggtgtacggtatggagaattatcttgtctgacttacgacaaaatagattttgaaaataaagaaattctgattaatgcaacttacgattttaacacacgaraaatcactacgaccaagaccaaaaaatcaacacgcaaaatatctgtatcagataatattttagatatcgtcnnnnnt

SEQ ID NO: 7090 - protein, 234 aa, Streptococcus agalactiae
  MISC_FEATURE (1)..(234): Xaa = Any Amino Acid
MTLDKNSSQAQKKAGLILQEKIEDRLAIRNHSEMTYGELKKEYLKQWIPTVKDSTKRGYLVSDSHIATVLPDDTIINKLTKRDIRLIIDKLLKHNSYHVTHKCRKRLHAIFSYAIQMDYMTSNPTENVLVPKPKDDYKPEKVLYLTSNEVYDLCNRMIDNDEQTLADIVLFMFLTGVRYGELSCLTYDKIDFENKEILINATYDFNTRXITTTKTKKSTRKISVSDNILDIVXX

SEQ ID NO: 7091 - DNA, 450 bp, Streptococcus agalactiae
ttgcccaagtatagtctgttcgaattagaaaatgggcgtcgtcgattacttgctagtgctggtgaattacaaaaaggtaatgagctagccttaccaacacaatttatgaagttcttataccttgcaagtcgttataatgagtcaaaaggtaaaccagaggagattgagaagaaacaagaatttgtaaatcaacatgtctcttattttgatgacatccttcaattaattaatgatttttcaaaacgagttattctagcagatgctaatttagagaaaatcaataagctttaccaagataataaggaaaatatatcagtagatgaacttgctaataatattatcaatctatttacttttaccagtctaggagctccagcagcttttaaattttttgataaaatagttgatagaaaacgctatacatccacgcaactttgtttattattcatg

SEQ ID NO: 7092 - protein, 150 aa, Streptococcus agalactiae
MPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTQLCLLFM

SEQ ID NO: 7093 - DNA, 771 bp, Streptococcus agalactiae
  misc_feature (1)..(771): n = a, c, g, or t
atggcgaggttgggggctgatttttattcaaagctagtcacggatttacaaaaagatggttttgaaacaaaattttatcagcaaactggtgttttcttattaaaaaaggacgagagtcagttagagtcattgtttgcactagcagataaacgtcgactagaatctcctctaataggtgatttacaaatactaaataaaagtgaagcaaatactcactttcctgagttagatggctatgaacagttactttatgcgagcggaggagcacgagtagaaggggcggacttaacacgaatattgttagaagcaagtggtgttaatgtcatcaaggatgaagttcactttacgataactgataatggctttcgtgttcaaggaattgattttgataaacttgttttagcgagtggagcctggctagctaagatattagatgagcacaactatcaggtagatgttcgccctcaaaaagggcaattgcgagactattattttagcaatattaatacaggaaaatatcctgttgtaatgccagaaggtgagctagatattatcccatttgataatggtaaagtctctgtaggtgcaagtcacgaaaatgatatggcttttgatttaaacattgattttaaagtcttagacaagtttgaagagcaagctattggctattttccgcaattaaaaaagcagatacgacttctgaaacgtgtggaattcgtgcctatacaagtgatttttctccattttttggccctgtccctnnnnnttaat

SEQ ID NO: 7094 - protein, 257 aa, Streptococcus agalactiae
  MISC_FEATURE (1)..(257): Xaa = Any Amino Acid
MARLGADFYSKLVTDLQKDGFETKFYQQTGVFLLKKDESQLESLFALADKRRLESPLIGDLQILNKSEANTHFPELDGYEQLLYASGGARVEGADLTRILLEASGVNVIKDEVHFTITDNGFRVQGIDFDKLVLASGAWLAKILDEHNYQVDVRPQKGQLRDYYFSNINTGKYPVVMPEGELDIIPFDNGKVSVGASHENDMAFDLNIDFKVLDKFEEQAIGYFPQLKKQIRLLKRVEFVPIQVIFLHFLALSLXXN

SEQ ID NO: 7095 - DNA, 783 bp, Streptococcus agalactiae
  misc_feature (1)..(783): n = a, c, g, or t
atgattatttttcaacaaattcttgataaaatcaaagagtacgacaccatcattatccatcgacatatgagaccagaccctgatgctcttggtagccaaatcggcttaagggatatcatcaggcataattttccaaagaaaaaagtacttgctactggttttgacgaacccactctcgcttggattgctaaaatggatcaagtgaccgaccaagactatcaaggcgctcttgttgttgttacagatacagcaaataccccacgcattgatgatgaacgttataaaaaaggtgactttttaattaaaattgaccatcatccaaacgatgaagtctatggagatctctcttatgtagatactaacgcctctagtgcaagtgaaattgtgacagactttgctctttcttgtgatttgttgttatcaacaagtgcagcaagagttctatataatggtattgtaggagatacaggacgctttttatatcctgctaccacaagtaaaacactgaagattgctagcaaacttcgtgaatttgactttgatttttctgcaatggcacgtcaaatggattcctttcctttcaaaattgcaaaattacaaggctttatttttgagcaacttaaaattgacaagaacggcgctgcatgcgttactttaacacaagaagacctaaaacgcttcgatgtaacagatgcagagactgctgcaatcgttggtgtacctggaaaaattgatattgtagaaagttgggcaattttcgttaaacaaagcgatgggnnnnnt

SEQ ID NO: 7096 - protein, 261 aa, Streptococcus agalactiae
  MISC_FEATURE (1)..(261): Xaa = Any Amino Acid
MIIFQQILDKIKEYDTIIIHRHMRPDPDALGSQIGLRDIIRHNFPKKKVLATGFDEPTLAWIAKMDQVTDQDYQGALVVVTDTANTPRIDDERYKKGDFLIKIDHHPNDEVYGDLSYVDTNASSASEIVTDFALSCDLLLSTSAARVLYNGIVGDTGRFLYPATTSKTLKIASKLREFDFDFSAMARQMDSFPFKIAKLQGFIFEQLKIDKNGAACVTLTQEDLKRFDVTDAETAAIVGVPGKIDIVESWAIFVKQSDGXX

SEQ ID NO: 7097 - DNA, 939 bp, Streptococcus pyogenes
atgataacaacttttgaaacaattttagataaaataaaagctcaccaaactattattatccatcgccatcaaaatcctgaccctgatgctcttggtagtcaggccggcttgaaagaaattattgcacaaaatttcccagacaaaaaggttttgatgactggttttgatgagcctagtttagcttggattagccaaatggatcaggtgactgacaaagactataaagaggctttggtcatcattacagatacagcgaatcgaccaaggattgatgatgagcgctacacactggggaagtgcttaattaagattgatcaccatcccaacgatgatgtgtatggtgacttctattatgtggacacaagcgcttctagcgcaagtgaaatcattgcagactttgcctttagtcagaatcttactctctctgacaaggctgctaagctcttatacaccggtatcgttggtgatacagggcgatttctttatgcctcaaccactagtaaaaccctttccattgctagccaactcagacatttcgagttcgactttgctgcgatttcaaggcaaatggattcgtttcctttgaaaatagcaaagctgcaaagctacgtctttgagcatttaacaattgatgagagtggggctgcttatgtccttgtcagccaagaaaccttaaaacattttgacgtgaccctagcagaaagctctgccattgtctgtgctcctggtaaaattgataacgttcaagcttgggctatttttgttgagttaactgacggcaactaccgtgtgcgtatgcgcagtaaagaaaagattattaatggcattgctaagcgtcacggtggaggggggcatccccttgctagcggagccaactcagctaatttagaagaaaatcaagctattttccgagaactcatcgctgtttgccaagagatt

SEQ ID NO: 7098 - protein, 313 aa, Streptococcus pyogenes
MITTFETILDKIKAHQTIIIHRHQNPDPDALGSQAGLKEIIAQNFPDKKVLMTGFDEPSLAWISQMDQVTDKDYKEALVIITDTANRPRIDDERYTLGKCLIKIDHHPNDDVYGDFYYVDTSASSASEIIADFAFSQNLTLSDKAAKLLYTGIVGDTGRFLYASTTSKTLSIASQLRHFEFDFAAISRQMDSFPLKIAKLQSYVFEHLTIDESGAAYVLVSQETLKHFDVTLAESSAIVCAPGKIDNVQAWAIFVELTDGNYRVRMRSKEKIINGIAKRHGGGGHPLASGANSANLEENQAIFRELIAVCQEI

SEQ ID NO: 7099 - DNA, 1020 bp, Streptococcus agalactiae
atgacacaagcagtattaaaagaattggctaaggcggagttgcattgtcatctagatggctcactttctttaccagctattagaaaattggctaatatggctgatataatactgccgagtagtgataaagaattaagaaaatatgttatagctccagctcaaacagaaagcttggtagattaccttaaaacgtttgagtttatcagaccgcttcttcaaacgaaggaagcattacgttttgctgcttatgatgttgctagacaggcagctttagaaaatgttatttatattgagattcgttttgcgccagaactctctatggataaaggtttaactgcaagtgatacagtccttgcagtcttagaaggtttagcagacgctcagaaagaatttaatatcgttgcacgcgcccttgtttgcggtatgcgccaatcgtctcataaaacgaccaaggacattattaaacacattgttgatttggctcccaaaggcctggtaggttttgattttgcaggtgatgaattttcctatccaacagatagtttagtagatcttattcaggaagtaaaacgctcaggttacccgatgactttacatgcaggtgagtgtggttgtgctaagcatattgcggatagtttaaatttagggattaagcgtatgggacatgtgacagctttaacaggacagagggatttaataaagcgatttgtcgaagaagatgctgtagcagagatgtgtttaactagcaatttacaaacaaaagcagcctcaagtattcaaagttttccttatcaagaactttatgatgctggaggtaagattacaattaatacagataatcgtactgtttccgatacaaatttgacgaaagaatatagtcttttcgtaacttattttggaacgaaaatagaagactttcttgttttcaatcaaaacgctgtgaaggcctcctttacaagtgattcagagaaagatactttactacataagctacaagaaaactatgacagctatctaaaa

SEQ ID NO: 7100 - protein, 340 aa, Streptococcus agalactiae
MTQAVLKELAKAELHCHLDGSLSLPAIRKLANMADIILPSSDKELRKYVIAPAQTESLVDYLKTFEFIRPLLQTKEALRFAAYDVARQAALENVIYIEIRFAPELSMDKGLTASDTVLAVLEGLADAQKEFNIVARALVCGMRQSSHKTTKDIIKHIVDLAPKGLVGFDFAGDEFSYPTDSLVDLIQEVKRSGYPMTLHAGECGCAKHIADSLNLGIKRMGHVTALTGQRDLIKRFVEEDAVAEMCLTSNLQTKAASSIQSFPYQELYDAGGKITINTDNRTVSDTNLTKEYSLFVTYFGTKIEDFLVFNQNAVKASFTSDSEKDTLLHKLQENYDSYLK

SEQ ID NO: 7101 - DNA, 453 bp, Streptococcus agalactiae
gtggaggaagatatggctttagcaaagattgtttatgctagcatgaccggaaatactgaagaaattgctgacattgttgctgataaattacgtgacttgggtctagatgttgaagtagaagagtgtacgatggttgatgctgcagattttgaagatgctgacattgcaattgttgccacttatacatatggtgatggagatttaccagatgaaatcgtggacttttatgaagatttagcagaggttgatttatctggtaaagtttacggcgtagtgggttcaggtgatactttctatgattacttctgcaaatctgttgatgagttcgaggctcaattcgcattaacaggagcacaaaaaggtgctgattgtgttaaagttgatttagcggcagaagacgaagacattgaaaacttagaagcttttgctgaagaaattgcttctaaacttaac

SEQ ID NO: 7102 - protein, 151 aa, Streptococcus agalactiae
MEEDMALAKIVYASMTGNTEEIADIVADKLRDLGLDVEVEECTMVDAADFEDADIAIVATYTYGDGDLPDEIVDFYEDLAEVDLSGKVYGVVGSGDTFYDYFCKSVDEFEAQFALTGAQKGADCVKVDLAAEDEDIENLEAFAEEIASKLN

SEQ ID NO: 7103 - DNA, 447 bp, Streptococcus pyogenes
atggcattagcaaaaatcgtttatgccagcatgacgggaaatactgaagaaatcgctgatatcgttgcaaataaattgcaagaattgggccatgatgttgacattgatgagtgcacaacagttgacgcttcagagtttgagaatgctgatatcgctgtcgttgcgacttatacttatggtgatggtgacttaccagatgaaatcgttgatttttacgaagatttacaagatttagatttagaaggtaaaatctatggcgttgtcggctctggtgacactttttatgactatttttgcaaatctgttgatgacttttcagagcaatttgcgcttactggtgccatcaaaggtgcagagcctgtcaaagtagacttggcagcagaagatgaagacatcgatcgtttagaggcctttgcagagcaactctcacaggctgttaataatcta

SEQ ID NO: 7104 - protein, 149 aa, Streptococcus pyogenes
MALAKIVYASMTGNTEEIADIVANKLQELGHDVDIDECTTVDASEFENADIAVVATYTYGDGDLPDEIVDFYEDLQDLDLEGKIYGVVGSGDTFYDYFCKSVDDFSEQFALTGAIKGAEPVKVDLAAEDEDIDRLEAFAEQLSQAVNNL

SEQ ID NO: 7105 - DNA, 339 bp, Streptococcus agalactiae
atggaattagaagagattcgtcaagaaatagatgaaatagatcagcaattagtaagccttttagaaactagaatgggtctaattttagaggtcatagcatttaaaaagaaacatcgacttccagttttagataataatcgtgaaaacgaagtgcttaacaatgtattgaagaaagtccaaaaccatcaatttgacgatgtgatacgagcaactttcaaagacattatgacagaatctcgtgtttatcaaaaggagaatatcttgctcaactactcgtgctgtcaaaatcagcggtggctcgtatccgtcgtcctgtatccgcacaacatcaccaagttc

SEQ ID NO: 7106 - protein, 113 aa, Streptococcus agalactiae
MELEEIRQEIDEIDQQLVSLLETRMGLILEVIAFKKKHRLPVLDNNRENEVLNNVLKKVQNHQFDDVIRATFKDIMTESRVYQKENILLNYSCCQNQRWLVSVVLYPHNITKF

SEQ ID NO: 7107 - DNA, 321 bp, Streptococcus agalactiae
atggaagtcgagactgatagtcaagaagtcttgatgtcaacaggtctaaaagacttaaaagcacacgcatatccagcaattacatacgaagttgatggctatgttgacttagaacttggtgatgttgtgcggatacaggacgacggatacgagccaccgctgattttgacagcacgagtagttgagcaagatattctccttttgataaacacgagattctgtcataatgtctttgaaagttgctcgtatcacatcgtcaaattgatggttttggactttcttcaatacattgttaagcacttcgttttcacgattattatc

SEQ ID NO: 7108 - protein, 107 aa, Streptococcus agalactiae
MEVETDSQEVLMSTGLKDLKAHAYPAITYEVDGYVDLELGDVVRIQDDGYEPPLILTARVVEQDILLLINTRFCHNVFESCSYHIVKLMVLDFLQYIVKHFVFTIII

SEQ ID NO: 7109 - DNA, 237 bp, Streptococcus agalactiae
atgaagacgaggaatgttttagcaatttcaggaaatgatattttctctggcggcggcttgcatgcagatttagcaacttacgttgttaataaattacatggttttgtggcagtaacatgcttaacagcaatgtcagataaagggtttgaagtcattcctatagaggcatctatactaaagcagcaactagaaagtttaaaagatgtagagtttgggtctattaaactaggccttctt

SEQ ID NO: 7110 - protein, 79 aa, Streptococcus agalactiae
MKTRNVLAISGNDIFSGGGLHADLATYVVNKLHGFVAVTCLTAMSDKGFEVIPIEASILKQQLESLKDVEFGSIKLGLL

SEQ ID NO: 7111 - DNA, 480 bp, Streptococcus agalactiae
  misc_feature (1)..(480): n = a, c, g, or t
ttgccacatattaatacagcgcaaaaaaataatgagaaaattttgaaggacgagctgcttcagcatggggctaaatacttaatattaacaataatttcaggctctggagttatcgaaactgttcgttttacagctgataaattgatttggtttcttatttttgctgttggatggcaggtacaaagcgcatctgttgaaatattgtgtcgtggatggttacttccggtgagtgccacaaagtatagtaagatagtttctgtcagtatcagttcaatctttttcggtcttctgcatagcgctaataatcatgtaagccttatctcgattttcaatctgtgtctctttggactatttctatcgctctatgttattttaaaaggtaacatctggggggcgtgtggtattcatggcgcctggaactgtgtacaagggagtgtctttggaatcgaagttagtggagagccaatgttnnnnnttaat

SEQ ID NO: 7112 - protein, 160 aa, Streptococcus agalactiae
  MISC_FEATURE (1)..(160): Xaa = Any Amino Acid
MPHINTAQKNNEKILKDELLQHGAKYLILTIISGSGVIETVRFTADKLIWFLIFAVGWQVQSASVEILCRGWLLPVSATKYSKIVSVSISSIFFGLLHSANNHVSLISIFNLCLFGLFLSLYVILKGNIWGACGIHGAWNCVQGSVFGIEVSGEPMXXXN

SEQ ID NO: 7113 - DNA, 240 bp, Streptococcus agalactiae
  misc_feature (1)..(240): n = a, c, g, or t
atggaaatatctcttttaacagatattgggcaacgtcgttccaataatcaagattttattaatcaatttgaaaataaagccggcgtcccactaatcatcttagcagatggtatgggaggacatcgtgcaggaaatattgctagcgagatgactgtaactgatctaggaagtgattgggcggagacagatttttctgagttatcagaaattcgtgattggatgctctttccaagcnnnnnt

SEQ ID NO: 7114 - protein, 80 aa, Streptococcus agalactiae
  MISC_FEATURE (1)..(80): Xaa = Any Amino Acid
MEISLLTDIGQRRSNNQDFINQFENKAGVPLIILADGMGGHRAGNIASEMTVTDLGSDWAETDFSELSEIRDWMLFPSXX

SEQ ID NO: 7115 - DNA, 246 bp, Streptococcus agalactiae
ttgtctatcctatctagcgtttgtcaaacgctacgtaaaggtggtataataacctatagcacttgtaccatttttgaggaagaaaattttcaagttattgaaaaattcttagaaaaccaccccaattttgagcaagtagaactgagtcatacacaagaggatattgtaaagagaggctgtattagtataagccctgaacaatatcatacagatggcttttttattggacaagtcaaacgtatcttg

SEQ ID NO: 7116 - protein, 82 aa, Streptococcus agalactiae
MSILSSVCQTLRKGGIITYSTCTIFEEENFQVIEKFLENHPNFEQVELSHTQEDIVKRGCISISPEQYHTDGFFIGQVKRIL

SEQ ID NO: 7117 - DNA, 498 bp, Streptococcus agalactiae
  misc_feature (1)..(498): n = a, c, g, or t
ttgaatactagtaataaagctagcaatgccttaatcataccagcgcctgataaagcaggtaaaatcggttggaaagtcccagaaacaaaatcaataattcgactaactgctttggcttttttggtttgttctattttagtcgttgagttagtttcaatgagggagttaatttcttctatttctttcattggtattttagtaggtagtgggcctgttaatagttttgtccatcatattcctcaaaacctgatgaatggtttgagtgcggcgggaggcctccttccagctgttggttttgccatgctgatgaaattattatggacaaataaattagctgttttttacttgcttggttttgttttaacagcttatttaaaattaccagcggttgcagttgctgccctaggagcagttatttgcgtcattagttcacaacgtgatatagaattagacgcaattactagaggtgcgatcagtaaacagacaacctttnnnnnt

SEQ ID NO: 7118 - protein, 166 aa, Streptococcus agalactiae
  MISC_FEATURE (1)..(166): Xaa = Any Amino Acid
MNTSNKASNALIIPAPDKAGKIGWKVPETKSIIRLTALAFLVCSILVVELVSMRELISSISFIGILVGSGPVNSFVHHIPQNLMNGLSAAGGLLPAVGFAMLMKLLWTNKLAVFYLLGFVLTAYLKLPAVAVAALGAVICVISSQRDIELDAITRGAISKQTTFXX

SEQ ID NO: 7119 - DNA, 618 bp, Streptococcus agalactiae
  misc_feature (1)..(618): n = a, c, g, or t
atgattaaggcattgctagctttattactagtattcaaaatcttgacaccgtcatctcaaacatatatattactaaatctttttgcagatggtgttttctattttttacctatcttaatcgccatcacagctgctcaaaaattgaaagctaatcctattttagctttgggaactgttgtcatgctccttcaccctaattgggctaatttagtagcttctggtaaaccagtatccttattccatacgatcccattcacacttactaactatgcatcaagtgtcattcccattattctaattatttgtgttcaggcttatatagaaaaatatttaaagcaaattattcctaaatcactgcgtttagtgcttgttcctatgttaatatttctcagcatgggaattttgtcgttctctatattgggaccaatgggtactatcgctggccaatatttagctgttatttttacttttttatccaaatacgccagttgggcacctgcttttctagtaggagcatttgctcctatcctaatcatgtttggtgttcatagtggaattgctgcattaggaatcacacaactagcgaaattaggggttgattctannnnnttaattaat

SEQ ID NO: 7120 - protein, 206 aa, Streptococcus agalactiae
  MISC_FEATURE (1)..(206): Xaa = Any Amino Acid
MIKALLALLLVFKILTPSSQTYILLNLFADGVFYFLPILIAITAAQKLKANPILALGTVVMLLHPNWANLVASGKPVSLFHTIPFTLTNYASSVIPIILIICVQAYIEKYLKQIIPKSLRLVLVPMLIFLSMGILSFSILGPMGTIAGQYLAVIFTFLSKYASWAPAFLVGAFAPILIMFGVHSGIAALGITQLAKLGVDSXXLIN

SEQ ID NO: 7121 - DNA, 177 bp, Streptococcus agalactiae
gtggttattggtggcggtgtctcagcagcaggtgaatttttacgtagtcgcgttgagaaatactttgtcacatttgctttcccacaagttaaaaagtcaactaaaattaagattgctgaactaggtaatgatgctggtattattggtgcagcaagcttagccaatcaacaagcaagt

SEQ ID NO: 7122 - protein, 59 aa, Streptococcus agalactiae
MVIGGGVSAAGEFLRSRVEKYFVTFAFPQVKKSTKIKIAELGNDAGIIGAASLANQQAS

SEQ ID NO: 7123 - DNA, 324 bp, Streptococcus agalactiae
atggatatgtctgttattttaattattgttattcttctggcttttgttgcttgggcatcttggaattattggagggttcgtagggcagctaaatttttagataacgagtcttttcaaaaagaaatgtcacgaggacagttaattgatatccgagaagctggtgcttttcatagaaagcatattctcggagcacgtaacattccagcaagtcaatttaaagttgccttatcggctttgcgcaaagataaacctgtcctcttatatgacgcaagccgtggtcaatctattccaaggattgttttgttactcagaaaagaaaggttt

SEQ ID NO: 7124 - protein, 108 aa, Streptococcus agalactiae
MDMSVILIIVILLAFVAWASWNYWRVRRAAKFLDNESFQKEMSRGQLIDIREAGAFHRKHILGARNIPASQFKVALSALRKDKPVLLYDASRGQSIPRIVLLLRKERF

SEQ ID NO: 7125 - DNA, 531 bp, Streptococcus agalactiae
  misc_feature (1)..(531): n = a, c, g, or t
gtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttnnnnnt

SEQ ID NO: 7126 - protein, 177 aa, Streptococcus agalactiae
  MISC_FEATURE (1)..(177): Xaa = Any Amino Acid
MTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVXX

SEQ ID NO: 7127 - DNA, 114 bp, Streptococcus agalactiae
  misc_feature (1)..(114): n = a, c, g, or t
gtggatacttatgatacccttcgtgtaggtgtgcctaatatgacgtctgaatcgcttgaccatccgcgttataaaaggtttgtgcaaaacagaacccaaannnnnttaattaat

SEQ ID NO: 7128 - protein, 38 aa, Streptococcus agalactiae
  MISC_FEATURE (1)..(38): Xaa = Any Amino Acid
MDTYDTLRVGVPNMTSESLDHPRYKRFVQNRTQXXLIN

SEQ ID NO: 7129 - DNA, 261 bp, Streptococcus agalactiae
  misc_feature (1)..(261): n = a, c, g, or t
atgacaaattttgcgacaacagatgacgtcattttattatggcgtcaattatccgttgacgaaatcaagcgtgctgaggctttgttagagactgtctctgacacgttgaggttagaagcaagtaaagtgggtaagaatctagatgaaatgattttggaaactccttactttgctactgtattgaaatcggtaactgtagatattgtagcgagaacgctgatgactgctacacaaggtgaaccgatgtcgcaagaannnnnt

SEQ ID NO: 7130 - protein, 87 aa, Streptococcus agalactiae
  MISC_FEATURE (1)..(87): Xaa = Any Amino Acid
MTNFATTDDVILLWRQLSVDEIKRAEALLETVSDTLRLEASKVGKNLDEMILETPYFATVLKSVTVDIVARTLMTATQGEPMSQEXX

SEQ ID NO: 7131 - DNA, 714 bp, Streptococcus agalactiae
atggaagatatcttcgttggtgagacagtaactccgacagatgctattgaaccactaccagttttacgtattgacgagccaacacttcaaatgactttcttggtgaataattcaccatttgcaggtcgcgaaggtaaatggattacgtcacgtaaggttgaagaacgtcttttagcagaattacaaacagacgtttctttacgtgttgacccaacagattcgccagataaatggacggtttcagggcgtggagaattacatttatctatccttattgaaacaatgcgtcgtgagggatatgaacttcaagtatcacgtccagaagttatcatcaaagaaattgatggtgttcaatgcgagccgtttgagcgtgttcaaattgatactccagaagaatatcagggtgctattatccaaagtttgtcagagcgtaaaggtgatatgcttgatatgcagatggttggtaatggtcaaacgcgtttgattttcttgattcctgcacgtggtttgattggttattcaacagagtttctttcaatgacacgtggatatggtatcatgaatcatacttttgaccagtatctaccggttgttcaaggagaaattggtggtcgtcatcgtggtgccttggtttctattgaaaatggtaaagcaactacatattcaattatgcgtattgaagaacgtgggaacctatcctttgtaaatcccagg

SEQ ID NO: 7132 - protein, 238 aa, Streptococcus agalactiae
MEDIFVGETVTPTDAIEPLPVLRIDEPTLQMTFLVNNSPFAGREGKWITSRKVEERLLAELQTDVSLRVDPTDSPDKWTVSGRGELHLSILIETMRREGYELQVSRPEVIIKEIDGVQCEPFERVQIDTPEEYQGAIIQSLSERKGDMLDMQMVGNGQTRLIFLIPARGLIGYSTEFLSMTRGYGIMNHTFDQYLPVVQGEIGGRHRGALVSIENGKATTYSIMRIEERGNLSFVNPR

SEQ ID NO: 7133 - DNA, 336 bp, Streptococcus agalactiae
  misc_feature (1)..(336): n = a, c, g, or t
ttgttgccacaagtcaaagaacggatatatcctgttggtcgcttggattgggatacaactggacttttaattttgactaatgatggtgattttactgataaaatgattcatcctcgtaatgaaattgataaagtttatttagcacgtgttaaaggaatagctactaaagaaaaccttcgaccattaacgcgtggcgttgttatcgatggtaagaaaacaaaacctgctcgctatactatcataaaagtggatcatgaaaaaaatcgttcagtagttgaattaactattcatgaaggtcgtaatcatcaagttaagaaaatgtttgaacaannnnnt

SEQ ID NO: 7134 - protein, 112 aa, Streptococcus agalactiae
  MISC_FEATURE (1)..(112): Xaa = Any Amino Acid
MLPQVKERIYPVGRLDWDTTGLLILTNDGDFTDKMIHPRNEIDKVYLARVKGIATKENLRPLTRGVVIDGKKTKPARYTIIKVDHEKNRSVVELTIHEGRNHQVKKMFEQXX

SEQ ID NO: 7135 - DNA, 348 bp, Streptococcus agalactiae
  misc_feature (1)..(348): n = a, c, g, or t
ntgcaagaaatgcgtgaacgtgtgtgtgaagctaataaatcactaccagttcatagtttagttaaatttacttggggtaacgtttctgaagttgaccgcgaagcaggattgattgttatcaaaccttcaggagttgactatgaccaattgacacctgaaaatatggttgtcacagacttagagggaaatatagtggagggggatttgaatccatcatctgatcttccaactcatgttcaactttataaagcatggccagaagtcggtggtattgttcatactcattcaacagaagcagttggttgggcacaagattacctgatatcgttattactgttggaaaactca

SEQ ID NO: 7136 - protein, 116 aa, Streptococcus agalactiae
  MISC_FEATURE (1)..(116): Xaa = Any Amino Acid
XQEMRERVCEANKSLPVHSLVKFTWGNVSEVDREAGLIVIKPSGVDYDQLTPENMVVTDLEGNIVEGDLNPSSDLPTHVQLYKAWPEVGGIVHTHSTEAVGWAQDYLISLLLLENS

SEQ ID NO: 7137 - DNA, 681 bp, Streptococcus agalactiae
atgactcaaccaaccggctctaacccactctcgctgggcaccgattacgaaaccctggccaaccgcttccggccgatcttccgtgagatcagcgcgggcaacgtcgaacgtgaaaaagctcgtgccctgccctacgagcctattgaatggctgaagaaagccggtttcggcgctgtgcgggtaccgagcgaatatggcggtgccggtgcctcgatcggccagctttttcagctgttgatagaattggccgaggccgactcgaacatcccgcaggctttgcgggcgcattttgcttttgtcgaagaccgcctgaatgcgccaccgggcgtggaccgtgacacatggtttgcacgctttgtcgccggggatctggtcggcaatggctggaccgaagtcggcacggtgaaaatcggtgatgtgatcaccaaggtcagtgctcagggcgacggttttgtgctcaacggcaccaagttctacagcaccggcagcatcttcgccgactggatcgacgtctacgcccagcgtgcagacaatggcgccgacgtgattgccgtggtcaatgcccggcacgctggcgtgcgtcacagcgacgactgggacggtttcgggcagcgcaccaccggcaagcggcacgtcggtgtacgacaacgtgccattgccggcgaaccatgtgattccctt

SEQ ID NO: 7138 - protein, 227 aa, Streptococcus agalactiae
MTQPTGSNPLSLGTDYETLANRFRPIFREISAGNVEREKARALPYEPIEWLKKAGFGAVRVPSEYGGAGASIGQLFQLLIELAEADSNIPQALRAHFAFVEDRLNAPPGVDRDTWFARFVAGDLVGNGWTEVGTVKIGDVITKVSAQGDGFVLNGTKFYSTGSIFADWIDVYAQRADNGADVIAVVNARHAGVRHSDDWDGFGQRTTGKRHVGVRQRAIAGEPCDSL

SEQ ID NO: 7139 - DNA, 105 bp, Streptococcus agalactiae
gtgccagcagccgcggtaatacgtaggtcccgagcgttgtccggatttattgggcgtaaagcgagcgcaggcggttctttaagtctgaagttaaaggcagtggct

SEQ ID NO: 7140 - protein, 35 aa, Streptococcus agalactiae
MPAAAVIRRSRALSGFIGRKASAGGSLSLKLKAVA

SEQ ID NO: 7141 - DNA, 141 bp, Streptococcus agalactiae
ttgagttttagctatgaagcagaatcaactagtcgtttagaagttagactttacctctcgctgggagacaaaccacctccttgttcgagcataaaaaaagcacttgcaacactagctaagcgcttattaaatgatttcaat

SEQ ID NO: 7142 - protein, 47 aa, Streptococcus agalactiae
MSFSYEAESTSRLEVRLYLSLGDKPPPCSSIKKALATLAKRLLNDFN

SEQ ID NO: 7143 - DNA, 210 bp, Streptococcus agalactiae
gtggataccgatgttttataccaaaagtataaacagactggtgaagtaatcaagaatagaaggggacggactcataaggaacttattgatttaccagaagatatttcgataggtattgatatttactcaggaaatttagtaaatggcctgactattcattacggaaagaccggatcgcacattgttccaacttatcatgaaaggagagag

SEQ ID NO: 7144 - protein, 70 aa, Streptococcus agalactiae
MDTDVLYQKYKQTGEVIKNRRGRTHKELIDLPEDISIGIDIYSGNLVNGLTIHYGKTGSHIVPTYHERRE

SEQ ID NO: 7145 - DNA, 747 bp, Streptococcus agalactiae
atggagcttggacaactatttcatcatttaggttcagaaataacgcttatgcaaagaagtgagcgacttttaaaggagtatgatcctgagatttcagagtcagttgaaaaagcgttaattgaacagggtataaaccttgtcaaaggggcaacttttgagcgtgttgaacaaagtggagagataaaaagggtttacgtaacagtaaatggcagtagagaagtcattgaatcagatcagttacttgttgccactggaagaaaaccaaatacggattctttaaatttaagtgcagcaggtgttgaaactggaaaaaataatgaaatcctgatcaatgattttggtcaaacaagtaatgaaaagatttatgcagcaggagatgtgactttaggaccacaatttgtatatgtagcagcctatgaaggtggaattattactgataatgctattggtggattaaacaaaaaaatagatttatcggtagttcctgctgttacgtttacgaatccgacggttgcaacggttggtttaacagaagaacaagcaaaagagaaagggtatgatgtgaagacatctgtattacctttaggtgctgttccaagagcaattgtaaaccgtgaaacaaccggtgtatttaaactagtagcagatgcagaaacactaaaagtattaggggttcatattgtatctgaaaatgcaggagatgtcatctatgcagcatcattagctgttaaatttgggcttaacgaa

SEQ ID NO: 7146 - protein, 249 aa, Streptococcus agalactiae
MELGQLFHHLGSEITLMQRSERLLKEYDPEISESVEKALIEQGINLVKGATFERVEQSGEIKRVYVTVNGSREVIESDQLLVATGRKPNTDSLNLSAAGVETGKNNEILINDFGQTSNEKIYAAGDVTLGPQFVYVAAYEGGIITDNAIGGLNKKIDLSVVPAVTFTNPTVATVGLTEEQAKEKGYDVKTSVLPLGAVPRAIVNRETTGVFKLVADAETLKVLGVHIVSENAGDVIYAASLAVKFGLNE

SEQ ID NO: 7147 - DNA, 102 bp, Streptococcus agalactiae
atgggttcaaaagatactgtagatgtgactgttaaggttggtcgatccacggtacagatgccgataagaatgatccagcaggtaaagatcagcaagtcaatg

SEQ ID NO: 7148 - protein, 34 aa, Streptococcus agalactiae
MGSKDTVDVTVKVGRSTVQMPIRMIQQVKISKSM

SEQ ID NO: 7149 - DNA, 282 bp, Streptococcus agalactiae
gtgacttacccagatggttcaaaagatactgtagatgtgactgttaaggttgtcgatcgacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatgggttcaaaagatactgtagatgtgactgt

SEQ ID NO: 7150 - protein, 94 aa, Streptococcus agalactiae
MTYPDGSKDTVDVTVKVVDRRTDADKNDPAGKDQQVNVGETPKAEDSIGNLPDLPKGTTVAFETPVDTATPGDKPAKVVVTYPDGFKRYCRCDC

SEQ ID NO: 7151 - DNA, 816 bp, Streptococcus agalactiae
atggagttatccaaagcagctcaaaagagtattgctatacatcttggtatagagttgaatgaaggtttacttgattatctatatttagtgttttgtattagtgatggtcctctatttagcaatcgagatgatatcaatatcaacgaagaatttatttttgcttcttataagatatcaaagtctaaagcctttaagaatttttgtggtcgattattgggtagagaatttattgactcgcagcattttaaagatattaatgcctattttttgagacattttatttgttattgttattattttattcctgatttttattttttaaatacatcaaggctgagctattctaaggatttatatcacctattagataaaggtctggctgatatttttaaccttaaaggagggaatttaactttttcaaaacatgagacagtgctactaacaatgcaattatctaacttaatagagactttcttagctcctctttctgtatatgtaatttcatctagtaatattagattacaaacctatcaagtaatgttaaaccaatattttacatctaagatagcggaattcttttttgtaaactatcaaacgactcagatagatgaaaaattactaaaaaaagcagatatcattattgctgagagacgctatatatcttctttaaaaaatgactcaggtgtggctatacaagatatattagaaattgggatgaataataagcagtaccatgaactacttttacaagctattatcgaaaaaagggaccaaaaagtttttgaatatatttcaaaaatgaaacataaaatactt

SEQ ID NO: 7152 - protein, 272 aa, Streptococcus agalactiae
MELSKAAQKSIAIHLGIELNEGLLDYLYLVFCISDGPLFSNRDDININEEFIFASYKISKSKAFKNFCGRLLGREFIDSQHFKDINAYFLRHFICYCYYFIPDFYFLNTSRLSYSKDLYHLLDKGLADIFNLKGGNLTFSKHETVLLTMQLSNLIETFLAPLSVYVISSSNIRLQTYQVMLNQYFTSKIAEFFFVNYQTTQIDEKLLKKADIIIAERRYISSLKNDSGVAIQDILEIGMNNKQYHELLLQAIIEKRDQKVFEYISKMKHKIL

SEQ ID NO: 7153 - DNA, 654 bp, Streptococcus pyogenes
ttgaaagcatccctgcgtccactactaggcaataatatcctaaactcccttcctttcaaacggattttggtttccttctcacgtctatttatcagtaatcttcaagttttgttacctgacatacacttgttccattacctcagaagacagcaaaaacgaaacaagagcttctacaatactctaaaaaccatcgttgaggaatggatgagcgcagaaggcatcgtggggaaactgccgtcttatcatttattgctcttcacgatacagttagaggaactcctaaaaacatatttgccaccgatacctgtctatcttttgaccaataacactgctgcgctggatttgatgaccaatgcactctcaatttacttcccgccagctattgcaacggttatgcctgtcaatgtcgaaatcattcctttcaaagatattgttaaggaaaagcagagtgtcattatcgcagataggcaatacctgaacctgatacagcatttgtaccagaatcaagggcatttgttcttgtatttcttgtttagttttagagacgtttctgaggcttacattcataaggcatttctagacttccgccaaaaacggtacgatgagtttatcgtgaccttgttggacacttaccacaagaacctgtcttctcct

SEQ ID NO: 7154 - protein, 218 aa, Streptococcus pyogenes
LKASLRPLLGNNILNSLPFKRILVSFSRLFISNLQVLLPDIHLFHYLRRQQKRNKSFYNTLKTIVEEWMSAEGIVGKLPSYHLLLFTIQLEELLKTYLPPIPVYLLTNNTAALDLMTNALSIYFPPAIATVMPVNVEIIPFKDIVKEKQSVIIADRQYLNLIQHLYQNQGHLFLYFLFSFRDVSEAYIHKAFLDFRQKRYDEFIVTLLDTYHKNLSSP

SEQ ID NO: 7155 - DNA, 132 bp, Streptococcus agalactiae
ttgccggtggctgcgccgcgattgctgcgttctgttcggcggcgtttttcagcggcagcaccaccggttccggtgacatgttgctgtcggtggtggccattgccttcctcggtgtggtgttctcgcgacgcc

SEQ ID NO: 7156 - protein, 44 aa, Streptococcus agalactiae
MPVAAPRLLRSVRRRFSAAAPPVPVTCCCRWWPLPSSVWCSRDA

SEQ ID NO: 7157 - DNA, 447 bp, Streptococcus agalactiae
  misc_feature (1)..(447): n = a, c, g, or t
ttgcacgccgttgacccagaagttggaaatgttcagcaactgaaagccattgatcaaaaaacccagcaacaggttcgccaacaacgtgccggggatgttcgcggtcaggcgtcgcgagaacaccacaccgaggaaggcaatggccaccaccgacagcaacatgtcaccggaaccggtggtgctgccgctgaaaaacgccgccgaacagaacgcagcaatcgcggcgcagccaccggcaatcaggtagctggcgaacacatagcgttgcacactcaacccggcagccttcgcggcctgcgggtattcgccgatggcgtacaggcgcaggccgaacgcgctgtgctgaatcagcagccacaagcctgccgctacactcaacagcacccacgccagcgccggaacgcccagccagacgccggaagcaaggctgtccagcannnnnttaat

SEQ ID NO: 7158 - protein, 149 aa, Streptococcus agalactiae
  MISC_FEATURE (1)..(149): Xaa = Any Amino Acid
MHAVDPEVGNVQQLKAIDQKTQQQVRQQRAGDVRGQASREHHTEEGNGHHRQQHVTGTGGAAAEKRRRTERSNRGAATGNQVAGEHIALHTQPGSLRGLRVFADGVQAQAERAVLNQQPQACRYTQQHPRQRRNAQPDAGSKAVQXXXN

SEQ ID NO: 7159 - DNA, 213 bp, Streptococcus agalactiae
ttgccccagctcagaaaacctggcgcattaatggcgaagaacagcagaatgatcagcaccagcaacggcaggaccgcaggtaacaggcgcggcaggacttttatcagcgtcgacgaggtattcagcgtcacggtactcattgttcaccttcctgacggccaagcgcccctgaaaacgccaccaccagcagaatcaacacaccttgcacgccgt

SEQ ID NO: 7160 - protein, 71 aa, Streptococcus agalactiae
MPQLRKPGALMAKNSRMISTSNGRTAGNRRGRTFISVDEVFSVTVLIVHLPDGQAPLKTPPPAESTHLARR

SEQ ID NO: 7161 - DNA, 483 bp, Streptococcus agalactiae
atgaccacttattttgataactttttaaaaaccaatcaagcctatgctgacttacatggaacagctcatctacctatcaagccaaagacaaaggttgctattgtaacctgtatggattctcgtttacacgttgctcaagctctagggctagctttaggagatgctcatattttacgtaatgctggtggacgagttacagacgatgttctacgttctttagttatttcgcaacaacaattaggaacacgagaaatcgttgttctacaccatacagattgtggagcacagacgtttactaacgaagcttttgctgctcaattacagagagatttgggtgttgatatgcatggacatgattttcttccttttaatgatattgaagaaagcgttcgtgaagatgtggcaaaattacatgcttctccattcttacgagaagaaagtcgtctctgcccaccgtacgccagacctcatgttcaagcatgc

SEQ ID NO: 7162 - protein, 161 aa, Streptococcus agalactiae
MTTYFDNFLKTNQAYADLHGTAHLPIKPKTKVAIVTCMDSRLHVAQALGLALGDAHILRNAGGRVTDDVLRSLVISQQQLGTREIVVLHHTDCGAQTFTNEAFAAQLQRDLGVDMHGHDFLPFNDIEESVREDVAKLHASPFLREESRLCPPYARPHVQAC

SEQ ID NO: 7163 - DNA, 96 bp, Streptococcus agalactiae
  misc_feature (1)..(96): n = a, c, g, or t
atgttcaagcatgctgaggaggcgcgtggtcgtggtatcaagattatcatcgctggagcaggtggagcagcccacttgcctttccagcacnnnnnt

SEQ ID NO: 7164 - protein, 32 aa, Streptococcus agalactiae
  MISC_FEATURE (1)..(32): Xaa = Any Amino Acid
MFKHAEEARGRGIKIIIAGAGGAAHLPFQHXX

SEQ ID NO: 7165 - DNA, 810 bp, Streptococcus agalactiae
ttgtctagcatttttgctagtgtaatgatttattatgcacgtattttacacgagcatacaccagatatttcagaaccttttgtgattacttatcttgctgatatcagttacggtatgtacctttttcattggccattttatattatttttagtcgtttatccccaaactggatagctgttattttgacagtagtattatcagcagtcttctcaacattatcattttatatcattgaaccttttattttaggtagaaaacctaaattccttgattatgaatttgacttgttgccttacaaaaagtggttatttagtatcggaggggtactaactcttattactgtagtgacaatgttgacagctccaagtataggtagttttgagacagaattattgcagaattcgttacaacaagytagaacaaatactaaccgaacacatacactagccgcaggggatgcaggtgctcttagtgatgtgacagtaatcggagattcagttgccttaaggtcaagtgctgcttttaataaattgttaccagaagtacaattagatgctgcggtgagtcgtaattttagtaaatcatttgatatttttgaaaaccgtattcaaaataaagccttgtccaaaattgttgttttggcagttggtgtgaattcattagataactacaagacagacttgagccaatttattaaatctttgcctaagggacaccgtttgattatagtaacaccttataatgctaaaaatatgagtcaagttacgacagtgcgtgattatgaactctcgctaatgaaaaaaaaaaat

SEQ ID NO: 7166 - protein, 270 aa, Streptococcus agalactiae
  MISC_FEATURE (1)..(270): Xaa = Any Amino Acid
MSSIFASVMIYYARILHEHTPDISEPFVITYLADISYGMYLFHWPFYIIFSRLSPNWIAVILTVVLSAVFSTLSFYIIEPFILGRKPKFLDYEFDLLPYKKWLFSIGGVLTLITVVTMLTAPSIGSFETELLQNSLQQXRTNTNRTHTLAAGDAGALSDVTVIGDSVALRSSAAFNKLLPEVQLDAAVSRNFSKSFDIFENRIQNKALSKIVVLAVGVNSLDNYKTDLSQFIKSLPKGHRLIIVTPYNAKNMSQVTTVRDYELSLMKKKN

SEQ ID NO: 7167 - DNA, 297 bp, Streptococcus agalactiae
  misc_feature (1)..(297): n = a, c, g, or t
ttgcaatcaattgatttgttggttaataatgcaggtttagcacttggattggataaatcatatgaagctgattttggagattggatgactatgattaatactaacgttgtaggattaatttacttgacacgatgcattttacctaaaatggtagaagttaatagagggttaattatcaatttgggatcamctgcaggaacaattccttatccaggagctaatgtctatggcgcatcaaaagcttttgtaaaacaattttctctcaacttgcgtgccgatttagctggaactnnnnnt

SEQ ID NO: 7168 - protein, 99 aa, Streptococcus agalactiae
  MISC_FEATURE (1)..(99): Xaa = Any Amino Acid
MQSIDLLVNNAGLALGLDKSYEADFGDWMTMINTNVVGLIYLTRCILPKMVEVNRGLIINLGSXAGTIPYPGANVYGASKAFVKQFSLNLRADLAGTXX

SEQ ID NO: 7169 - DNA, 633 bp, Streptococcus pyogenes
ttgaaggtgaggaaatgtatgggaaatattgccttagtaacaggggcttcagccggttttggcagagccattgtcgaacacttaattgcagatgggataaaggttattggtgcttctcgtcgtcttgagaaactcaaggccttagaaacgagctttgggtcggacaacttttaccctttgcagatggatgtcacagataccaaagcgattgatgatgctttgacaagtctaccaaatcagtggcaagatattactattttagtgaataatgcaggcttggcattaggacttgataaggcttatgaagccgattttgagaattggatgacgatgattaataccaatattgttgggttgatttatctcacacgtcaattattaccacatatggtctccaaagatgatggtattattattaatttagggtcaaccgcagggacaattccctatccgggagctaatatttatggggctagcaaggcttttgttaagcagttctcactcaatttacgagctgatttagcaggtagccatatacgtgtgaccaatattgaacccggtctatgtgaagggacagaattttcaaagggacagaattttcaaaggtccgctttaatggtgatgaggaacggg

SEQ ID NO: 7170 - protein, 211 aa, Streptococcus pyogenes
LKVRKCMGNIALVTGASAGFGRAIVEHLIADGIKVIGASRRLEKLKALETSFGSDNFYPLQMDVTDTKAIDDALTSLPNQWQDITILVNNAGLALGLDKAYEADFENWMTMINTNIVGLIYLTRQLLPHMVSKDDGIIINLGSTAGTIPYPGANIYGASKAFVKQFSLNLRADLAGSHIRVTNIEPGLCEGTEFSKGQNFQRSALMVMRNG

SEQ ID NO: 7171 - DNA, 360 bp, Streptococcus agalactiae
  misc_feature (1)..(360): n = a, c, g, or t
atgaataaatttaaggtaaacatttcaggaatgacttgtacgggttgtgaaaaacacgtagaatcagcacttgaaaagataggtgctaaaaatattgagtctagttatcgtcgtggtgaagcagtatttgaactgcccgatgatattgaggttgaaagtgcaataaaggcgattgatgaagcaaattaccaagccggagaaattgaagaagtatcatcactagaaaacgtggcgttaattaatgaagacaattatgaccttcttattattggttctggtgctgctgccttttcttcggcaattaaagctatagctgcatctttgaccaatttcaatttacgagcaatggcnnnnnttaat

SEQ ID NO: 7172 - protein, 120 aa, Streptococcus agalactiae
  MISC_FEATURE (1)..(120): Xaa = Any Amino Acid
MNKFKVNISGMTCTGCEKHVESALEKIGAKNIESSYRRGEAVFELPDDIEVESAIKAIDEANYQAGEIEEVSSLENVALINEDNYDLLIIGSGAAAFSSAIKAIAASLTNFNLRAMAXXN

SEQ ID NO: 7173 - DNA, 297 bp, Streptococcus agalactiae
ttggtaaatcaggccaatggtaaaaagcaagaaattgctaagttagaaaatttatctaacgatgaaatgttgagatataatactgcaattgataatgtagtgaaacagtataatgaaggtaagctcaatattactgctgcaatgaatgctttaaatagtattaagcaagcagcacaggaagttgcccagaaaaacttacaaaataaggattattgtcaaacaaagctaccagagcttgatcaacatcgttttccagtaaatcagagaaatcaaaagaaatatctagcaggcttccct

SEQ ID NO: 7174 - protein, 99 aa, Streptococcus agalactiae
MVNQANGKKQEIAKLENLSNDEMLRYNTAIDNVVKQYNEGKLNITAAMNALNSIKQAAQEVAQKNLQNKDYCQTKLPELDQHRFPVNQRNQKKYLAGFP

SEQ ID NO: 7175 - DNA, 528 bp, Streptococcus agalactiae
ttgaaatctacaatccctgccaatttaggtgactatgaaaaatttgaaattactgataaatttgcagatggcttgacttataaatctgttggaaaaatcaagattggttcgaaaacactgaatagagatgagcactacactattgatgaaccaacagttgataaccaaaatacattaaaaattacgtttaaaccagagaaatttaaagaaattgctgagctacttaaaggaatgacccttgttaaaaatcaagatgctcttgataaagctactgcaaatacagatgatgcggcatttttggaaattccagttgcatcaactattaatgaaaaagcagttttaggaaaagcaattgaaaatacttttgaacttcaatatgaccatactcctgataaagctgacaatccaaaaccatctaatcctccaagaaaaccagaagttcatactggtgggaaacgatttgtaaagaaagactcaacagaaacacaaacactagggtggtggctgagtttggatttgttggctttc

SEQ ID NO: 7176 - protein, 176 aa, Streptococcus agalactiae
MKSTIPANLGDYEKFEITDKFADGLTYKSVGKIKIGSKTLNRDEHYTIDEPTVDNQNTLKITFKPEKFKEIAELLKGMTLVKNQDALDKATANTDDAAFLEIPVASTINEKAVLGKAIENTFELQYDHTPDKADNPKPSNPPRKPEVHTGGKRFVKKDSTETQTLGWWLSLDLLAF

SEQ ID NO: 7177 - DNA, 468 bp, Streptococcus agalactiae
gtggctaaaagttatgcgctggtaaagcactatatggctttaaacgaagaggctcctgatcttattgatgtttcaagaattcgctgtgcagctcttattgatttttcagaatccttaaccaataagagcatctctgacaagcagcaaatgtacaatagtattctccattatgtggacaaccacctctactccaaactcaaagtatctgatattgccaactacctatatatctcagattcccacttacgctcagtttttaaaaaatactctgacatttccttgcaaagttatattctaaaggcaaaaattaaggagggacaattactactgcaaagaggggtaccgattggggaagtagcgaaattattacatttttacgacaccacacattttcttaaaacctttaaaaaatacgtgggaatatcttcaaacgaatatcttactaaatatcgtgagacctcatgccag

SEQ ID NO: 7178 - protein, 156 aa, Streptococcus agalactiae
MAKSYALVKHYMALNEEAPDLIDVSRIRCAALIDFSESLTNKSISDKQQMYNSILHYVDNHLYSKLKVSDIANYLYISDSHLRSVFKKYSDISLQSYILKAKIKEGQLLLQRGVPIGEVAKLLHFYDTTHFLKTFKKYVGISSNEYLTKYRETSCQ

SEQ ID NO: 7179 - DNA, 744 bp, Streptococcus agalactiae
  misc_feature (1)..(744): n = a, c, g, or t
atgccttttaaatattaccggtatttcgatcctgtcaaacataatttaatttttgaacgttttttaaatgaagagcgttattcgatgccagatattgatattgatcttccggatatttatcgtggagaattcttgcgctatgtacgtaatcgatatggttcaatgcattctgcacagattgtaaccttctcaacttttggtgcgaaacaggctattcgagatgtttttaaacgctttggtgcatcagagtatgagttaacaaacataactaaaaaaattcatttcagagataatttgaccagtgtttataaccgcaacttagctttcagacaaataatagatagtaaaattgaataccaaaaagcctatgatattgctaagcgtattgaaggaaatcctagacagacttctattcatgccgctggggtagtaatgagtgacgatttgttaacagatcatattcctttaaaaaacggtgaggatatgatgataacgcaatatgatgctagttctgttgaggataatggtcttctaaaaatggactttctaggtcttcgaaatttgacatttgttcagaaaatgaaggagaaagtcgataaggactacggtatctctatacaattagaaactattgatttagaagataaagagactctaaaactatttgcagctggtcaaacaaaggggatttttcaatttgagcaaagtggagctattaatttgttgcgacgtattaggnnnnnt

SEQ ID NO: 7180 - protein, 248 aa, Streptococcus agalactiae
  MISC_FEATURE (1)..(248): Xaa = Any Amino Acid
MPFKYYRYFDPVKHNLIFERFLNEERYSMPDIDIDLPDIYRGEFLRYVRNRYGSMHSAQIVTFSTFGAKQAIRDVFKRFGASEYELTNITKKIHFRDNLTSVYNRNLAFRQIIDSKIEYQKAYDIAKRIEGNPRQTSIHAAGVVMSDDLLTDHIPLKNGEDMMITQYDASSVEDNGLLKMDFLGLRNLTFVQKMKEKVDKDYGISIQLETIDLEDKETLKLFAAGQTKGIFQFEQSGAINLLRRIRXX

SEQ ID NO: 7181 - DNA, 765 bp, Streptococcus agalactiae
  misc_feature (1)..(765): n = a, c, g, or t
ttggacacttatcctctggggtcattggtttcctataagggacaggactttgaggtcatgtcggtcagcgatgctcgattgaacggtttgattcggattgagttagtcaatgacttttcggatatcattgaacaaaatccagttctttatgtgaggacctgggaagaagtcagtcaggcacttcatcagccaaaggcagaaccacaaacagagttagaagaagcggaccaagaattaaacctattctcatttctggaagaggagccagttcagagtattggactattggaaccagatgattcagaaaatggtcataacgatactgatcttgaagaaacagataatcaaattcctgaagaggaagtcgtcgaaacaattccagagattccagtaacggacttttattttccagaagatttgacggacttttatcctaagactgctagagataaggttgagacaaacattgtggccattcgtttggtaaaaaatctagaagtagagcaccgcaatgcttcaccaagtgaacaagaactccttgccaagtatgtaggctggggtggactagccaatgaattttttgatgactataatccaaaattttctaaggaacgagaagaactgaagagcctagtcacagataaagagtattcggatatgaaacagtcctccctgacagcctattacacagacccatccctgatccgtcagatgtgggggatagtggaaagagatggctttacagggtggcaaatcctannnnnt

SEQ ID NO: 7182 - protein, 255 aa, Streptococcus agalactiae
  MISC_FEATURE (1)..(255): Xaa = Any Amino Acid
MDTYPLGSLVSYKGQDFEVMSVSDARLNGLIRIELVNDFSDIIEQNPVLYVRTWEEVSQALHQPKAEPQTELEEADQELNLFSFLEEEPVQSIGLLEPDDSENGHNDTDLEETDNQIPEEEVVETIPEIPVTDFYFPEDLTDFYPKTARDKVETNIVAIRLVKNLEVEHRNASPSEQELLAKYVGWGGLANEFFDDYNPKFSKEREELKSLVTDKEYSDMKQSSLTAYYTDPSLIRQMWGIVERDGFTGWQILXX

SEQ ID NO: 7183 - DNA, 111 bp, Streptococcus agalactiae
  misc_feature (1)..(111): n = a, c, g, or t
gtgttagcctatgaggttgtttatgtcttttttagtgatcaagatgacacatggtatcatcataaaaataagatgctagttgatattatggaagcacgccannnnnttaat

SEQ ID NO: 7184 - protein, 37 aa, Streptococcus agalactiae
  MISC_FEATURE (1)..(37): Xaa = Any Amino Acid
MLAYEVVYVFFSDQDDTWYHHKNKMLVDIMEARXXXN

SEQ ID NO: 7185 - DNA, 174 bp, Streptococcus agalactiae
atggtgaagtttaaaaaacctgaaacaatcaactaccgcacattgaaaccagaacgtgaaggactttttgatgaagttatttttggtccaacaaaagattgggaatgtgcgtgtggaaaatacaaacgtattcgttacaaaggaatcatttgtgaccgttgtggcgttgaaagg

SEQ ID NO: 7186 - protein, 58 aa, Streptococcus agalactiae
MVKFKKPETINYRTLKPEREGLFDEVIFGPTKDWECACGKYKRIRYKGIICDRCGVER

SEQ ID NO: 7187 - DNA, 663 bp, Streptococcus agalactiae
atgacttatctcccccaacatattccgtgcacttattatcctgttggttcgggaaatgattttgccagagctttgaaaattcctaacctcaaagaaacccttaccgctattcagacagaaagattaaaggaaattaattgctttatttatgataaagggctgattttgaatagtttagatttaggttttgcagcctatgtcgtttggaaagcatctaactctaaaataaaaaatattttgaatagatatcgtctaggaaaaataacttacattgttatagctatcaaatcattattacattcttctaaagtacaagtattagtggaaggagagacaggacagcagataaaactaaatgacctttattttttcgcattagcaaataacacttattttggaggtggcattactatttggcctaaagcaagtgctttaactgcagagttagatatggtttacgctaaagggcatacttttctaaaacgattaagtattttattatctttggtttttaaaaggcatactacctctaaaagtataaaacaccagactttcaaagctatgaccgtatattttcctaaaaatagtttgattgaaatagatggcgaaatagttgagttagatcagattagtttaaaatgtcaaaaaaggtatttatatatg

SEQ ID NO: 7188 - protein, 221 aa, Streptococcus agalactiae
MTYLPQHIPCTYYPVGSGNDFARALKIPNLKETLTAIQTERLKEINCFIYDKGLILNSLDLGFAAYVVWKASNSKIKNILNRYRLGKITYIVIAIKSLLHSSKVQVLVEGETGQQIKLNDLYFFALANNTYFGGGITIWPKASALTAELDMVYAKGHTFLKRLSILLSLVFKRHTTSKSIKHQTFKAMTVYFPKNSLIEIDGEIVELDQISLKCQKRYLYM

SEQ ID NO: 7189 - DNA, 690 bp, Streptococcus agalactiae
gtgtcccagaccgagcgtgcggttttgctgcagttcggcaaggtggttcagactgacgtcaagccgggtctgcacgtgaaggtcccttacgtgaaccaggtgcgcaagttcgacggacgtctgctgacgctcgatgcgcctacccagcgttttctgacgctggaaaagaaagccgtcatggttgatgcctatgccaaatggcgcgtgaaggatgcggagcgtttctatactgcgacttccggcctcaagcagattgccgacgagcgcctgtcgcgtcgtctggaatccggcctgcgagaccagttcggcaagcgcaccctgcatgaagtcgtgtcgggtgagcgggatgcactgatggctgacatcacgggttcgctgaaccgcatggctgagaaagagctgggtatcgaagtactcgatgtccgggtcaaggccatcgacctgcccaaggaagtgaatcgcagcgttttcgagcggatgagtaccgagcgtgaacgtgaagcgcgcgagcaccgtgccaagggtaacgagctgggtgaaggcatccgtgccgacgccgatcgtcaacgccgtgtattgctggcagaagcctatcgcgagtctgaaaggcgcgtggtgatggtgatgcccaggctgcggcgatctattccaggcctacggtcaggatcaggagttctacgcgttttatcg

SEQ ID NO: 7190 - protein, 230 aa, Streptococcus agalactiae
MSQTERAVLLQFGKVVQTDVKPGLHVKVPYVNQVRKFDGRLLTLDAPTQRFLTLEKKAVMVDAYAKWRVKDAERFYTATSGLKQIADERLSRRLESGLRDQFGKRTLHEVVSGERDALMADITGSLNRMAEKELGIEVLDVRVKAIDLPKEVNRSVFERMSTEREREAREHRAKGNELGEGIRADADRQRRVLLAEAYRESERRVVMVMPRLRRSIPGLRSGSGVLRVLS

SEQ ID NO: 7191 - DNA, 141 bp, Streptococcus agalactiae
gtgacagtaactaaccagaaagggacggctaagtacgtgcccgcatccgcggtaatatgtaggtcccgagcgttgtccggatttattgtgcgtaaagcgagcgcaggcggttctttaagtctgaagttaaaggcagtggct

SEQ ID NO: 7192 - protein, 47 aa, Streptococcus agalactiae
MTVTNQKGTAKYVPASAVICRSRALSGFIVRKASAGGSLSLKLKAVA

SEQ ID NO: 7193 - DNA, 702 bp, Streptococcus agalactiae
gtgacttttgggcagacaaaaagtaatcaagttattggttatttgcctgacgttccgaagttttatgactatatgacggcacaagaatacttacaactttgcgctggcttagctcaaaacaaaaccagtttaccaattgctgatctgctagaacaggtcggcttagccgataatcagcaacgcattagcacctattctcgaggtatgaaacaacgcttaggtctagcccaagcactgattcacaaksskaaaattctgatttgtgatgaaccaacatcagccttagaccctcaaggacgacaagaaatcctctccattatttctcaactacgtggtcaaaagacagtcattttctcgacacacatcttatcagatgtggaaaaagtctgtgatcaagttctaattctaacaaaatcaggtatccataatctagaagatctaagagacaaagcgtcagccagtgtgaatcaactgaaccttttaataaaagtctcagacaatgaagcacaaaaattagctctgcgatttcctttaaatcaaaaagatcaatattataaggtacatttggaattgagtgaggcaaacaatcgtgaacaagcattagcaagtttttacaggtatttagttgagcaagaaatcacgccatacttcattgaattactggaagatagcctggaagacttctatttggaggtgattaaa

SEQ ID NO: 7194 - protein, 234 aa, Streptococcus agalactiae
  MISC_FEATURE (1)..(234): Xaa = Any Amino Acid
MTFGQTKSNQVIGYLPDVPKFYDYMTAQEYLQLCAGLAQNKTSLPIADLLEQVGLADNQQRISTYSRGMKQRLGLAQALIHXXKILICDEPTSALDPQGRQEILSIISQLRGQKTVIFSTHILSDVEKVCDQVLILTKSGIHNLEDLRDKASASVNQLNLLIKVSDNEAQKLALRFPLNQKDQYYKVHLELSEANNREQALASFYRYLVEQEITPYFIELLEDSLEDFYLEVIK

SEQ ID NO: 7195 - DNA, 168 bp, Streptococcus agalactiae
  misc_feature (1)..(168): n = a, c, g, or t
gtggggggggggggggggggggggggggggggggggggggggggggggggggggggggcggggggggkgggggggggggggggggggggggggggggggccggggggggggggggggggggcggggggggggggggggggggggggggtgggggnnnnnttaattaat

SEQ ID NO: 7196 - protein, 56 aa, Streptococcus agalactiae
  MISC_FEATURE (1)..(56): Xaa = Any Amino Acid
MGGGGGGGGGGGGGGGGGGAGGXGGGGGGGGGGPGGGGGGAGGGGGGGGVGXXLIN

SEQ ID NO: 7197 - DNA, 111 bp, Streptococcus agalactiae
  misc_feature (1)..(111): n = a, c, g, or t
ttgtcacctctgacaaagttaccaattttcccggcaagacatgcgtctgactatctacaacggttgctacaaaacggaaaccttgttgtgcacttgctgccnnnnnttaat

SEQ ID NO: 7198 - protein, 37 aa, Streptococcus agalactiae
  MISC_FEATURE (1)..(37): Xaa = Any Amino Acid
MSPLTKLPIFPARHASDYLQRLLQNGNLVVHLLPXXN

SEQ ID NO: 7199 - DNA, 522 bp, Streptococcus agalactiae
  misc_feature (1)..(522): n = a, c, g, or t
ttggtaactttgtcagaggtgacaagtggtcagcctaaaattattgcaagtgtgaaaacgaatgatgccggacaagctatttttaataatctccctataaaacgtaaccttagtgtgtctgttgatggacaagtaaaaggatatactattcgaactgacgtagcaggttctagtaaagcagctagttttasagcaacaggagtagggacaaatgagccaacgtattcaaaaaaaaccatagacatcacagtgagagaccagaatgctgaacctgtttcaggcaggacagttaccttaaaaacacaagctggtcgtgagattgctagcttggtttctggtgacaatggattaactcgctttactgatcgtttactagatggaacattctaccaatattttgttgatgggaaaaaaattggtgatattgtacctggagaatcaagaagtgcatatgttaatgttgcacctaaaaaagattattttacctttacagtcactgctttagataaagatggannnnnt

SEQ ID NO: 7200 - protein, 174 aa, Streptococcus agalactiae
  MISC_FEATURE (1)..(174): Xaa = Any Amino Acid
MVTLSEVTSGQPKIIASVKTNDAGQAIFNNLPIKRNLSVSVDGQVKGYTIRTDVAGSSKAASFXATGVGTNEPTYSKKTIDITVRDQNAEPVSGRTVTLKTQAGREIASLVSGDNGLTRFTDRLLDGTFYQYFVDGKKIGDIVPGESRSAYVNVAPKKDYFTFTVTALDKDGXX

SEQ ID NO: 7201 - DNA, 726 bp, Streptococcus agalactiae
  misc_feature (1)..(726): n = a, c, g, or t
gtgacttacccagatggttcaraagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtatgtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacnnnnnttaat

SEQ ID NO: 7202 - protein, 242 aa, Streptococcus agalactiae
  MISC_FEATURE (1)..(242): Xaa = Any Amino Acid
MTYPDGSXDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVCETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTXXN

SEQ ID NO: 7203 - DNA, 591 bp, Streptococcus agalactiae
  misc_feature (1)..(591): n = a, c, g, or t
gtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcnnnnnttaattaat

SEQ ID NO: 7204 - protein, 197 aa, Streptococcus agalactiae
  MISC_FEATURE (1)..(197): Xaa = Any Amino Acid
MTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQXXLIN

SEQ ID NO: 7205 - DNA, 537 bp, Streptococcus agalactiae
  misc_feature (1)..(537): n = a, c, g, or t
gtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtaagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtaaatgtgactgttaaggttgtcgatnnnnnt

SEQ ID NO: 7206 - protein, 179 aa, Streptococcus agalactiae
  MISC_FEATURE (1)..(179): Xaa = Any Amino Acid
MTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGKTPKAEDSIGNLPDLPKGTTVAFETPVDTATPGDKPAKVVVTYPDGSKDTVNVTVKVVDXX

SEQ ID NO: 7207 - DNA, 90 bp, Streptococcus agalactiae
  misc_feature (1)..(90): n = a, c, g, or t
ttgtatcccagcaataaaagtatttttaccgaaatcaaagtaagaaccaaaaggagatgggggtactctgtcttagttttnnnnnttaat

SEQ ID NO: 7208 - protein, 30 aa, Streptococcus agalactiae
  MISC_FEATURE (1)..(30): Xaa = Any Amino Acid
MYPSNKSIFTEIKVRTKRRWGYSVLVXXXN

SEQ ID NO: 7209 - DNA, 498 bp, Streptococcus agalactiae
  misc_feature (1)..(498): n = a, c, g, or t
gtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttaccnnnnnttaattaat

SEQ ID NO: 7210 - protein, 166 aa, Streptococcus agalactiae
  MISC_FEATURE (1)..(166): Xaa = Any Amino Acid
MTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYXXLIN

SEQ ID NO: 7211 - DNA, 219 bp, Streptococcus agalactiae
ttggatatgagcacagcagtaaaaatgtttttgattcaatctgttaaaactcaaagtattccttttgaaataaaaaataaatcatctgtttctgatgaagaatttcaaaatttggtagaaacaaaattaaagggaatacgagttaaggctagtgatccagaaagtgtaaatgcgttttttggagatgaagatttttcagaatatgaggaatattttaaa

SEQ ID NO: 7212 - protein, 73 aa, Streptococcus agalactiae
MDMSTAVKMFLIQSVKTQSIPFEIKNKSSVSDEEFQNLVETKLKGIRVKASDPESVNAFFGDEDFSEYEEYFK

SEQ ID NO: 7213 - DNA, 222 bp, Streptococcus agalactiae
ttggtagcacgttttgattctatcttatctgacaacggtgcaactgttgttgaatcaaaagattgggaaaaacgtcgtcttgcatacgaaatccaagatttcactgaaggactttaccatatcgttaacgttgaagctgaagatgcagtagctcttaatgagtttgatcgtctttcaaaaatcaacggtgacattcttcgtcacatgatcgttaaagtagac

SEQ ID NO: 7214 - protein, 74 aa, Streptococcus agalactiae
MVARFDSILSDNGATVVESKDWEKRRLAYEIQDFTEGLYHIVNVEAEDAVALNEFDRLSKINGDILRHMIVKVD

SEQ ID NO: 7215 - DNA, 288 bp, Streptococcus pyogenes
atggctaaatacgaaattctttatatcattcgtccaaacattgaagaagaagctaaaaacgctttggtagcacgctttgactctatcttgactgacaacggtgcaactgttgttgaatcaaaagattgggaaaaacgtcgtcttgcatacgaaatcaacgatttccgtgaaggactttaccacatcgttaaccttgaagcgactgacgcagcagctcttaacgagtttgaccgtctttcaaaaatcaatggtgacattcttcgtcacatgatcgttaaacttgacgct

SEQ ID NO: 7216 - protein, 96 aa, Streptococcus pyogenes
MAKYEILYIIRPNIEEEAKNALVARFDSILTDNGATVVESKDWEKRRLAYEINDFREGLYHIVNLEATDAAALNEFDRLSKINGDILRHMIVKLDA

SEQ ID NO: 7217 - DNA, 342 bp, Streptococcus agalactiae
  misc_feature (1)..(342): n = a, c, g, or t
atgattaataatgtagtacttgtaggtcgcatgacccgtgatgcagaacttcgttatacaccaagtaatcaagcggtagccactttttcacttgcagttaatcgtaattttaaaaatcaatctggcgaacgtgaggctgattttattaactgtgttatttggcgccaacaagctgaaaacttggctaactgggcaaaaaaaggtgctttggttggaattacaggtcgtatccaaacgcgtaattatgaaaaccaacaaggtcaacgtgtctatgtaacagaagtttgttgcggaaagtttccaattattggaaagtcgtgctacacgannnnnttaattaat

SEQ ID NO: 7218 - protein, 114 aa, Streptococcus agalactiae
  MISC_FEATURE (1)..(114): Xaa = Any Amino Acid
MINNVVLVGRMTRDAELRYTPSNQAVATFSLAVNRNFKNQSGEREADFINCVIWRQQAENLANWAKKGALVGITGRIQTRNYENQQGQRVYVTEVCCGKFPIIGKSCYTXXLIN

SEQ ID NO: 7219 - DNA, 657 bp, Streptococcus agalactiae
  misc_feature (1)..(657): n = a, c, g, or t
gtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagaatctattggtaacttaccagatcttccgaaaggtacaacagtagcctttgaaactccagttgatacggnnnnnttaattaat

SEQ ID NO: 7220 - protein, 219 aa, Streptococcus agalactiae
  MISC_FEATURE (1)..(219): Xaa = Any Amino Acid
MTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEESIGNLPDLPKGTTVAFETPVDTXXLIN

SEQ ID NO: 7221 - DNA, 105 bp, Streptococcus pyogenes
gtggaaaataaattaacactgttaatttgggttctccacaacctgtggaaaagccattttaaggggacaccgctattgttttcaactatttttcatgtggaaaac

SEQ ID NO: 7222 - protein, 35 aa, Streptococcus pyogenes
VENKLTLLIWVLHNLWKSHFKGTPLLFSTIFHVEN

SEQ ID NO: 7223 - DNA, 117 bp, Streptococcus pyogenes
atgaataagaagaaaatttcagatttgcttatcattatgccactctttcaccttcatttaaattatcaaagtttggtgtattattctcattttgatatagtttgccgagaaactaag

SEQ ID NO: 7224 - protein, 39 aa, Streptococcus pyogenes
MNKKKISDLLIIMPLFHLHLNYQSLVYYSHFDIVCRETK

SEQ ID NO: 7225 - DNA, 123 bp, Streptococcus pyogenes
atgatgatggacaatattgtaaaaaaaatagaagcatttcttgctttttctgataaaaaattagcagagctgcaacaggaaaatcaaaaagttaaagaagaaagtcagtatattcaaaaaaac

SEQ ID NO: 7226 - protein, 41 aa, Streptococcus pyogenes
MMMDNIVKKIEAFLAFSDKKLAELQQENQKVKEESQYIQKN

SEQ ID NO: 7227 - DNA, 153 bp, Streptococcus pyogenes
ttgttatttagcagtaatataattgaaaaacagaaacattttgtaaaaaaagagttgacaatgacagtaaagatatcgtatactaataaagctgtcagagaggttcctgtaacacacttattgaaaaaagatgaaaaagtagttgacaggcta

SEQ ID NO: 7228 - protein, 51 aa, Streptococcus pyogenes
LLFSSNIIEKQKHFVKKELTMTVKISYTNKAVREVPVTHLLKKDEKVVDRL

SEQ ID NO: 7229 - DNA, 111 bp, Streptococcus pyogenes
ttggtagagcaattgacttttaatcaatgggtcactggttcgagcccagtacgggtcataaaagcgggtttggcggaattggcagacgcaccagatttaggatctggcgct

SEQ ID NO: 7230 - protein, 37 aa, Streptococcus pyogenes
LVEQLTFNQWVTGSSPVRVIKAGLAELADAPDLGSGA

SEQ ID NO: 7231 - DNA, 1641 bp, Streptococcus pyogenes
atggcaaatattcaaataaatagaataaaaagtaaattgacagaactgtttagtagtattatctatatgggtaatatcaaagttgatgaggactctgaagagtataaaaaaatgtggtatagtagggcttactcagcttattcaacttttctacttggagcagaaaatgtagatgaagcaactaagtcagttacggatggatttgctgataatggcatagatgccatctataacgataaaaataaaaaaattttatattttattcaaactaaatttagcaatgaagcaaacggaagcatttctgaaggtgatacattaaaatttattaaaggggttaaaaaaatcaccacttcagatttttcaaattttaatgatctcatagtagcaaagcaaaaagaaatagaaaaagctttatcagattttaattatcgaatagaaattatagtttgtacttcctctaatcaaaatatatcttcaaatagtcaagaagtaatagatgattttttgcagggtgtaaattctgatggtagtgatgatgtagtaacatacagacatataaaacttaatgatgtttatgatcatatggctaatcaaggagtggctcctaaaatagatttcgaggacgttgtcgttcataattggggcagacctacattatacaatgacagttataaagtctattatggatggttatctgctactgatatagttaactggaaagagcaatatggagatcgaatatttgaaaagaatattcggaactttaagcaaaatacggatgttaataacggaataaaaataatttctgaaaaagttgaaaaaaatctaaaaggtgtttcaacaacggattatatcaatttaaaattgattggagcaagtataattaatggagcgcaaacaacgggttctttatttgaagcataccattctgaagatattgatttgacaaatgtttcagtccaagttcaaataatagtattaggagaagatattgataatatcggacctaaaataactaagttatcgaatactcaaaatagaatagaaaataaagattttgctgctcaggataaagaacaagaaagattgatgaaagatcttgcaattgatggtaaacagtatgtgtatcgtcaaggtgtcgagctacctaattctgatgaaggttgtgatctggatagtgcaacagtggctctaggttgctatttagatgatgttgcaatttctacacagatgaagagagcatatggtagcatttttgacaatactaataaacctccatataagctaatctttaattccggaacttctgcatataaattatggaattgcgttgaagtgtatcgcgaattacaaaacatagaaggggagtatcaacaagatccaaataatcaatctaaaaagttgatgtctattcatggaaatagatttattcttcatttgattttccaaaagttaaaaaataacccaagtttagatttcgagaatggatatattacaacttttccaaatttaactgaagagtattgtttaataatggaagaattgataagagcgaaggaagagttatacccagaagcttatccagctaatatatttaaaaatggtaaacgtactaaagaattaaaagaaaaaatgtctttt

SEQ ID NO: 7232 - protein, 547 aa, Streptococcus pyogenes
MANIQINRIKSKLTELFSSIIYMGNIKVDEDSEEYKKMWYSRAYSAYSTFLLGAENVDEATKSVTDGFADNGIDAIYNDKNKKILYFIQTKFSNEANGSISEGDTLKFIKGVKKITTSDFSNFNDLIVAKQKEIEKALSDFNYRIEIIVCTSSNQNISSNSQEVIDDFLQGVNSDGSDDVVTYRHIKLNDVYDHMANQGVAPKIDFEDVVVHNWGRPTLYNDSYKVYYGWLSATDIVNWKEQYGDRIFEKNIRNFKQNTDVNNGIKIISEKVEKNLKGVSTTDYINLKLIGASIINGAQTTGSLFEAYHSEDIDLTNVSVQVQIIVLGEDIDNIGPKITKLSNTQNRIENKDFAAQDKEQERLMKDLAIDGKQYVYRQGVELPNSDEGCDLDSATVALGCYLDDVAISTQMKRAYGSIFDNTNKPPYKLIFNSGTSAYKLWNCVEVYRELQNIEGEYQQDPNNQSKKLMSIHGNRFILHLIFQKLKNNPSLDFENGYITTFPNLTEEYCLIMEELIRAKEELYPEAYPANIFKNGKRTKELKEKMSF

SEQ ID NO: 7233 - DNA, 435 bp, Streptococcus pyogenes
atgaaaaaagtatgttttgtctgtctgggtaatatttgtcgaagccccatggctgagtttgtaatgaagtcaatagtatcaagtgatgttatgatgatagaaagtcgtgctacttctgattgggagcatggaaaccctattcactcaggtacacagtccatattaaaaacttaccaaattaattatgatataactaaatgctccaagcagataactataactgattttaacacctttgactatattattggtatggatagcgataatgtgaaaaatctcaaagagatgtcgcaacatcaatgggactctaaaatctacctgtttagagaagggggtgttcctgatccttggtacactaacgattttgaagaaacctaccaattagttagaaaaggatgccaggattggctttctcgtttaatgagtaaagagtat

SEQ ID NO: 7234 - protein, 145 aa, Streptococcus pyogenes
MKKVCFVCLGNICRSPMAEFVMKSIVSSDVMMIESRATSDWEHGNPIHSGTQSILKTYQINYDITKCSKQITITDFNTFDYIIGMDSDNVKNLKEMSQHQWDSKIYLFREGGVPDPWYTNDFEETYQLVRKGCQDWLSRLMSKEY

SEQ ID NO: 7235 - DNA, 105 bp, Streptococcus pyogenes
atgatatatttagaaaataaaatgatttcttatgactttaatcataagaaatcatttcctggtatcaacattaaaaatcacttacgtcgtcctggacgttcagca

SEQ ID NO: 7236 - protein, 35 aa, Streptococcus pyogenes
MIYLENKMISYDFNHKKSFPGINIKNHLRRPGRSA

SEQ ID NO: 7237 - DNA, 390 bp, Streptococcus pyogenes
gtgttcaagttccatcaaacactaactgtacttgcaaaatctcaccgattaaagtttgatttctacgttgacaccacttggaagatcaagtttcatcaaagcatcaacagttttttgtgttggattgatgatgtctaccaaacgtttgtgtgtacgcatttcaaattgttcgcgagaatctttgtatttgtgagtcgcacgaataattgtgtaaagactgcgttcagttggaagtggaactggtccagcaactgtagcacctgtacgtgttgcagtttcaacgattttttctgccgctgtatcaagtgtacggtgttcgtacgctttcaaacggatacggatttttttgtttgccatcttttctcctctcgtctatttacgataataggc

SEQ ID NO: 7238 - protein, 130 aa, Streptococcus pyogenes
VFKFHQTLTVLAKSHRLKFDFYVDTTWKIKFHQSINSFLCWIDDVYQTFVCTHFKLFARIFVFVSRTNNCVKTAFSWKWNWSSNCSTCTCCSFNDFFCRCIKCTVFVRFQTDTDFFVCHLFSSRLFTIIG

SEQ ID NO: 7239 - DNA, 321 bp, Streptococcus pyogenes
ttgttgattggtgaagctgaacctttcgcacgtggacggaaacgtttcattgttggtccttcgttagcgaatgtttcagatactaccaagtttgctttttccaaaccaaagttgttttctgcgttagcaattgctgagttaagagttttctcaataacacgagctgctttgtttggagtgaattttaagattgcgattgcgtcagcaactttcttaccacggataagatcaagtactaaacgtgttttacgaggtgaaacacgcactgtacgagccattgctttagctgaagtaatttctgccattgtgtcctcctcctat

SEQ ID NO: 7240 - protein, 107 aa, Streptococcus pyogenes
LLIGEAEPFARGRKRFIVGPSLANVSDTTKFAFSKPKLFSALAIAELRVFSITRAALFGVNFKIAIASATFLPRIRSSTKRVLRGETRTVRAIALAEVISAIVSSSY

SEQ ID NO: 7241 - DNA, 450 bp, Streptococcus pyogenes
gtgagggattgttgtaccaaccattggtacttcgatcatgtttttcttagcagcttcaactgctttacggatagcttctggaacttcttgagctttaccagtaccaaatccaacacgaccatttccatcaccaacaactacaagagctgcaaagcgaagacgacgtccacctttaacaacttttgtaacgcggttaatcgcaacaacgcgttcttcaagttcaactgcattatctttaaatgccattattttgtgtcctccctattagaatttcaatccgttttcacgagctgcatcagccaaggctttaacacgtccgtgatagagatatccaccgcggtcaaacaccacttcagaaatacctttagccactgcacgttcagcaacaagtttgccgactacaacggcttgttctgtttttgttcctttagaaacgtctttatcaagagt

SEQ ID NO: 7242 - protein, 150 aa, Streptococcus pyogenes
VRDCCTNHWYFDHVFLSSFNCFTDSFWNFLSFTSTKSNTTISITNNYKSCKAKTTSTFNNFCNAVNRNNAFFKFNCIIFKCHYFVSSLLEFQSVFTSCISQGFNTSVIEISTAVKHHFRNTFSHCTFSNKFADYNGLFCFCSFRNVFIKS

SEQ ID NO: 7243 - DNA, 114 bp, Streptococcus pyogenes
atgaaggtaagaccatcggttaaaccaatttgcgaatactgtaaagttattcgccgtaatggtcgtgttatggtaatttgtccgacaaatccaaaacacaaacaacgtcaagga

SEQ ID NO: 7244 - protein, 38 aa, Streptococcus pyogenes
MKVRPSVKPICEYCKVIRRNGRVMVICPTNPKHKQRQG

SEQ ID NO: 7245 - DNA, 363 bp, Streptococcus pyogenes
atggctcgtattgctggagttgatattccaaatgataaacgcgtagtaatttcacttacttatgtttacggaattggtcttgcaacatctaaaaaaatcttagcagctgcaggtatttctgaagatatccgtgttaaagatttaacatcagatcaagaagatgctatccgtcgtgaagtggatgcaatcaaagttgaaggtgaccttcgacgtgaagtaaacatgaacattaaacgtttgatggaaatcggttcataccgtggaatccgtcatcgtcgtggacttcctgtccgtggacaaaatactaaaaacaatgctcgcactcgtaaagggaaagctgttgcgattgcaggtaagaaaaaa

SEQ ID NO: 7246 - protein, 121 aa, Streptococcus pyogenes
MARIAGVDIPNDKRVVISLTYVYGIGLATSKKILAAAGISEDIRVKDLTSDQEDAIRREVDAIKVEGDLRREVNMNIKRLMEIGSYRGIRHRRGLPVRGQNTKNNARTRKGKAVAIAGKKK

SEQ ID NO: 7247 - DNA, 102 bp, Streptococcus pyogenes
gtgtctcgccgtactcaggatactgctagggctcaaaagaattttaaatacgaggcttttactctctttggcttaccttcccaggtaattcttctatccttt

SEQ ID NO: 7248 - protein, 34 aa, Streptococcus pyogenes
VSRRTQDTARAQKNFKYEAFTLFGLPSQVILLSF

SEQ ID NO: 7249 - DNA, 378 bp, Streptococcus pyogenes
ttgactgcgagagctacaactcgagcagggacgaaagtcgggcttagtgatcccggtggtaccgaatggaagggccatcgctcaacggataaaagctaccctggggataacaggcttatctcccccaagagttcacatcgacggggaggtttggcacctcgatgtcggctcgtcgcatcctggggctgtagtcggtcccaagggttgggctgttcgcccattaaagcggcacgcgagctgggttcagaacgtcgtgagacagttcggtccctatccgtcgcgggcgtaggaaatttgagaggatctgctcctagtacgagaggaccagagtggacttaccgctggtgtaccagttgtcttgccaaaggcatcgctggg

SEQ ID NO: 7250 - protein, 126 aa, Streptococcus pyogenes
LTARATTRAGTKVGLSDPGGTEWKGHRSTDKSYPGDNRLISPKSSHRRGGLAPRCRLVASWGCSRSQGLGCSPIKAARELGSERRETVRSLSVAGVGNLRGSAPSTRGPEWTYRWCTSCLAKGIAG

SEQ ID NO: 7251 - DNA, 183 bp, Streptococcus pyogenes
ttgagttttgagatatttacactgataatcgggtggaaactggtcgggtatcgggtaatggagtgtggttcttcgtttaagcaaggagattatcgtttggtggttcatatttgcttgttaaatgttagggatgagatgctgagtcagcaaggccatgaagataaagctgactggctagagcct

SEQ ID NO: 7252 - protein, 61 aa, Streptococcus pyogenes
LSFEIFTLIIGWKLVGYRVMECGSSFKQGDYRLVVHICLLNVRDEMLSQQGHEDKADWLEP

SEQ ID NO: 7253 - DNA, 93 bp, Streptococcus pyogenes
ttggtggaagtcctttttggtgagatggcacagcatatagtaatattagatcctgaggaagaattgggactttcattaggcttgactggggta

SEQ ID NO: 7254 - protein, 31 aa, Streptococcus pyogenes
LVEVLFGEMAQHIVILDPEEELGLSLGLTGV

SEQ ID NO: 7255 - DNA, 150 bp, Streptococcus pyogenes
atgattttacaattaatatctagaaaaaatgttcaagtcgagataccaaaatctggtttaaccaaaaccacccaagacgataacagccccaaaatgcgacaaaccacttcacctttaccagtgacttgggcacaacctgaaagcaagcaa

SEQ ID NO: 7256 - protein, 50 aa, Streptococcus pyogenes
MILQLISRKNVQVEIPKSGLTKTTQDDNSPKMRQTTSPLPVTWAQPESKQ

SEQ ID NO: 7257 - DNA, 324 bp, Streptococcus pyogenes
atgattaatcaatggaacaacttacgacacaagaagctaaaaggatttactcttctagaaatgttattggtgattcttgtcatcagtgttttgatgctattatttgtgcctaatttaagcaagcaaaaagacagggttacagaaacaggtaatgccgctgttgttaaattagtggagaatcaagcagaactatatgaattatctcaaggctcaaaaccaagtttgagccagttaaaggcagatggtagtatcactgagaaacaagaaaaagcttatcaagactattatgacaaacataaaaatgaaaaagcccgtcttagcaat

SEQ ID NO: 7258 - protein, 108 aa, Streptococcus pyogenes
MINQWNNLRHKKLKGFTLLEMLLVILVISVLMLLFVPNLSKQKDRVTETGNAAVVKLVENQAELYELSQGSKPSLSQLKADGSITEKQEKAYQDYYDKHKNEKARLSN

SEQ ID NO: 7259 - DNA, 426 bp, Streptococcus pyogenes
atgaaaaagcccgtcttagcaattaaagcttttactttgcttgaaactttactaagtttgtcagtgatgagtttcattatattgggattgtctgtaccagtgacaaaaagctatcaaaaagtagaagagcatctgttttttagccattttgaacatttgtatcgacatcagcaaaagttagccatattacagcaaaaacagcgcgtcttggatatttcttcaacaaaaattgttacagaaggtaatagcctaacagttcctaaatcaataacagtgaatcatccttatcggttagttattgatcagatgggaggcaaccattccttagctaaaattatttttgacatgactgatcgacgctttaaataccaattttatctagggagtgggaattatcaaaaaacaagtcaaagcttacatagccct

SEQ ID NO: 7260 - protein, 142 aa, Streptococcus pyogenes
MKKPVLAIKAFTLLETLLSLSVMSFIILGLSVPVTKSYQKVEEHLFFSHFEHLYRHQQKLAILQQKQRVLDISSTKIVTEGNSLTVPKSITVNHPYRLVIDQMGGNHSLAKIIFDMTDRRFKYQFYLGSGNYQKTSQSLHSP

SEQ ID NO: 7261 - DNA, 234 bp, Streptococcus pyogenes
atgatcgcaacaggcatcctctttagtattgtcattctcgtcttaagcagtttacagcagagtcaggctgctctaacgtactatcgaaagcagcaagaaaagcttaatctagccttgatggcagtacaaactagaactaaagagatgacattgaatggttgtcatattactattttacgtacggatagatacattagtattcacgatgacgaaggagaagtgatgaagattgag

SEQ ID NO: 7262 - protein, 78 aa, Streptococcus pyogenes
MIATGILFSIVILVLSSLQQSQAALTYYRKQQEKLNLALMAVQTRTKEMTLNGCHITILRTDRYISIHDDEGEVMKIE

SEQ ID NO: 7263 - DNA, 324 bp, Streptococcus pyogenes
atgcctttcaagactaatctcaaagcaggcatccttttgtatgctatgtttatggctagtatttttttgctggttttacaggtttacctttctcaagtgacagctctacacaaggaataccaagctcaaactgactatgttaaagcccgactgatagcagaaatagtttatcaagatcatagatataaagcttctaatcctgtcttttttaaaggtggtcaagtcatttgtcgagagcgaaaagagagatggatgttaattgttaagttagatcagcaacgacagtatcagtttgaataccttaaacccaaacaatatagtcaa

SEQ ID NO: 7264 - protein, 108 aa, Streptococcus pyogenes
MPFKTNLKAGILLYAMFMASIFLLVLQVYLSQVTALHKEYQAQTDYVKARLIAEIVYQDHRYKASNPVFFKGGQVICRERKERWMLIVKLDQQRQYQFEYLKPKQYSQ

SEQ ID NO: 7265 - DNA, 306 bp, Streptococcus pyogenes
ttgtatgtgtttatagagcccaatgatctaaaagactatttgataacggtttatgatgagcgtaatcgtgcgattcgaaaacagacacaagtttactgcttttacctgatgattgttctatttgttgccttattctttttcttcccttgcttaaccattcgagatcttgtttcttataagctacctttgatttttgcttacctttacttgattatcagaagtctggtggctaagaaaatggaggcactagggaaaataacaactaatagtcaaaaacctccgtttgatacgagtcaggttctttgt

SEQ ID NO: 7266 - protein, 102 aa, Streptococcus pyogenes
LYVFIEPNDLKDYLITVYDERNRAIRKQTQVYCFYLMIVLFVALFFFFPCLTIRDLVSYKLPLIFAYLYLIIRSLVAKKMEALGKITTNSQKPPFDTSQVLC

SEQ ID NO: 7267 - DNA, 162 bp, Streptococcus pyogenes
atgactccattatccttacttttcgctagtgaagagtcttttcgcatcctaagcgccctactattcttattaaccagcttgtgctttatcattttaatgatttccttgctgcctaaaaaaacaggttatcgccaaaagacaaacacttcttccagagatctc

SEQ ID NO: 7268 - protein, 54 aa, Streptococcus pyogenes
MTPLSLLFASEESFRILSALLFLLTSLCFIILMISLLPKKTGYRQKTNTSSRDL

SEQ ID NO: 7269 - DNA, 2286 bp, Streptococcus pyogenes
ttgagaggagagaaaatgaaaaaaacaaggtttccaaataagcttaatactcttaatactcaaagggtattaagtaaaaactcaaaacgatttactgtcactttagtgggagtctttttaatgatcttcgctttggtaacttccatggttggtgctaagactgtttttggtttagtagaatcctcgacgccaaacgcaataaatccagattcaagttcggaatacagatggtatggatatgaatcttatgtaagagggcatccatattataaacagtttagagtagcacacgatttaagggttaacttagaaggaagtagaagttatcaagtttattgctttaatttaaagaaagcatttcctctcggatcagatagtagtgttaaaaagtggtataaaaaacatgatggaatctctacaaaatttgaagattatgcgatgagccctagaattacgggagatgagctaaatcagaagttacgagctgttatgtataatggacatccacaaaatgccaatggtattatggaaggcttggaacccttgaatgctatcagagttacacaagaggcggtatggtactattctgataatgctcctatttctaatccagatgaaagttttaaaagggagtcagaaagtaacttggttagtacttctcaattatctttgatgcgtcaagctttgaagcaactgattgatccgaatttggcaactaaaatgccaaaacaagttccggatgattttcagctaagtatttttgagtctgaggacaagggagataaatataataaaggataccaaaatcttttgagtggtggtttagttcctactaaaccaccaactccaggagacccaccaatgcctccaaatcaacctcaaacgacttcagtacttattagaaagtatgctataggtgattactctaaattgcttgaaggtgcaacattacagttgacaggggataacgtgaatagttttcaagcgagagtgtttagcagtaatgatattggagaaagaattgaactatcagatggaacttatactttaactgaattgaattctccagctggttatagtatcgcagagccaatcacttttaaggttgaagctggcaaagtgtatactattattgatggaaaacagattgaaaatcccaataaagagatagtagagccttactcagtagaagcatataatgattttgaagaatttagcgttttaactacacaaaactatgcaaaattttattatgcaaaaaataaaaatggaagttcacaggttgtctattgctttaatgcagatctaaaatctccaccagactctgaagatggtgggaaaacaatgactccagactttacaacaggagaagtaaaatacactcatattgcaggtcgtgacctctttaaatatactgtgaaaccaagagataccgatcctgacactttcttaaaacatatcaaaaaagtaattgagaagggttacagggaaaaaggacaagctattgagtatagtggtctaactgagacacaattgcgtgcggctactcagttagcaatatattatttcactgatagtgctgaattagataaggataaactaaaagactatcatggttttggagacatgaatgatagtactttagcagttgctaaaatccttgtagaatacgctcaagatagtaatcctccacagctaactgaccttgatttctttattccgaataacaataaatatcaatctcttattggaactcagtggcatccagaagatttagttgatattattcgtatggaagataaaaaagaagttatacctgtaactcataatttaacattgagaaaaacggtgactggtttagctggtgacagaactaaagatttccattttgaaattgaattaaaaaataataagcaagaattgctttctcaaactgttaaaacagataaaacaaacctcgaatttaaagatggtaaagcaaccattaatttaaaacatggggaaagtttaacacttcaaggtttaccagaaggttattcttaccttgtcaaagaaacagattctgaaggctataaggttaaagttaatagccaagaagtagcaaatgctacagtttcaaaaacaggaataacaagtgatgagacacttgcttttgaaaataataaagagcctgttgttcctacaggagttgatcaaaagatcaatggctatctagctttgatagttatcgctggtatcagtttggggatctggggaattcacacgataaggataagaaaacatgac

SEQ ID NO: 7270 - protein, 762 aa, Streptococcus pyogenes
LRGEKMKKTRFPNKLNTLNTQRVLSKNSKRFTVTLVGVFLMIFALVTSMVGAKTVFGLVESSTPNAINPDSSSEYRWYGYESYVRGHPYYKQFRVAHDLRVNLEGSRSYQVYCFNLKKAFPLGSDSSVKKWYKKHDGISTKFEDYAMSPRITGDELNQKLRAVMYNGHPQNANGIMEGLEPLNAIRVTQEAVWYYSDNAPISNPDESFKRESESNLVSTSQLSLMRQALKQLIDPNLATKMPKQVPDDFQLSIFESEDKGDKYNKGYQNLLSGGLVPTKPPTPGDPPMPPNQPQTTSVLIRKYAIGDYSKLLEGATLQLTGDNVNSFQARVFSSNDIGERIELSDGTYTLTELNSPAGYSIAEPITFKVEAGKVYTIIDGKQIENPNKEIVEPYSVEAYNDFEEFSVLTTQNYAKFYYAKNKNGSSQVVYCFNADLKSPPDSEDGGKTMTPDFTTGEVKYTHIAGRDLFKYTVKPRDTDPDTFLKHIKKVIEKGYREKGQAIEYSGLTETQLRAATQLAIYYFTDSAELDKDKLKDYHGFGDMNDSTLAVAKILVEYAQDSNPPQLTDLDFFIPNNNKYQSLIGTQWHPEDLVDIIRMEDKKEVIPVTHNLTLRKTVTGLAGDRTKDFHFEIELKNNKQELLSQTVKTDKTNLEFKDGKATINLKHGESLTLQGLPEGYSYLVKETDSEGYKVKVNSQEVANATVSKTGITSDETLAFENNKEPVVPTGVDQKINGYLALIVIAGISLGIWGIHTIRIRKHD

SEQ ID NO: 7271 - DNA, 159 bp, Streptococcus pyogenes
atgagtaagggctttattgcttctttatctgaaaatgatagtttgttaagttctccagatgaattagaagttctgaaatcagctctagtcatgttttcttatccttatcgtgtgaattccccagatccccaaactgataccagcgataactatcaaagc

SEQ ID NO: 7272 - protein, 53 aa, Streptococcus pyogenes
MSKGFIASLSENDSLLSSPDELEVLKSALVMFSYPYRVNSPDPQTDTSDNYQS

SEQ ID NO: 7273 - DNA, 393 bp, Streptococcus pyogenes
atgattatcaaaagaaacgatatggctcctagtgtaaaagcaggagatgctattttattttatcgcttatctcagacttataaagtagaagaagcagttgtttatgaggactctaaaacatctataacgaaagtcggtcggattattgctcaagcaggtgatgaagtggacctgacagaacaaggtgaattaaaaattaatggccatattcaaaatgaaggactaacttttataaaatcaagagaagctaattatccgtatcgaattgctgataatagttatttgatactcaatgattactatagccaagagagtgagaattacctacaagatgcaattgctaaagatgctataaaaggcacgattaatacacttattcgattaagaaaccat

SEQ ID NO: 7274 - protein, 131 aa, Streptococcus pyogenes
MIIKRNDMAPSVKAGDAILFYRLSQTYKVEEAVVYEDSKTSITKVGRIIAQAGDEVDLTEQGELKINGHIQNEGLTFIKSREANYPYRIADNSYLILNDYYSQESENYLQDAIAKDAIKGTINTLIRLRNH

SEQ ID NO: 7275 - DNA, 1020 bp, Streptococcus pyogenes
atgaaattacgtcacttactattaacgggagcagccctaactagttttgctgctacaacagttcacggggagactgttgtaaacggagccaaactaacagttacaaaaaaccttgatttagttaatagcaatgcattaattccaaatacagattttacatttaaaatcgaacctgatactactgtcaacgaagacggaaataagtttaaaggtgtagctttgaacacaccgatgactaaagtcacttacaccaattcagataaaggtggatcaaatacgaaaactgcagaatttgatttttcagaagttacttttgaaaaaccaggtgtttattattacaaagtaactgaggagaagatagataaagttcctggtgtttcttatgatacaacatcttacactgttcaagttcatgtcttgtggaatgaagagcaacaaaaaccagtagctacttatattgttggttataaagaaggtagtaaggtgccaattcagttcaaaaatagcttagattctactacattaacggtgaagaaaaaagtttcaggtaccggtggagatcgctctaaagattttaattttggtctgactttaaaagcaaatcagtattataaggcgtcagaaaaagtcatgattgagaagacaactaaaggtggtcaagctcctgttcaaacagaggctagtatagatcaactctatcattttaccttgaaagatggtgaatcaatcaaagtcacaaatcttccagtaggtgtggattatgttgtcactgaagacgattacaaatcagaaaaatatacaaccaacgtggaagttagtcctcaagatggagctgtaaaaaatatcgcaggtaattcaactgaacaagagacatctactgataaagatatgaccattacttttacaaataaaaaagactttgaagtgccaacaggagtagcaatgactgtggcaccatatattgctttaggaattgtagcagttggtggagctctttactttgttaaaaagaaaaatgct

SEQ ID NO: 7276 - protein, 340 aa, Streptococcus pyogenes
MKLRHLLLTGAALTSFAATTVHGETVVNGAKLTVTKNLDLVNSNALIPNTDFTFKIEPDTTVNEDGNKFKGVALNTPMTKVTYTNSDKGGSNTKTAEFDFSEVTFEKPGVYYYKVTEEKIDKVPGVSYDTTSYTVQVHVLWNEEQQKPVATYIVGYKEGSKVPIQFKNSLDSTTLTVKKKVSGTGGDRSKDFNFGLTLKANQYYKASEKVMIEKTTKGGQAPVQTEASIDQLYHFTLKDGESIKVTNLPVGVDYVVTEDDYKSEKYTTNVEVSPQDGAVKNIAGNSTEQETSTDKDMTITFTNKKDFEVPTGVAMTVAPYIALGIVAVGGALYFVKKKNA

SEQ ID NO: 7277 - DNA, 711 bp, Streptococcus pyogenes
atgatagtaagactgattaagctccttgacaagttgataaacgtcattgttctttgtttcttctttctttgtttattgattgcggcacttggaatctacgatgctttaacagtttatcaaggagctaatgctactaactatcaacaatataagaaaaagggtgttcagtttgacgatttattagctattaattctgatgttatggcatggctgactgttaaaggaacgcatattgattatccaattgtacagggagagaataatttagaatatatcaacaaatcagtagaaggagagtactccttatcaggaagtgtttttctagattatcgtaataaagtaacttttgaagataaatactcattaatctatgcacatcatatggctggaaatgttatgtttggcgaattacctaactttaggaaaaaatcattttttaataaacacaaagaatttagtattgaaaccaaaacaaagcaaaaactgaaaatcaatatttttgcatgtatccaaacagatgcttttgacagtttactgtttaatccaattgatgttgatatttctagtaaaaatgaatttttaaaccatatcaagcaaaaatcggtacagtatcgtgaaatattgacaacaaatgaaagtcgttttgttgccttatcaacctgtgaggatatgacaacagatggtaggattatcgttattggacaaattgaa

SEQ ID NO: 7278 - protein, 237 aa, Streptococcus pyogenes
MIVRLIKLLDKLINVIVLCFFFLCLLIAALGIYDALTVYQGANATNYQQYKKKGVQFDDLLAINSDVMAWLTVKGTHIDYPIVQGENNLEYINKSVEGEYSLSGSVFLDYRNKVTFEDKYSLIYAHHMAGNVMFGELPNFRKKSFFNKHKEFSIETKTKQKLKINIFACIQTDAFDSLLFNPIDVDISSKNEFLNHIKQKSVQYREILTTNESRFVALSTCEDMTTDGRIIVIGQIE

SEQ ID NO: 7279 - DNA, 645 bp, Streptococcus pyogenes
atgaaaaaatctatattaagaattttagctattggttatttacttatgagtttttgtttgttagactccgtagaggcagagaacctcactgcaagcattaatattgaagttattaatcaagttgatgttgctaccaacaaacaatcctctgacatagatgaaacgtttatgtttgtaattgaagcgttagataaagaaagtcctttacctaattcggtaactacttctgttaagggaaatgggaaaacatcatttgaacagttgactttttcagaagttggacaatatcattataaaattcatcaactgttaggtaagaatagtcaatatcattatgatgaaacagtatatgaagttgttatttacgtattgtataatgagcaaagtggtgctttagaaactaacctagtttctaacaaacttggagaaaccgaaaaatcggagcttatttttaaacaagaatatagtgaaaaaacaccggaacctcatcaaccagatacaactgagaaggaaaaacctcagaaaaaacgtaatggtattttgccatcaactggtgaaatggtgagttacgtatctgctttaggaattgtcttagtggctaccattactttgtattctatttataaaaagctaaagacaagcaaa

SEQ ID NO: 7280 - protein, 215 aa, Streptococcus pyogenes
MKKSILRILAIGYLLMSFCLLDSVEAENLTASINIEVINQVDVATNKQSSDIDETFMFVIEALDKESPLPNSVTTSVKGNGKTSFEQLTFSEVGQYHYKIHQLLGKNSQYHYDETVYEVVIYVLYNEQSGALETNLVSNKLGETEKSELIFKQEYSEKTPEPHQPDTTEKEKPQKKRNGILPSTGEMVSYVSALGIVLVATITLYSIYKKLKTSK

SEQ ID NO: 7281 - DNA, 1170 bp, Streptococcus pyogenes
ttgacagaaattggctcggtggttcaacgtcaagaattagtctttatcccagcacaattgaaacgtataaatcatgtgcaacacgcttataagtgccaaacttgtagcgataatagcctcagtgacaagatcatcaaagcgcctgttcctaaggcaccattagctcatagccttggttcggcttctattattgcccataccgttcatcaaaaattcacccttaaagttcctaactacagacaggaagaggattggaataaattaggactgtccattagtcgcaaggaaatcgctaactggcatatcaagtctagccagtattattttgagcctctttatgacttgcttcgtgacatcttattaagtcaagaggtcattcatgcggatgagacatcttatagagttcttgaaagtgacactcagttgacctattactggacttttttgtctggtaagcatgagaaaaaagggattaccctttaccatcatgataaaaggcgtagcggcctcgttactcaagaggttctcggcgattactcaggttatgtgcattgtgatatgcatggggcttatcgtcaattagagcatgccaagcttgttggttgttgggcacatgtgaggcggaagttctttgaggccaccccgaagcaagctgataagacttctctagggcgtaaaggacttgtttactgtgacaagttgttcgccttagaagctgaatggtgtgagttaccccctcaagagcgtctggttaaacgcaaagaaatcttgacgccattaatgaccaccttctttgattggtgtcgcgagcaagttgtcctttcaggatcgaagctgggtctcgctatcgcttatagtctcaagcatgaaagaacctttagaactgttttagaggatggccatattgttctgtctaacaatatggcagagagagctatcaaatccttagtgatgggccgaaaaaattggttgttttctcaaagttttgaaggagccaaagcggcagctatcatcatgagtttgcttgaaacggctaagcgacatggactgaactccgaaaaatatattagctaccttctagaccgccttcctaatgaagaaactctcgctaaaagagaagtgctagaagcttatttgccatgggctaaaaaagtacaaacaaattgtcaa

SEQ ID NO: 7282 - protein, 390 aa, Streptococcus pyogenes
LTEIGSVVQRQELVFIPAQLKRINHVQHAYKCQTCSDNSLSDKIIKAPVPKAPLAHSLGSASIIAHTVHQKFTLKVPNYRQEEDWNKLGLSISRKEIANWHIKSSQYYFEPLYDLLRDILLSQEVIHADETSYRVLESDTQLTYYWTFLSGKHEKKGITLYHHDKRRSGLVTQEVLGDYSGYVHCDMHGAYRQLEHAKLVGCWAHVRRKFFEATPKQADKTSLGRKGLVYCDKLFALEAEWCELPPQERLVKRKEILTPLMTTFFDWCREQVVLSGSKLGLAIAYSLKHERTFRTVLEDGHIVLSNNMAERAIKSLVMGRKNWLFSQSFEGAKAAAIIMSLLETAKRHGLNSEKYISYLLDRLPNEETLAKREVLEAYLPWAKKVQTNCQ

SEQ ID NO: 7283 - DNA, 279 bp, Streptococcus pyogenes
ttgaactcatggcttttcttcaggtataatgaagaaaatatcaggaggaagaccatgagttcacaagataaagtcattaaaacacaagccaaaaccattgaaacaatggctaatgagctagccctcctgcgtgaacaagtggcttatttaactcaaaagctttatgggaaatcttctgaaaaagctatgcctatgaccggtcaactcagtctctttgaccaggaccaattaccagaagaagcggatgacttgcccagtagaaacagaagacattactta

SEQ ID NO: 7284 - protein, 93 aa, Streptococcus pyogenes
LNSWLFFRYNEENIRRKTMSSQDKVIKTQAKTIETMANELALLREQVAYLTQKLYGKSSEKAMPMTGQLSLFDQDQLPEEADDLPSRNRRHYL

SEQ ID NO: 7285 - DNA, 348 bp, Streptococcus pyogenes
atgaccattcggctaaatgacctaggacaagtttatctggtttgtggaaaaacagatatgcgacaaggcattgattccctagcctatcttgtcaaatcccaacatgagttagatctcttttcaggtgctgtttatctcttctgtggtgggcgacgtgatcggttcaaagcgctttactgggatggtcaaggtttctggttactttataaacgctttgaaaatgggaaactagcctggccaagaaatagggatgaggtcaaatgcttgacagctgtacaggtggactggcttatgaagggatttttcattagtcctaacataaaaatttcaaaaagtcatgatttctat

SEQ ID NO: 7286 - protein, 116 aa, Streptococcus pyogenes
MTIRLNDLGQVYLVCGKTDMRQGIDSLAYLVKSQHELDLFSGAVYLFCGGRRDRFKALYWDGQGFWLLYKRFENGKLAWPRNRDEVKCLTAVQVDWLMKGFFISPNIKISKSHDFY

SEQ ID NO: 7287 - DNA, 111 bp, Streptococcus pyogenes
ttgcttaaagttcgccttggaaaactggaacttagtttatttcaagcactcaatcaggacttgttggaaagcattttggataaggtactgaacgatgaccattcggctaaa

SEQ ID NO: 7288 - protein, 37 aa, Streptococcus pyogenes
LLKVRLGKLELSLFQALNQDLLESILDKVLNDDHSAK

SEQ ID NO: 7289 - DNA, 663 bp, Streptococcus pyogenes
atgaaacgatgtaataaatatctcttcacttcactactagcagcttcgatgctgtttagttcgtataaatcagtacatgcccatgataacattgatgagaaaggtaaagtgcacctttactggcagggaaattactatgttgataactatgtcgactatactaaaaaattggtcgatagcgataaaaatattgaatggactgtaacctttaattcagctaaagaacaatgggtttaccctgatttctcagtttttcttcctaagggtgtaaaagctcctacagagataacttatgagcatcattattgggacggtacagttcgttctgaaacacgcaataatacacaatggcattatgattggaaaagccaacaaacaaattttaatcaagaatttgataaattccctggttatactggttggagtccttctctagataaattttacaaactaaaaaacgacggaaaattttctcacgttttagtagatacctatggccgtcaatcacacacttatttttctcataaaatggtttggaagtttaaaactgagcttgaagataattacaaaaataaatgggataaattaccgtttatagcaggtattaaacaaaacaacccattagcagcatcattcccaagttataaaggggaattcggtgag

SEQ ID NO: 7290 - protein, 221 aa, Streptococcus pyogenes
MKRCNKYLFTSLLAASMLFSSYKSVHAHDNIDEKGKVHLYWQGNYYVDNYVDYTKKLVDSDKNIEWTVTFNSAKEQWVYPDFSVFLPKGVKAPTEITYEHHYWDGTVRSETRNNTQWHYDWKSQQTNFNQEFDKFPGYTGWSPSLDKFYKLKNDGKFSHVLVDTYGRQSHTYFSHKMVWKFKTELEDNYKNKWDKLPFIAGIKQNNPLAASFPSYKGEFGE

SEQ ID NO: 7291 - DNA, 1437 bp, Streptococcus pyogenes
gtgcttttggacaatgtgaaaggaattgacaacatgaataacatcaaaaccaaaaaaaggtttatggatcgctatattgatggctttatgaaatggatgccagaatcgctttttatctgttttattttaacctttttagtcgttactatgtctgtgttgatgacggatagtccctttattggtacggaaaagacgggcgggattatctatggctgggtaaatggtttttgggggctgttgtcctttgccatgcagatgactattttacttgcgacagggaatgctgtagcgagttctccacctgctcataagatgtttaagtcccttgccaaactgcctcaaaccaggactcagatttttatcttttccattgtagtaggctctatctttggctttttacactggggtcttggtatgatggttgctattgtgtttgggaaagagttgcttgttcaggctaggcaaaaagggattaaggtgcatacgcctttgtttgttgctactttattttttacctttttaccagctacttctggtctatctggtgctgcggtgctttattcggctactccagattatttgcgaaatagtgtcgcagatgcttataaacaggttgttcctgaaagtgttcctctgacagaatcagttttgaatcttccatttatcagtcttttagtggtgtgtatgctggtaccgctttgctttgctttattggcgcacccaaaagatgaaactaaaatcatggaacttgatgatgagatctatcaccatagtcttgataccgcttcacatgttgttattgcaagaaacacacctgctgaaaagatgaacgcatctcgcttagtgatgtatcttgttggtggggccattgttagctatagcctttatcatttttcggtggtgggcttgtctggtctagatctcaattgttttaactttttatttttaggcttaggcttgcttctttgtggtcaacaaggaccagaatattatggttccttattcaaagatggggtcatgtcatcttggggcttggtgcttcagtttccattttacgctggtatttttggaatcattcaaagtacaggtttaggattagagatttcccatttctttgtcgctatttcaaatgggacaacatggccggtctttgcttatctttactcggctttgctgaatattgcggtaccatcaggaggctcaaaatttgtgattgaagctccctatatcgtccctgcaactatcgaagttggtaatgacttaggtaagattttgcaggcttatcaattaggagatgccacaacaaacttgatagttcctttttgggccttatcttacctctcaaacttcaaactaaaattcaatcaaattgtggcttatactattccttgtgtcttggtggtcacaggtattgccatcatttacctatttgtattt

SEQ ID NO: 7292 - protein, 479 aa, Streptococcus pyogenes
VLLDNVKGIDNMNNIKTKKRFMDRYIDGFMKWMPESLFICFILTFLVVTMSVLMTDSPFIGTEKTGGIIYGWVNGFWGLLSFAMQMTILLATGNAVASSPPAHKMFKSLAKLPQTRTQIFIFSIVVGSIFGFLHWGLGMMVAIVFGKELLVQARQKGIKVHTPLFVATLFFTFLPATSGLSGAAVLYSATPDYLRNSVADAYKQVVPESVPLTESVLNLPFISLLVVCMLVPLCFALLAHPKDETKIMELDDEIYHHSLDTASHVVIARNTPAEKMNASRLVMYLVGGAIVSYSLYHFSVVGLSGLDLNCFNFLFLGLGLLLCGQQGPEYYGSLFKDGVMSSWGLVLQFPFYAGIFGIIQSTGLGLEISHFFVAISNGTTWPVFAYLYSALLNIAVPSGGSKFVIEAPYIVPATIEVGNDLGKILQAYQLGDATTNLIVPFWALSYLSNFKLKFNQIVAYTIPCVLVVTGIAIIYLFVF

SEQ ID NO: 7293 - DNA, 393 bp, Streptococcus pyogenes
atgagtcacaaaacctttcaagagacgtttgatagtaatcctaacatctctatcaaagcattacatcgtcaaaacttagtaacttttgataaaacctttatgattaatcatcagcttaccaccttatttgaagaagcaaatagtcttcctgtagtcaaatgttattctgcctcgtgggattttttattaaattgcacgcgctattcctcttacctaacaatcctaccaagacctattactcattttgctcatatggacggtttagtggaggtccaactgaccgaacatccaaaatgggaagttgttctagcctctctcaagcacaacaaaacaagccatttaaaacattatatcaagcacaccatcttagattatttcatgaaccagcgcttc

SEQ ID NO: 7294 - protein, 131 aa, Streptococcus pyogenes
MSHKTFQETFDSNPNISIKALHRQNLVTFDKTFMINHQLTTLFEEANSLPVVKCYSASWDFLLNCTRYSSYLTILPRPITHFAHMDGLVEVQLTEHPKWEVVLASLKHNKTSHLKHYIKHTILDYFMNQRF

SEQ ID NO: 7295 - DNA, 714 bp, Streptococcus pyogenes
ttgtattggtggtggccaaggtcaaagtatcatcgtaacaagatagaaggtaaccgtatgaaagagaataaaagaatagcaatagcagaagctatcagtcatattaaagatggtgacacgattatggtcggtggttttatggctaatggaacaccagaagcgttaattgatgcactggttgacaaaggcacaaaagacttaaccttgatctgtaatgatgctggttttgttgatcgcggtgttggaaaaatggtggctaatcatcaattcaaaaccatttatgcaacacatattggattaaataaagaagctgggcgccaaatgactgccggtgaaacgacgattgagctcattcctcaaggaaccttcgccgaaaaaattcgcatcggagcttatggcattggtggcttttacacgccaacaggggtaggaaccttagtggcagaaggcaaggaaacaaaaaccatcaagggaaaaacctatctcttagaatacccatttgaggcagatgtcgccttgatatttgctaatcaagctgatgaaatgggaaatttacagtatagtggttctgaaaataattttaatcaattgatggcagcttgtgcaaaaacaacaattgttcaggcgcgagaaatagtaccagtcggcaccatacaaccagaatgcgttcatacaccacatatttttgtagattacattgttaaagaaggagta

SEQ ID NO: 7296 - protein, 238 aa, Streptococcus pyogenes
LYWWWPRSKYHRNKIEGNRMKENKRIAIAEAISHIKDGDTIMVGGFMANGTPEALIDALVDKGTKDLTLICNDAGFVDRGVGKMVANHQFKTIYATHIGLNKEAGRQMTAGETTIELIPQGTFAEKIRIGAYGIGGFYTPTGVGTLVAEGKETKTIKGKTYLLEYPFEADVALIFANQADEMGNLQYSGSENNFNQLMAACAKTTIVQAREIVPVGTIQPECVHTPHIFVDYIVKEGV

SEQ ID NO: 7297 - DNA, 645 bp, Streptococcus pyogenes
atggcggttgcattaagtaaagaagagattcaaaatcgtattgcaaagcgtgtggccaaagaattagaagatggtactttggtaaatttaggtattggtctaccaaccaaagtagcaaattttgtgcctgaagaaatgacagtgtattttcaatctgaaaatgggtttattggactaggtcctaagtcagatgatccgaattcgactatcgttaatgcaggaggacagcctgtgacggtttatccaggagccgctttctttaatagtgcagattcttttggcattatacgtggtggtcatgttgatttgaccgtcttgggtgctttagaaattgcagaaaatggagatatcgccaattacctgattccaggcaaaatggttcctggtatgggaggagcgatggatttattagttggtgctaaaaaagtcatcgtagctatggagcataccaataaaggaaagcataagctcctaaaagaatgtaccttacctttaacagcaaaaggtgtggttgaccttattatcacagaaatgggtgtgtttaaagtaacgccagatggtatccaagtaattgaaatcagtgaagggtttacttttgatgaggttcaagctgcgacaggtgtacctctaagcatagctgaaggt

SEQ ID NO: 7298 - protein, 215 aa, Streptococcus pyogenes
MAVALSKEEIQNRIAKRVAKELEDGTLVNLGIGLPTKVANFVPEEMTVYFQSENGFIGLGPKSDDPNSTIVNAGGQPVTVYPGAAFFNSADSFGIIRGGHVDLTVLGALEIAENGDIANYLIPGKMVPGMGGAMDLLVGAKKVIVAMEHTNKGKHKLLKECTLPLTAKGVVDLIITEMGVFKVTPDGIQVIEISEGFTFDEVQAATGVPLSIAEG

SEQ ID NO: 7299 - DNA, 363 bp, Streptococcus pyogenes
atgaagagctacccagaaccaatgggcccttattcaacttatacgattgaaggacattttctatacaccgcaggccaattaccccttaatccagtgacaggtcaattgtcagatggttttgaggcacagtgtcgccaggtttttgttaatttacaatctattttggcagagcaaaagttggacttgaatcatatctataagctaaatgtgtatttaacagatgtgaccaatgtggaaatattaaatcatgtcatgactgatttgtttgaagagccctaccctgttcggacagcggttcaagtgtcggcgcttcctttgcaagctttgattgaagtcgaagctgtcgccagagtgaagcagtta

SEQ ID NO: 7300 - protein, 121 aa, Streptococcus pyogenes
MKSYPEPMGPYSTYTIEGHFLYTAGQLPLNPVTGQLSDGFEAQCRQVFVNLQSILAEQKLDLNHIYKLNVYLTDVTNVEILNHVMTDLFEEPYPVRTAVQVSALPLQALIEVEAVARVKQL

SEQ ID NO: 7301 - DNA, 321 bp, Streptococcus pyogenes
gtgatgaataccctattgtcactaatgaatagtatcgaacaagaggctagaacaatttatgacagttacgatgctaagaaaaaagctctagctgacaaaaaagaagaagagttaaagcagctgttccttgagtacgaacaagaaactcagctactattagaagctaaacgtgaggtgttttttgaagctaatcgtcaagaacaaaaagcttcaaaaaagagattagcgacgcaacagctagcccttcatgccattttagaagagcataagctaaccgttgttagggagttagtggataaggtggtggagacatatggccat

SEQ ID NO: 7302 - protein, 107 aa, Streptococcus pyogenes
VMNTLLSLMNSIEQEARTIYDSYDAKKKALADKKEEELKQLFLEYEQETQLLLEAKREVFFEANRQEQKASKKRLATQQLALHAILEEHKLTVVRELVDKVVETYGH

SEQ ID NO: 7303 - DNA, 1998 bp, Streptococcus pyogenes
atggccattagtcaaatgaaaaagctggcaatggtttttgaaaaagattatcttgatcttgttttaaaaacacttcaacaatctcaattagttgaagttcgtgacatgaagcaactaaaacattggcaagatgcttttaacaaaggcaacgtcaagttgccacaaatcgtccaatacgatctgacgcatcaaaaacctctactagatgatgaagctttacaataccttttacaaagccaacaagagttagaaaacggccttgctagcttatcagcgtttttaccaccaataggaaagttaacagccttgagacaaaaaacgccatctctttcgtttaaacagttcgaagaacgccatcgacaacaagcagctcaaacggctttgaaaatgatgtcacaaaagatagagcgactagagcagctgcaaagcaaaatagaccagctaacagaatactgtcaggagttagaaaagtggcgttccttgactgttttgcctcaggacttagcgcaatttcattttttgtcggcaagagttggaacgattcctagtacagcaaataatcatttttatcatcagctaaagcagcacaaaggtctttttattgaggaagtataccatacagaatttgagtacggccttgtcttattttggcaagcacaagatacgattcatttacagaaatatcagtttaaacccttattatataaagaacagttactgccatcagaacaacttcgtataaacaaagagttactaacgaattggctagctgaaaaagatagtctactaaaagagcttaggcagtctcaaaagatactggcacagttacaggttgaaatagactatgtccttagtcagtatcaacggcagcaaactaaaaagcaattactcggtacaagacatctaatagccttagaagggtggatagaagctgattcggttaaccaattaaaagggctaatgactaagacactaggtgatatgttttatctggatagttacgatgtcacgccagacgattgggaagatgttcccattaagctacgtaatcaccgctacattgcaccgtttgaattggttacagaaatgtacgctttgccaaaatatcaagaaaaagatccgacaccttttttagctcctttataccttactttttttggcatgatggtagctgatttgggctatggtttgttgctatatgctgtgacactagctgcattggtcttttttaatctccaaaaaaccagtaaacggttagtgaccttctttaatattttagctatttcagtagccatatgggggcttatttacggttctttctttggttttgacttacctgtggcattattatcaactaaaacggatgtgattactattttggttgtttctttgctatttgggtttgttacacttatatttgggcttttgttaggagcatggcaacaagtaaggatgaaagcatatgctacggcctatacgtcaagtctagcttggacttttattttattaggtctgctgttatttattcttggtaagaatgtatctggccttgcttacttatcggttattggtaagtggcttgcattgggcaatgcctttgggattttggttgtttctttactaaaaagcaaaagccttttaggtctaggtagtggattatataatttatatggcattagctcttacttaagtgatttggttagctttactcgtctaatggcattagggctttctggagctagtattggagcggcttttaacatgattgttgggatttttccaccagtcacgcgctttacagtaggtatctttatttttattcttttgcatgcgatcaatattttcttatcaatgctttcaggatatgtgcatggtgctcgtcttattttcgtagagttttttggaaaattttatgaaggtggaggaaaagctttcaatcctttaaagttagctgataattatgtcaatgtcaatgaagaaacagatttggaggacaat

SEQ ID NO: 7304 - protein, 666 aa, Streptococcus pyogenes
MAISQMKKLAMVFEKDYLDLVLKTLQQSQLVEVRDMKQLKHWQDAFNKGNVKLPQIVQYDLTHQKPLLDDEALQYLLQSQQELENGLASLSAFLPPIGKLTALRQKTPSLSFKQFEERHRQQAAQTALKMMSQKIERLEQLQSKIDQLTEYCQELEKWRSLTVLPQDLAQFHFLSARVGTIPSTANNHFYHQLKQHKGLFIEEVYHTEFEYGLVLFWQAQDTIHLQKYQFKPLLYKEQLLPSEQLRINKELLTNWLAEKDSLLKELRQSQKILAQLQVEIDYVLSQYQRQQTKKQLLGTRHLIALEGWIEADSVNQLKGLMTKTLGDMFYLDSYDVTPDDWEDVPIKLRNHRYIAPFELVTEMYALPKYQEKDPTPFLAPLYLTFFGMMVADLGYGLLLYAVTLAALVFFNLQKTSKRLVTFFNILAISVAIWGLIYGSFFGFDLPVALLSTKTDVITILVVSLLFGFVTLIFGLLLGAWQQVRMKAYATAYTSSLAWTFILLGLLLFILGKNVSGLAYLSVIGKWLALGNAFGILVVSLLKSKSLLGLGSGLYNLYGISSYLSDLVSFTRLMALGLSGASIGAAFNMIVGIFPPVTRFTVGIFIFILLHAINIFLSMLSGYVHGARLIFVEFFGKFYEGGGKAFNPLKLADNYVNVNEETDLEDN

SEQ ID NO: 7305 - DNA, 519 bp, Streptococcus pyogenes
atgtcaatgtcaatgaagaaacagatttggaggacaattaacatggaacatttagcacattattttacagcacatggtggcgttttcttcgcagccttaggaattgttttagccgtagctcttagtggcatgggctcagcttatggtgtcggtaaaggtggtcaagcggcagctgcgctcttaaaagaagaacccgaaaaatttacgtctgcgcttatcttgcaactgttacccggtagtcaaggaatctacggctttgctattggtattttaatttggatgaaactgacaccagaactttcagttaaccaaggattagcttactttttggtatctcttccaattgctattgttggttatttttcggccaagcaccaaggcaatgtttctgtagctggtatgcaaatcttggctaagcgccctaaagactttatgaaaggtgtcattttagcagctatggttgaaacctatgctattcttgcctttgtcgtctcctttattctcttaaataaaattgga

SEQ ID NO: 7306 - protein, 173 aa, Streptococcus pyogenes
MSMSMKKQIWRTINMEHLAHYFTAHGGVFFAALGIVLAVALSGMGSAYGVGKGGQAAAALLKEEPEKFTSALILQLLPGSQGIYGFAIGILIWMKLTPELSVNQGLAYFLVSLPIAIVGYFSAKHQGNVSVAGMQILAKRPKDFMKGVILAAMVETYAILAFVVSFILLNKIG

SEQ ID NO: 7307 - DNA, 582 bp, Streptococcus pyogenes
gtgaatgatataacacagttaagacaaaacgttcttgaaaaagcacatcaagaaggtcaacagtgcctaaagatagcgacagatagtcttgatactgactttaaagagcgtcaacagcaaggactacacgatttaaaagcaaagcgtcaaaaagagttaaaagctcttgaacagcaatttcaggttgcgcagcagcaactcaaaaatcaagaaagacaagctctactagcattaaaacaagacagtataaaggagctatttgaagcttctttggagaagatgacgaacttttctaaggaagaagaattggcttttttgaagcaagtcttgtctaaatatccagaacagccattgcaagttacttttggcgaaaaaacagggcaaaagttcagttcttatgattgtgctgagctgagattagcatttcctcaattaagctataatcaagagctaattcctcaggaagcaggatttttagtcagtttagaccaagtcgatgacaattatttataccgttaccttttagaatcagttcttaaagaagaaagctcccgcatcattgatatgcttttttcagagata

SEQ ID NO: 7308 - protein, 194 aa, Streptococcus pyogenes
VNDITQLRQNVLEKAHQEGQQCLKIATDSLDTDFKERQQQGLHDLKAKRQKELKALEQQFQVAQQQLKNQERQALLALKQDSIKELFEASLEKMTNFSKEEELAFLKQVLSKYPEQPLQVTFGEKTGQKFSSYDCAELRLAFPQLSYNQELIPQEAGFLVSLDQVDDNYLYRYLLESVLKEESSRIIDMLFSEI

SEQ ID NO: 7309 - DNA, 996 bp, Streptococcus pyogenes
atgccaacatttctagaattaaacactactatcagtgtcaaagaaaaagagttattgactaaagagcaatttgataagctattgcaggctcccaatacaacaaccttagctcgactgttgcaccagtcagtctatcacctaactgttgacgatctcaacgatttggatcggctagaatctatcttaatggctgagctaaccaagacctatcgctgggcttttgcagaaacccctcaacctgacatagtacaattatttaccttgcgttacacctatcataatgtcaaagtgttgttaaaagctaaagctagtcaagcagatctgagtcacttattactaccaattggtgacaagcctttggtggctttggaacatttgattaggacgatgacttctgatgagtttccaaaagaggtggtaacagaaatccagtccatttgggccgaatatcaagattatcaagacatacgcgtcttagaaattggtactgacttagcttattttaaggcgttgaaacaaatagcacaaagattagaggaccctgttttccaacaagctgttcttattgtgattgatttgtataatctgattaccgtcagacgggccaaatcgcaaaataaaccaataagtttcatgatgcagttattatctgatgaagcaagtagaccaagtaaaacatttatcacacttgaagatgataaggatctgatgacgtggtttgaaaatgtaacacctgatagctatatgacagccctaaaaccttattcagagaaacttcgccaaggcactcttcaaacgactgagttagaataccttgttgatgaatgcctttaccatttatttgcgaaggccaaatatcaagtcgatgggccttatgtgcttgctcgctttttgctcgctaaatcgtttgaagtaaaaaacctacggcttttagcggctgctttagctaatgatttacccaaagaacgtgtcatagaaaggatgagaccaatagca

SEQ ID NO: 7310 - protein, 332 aa, Streptococcus pyogenes
MPTFLELNTTISVKEKELLTKEQFDKLLQAPNTTTLARLLHQSVYHLTVDDLNDLDRLESILMAELTKTYRWAFAETPQPDIVQLFTLRYTYHNVKVLLKAKASQADLSHLLLPIGDKPLVALEHLIRTMTSDEFPKEVVTEIQSIWAEYQDYQDIRVLEIGTDLAYFKALKQIAQRLEDPVFQQAVLIVIDLYNLITVRRAKSQNKPISFMMQLLSDEASRPSKTFITLEDDKDLMTWFENVTPDSYMTALKPYSEKLRQGTLQTTELEYLVDECLYHLFAKAKYQVDGPYVLARFLLAKSFEVKNLRLLAAALANDLPKERVIERMRPIA

SEQ ID NO: 7311 - DNA, 318 bp, Streptococcus pyogenes
atgaccaaaacattgtataaagtcggggtaattggtaacagagatgttattctaccttttcagatgattgggtttcaaacttttccagtaataaaaccacaagacgctattaaccagttgcgtcaactagcaatggaagactttggtattatttatatcacagaagatattgctgcagctattccagaagccctcactcactatgacaatcaagttctaccagcagtcataccattaccaactcatcaaggagcgcaagggataggcctgtcacgcatacaagccatggttgaaaaggctgtcggtcaaaatatttta

SEQ ID NO: 7312 - protein, 106 aa, Streptococcus pyogenes
MTKTLYKVGVIGNRDVILPFQMIGFQTFPVIKPQDAINQLRQLAMEDFGIIYITEDIAAAIPEALTHYDNQVLPAVIPLPTHQGAQGIGLSRIQAMVEKAVGQNIL

SEQ ID NO: 7313 - DNA, 111 bp, Streptococcus pyogenes
atgcgttcagctgctaacttcaccaattttcctgtccttgcatttcatcagttagctactcataagcctcaaacagagtataagtcctctttgcctaacgtcttagtgtta

SEQ ID NO: 7314 - protein, 37 aa, Streptococcus pyogenes
MRSAANFTNFPVLAFHQLATHKPQTEYKSSLPNVLVL

SEQ ID NO: 7315 - DNA, 645 bp, Streptococcus pyogenes
ttgacgaaaggagttatatcaatggcacgattaaatgttaaaccaacacgcatggaacttagtaacttgaaaaatcgcttgaagacagctacaagaggtcataaattattaaaggacaagcgggatgagttgatgcgccgcttcgttgatttaattcgtgaaaacaatgagcttcggcaaactatcgaaaaagaacttgctgccaatatgaaggagtttgtcttggcaaaagcatccgaaaatagtctaatggtagaagaactctttgctgttccagtccatgaagtgaccttatggattgatattgaaaatatcatgagtgtcaatgtgcctaaattccatgtccagtctaatacggcaagagagcaagaacaaggtgagtttgcttatagttacctcagctcaaatagtgagatggacaatactatccaaaagacaaaagaactattagaaaagctcttacggttagctgaagttgaaaaaacttgtcaactaatggctgatgacattgaaaagactagacgtcgcgtcaatggcttagagtattctattatcccgcaactgaaagagacgattcactacattgagttgaaattagaagaggccgagcgtgcgagccttgttcgtattatgaaaataacatca

SEQ ID NO: 7316 - protein, 215 aa, Streptococcus pyogenes
LTKGVISMARLNVKPTRMELSNLKNRLKTATRGHKLLKDKRDELMRRFVDLIRENNELRQTIEKELAANMKEFVLAKASENSLMVEELFAVPVHEVTLWIDIENIMSVNVPKFHVQSNTAREQEQGEFAYSYLSSNSEMDNTIQKTKELLEKLLRLAEVEKTCQLMADDIEKTRRRVNGLEYSIIPQLKETIHYIELKLEEAERASLVRIMKITS

SEQ ID NO: 7317 - DNA, 93 bp, Streptococcus pyogenes
atgactaactatacaatccaacaaacggtaaaaagagctggaaacgctatccaactctttgtcatactagacaccttagatagatgcccagac

SEQ ID NO: 7318 - protein, 31 aa, Streptococcus pyogenes
MTNYTIQQTVKRAGNAIQLFVILDTLDRCPD

SEQ ID NO: 7319 - DNA, 1350 bp, Streptococcus pyogenes
gtggtttacatgagaaacaaaaaagtaacattagctcatattgtcgcaaagacaagtgttgctattgctttggctggagcaatgggtagcagtttattagctaatagcacaacgtacgctgttagtggcaaagaaaataaaaaaagcgatgtcaaatatgaaacgaccaaagttatggaagctaacgcaacttcctctaaagaagacaatcatgtcatgcacacattagacggctcaatgagtactgtctgggaggaaaattcacctggtggtggtgttggtgaagtactttcctacaagtttgcgtccccgatgcatattgggagaattttaattgttaatggagatacatctagcaaggagaattactacaagaaaaatagaattgcaaaggctgatgttaaatactataacaggaataaattggtcctctttcaaaaaattgaattaggcgacacctacactaaaaaaccgcatcacattgagattgataaaaaattagatgttgatcgtattgatattgaggtaacagaggtccatcagggacaaaacaaggatattttagccttgtcagaggtcacttttggcaatatagaacgcgatatttttgaaaaaaagtttaaagaaattaaagataaatgggtaacagataaacaagcagatgagtttattgaaactgccgacaagtatgctgataaagctgttcagatgtctgctgttgcgtcacgtgctgagtattatcggatgtacgttagccgcaaataccactacaaaaaagagtttgttgaaaaactaaaacaagtctacaaagaaagcggagcttcccacgttacaagcaaaaaagatgtgatgttagcttttgacgatgctaaaaaaaagtcaacgattggtcgacaagaaaacggtctttttgtgacaagttttgctgaggatatggctttgctctttactgatcaaggtaagttaaaatcagctgaccaaattgaaaatataaaagatgtcgatagcggaaaatatagcgatggggtttatcaatatgagtacgattctgaactaacaaaaaacattgataagctaggctatatccgaacagctagcggagatactcctggagcaaattcgctcaacgttcctggttgccaaacgtggtcaggaaaacacattgaaaattcagaaagtgaattaattttcccatcgattagtgttaaagatctaaaatctaaagctgtcttagcagagattgatgccaaaggctattttgaaattattgatcctaccatcattgctccaaatggtgaccataaaaaagtaactggtcgcttcaaaattaagaaaatgcaagataggaag

SEQ ID NO: 7320 - protein, 450 aa, Streptococcus pyogenes
VVYMRNKKVTLAHIVAKTSVAIALAGAMGSSLLANSTTYAVSGKENKKSDVKYETTKVMEANATSSKEDNHVMHTLDGSMSTVWEENSPGGGVGEVLSYKFASPMHIGRILIVNGDTSSKENYYKKNRIAKADVKYYNRNKLVLFQKIELGDTYTKKPHHIEIDKKLDVDRIDIEVTEVHQGQNKDILALSEVTFGNIERDIFEKKFKEIKDKWVTDKQADEFIETADKYADKAVQMSAVASRAEYYRMYVSRKYHYKKEFVEKLKQVYKESGASHVTSKKDVMLAFDDAKKKSTIGRQENGLFVTSFAEDMALLFTDQGKLKSADQIENIKDVDSGKYSDGVYQYEYDSELTKNIDKLGYIRTASGDTPGANSLNVPGCQTWSGKHIENSESELIFPSISVKDLKSKAVLAEIDAKGYFEIIDPTIIAPNGDHKKVTGRFKIKKMQDRK

SEQ ID NO: 7321 - DNA, 402 bp, Streptococcus pyogenes
ttgataggtagtgacaaagagtatcgtatcactagaagagactcttatatggaagatatttctgatccagaagttattttagagtatggggtttaccctgctttcataaaaggctatacccaattgaaagctaacatcgaagaagcattattagaaatgtcaaatagcggtcaagcattagacatttaccaagcagttcaaaccctaaacgctgaaaacatgttattaaattattacgaaagcttgccattttatttaaaccgtcaaagcatactagctaatatgaccaaagcgttaaaagatgcgcatattagagaggctatggcacattacaaattaggagaatttgctcactatcaagatactatgcttgatatggtcgaaagaacaataaaaacattt

SEQ ID NO: 7322 - protein, 134 aa, Streptococcus pyogenes
LIGSDKEYRITRRDSYMEDISDPEVILEYGVYPAFIKGYTQLKANIEEALLEMSNSGQALDIYQAVQTLNAENMLLNYYESLPFYLNRQSILANMTKALKDAHIREAMAHYKLGEFAHYQDTMLDMVERTIKTF

SEQ ID NO: 7323 - DNA, 1722 bp, Streptococcus pyogenes
atgaaggacatgtctaataaaaaaacatttaaaaaatacagtcgcgtcgctgggctactgacggcagctcttatcattggtaaccttgttactgctaatgctgaatcgaacaaacaaaacactgctagtacagaaaccacaacgacaaatgagcaaccaaagccagaaagtagtgagctaactactgaaaaagcaggtcagaaaacggatgatatgcttaactctaacgatatgattaagcttgctcccaaagaaatgccactagaatctgcagaaaaagaagaaaaaaagtcagaagacaaaaaaaagagcgaagaagatcacactgaagaaatcaatgacaagatttattcactaaattataatgagcttgaagtacttgctaaaaatggtgaaaccattgaaaattttgttcctaaagaaggcgttaagaaagctgataaatttattgtcattgaaagaaagaaaaaaaatatcaacactacaccagtcgatatttccattattgactctgtcactgataggacctatccagcagcccttcagctggctaataaaggttttaccgaaaacaaaccagacgcggtagtcaccaagcgaaacccacaaaaaatccatattgatttaccaggtatgggagacaaagcaacggttgaggtcaatgaccctacctatgccaatgtttcaacagctattgataatcttgttaaccaatggcatgataattattctggtggtaatacgcttcctgccagaacacaatatactgaatcaatggtatattctaagtcacagattgaagcagctctaaatgttaatagcaaaatcttagatggtactttaggcattgatttcaagtcgatttcaaaaggtgaaaagaaggtgatgattgcagcatacaagcaaattttttacaccgtatcagcaaaccttcctaataatcctgcggatgtgtttgataaatcggtgacctttaaagagttgcaacgaaaaggtgtcagcaatgaagctccgccactctttgtgagtaacgtagcctatggtcgaactgtttttgtcaaactagaaacaagttctaaaagtaatgatgttgaagcggcctttagtgcagctctaaaaggaacagatgttaaaactaatggaaaatattctgatatcttagaaaatagctcatttacagctgtcgttttaggaggagatgctgcagagcacaataaggtagtcacaaaagactttgatgttattagaaacgttatcaaagacaatgctaccttcagtagaaaaaacccagcttatcctatttcatacaccagtgttttccttaaaaataataaaattgcgggtgtcaataacagaactgaatacgttgaaacaacatctaccgagtacactagtggaaaaattaacctgtctcatcaaggcgcgtatgttgctcaatatgaaatcctttgggatgaaatcaattatgatgacaaaggaaaagaagtgattacaaaacgacgttgggacaacaactggtatagtaagacatcaccatttagcacagttatcccactaggagctaattcacgaaatatccgtatcatggctagagagtgcactggcttagcttgggaatggtggcgaaaagtgatcgacgaaagagatgtgaaactgtctaaagaaatcaatgtcaatatctcaggatcaaccttgagcccatatggttcgattacttataag

SEQ ID NO: 7324 - protein, 574 aa, Streptococcus pyogenes
MKDMSNKKTFKKYSRVAGLLTAALIIGNLVTANAESNKQNTASTETTTTNEQPKPESSELTTEKAGQKTDDMLNSNDMIKLAPKEMPLESAEKEEKKSEDKKKSEEDHTEEINDKIYSLNYNELEVLAKNGETIENFVPKEGVKKADKFIVIERKKKNINTTPVDISIIDSVTDRTYPAALQLANKGFTENKPDAVVTKRNPQKIHIDLPGMGDKATVEVNDPTYANVSTAIDNLVNQWHDNYSGGNTLPARTQYTESMVYSKSQIEAALNVNSKILDGTLGIDFKSISKGEKKVMIAAYKQIFYTVSANLPNNPADVFDKSVTFKELQRKGVSNEAPPLFVSNVAYGRTVFVKLETSSKSNDVEAAFSAALKGTDVKTNGKYSDILENSSFTAVVLGGDAAEHNKVVTKDFDVIRNVIKDNATFSRKNPAYPISYTSVFLKNNKIAGVNNRTEYVETTSTEYTSGKINLSHQGAYVAQYEILWDEINYDDKGKEVITKRRWDNNWYSKTSPFSTVIPLGANSRNIRIMARECTGLAWEWWRKVIDERDVKLSKEINVNISGSTLSPYGSITYK

SEQ ID NO: 7325 - DNA, 426 bp, Streptococcus pyogenes
atgaaacaacaatcttaccagcctctacgcttcgtctacctcttggtggctctatttgctgctctgttgcttatagcaagacctgttatggcagatgagggaacaaatagtgctgatgcggcgtattataaagggcaaagtgctggaaaaaaagcagggaaaaaagctggaaaagaagctacttggactgatttgaccccaactgtcccaactaatccagaaacacctagtgacatcggagagactactaataaacagctctataaagaagggtataaagatgggtacaaagagggttataatgaaggctggaaatctcagtatcccgttttgactccggtcaaggttatatgggatttgatctcttattggctacagcgattattccccaataatcagtcaagtaccgcagcacaaagcatgtca

SEQ ID NO: 7326 - protein, 142 aa, Streptococcus pyogenes
MKQQSYQPLRFVYLLVALFAALLLIARPVMADEGTNSADAAYYKGQSAGKKAGKKAGKEATWTDLTPTVPTNPETPSDIGETTNKQLYKEGYKDGYKEGYNEGWKSQYPVLTPVKVIWDLISYWLQRLFPNNQSSTAAQSMS

SEQ ID NO: 7327 - DNA, 198 bp, Streptococcus pyogenes
atgaaaaagaaattatctttatttatgatcgcaactgctgctgtcgtaagccttagccttgcaacaccagaaaaccaaactgtttcagcatacgaagtgaccgcaactagagatgccagcgtgtgttggacttgttgccctctaacctgcttaaagtataatgtagaagactggtacaaagcagtaacaagtttcttc

SEQ ID NO: 7328 - protein, 66 aa, Streptococcus pyogenes
MKKKLSLFMIATAAVVSLSLATPENQTVSAYEVTATRDASVCWTCCPLTCLKYNVEDWYKAVTSFF

SEQ ID NO: 7329 - DNA, 165 bp, Streptococcus pyogenes
atgaaaaagaaattatctttatttatgatcgcaactgctgctgttgcaggccttagccttgcaacactaggagaccaccaaactgtttcagcaaatgatgctagctatagtaacggtttctacggacacactggtcctgacagctggttactttacactgtatgg

SEQ ID NO: 7330 - protein, 55 aa, Streptococcus pyogenes
MKKKLSLFMIATAAVAGLSLATLGDHQTVSANDASYSNGFYGHTGPDSWLLYTVW

SEQ ID NO: 7331 - DNA, 1389 bp, Streptococcus pyogenes
gtgttggcagcttggtcaaagatgataaaagggcttgcaaacttagctaaaggttgtataataaacgtaatcgatctaaaaatgatattgttggaaaaattcattatccatttaaaaggtgcccactacttttcttataggttagcagatcacgcttttttgaagagctttttggtttgtgcaaccattggggtgggaccattgtctaaaagagagttcattggagttaacgctattgcggaggtgtacgaaatgagagaaaatacgaccttattacatggctatacggttattgatgagtttacaggagcagcttcagttcccatctatcagacttcgacgttccacaattcagaactgtattgtcctagtcaaaaacatttgtacacacgcttttcaaacccaacgactgaagctttagaagacgggttagcctgtttagaaaaagcgacttatgcggtggcttatgcatctggtatggctgctatttcaactgttttgatgctcttaaaagctggagatcatgtgattttcccattggaggtctatggagggacttgccaatttgcgacagctattttacccaattatcagattgaaacaagctttgtagatatggctgatttagcaacagtaaaagcaagtatcaggcctaatacgcgtatgatttatctagagacaccgtcaaatccgctcttgaaaatttgtgatatttcagagcttgtgcaactcgccaaagcttatggtgtgctaactgtggctgataatacctttatgacaagtttgtatcaagaacccttagctatgggtgtggatattgtggtagaaagtgtgaccaaatttatcaatggtcatagtgatgtggtagctggtttagctgctaccaataatgaggctatctacaaccagctcaagctttttcaaaaaaactttggagcaattgttggggtcgaagacgcttggctgattcttcgtggcatgaaaactatggggatccgtatggaacaagcggtaaaaaatgctcagcagctcgctaactatttagcgaagcaccccaaagttcttaaggtacattaccctggcttagacagtcatcctaatcacgacacccacctgcaacaagctaagaatggtggtgctgttttatcctttgagttggcttctaaggaggagctgatgacctttacccatcgtattcagttgccgattttagccgttagtctaggtggagtagagtccattttgtcacatccagcaacgatgtctcatgcttgtttatcaccacaagcgcggttggaacaaggggttgttgatggtttgctgcgcttgtcttgtggtgttgaaaatatcgaagacttattagccgattttgagcaagcacttgctttt

SEQ ID NO: 7332 - protein, 463 aa, Streptococcus pyogenes
VLAAWSKMIKGLANLAKGCIINVIDLKMILLEKFIIHLKGAHYFSYRLADHAFLKSFLVCATIGVGPLSKREFIGVNAIAEVYEMRENTTLLHGYTVIDEFTGAASVPIYQTSTFHNSELYCPSQKHLYTRFSNPTTEALEDGLACLEKATYAVAYASGMAAISTVLMLLKAGDHVIFPLEVYGGTCQFATAILPNYQIETSFVDMADLATVKASIRPNTRMIYLETPSNPLLKICDISELVQLAKAYGVLTVADNTFMTSLYQEPLAMGVDIVVESVTKFINGHSDVVAGLAATNNEAIYNQLKLFQKNFGAIVGVEDAWLILRGMKTMGIRMEQAVKNAQQLANYLAKHPKVLKVHYPGLDSHPNHDTHLQQAKNGGAVLSFELASKEELMTFTHRIQLPILAVSLGGVESILSHPATMSHACLSPQARLEQGVVDGLLRLSCGVENIEDLLADFEQALAF

SEQ ID NO: 7333 - DNA, 144 bp, Streptococcus pyogenes
ttgttaatcattgtttgggcaagtccttttgacttgtccttttcgatgaactgtttaaacgccaatgagcacaaactggatgaaccgtatgttgtggagttcttagagaccagatataaggtgttggtgttggatcagttgagg

SEQ ID NO: 7334 - protein, 48 aa, Streptococcus pyogenes
LLIIVWASPFDLSFSMNCLNANEHKLDEPYVVEFLETRYKVLVLDQLR

SEQ ID NO: 7335 - DNA, 99 bp, Streptococcus pyogenes
atggcctttgccaacctttaccttgttaggattgctctttatttacaatcaagggttatggaagcagctaatgaatacctttactctggtgttagtagc

SEQ ID NO: 7336 - protein, 33 aa, Streptococcus pyogenes
MAFANLYLVRIALYLQSRVMEAANEYLYSGVSS

SEQ ID NO: 7337 - DNA, 297 bp, Streptococcus pyogenes
ttgttcctcacctgggaaaatctctttcttacaaatcaatcgcgtcgtcgcttgaaactattagtggttgagagaagttataacaatgttggcaacttcttaaaagagtattttggaggattttttgagattgtcaactttgatgacttgaggctgaccatggttgatatggtgtcactgtcttcagagtatgacgtaattgtgacagatatgattcttgagcaaacaacggactccgaaattttatttttcaatcagatggcccctagtgtggtggcgaatagattgacagacatg

SEQ ID NO: 7338 - protein, 99 aa, Streptococcus pyogenes
LFLTWENLFLTNQSRRRLKLLVVERSYNNVGNFLKEYFGGFFEIVNFDDLRLTMVDMVSLSSEYDVIVTDMILEQTTDSEILFFNQMAPSVVANRLTDM

SEQ ID NO: 7339 - DNA, 1332 bp, Streptococcus pyogenes
gtgaaaaagtatttaaatcaaaatgtttatgatgcattgatagaaagattacattttttgtttaatgattttcctattgtctatatttccttctcaggtggaaaagatagtgggttacttcttaatattttactggattttagagataaatattatccggatagagaaataggtgtgtttcatcaagattttgaagcacagtacagtttaacaacaaaatatgttcaagaaacattcacttctttagaaggtagaaaaaaagtttctttgtattgggtgtgcttaccgatggctactagaactgcacttagtagttatgaaatgttttggtatccgtgggatgacaaaacagaagatatctgggtaagaccaatgccatctcaagattatgttattaatttggaaaataattcaattactacttatcgttataaaatgaatcaggaggatttagcgaaacaatttggtaggtggtataaacaaattcacggaaatcaaaaaacagtttgtatattaggaaaccgtgcttcagaatccttacacagatatagtggttttatcaataaaaagtatggttatcaaaaggaatgctggattaccaaacaattcaaagatgtctggacagcatctcccttatatgattggtcagtggaagacatatggcatgcttactataagttttcttattcttataacgaactttatgatctattttataaagcgggtttaaaaccatcacaaatgagagttgcatctccttttcaagactatgctgttgatagcctaaatctttatagaataatagatcaagaaacttgggtaaagcttttgggacgtgttcaaggagttaacttttcgaatatttatggacgtactaaagcaatgggatataaatcaattgctttaccaaagggtcattcgtggaagtcgtatactcagtttcttttatcaacgctaccagtgaggttaagaaataattatgttagaaaatttaataaatcaatagacttttggcataaaacaggcggaggacttgcggaggaaacaattaatgaactaattgaaaaaggatatcgtattgctagaaatggtatttcaaattatacctcttttaaacattcaagggttatttttttagatcaaattcctgatgatacagacgatattgtaacaacaaaggatataccaagctggaaacgaatgtgtttctgtattttaaaaaacgatcatatttgtcgaactatggggtttggtttgacaagagagcaacaaaaaatagtagcctttttaaaagagaaatataagacgagtttaaaggagttagaaagtgag

SEQ ID NO: 7340 - protein, 444 aa, Streptococcus pyogenes
VKKYLNQNVYDALIERLHFLFNDFPIVYISFSGGKDSGLLLNILLDFRDKYYPDREIGVFHQDFEAQYSLTTKYVQETFTSLEGRKKVSLYWVCLPMATRTALSSYEMFWYPWDDKTEDIWVRPMPSQDYVINLENNSITTYRYKMNQEDLAKQFGRWYKQIHGNQKTVCILGNRASESLHRYSGFINKKYGYQKECWITKQFKDVWTASPLYDWSVEDIWHAYYKFSYSYNELYDLFYKAGLKPSQMRVASPFQDYAVDSLNLYRIIDQETWVKLLGRVQGVNFSNIYGRTKAMGYKSIALPKGHSWKSYTQFLLSTLPVRLRNNYVRKFNKSIDFWHKTGGGLAEETINELIEKGYRIARNGISNYTSFKHSRVIFLDQIPDDTDDIVTTKDIPSWKRMCFCILKNDHICRTMGFGLTREQQKIVAFLKEKYKTSLKELESE

SEQ ID NO: 7341 - DNA, 528 bp, Streptococcus pyogenes
gtgagtaattttattagtccagtctatgagattaaatcaattccaattgaaaagatttctccaaatgattataatccgaattcagttgctccgcctgaaatgaaattattgtatgatagtataaaatctgatggttatactatgccgattgtttgctattacgataaggaagaggatcggtatagtattgttgatggttttcatagatatcgtataatgctagattattcagatatttatgaaagggaaagtgggagattacctgtttctgttattgataagtcattagactatcgaatggcttctaccattcgacataatagagctagaggaagtcatgatgttgatttgatgagtcagattgtaaaggatcttcatgagtgtgggcgaagtgataactggattgcaaaacatttaggaatggataaagatgaaattttaagactgaaacaaataacaggattggcttctctttttaaggaccatgagtttaatcaatcttgggaaccagaagagctattaaatgag

SEQ ID NO: 7342 - protein, 176 aa, Streptococcus pyogenes
VSNFISPVYEIKSIPIEKISPNDYNPNSVAPPEMKLLYDSIKSDGYTMPIVCYYDKEEDRYSIVDGFHRYRIMLDYSDIYERESGRLPVSVIDKSLDYRMASTIRHNRARGSHDVDLMSQIVKDLHECGRSDNWIAKHLGMDKDEILRLKQITGLASLFKDHEFNQSWEPEELLNE

SEQ ID NO: 7343 - DNA, 108 bp, Streptococcus pyogenes
atgcaagacaagttggtaacagaagctttcaatcaagcttataatagagaaaagcctaaagaaggggtaatcgtccatacagatcagggttctcaatataccggagca

SEQ ID NO: 7344 - protein, 36 aa, Streptococcus pyogenes
MQDKLVTEAFNQAYNREKPKEGVIVHTDQGSQYTGA

SEQ ID NO: 7345 - DNA, 291 bp, Streptococcus pyogenes
atgccaagaaaaacctttgataaagccttcaaactctctgctgtaaaactcatccttgaggaagagcagtctgtaaaaatggttagttcaactttagaaattcatcccaatagtctttatcaatggattcaagaatatgaaaaatatggagaaagtgcgttcccaggacatgggagcgcacttcgtcatgctcaatttgagacaaaaaaacttgaaaaagagcacaaactgctacaggaggaattagctcttctaaaaaagttccaggtctttttgaagccaaaccggaaa

SEQ ID NO: 7346 - protein, 97 aa, Streptococcus pyogenes
MPRKTFDKAFKLSAVKLILEEEQSVKMVSSTLEIHPNSLYQWIQEYEKYGESAFPGHGSALRHAQFETKKLEKEHKLLQEELALLKKFQVFLKPNRK

SEQ ID NO: 7347 - DNA, 1308 bp, Streptococcus pyogenes
atgattcatttaataataattagcgccattgctctagccattggaattggttaccgcaccaaaatcaatattggcctgctggctattgctttttcttacctcatcgcaaccactctcatgggattaagccccaaagaacttcttcatttttggccaacctcactcttttttaccatttttagcgtctctctcttttataacgttgcaacaactaacggcactcttgatgttttggctcaacacattctctaccgcacacgcacccaccctaacgccctctacatgattttatacctgatagcaacccttttgtctgctttaggtgctggatttttcactactatggccgtttgctgtcctctagcgattaccctctgtcaaaaagcggacaaacaccctttgattggagctcaagccgtcaattggggagcttcaggaggggctaatttgataaccagtggctcaggcattgtctttcaaggcctgtttaagcaaatgggatgggaagagcaagctttttcacttggcaatcatatctttatcgtcagcattatctacccactcatcgtcttgcttttattatcttgttacatccgctacagtaagggaagaacaaactcatccttgactattgaccaaccaccagtcctcagcaaggtccaaagacaaaccaccttgctcatgatcagcagcatggttttggtttggctttttcccttgttgcttctcattttcccaaacatcgcatggatagctacttatcgacaaacatttgatattggctttgtctcaatactcatggtctgcctcgccttaaggctcaaattagggaagcaagaagccattttggctaaggttccctgggctataattatcatgctctgcggtatgagcttactaatgtctctagcggtcaagtcaggtttagttacactgatagggcacctcataacaacaaccattcctcatttctggttacctctgttcttttgtgtgatagccggagtgatgtcactctttagttccaccctatccgtcgtagccccaactctctttcccatcattgctaccatcagtgctcaaagtcctcacattgatattcgcttactcacaacagccactattattggcgctctatctactaatatctctcctttttcatcagctggttccctcattcaactctcccttccccatatagaggaacgcagtcttgctttcaaaaaacaaattcttctgggtgtgcccatcagcttaagtttggcactcttgaccatctggattctcatgctgctagcttccttaagt

SEQ ID NO: 7348 - protein, 436 aa, Streptococcus pyogenes
MIHLIIISAIALAIGIGYRTKINIGLLAIAFSYLIATTLMGLSPKELLHFWPTSLFFTIFSVSLFYNVATTNGTLDVLAQHILYRTRTHPNALYMILYLIATLLSALGAGFFTTMAVCCPLAITLCQKADKHPLIGAQAVNWGASGGANLITSGSGIVFQGLFKQMGWEEQAFSLGNHIFIVSIIYPLIVLLLLSCYIRYSKGRTNSSLTIDQPPVLSKVQRQTTLLMISSMVLVWLFPLLLLIFPNIAWIATYRQTFDIGFVSILMVCLALRLKLGKQEAILAKVPWAIIIMLCGMSLLMSLAVKSGLVTLIGHLITTTIPHFWLPLFFCVIAGVMSLFSSTLSVVAPTLFPIIATISAQSPHIDIRLLTTATIIGALSTNISPFSSAGSLIQLSLPHIEERSLAFKKQILLGVPISLSLALLTIWILMLLASLS

SEQ ID NO: 7349 - DNA, 897 bp, Streptococcus pyogenes
gtgatattaaaaatagaggacttagtgatgtcaatcatttcaactgatttaaccccttttcaaatagatgatacattgaaagcagccttgcgagaagatgttcattccgaagattacagtaccaatgccatttttgatcatcatggccaagccaaggtgtcgctttttgccaaggaagctggtgttttagcggggctaaccgtttttcaaagggtttttaccctatttgatactgaggtgaccttccagaatcctcatcaatttaaggatggggatcgtttgactagtggcgatttggttttagaaatcataggctcggtgagaagcctcttaacatgtgaacgcgttgccttgaattttttacaacatttatcagggattgcttcgatgacagctgcttatgtagaagccttaggcgatgatcgcattaaggtatttgatactcgaaaaaccactcctaatttacgtctttttgagaaatatgccgtgagagttggcggtggctataatcatcgctttaatttatcagatgctatcatgctaaaagacaatcacattgcggcagtaggtagtgttcaaaaggcgattgctcaagcgcgtgcctatgccccttttgtgaaaatggtcgaggtggaagtggaaagccttgctgctgccgaagaagctgcggcggcgggtgttgatattatcatgttggataatatgtcattggaacagattgaacaggccattactctaattgcaggacgttctcggattgaatgttctggaaatattgatatgaccactattagccgttttcgtggtttagcgattgattacgtctccagtggtagtttaacccatagtgctaagagtctcgatttttccatgaagggtttaacctaccttgatgtc

SEQ ID NO: 7350 - protein, 299 aa, Streptococcus pyogenes
VILKIEDLVMSIISTDLTPFQIDDTLKAALREDVHSEDYSTNAIFDHHGQAKVSLFAKEAGVLAGLTVFQRVFTLFDTEVTFQNPHQFKDGDRLTSGDLVLEIIGSVRSLLTCERVALNFLQHLSGIASMTAAYVEALGDDRIKVFDTRKTTPNLRLFEKYAVRVGGGYNHRFNLSDAIMLKDNHIAAVGSVQKAIAQARAYAPFVKMVEVEVESLAAAEEAAAAGVDIIMLDNMSLEQIEQAITLIAGRSRIECSGNIDMTTISRFRGLAIDYVSSGSLTHSAKSLDFSMKGLTYLDV

SEQ ID NO: 7351 - DNA, 126 bp, Streptococcus pyogenes
ttgattaaatttcataaaaaaatagcaccccaatcgttagattttgtgtctaacttttggggtgcagttcaagggctatttttatggatggaggatttatttagtctttttgatcgtcatacatca

SEQ ID NO: 7352 - protein, 42 aa, Streptococcus pyogenes
LIKFHKKIAPQSLDFVSNFWGAVQGLFLWMEDLFSLFDRHTS

SEQ ID NO: 7353 - DNA, 156 bp, Streptococcus pyogenes
atgagacagctaaccattattttgactatacttttttgggaaagcatgacaaattatggattttttgataaaatgataggcgctagaacaacatgtcatcttgaagcccttcattatgatggaaactcaggcagatcaaaaaagctcaagactgtt

SEQ ID NO: 7354 - protein, 52 aa, Streptococcus pyogenes
MRQLTIILTILFWESMTNYGFFDKMIGARTTCHLEALHYDGNSGRSKKLKTV

SEQ ID NO: 7355 - DNA, 120 bp, Streptococcus pyogenes
ttggaattgaccttgaccaagagtatcggtgcctacattatcataccccgcttgatattgttgggctcaaatgtgcttcttgtcagacttattatgcttgttaccattgccatgaccagt

SEQ ID NO: 7356 - protein, 40 aa, Streptococcus pyogenes
LELTLTKSIGAYIIIPRLILLGSNVLLVRLIMLVTIAMTS

SEQ ID NO: 7357 - DNA, 105 bp, Streptococcus pyogenes
atggggagagggaaagattttcaaaaagcaaaatcgtgtttggaaagggtcatgatttttctaggtattcagtccatcttgtcccaaaatgaagctatgctcact

SEQ ID NO: 7358 - protein, 35 aa, Streptococcus pyogenes
MGRGKDFQKAKSCLERVMIFLGIQSILSQNEAMLT

SEQ ID NO: 7359 - DNA, 702 bp, Streptococcus pyogenes
atgaaaacaaacattttgacaattatcatattatcatgtgtttttagctatggaagtcaattagcttatgcagatgaaaatttaaaagatttaaaaagaagtttaagatttgcctataatattaccccatgcgattatgaaaatgtagaaattgcatttgttactacaaatagcatacatattaatactaaacaaaaaagatcggaatgtattctttatgttgattctattgtatctttaggcattactgatcagtttataaaaggggataaggtcgatgtttttggtctcccttataatttttccccaccttatgtagataatatttatggtggtattgtaaaacattcgaatcaaggaaataaatcattacagtttgtaggaattttaaatcaagatgggaaagaaacttatttgccctctgaggctgttcgcataaaaaagaaacagtttactttacaggaatttgattttaaaataagaaaatttctaatggaaaaatacaatatctatgattcggaatcgcgttatacatcggggagccttttccttgctactaaagatagtaaacattatgaagttgatttatttaataaggatgataagcttttaagtcgagacagtttctttaaaaggtataaagataataagatttttaatagtgaagaaattagtcattttgatatctacttaaaaacgcac

SEQ ID NO: 7360 - protein, 234 aa, Streptococcus pyogenes
MKTNILTIIILSCVFSYGSQLAYADENLKDLKRSLRFAYNITPCDYENVEIAFVTTNSIHINTKQKRSECILYVDSIVSLGITDQFIKGDKVDVFGLPYNFSPPYVDNIYGGIVKHSNQGNKSLQFVGILNQDGKETYLPSEAVRIKKKQFTLQEFDFKIRKFLMEKYNIYDSESRYTSGSLFLATKDSKHYEVDLFNKDDKLLSRDSFFKRYKDNKIFNSEEISHFDIYLKTH

SEQ ID NO: 7361 - DNA, 117 bp, Streptococcus pyogenes
atgatatttttaggaaatatgaaatcctattttctcttaaaaaaccactatgatgagaatatgcttgcattgacacatgttttatgtctgaaaaaacgaaaaccttttcaaaaaacc

SEQ ID NO: 7362 - protein, 39 aa, Streptococcus pyogenes
MIFLGNMKSYFLLKNHYDENMLALTHVLCLKKRKPFQKT

SEQ ID NO: 7363 - DNA, 90 bp, Streptococcus pyogenes
gtggctagtttcttgtcagccttgaacctttttcctaatttatggtatgataagaagatgatgaaaaaagagattctcaaagaactcttc

SEQ ID NO: 7364 - protein, 30 aa, Streptococcus pyogenes
VASFLSALNLFPNLWYDKKMMKKEILKELF

SEQ ID NO: 7365 - DNA, 105 bp, Streptococcus pyogenes
atggatgtagacttaaaacgtcaaaatgatcaagctttattagtggatgttgttagcaatcaagcttatcagcgggccaatacgattgccaaatcaaacgattta

SEQ ID NO: 7366 - protein, 35 aa, Streptococcus pyogenes
MDVDLKRQNDQALLVDVVSNQAYQRANTIAKSNDL

SEQ ID NO: 7367 - DNA, 117 bp, Streptococcus pyogenes
atgttttttctcttgcttgctattataccatatcagaaaagaaagcttgactgctttattgttcaccaaaaaactccgctaagacgcggagctgatgccatctattcaaagacaaat

SEQ ID NO: 7368 - protein, 39 aa, Streptococcus pyogenes
MFFLLLAIIPYQKRKLDCFIVHQKTPLRRGADAIYSKTN

SEQ ID NO: 7369 - DNA, 744 bp, Streptococcus pyogenes
ttgtatcaagttattcatacaaacaaggagagtaagatggtcgacaatagaatgagatttacgattgatcaaaacatgcaatttccactagttgagattgatctggaacatgggggatcagtttacttacaacaaggaagtatggtttatcatactgagaatgtaaccttgaataccaaattgaatggtaagggatctggtttaggaaaattagttggagccatcggccgttccatggtttctggtgaatcaatgttcattacacaagctatgtcaaatggagatggtaaattagcattagcacccaatacaccaggacagattgttgctttagaactaggtgaaaaacaatatcgtctaaatgatggtgcctttctagccctagatggttcagcacagtacaaaatggaacgtcaaaatattggaaaagcactttttggtggtcaaggcggactttttgtcatgacaactgaaggccttggtaccttacttgctaactcgtttggatctatcaagaaaatcacacttgatggtggcacaatgactattgataatgcccatgttgtagcatggagcagagaacttgattatgatattcatttagaaaatggctttatgcagtcaattggtacaggtgaaggagttgttaatacctttagaggtcatggtgagatttatatccaaagtcttaaccttgagcaatttgctgggactcttaaacgttatctaccaactagttcaaat

SEQ ID NO: 7370 - protein, 248 aa, Streptococcus pyogenes
LYQVIHTNKESKMVDNRMRFTIDQNMQFPLVEIDLEHGGSVYLQQGSMVYHTENVTLNTKLNGKGSGLGKLVGAIGRSMVSGESMFITQAMSNGDGKLALAPNTPGQIVALELGEKQYRLNDGAFLALDGSAQYKMERQNIGKALFGGQGGLFVMTTEGLGTLLANSFGSIKKITLDGGTMTIDNAHVVAWSRELDYDIHLENGFMQSIGTGEGVVNTFRGHGEIYIQSLNLEQFAGTLKRYLPTSSN

SEQ ID NO: 7371 - DNA, 123 bp, Streptococcus pyogenes
ttgctgtcattatcacgtaagcatctcaccacctctctttcaaatccaatctccaaaatagaaataaactatactattttttactttaccaaggtagcaagctcagataacgataaaaaagac

SEQ ID NO: 7372 - protein, 41 aa, Streptococcus pyogenes
LLSLSRKHLTTSLSNPISKIEINYTIFYFTKVASSDNDKKD

SEQ ID NO: 7373 - DNA, 1344 bp, Streptococcus pyogenes
atggctaatagcgaatatatgtttttattattatcaattattgtctattatatgacaaaaatttatattttttcctttctatctgatatcacattaccagtttggaaacaactaacgattttggctttagccctatttttcaatcagttcccgtatttgtcgccattgctaattgatcctctattatttttagttgttttaaggcaagaaaccaagcaattattttctttgaaagctctttttttggctgttgcacctagtgttttggtggatttgctatctcgatttatgggtacaatcgttatcccctatctttttttgtcgagtggtatttatctgggtcatattatctttgacttgcttgcttatctgctgatttttccaagttttgctattattaattatatgattggaaaagattacaagatgatatgccaatccggatattcgaaacgatcgcataatttctatcaaacattgctgatgtttgttttggtttattatgtggacatttttgtcattttaggatttacggacccctttttacattttcatcattctctttttgttcccacaccttataagttattgtttttgatgtttatacttcttttagtttatcttctatcttattttaatcatagttctaaagaataccttaaaaatgagttgagaagagaacaacaagcttatatgactaacttagagatttatgggaaacatcttgagaaactctatcgagatgtaagagcttttcaaagtgattacctgagccgtatagagcgtttaggtcaagccattaagagtgaatccattactcagattcaagatatttatgcccaaacggttcatgaagctaacgactactgggatgataaacactataatatctcgaagcttaggaaaattaatatctcatcgattaagagcttattgtcagctaaaattatcagtgcggaaaaatcaggtattgatttgaatgtggaagtgccagataatataaaagaaacttacattcctgagttggacttactattgttgatgtctattttttgtgataacgccattgaggcagctcttgaagcacaacaacctcatatgtcaattgcttactttttgttaggtgactatcagatgtttgttgtgacaaatacgactaaaaaaaaggtagacattaacaagatctttgaagaaggctattcttcaaaaggttcagaacgtggtatcggcctttctaatgcgcagcgtattctcaaaaagtatccttatttatccttgcggactaaaagttttgataaggaatttagccaaaccttgaccatgccaaaggaggaggtggataga

SEQ ID NO: 7374 - protein, 448 aa, Streptococcus pyogenes
MANSEYMFLLLSIIVYYMTKIYIFSFLSDITLPVWKQLTILALALFFNQFPYLSPLLIDPLLFLVVLRQETKQLFSLKALFLAVAPSVLVDLLSRFMGTIVIPYLFLSSGIYLGHIIFDLLAYLLIFPSFAIINYMIGKDYKMICQSGYSKRSHNFYQTLLMFVLVYYVDIFVILGFTDPFLHFHHSLFVPTPYKLLFLMFILLLVYLLSYFNHSSKEYLKNELRREQQAYMTNLEIYGKHLEKLYRDVRAFQSDYLSRIERLGQAIKSESITQIQDIYAQTVHEANDYWDDKHYNISKLRKINISSIKSLLSAKIISAEKSGIDLNVEVPDNIKETYIPELDLLLLMSIFCDNAIEAALEAQQPHMSIAYFLLGDYQMFVVTNTTKKKVDINKIFEEGYSSKGSERGIGLSNAQRILKKYPYLSLRTKSFDKEFSQTLTMPKEEVDR

SEQ ID NO: 7375 - DNA, 102 bp, Streptococcus pyogenes
ttgcacagttaccaaaaaatgggcgaaaaagtagtaagaaaacatggcagtattcatccaaaatacccactttttcatcttatcttcactgataaaccttat

SEQ ID NO: 7376 - protein, 34 aa, Streptococcus pyogenes
LHSYQKMGEKVVRKHGSIHPKYPLFHLIFTDKPY

SEQ ID NO: 7377 - DNA, 1281 bp, Streptococcus pyogenes
atgatggttatatacagtatggctttattctatgctaccatctttattaacagctgggtcatttttgcaaaggtttctgctattaaactaagctggaaacgggttagcattataggcattagttttgtaattgctaatatgatatttgacaaagtcattttgattgaccaactgttctttattattgttagtttgttaagtgctccgaaaaagaaattatttgagcatatgtttaatggtttctttactatcttgattgtcgaattactgtttcgcgtcatcggatctttctttttaccagctgtcttaggatttagcattggtcaaattaataataaccttaagcttttagagttatgttatctttttgtattaccaatattttatctgtttagctacattttcagtattgacttaagcttaataaggtttatcagtgaagataagatgaaaaagtgggtattttggatgaatactgccatgttttcttactactttttcgcccattttttggtaactgtgcaaagcggatttcttgcactatatttccagtaccggtctattttagtatttatttatttagctatttttatttgggttattgtgaaattagatcgatttgctaaagatcagctgtcacaaaaattaacacaagcacaaaatgaacgtattgcgtatcttgaaaattacaatcaatcgattgagcaactttaccgagaaatcagaacagttaaacatgattctgaaaatattttaattagtctaaaagatagtatcgatagtggtgatatagatctgattactagagtttatgacacggttattcagcaatcggcaacttctatgatgcgcacaaattatgaaatatcttctttagacaatatcaaagaggctgtgattcgcagtatcatgaattccaaattgcttgaagctcagtatttgggtattgaactttatattgagattccagatgttatcgatcatttacctattaagttaatcgacttaattgtactttttactggactagtggacaatgctattgagacagccaaaggcagtagacgtccttttttatctattgcatactttaaacaagataacaagcaattatttattattgaaaatagcacaaaaaccaatcgtgtggatatagccaaacgctttgatgctcagcagcagaactcagcccactttttgactgttttagatagttacccccaaataacgctttcgactaaaagtgaccattatcgattaagacaattgttagaaatgaga

SEQ ID NO: 7378 - protein, 427 aa, Streptococcus pyogenes
MMVIYSMALFYATIFINSWVIFAKVSAIKLSWKRVSIIGISFVIANMIFDKVILIDQLFFIIVSLLSAPKKKLFEHMFNGFFTILIVELLFRVIGSFFLPAVLGFSIGQINNNLKLLELCYLFVLPIFYLFSYIFSIDLSLIRFISEDKMKKWVFWMNTAMFSYYFFAHFLVTVQSGFLALYFQYRSILVFIYLAIFIWVIVKLDRFAKDQLSQKLTQAQNERIAYLENYNQSIEQLYREIRTVKHDSENILISLKDSIDSGDIDLITRVYDTVIQQSATSMMRTNYEISSLDNIKEAVIRSIMNSKLLEAQYLGIELYIEIPDVIDHLPIKLIDLIVLFTGLVDNAIETAKGSRRPFLSIAYFKQDNKQLFIIENSTKTNRVDIAKRFDAQQQNSAHFLTVLDSYPQITLSTKSDHYRLRQLLEMR

SEQ ID NO: 7379 - DNA, 120 bp, Streptococcus pyogenes
ttgattattgttgctattgataaggtttcaacggtaaggcaaaggaacagtgtcaaagaagagacactttatgaaatgagcggcctcttaaatgagagagaaactgttgaaaaacgaaaa

SEQ ID NO: 7380 - protein, 40 aa, Streptococcus pyogenes
LIIVAIDKVSTVRQRNSVKEETLYEMSGLLNERETVEKRK

SEQ ID NO: 7381 - DNA, 90 bp, Streptococcus pyogenes
ttgcgttgctgttttatttttggtggttatactctttttgtacgcttatcctcaggccgtcaaaagagacctttccctatctacgctgtt

SEQ ID NO: 7382 - protein, 30 aa, Streptococcus pyogenes
LRCCFIFGGYTLFVRLSSGRQKRPFPIYAV

SEQ ID NO: 7383 - DNA, 108 bp, Streptococcus pyogenes
atgttcaaagctggtgaatctgatttttcaattttagatttacgtggtttacgtaccaactggttaattgtaggcatctacattctcctgtgtttttttatttttggt

SEQ ID NO: 7384 - protein, 36 aa, Streptococcus pyogenes
MFKAGESDFSILDLRGLRTNWLIVGIYILLCFFIFG

SEQ ID NO: 7385 - DNA, 468 bp, Streptococcus pyogenes
atgagtcgtaaaaatcaagcgcctaaacgcgaagtattaccagatccattatataactcaaaaatcgtaacacgtcttatcaaccgtgttatgcttgacggtaaacgtggtacagctgctactatcgtttacgatgctttcaacgctatcaaagaagcaacaggaaatgacgctcttgaagtatttgaaacagctatggacaacatcatgcctgtacttgaagtacgcgcacgccgtgtcggtggttctaactaccaagtcccagttgaagttcgtccagaacgtcgtacaacacttggacttcgttggttggtaaacgcatcacgtgctcgtggtgaacacactatgaaagatcgtcttgctaaagaaatcatggatgctgcaaacaacacaggtgcatcagttaagaaacgtgaagacactcacaaaatggctgaagctaaccgtgcctttgctcacttccgttgg

SEQ ID NO: 7386 - protein, 156 aa, Streptococcus pyogenes
MSRKNQAPKREVLPDPLYNSKIVTRLINRVMLDGKRGTAATIVYDAFNAIKEATGNDALEVFETAMDNIMPVLEVRARRVGGSNYQVPVEVRPERRTTLGLRWLVNASRARGEHTMKDRLAKEIMDAANNTGASVKKREDTHKMAEANRAFAHFRW

SEQ ID NO: 7387 - DNA, 1035 bp, Streptococcus pyogenes
ttgattttcataaggaggaaatcactaatggtagttaaagttggtattaacggtttcggtcgtatcggacgtcttgcattccgccgtattcaaaacatcgaaggtgttgaagtaactcgtatcaatgaccttacagatccaaatatgcttgcacacttgttgaaatacgatacaactcaaggtcgttttgatggaacagttgaagttaaagaaggtggatttgaagtaaacggaaacttcatcaaagtttctgctgaacgtgatccagaaaacatcgactgggcaactgatggggttgaaatcgttcttgaagcaactggtttctttgctaaaaaagaagcagctgaaaaacacttacatgctaacggtgctaaaaaagttgttatcacagctcctggtggaaacgatgttaaaacagttgttttcaacactaaccacgacattcttgacggtactgaaacagttatctcaggtgcttcatgtactacaaactgtttagctcctatggctaaagctcttcacgatgcattcggtattcaaaaaggtcttatgactacaatccacgcttacactggtgaccaaatgatccttgacggaccacaccgtggtggtgaccttcgtcgtgcacgcgctggtgctgcaaatatcgttcctaactcaactggtgctgctaaagctatcggtcttgttatcccagaacttaacggtaaacttgacggtgctgcacaacgtgttcctgttccaactggatcagtaactgagttggttgtaactcttgacaaaaacgtttctgttgacgaaatcaacgctgctatgaaagctgcttcaaacgatagcttcggttacactgaagatccaatcgtttcttcagatatcgtaggcgtatcatacggttcattgtttgacgcaactcaaactaaagtaatggaagttgacggatcacaattggttaaagttgtatcatggtatgacaacgaaatgtcttacactgctcaacttgtacgtactcttgagtacttcgcaaaaattgctaaa

SEQ ID NO: 7388 - protein, 345 aa, Streptococcus pyogenes
LIFIRRKSLMVVKVGINGFGRIGRLAFRRIQNIEGVEVTRINDLTDPNMLAHLLKYDTTQGRFDGTVEVKEGGFEVNGNFIKVSAERDPENIDWATDGVEIVLEATGFFAKKEAAEKHLHANGAKKVVITAPGGNDVKTVVFNTNHDILDGTETVISGASCTTNCLAPMAKALHDAFGIQKGLMTTIHAYTGDQMILDGPHRGGDLRRARAGAANIVPNSTGAAKAIGLVIPELNGKLDGAAQRVPVPTGSVTELVVTLDKNVSVDEINAAMKAASNDSFGYTEDPIVSSDIVGVSYGSLFDATQTKVMEVDGSQLVKVVSWYDNEMSYTAQLVRTLEYFAKIAK

SEQ ID NO: 7389 - DNA, 114 bp, Streptococcus pyogenes
atggcagaaaaaactgacttatcgtcagcttacagaagactgaaaagtcccaatattaaaaccagaaaacgtgctctgaagattattcacgagtacaaacgttacggtaaaaaa

SEQ ID NO: 7390 - protein, 38 aa, Streptococcus pyogenes
MAEKTDLSSAYRRLKSPNIKTRKRALKIIHEYKRYGKK

SEQ ID NO: 7391 - DNA, 123 bp, Streptococcus pyogenes
atggaaagaaaagaaggatttgaaacactaaaaaagccgagtaaggctttttttgctataatagatgcagtgaccattataaaaaaagcagtgcaaatgacactgtcttttcttgagatggta

SEQ ID NO: 7392 - protein, 41 aa, Streptococcus pyogenes
MERKEGFETLKKPSKAFFAIIDAVTIIKKAVQMTLSFLEMV

SEQ ID NO: 7393 - DNA, 90 bp, Streptococcus pyogenes
ttgaaaaatatcaaaaagaattgtaaaagagatgcactgaccccaaaagttggctactctattttaagtaaaggatttagttttgtattg

SEQ ID NO: 7394 - protein, 30 aa, Streptococcus pyogenes
LKNIKKNCKRDALTPKVGYSILSKGFSFVL

SEQ ID NO: 7395 - DNA, 132 bp, Streptococcus pyogenes
ttgtctaacgtttggggtgtagttcaaggctttttctcttttttgttgcacttcattttacaacgcgggcaaataaaaaagtacaaaaaaagtaaaaaaagagttgacaatgacagtaaagatatcgtatac

SEQ ID NO: 7396 - protein, 44 aa, Streptococcus pyogenes
LSNVWGVVQGFFSFLLHFILQRGQIKKYKKSKKRVDNDSKDIVY

SEQ ID NO: 7397 - DNA, 108 bp, Streptococcus pyogenes
atgggggcaaccctgaccgagcaacgccgcgtgagtgaaagaaggttttcggatcgtaaagctctgttgttagagaagaatgatggtgggagtggaaaatccaccaag

SEQ ID NO: 7398 - protein, 36 aa, Streptococcus pyogenes
MGATLTEQRRVSERRFSDRKALLLEKNDGGSGKSTK

SEQ ID NO: 7399 - DNA, 96 bp, Streptococcus pyogenes
ttgcattttagagaagagtgtggtaagatagaggcaagatatgcgttggcacccttagctcaactggatagagtacctgactacgaatcaggcggt

SEQ ID NO: 7400 - protein, 32 aa, Streptococcus pyogenes
LHFREECGKIEARYALAPLAQLDRVPDYESGG

SEQ ID NO: 7401 - DNA, 153 bp, Streptococcus pyogenes
ttggtttttattgtgatgcttaaaacgattttatatttctattttaccaaagcttttcaaagtgctataataagggagttagagtcaatattagtaacgttaatgttgacaatattcaataaaatactattaaaaggagacaaaaatgggacg

SEQ ID NO: 7402 - protein, 51 aa, Streptococcus pyogenes
LVFIVMLKTILYFYFTKAFQSAIIRELESILVTLMLTIFNKILLKGDKNGT

SEQ ID NO: 7403 - DNA, 114 bp, Streptococcus pyogenes
atgacatcatctaaacaacaacaccctaagtttttacttagggtgttgtttcgtttatttatgactaaaccttctagtcaagctatcaccaataaattggatagcaaaaataat

SEQ ID NO: 7404 - protein, 38 aa, Streptococcus pyogenes
MTSSKQQHPKFLLRVLFRLFMTKPSSQAITNKLDSKNN

SEQ ID NO: 7405 - DNA, 108 bp, Streptococcus pyogenes
gtgagcgtttggggtttttgctcaagcctcacttttttatgtctttgggcagataatctaaaatggcaggaattatcaaaaatatctgaacaaaaagaaaaaaatgag

SEQ ID NO: 7406 - protein, 36 aa, Streptococcus pyogenes
VSVWGFCSSLTFLCLWADNLKWQELSKISEQKEKNE

SEQ ID NO: 7407 - DNA, 102 bp, Streptococcus pyogenes
ttgaaaaaacagctattctttgatatactctttagagaatatggttacttatctaaagtagaaggtattttgaccatagagggcagagaaggtaatgactat

SEQ ID NO: 7408 - protein, 34 aa, Streptococcus pyogenes
LKKQLFFDILFREYGYLSKVEGILTIEGREGNDY

SEQ ID NO: 7409 - DNA, 93 bp, Streptococcus pyogenes
atgaaaaactcagttggaaatagccaactgagtttctttttaaaccctgaacagttgacaaatctaactgataagacaagtgctactgaacat

SEQ ID NO: 7410 - protein, 31 aa, Streptococcus pyogenes
MKNSVGNSQLSFFLNPEQLTNLTDKTSATEH

SEQ ID NO: 7411 - DNA, 93 bp, Streptococcus pyogenes
ttgagaagtagcttattttctcaaaatcttcactattatagcatagaaaaaaggcttaacaaagccttttttgatgtgatttttaggatgtat

SEQ ID NO: 7412 - protein, 31 aa, Streptococcus pyogenes
LRSSLFSQNLHYYSIEKRLNKAFFDVIFRMY

SEQ ID NO: 7413 - DNA, 90 bp, Streptococcus pyogenes
ttgttcaatggttatcatacccttattttatccttaaagttcttgttttacaagtcacaagcaaaagtttataataaagctaatagaaac

SEQ ID NO: 7414 - protein, 30 aa, Streptococcus pyogenes
LFNGYHTLILSLKFLFYKSQAKVYNKANRN

SEQ ID NO: 7415 - DNA, 132 bp, Streptococcus pyogenes
atgctggtgatcgtttatttgggacaaaataaaagagacaaccatcaaatagtagcctttttaggccaatcgttcttgattttgtttaaaaaatcagagagatttctcttctttaaaggaaaagcaagttta

SEQ ID NO: 7416 - protein, 44 aa, Streptococcus pyogenes
MLVIVYLGQNKRDNHQIVAFLGQSFLILFKKSERFLFFKGKASL

SEQ ID NO: 7417 - DNA, 99 bp, Streptococcus pyogenes
ttgagagacggcaacccactaggtcatctcttttttactgattgtctttattataatattttggtcaataaaggtcaaatcataaacttgcttttcctt

SEQ ID NO: 7418 - protein, 33 aa, Streptococcus pyogenes
LRDGNPLGHLFFTDCLYYNILVNKGQIINLLFL

SEQ ID NO: 7419 - DNA, 96 bp, Streptococcus pyogenes
gtgtggtataatcagattatgctagccaaaactaaaaaaggcattgccattaaaggtgttgtagatcggcttatcctagatctcataacaatgctg

SEQ ID NO: 7420 - protein, 32 aa, Streptococcus pyogenes
VWYNQIMLAKTKKGIAIKGVVDRLILDLITML

SEQ ID NO: 7421 - DNA, 273 bp, Streptococcus pyogenes
atgtttcaaaaacaagaacgtattggactcgtcgtttacctgtattataaccgagatgccagaaagttatcaaaatttggtgatttatattaccattccaagcgctctcgttacctcattatttatattaataaaaatgatttagacacaaaattagaagaaatgagacgtttgaaatgtgttaaagacattagaccatcagcttttgatgatattgaccgccaatttgtaggtaaccttcatcgcgacgaaacaaacaaccatcaaaagggt

SEQ ID NO: 7422 - protein, 91 aa, Streptococcus pyogenes
MFQKQERIGLVVYLYYNRDARKLSKFGDLYYHSKRSRYLIIYINKNDLDTKLEEMRRLKCVKDIRPSAFDDIDRQFVGNLHRDETNNHQKG

SEQ ID NO: 7423 - DNA, 255 bp, Streptococcus pyogenes
gtgcaattggaattcgttatggggaaacgaagcttgtcaaaagacttgcccgtagcgaccaaagtagcggcgcataagggcaaaaaagcttttgaagaaaatactgcctttgcaacagatttgatgaaagaagtatcacgattaataacacaaaatcaacttgaaatgacgtttgttaatagtgtctttctcttagatcagcatgttgtcctaattcccttttcagcagaagagcacatggatttttacaactgt

SEQ ID NO: 7424 - protein, 85 aa, Streptococcus pyogenes
VQLEFVMGKRSLSKDLPVATKVAAHKGKKAFEENTAFATDLMKEVSRLITQNQLEMTFVNSVFLLDQHVVLIPFSAEEHMDFYNC

SEQ ID NO: 7425 - DNA, 114 bp, Streptococcus pyogenes
gtgagctgccccagattaacagccaagaagatttcattttctatggaggctatggaccgtgtggcaggccactgtgctgctttcgtttttgggaaaatttctgacagtatctat

SEQ ID NO: 7426 - protein, 38 aa, Streptococcus pyogenes
VSCPRLTAKKISFSMEAMDRVAGHCAAFVFGKISDSIY

SEQ ID NO: 7427 - DNA, 129 bp, Streptococcus pyogenes
ttgggaaaatttctgacagtatctattaaaatactaaaaagtcaagggttatcattgactttgggtaaagcaacaagcccttatggccgtttgctttgctgtctctatgatgaaggtgtcttttaccaa

SEQ ID NO: 7428 - protein, 43 aa, Streptococcus pyogenes
LGKFLTVSIKILKSQGLSLTLGKATSPYGRLLCCLYDEGVFYQ

SEQ ID NO: 7429 - DNA, 135 bp, Streptococcus pyogenes
gtgactaaggtcaactggtcttttaaccgcaccttaatgggatctgtaaatatatcaacggctgctactgttgcagggccatcacttgtctctactatggtaccatattcagggaattttttcttgctttattgg

SEQ ID NO: 7430 - protein, 45 aa, Streptococcus pyogenes
VTKVNWSFNRTLMGSVNISTAATVAGPSLVSTMVPYSGNFFLLYW

SEQ ID NO: 7431 - DNA, 390 bp, Streptococcus pyogenes
atgacagaagatcaagcaactatccttattttaggagtatacggaatcatattggctgtattcttattatcagctttattatgccttatcgctaactggcgactctttaaaagagcaggttacaaaggatggtatagtctcattcctttctatgcaggttttgtcaaacacaaaatcacttttggagaagataataaatggttttactttattggttgggtcattgctatttattattactatgtgcacttttgctatgtccgtgcttttggtggatcaaagggtctagcagtatttggcttgtttttcccaggcattgcttctttgatagtggcttttggaaaaacttataccacacaagaatgccaccctgtgccacatcttttaaac

SEQ ID NO: 7432 - protein, 130 aa, Streptococcus pyogenes
MTEDQATILILGVYGIILAVFLLSALLCLIANWRLFKRAGYKGWYSLIPFYAGFVKHKITFGEDNKWFYFIGWVIAIYYYYVHFCYVRAFGGSKGLAVFGLFFPGIASLIVAFGKTYTTQECHPVPHLLN

SEQ ID NO: 7433 - DNA, 168 bp, Streptococcus pyogenes
ttggcaggtgctacattttgggtattggtaaatcgtaatcatttgttctcctttagtgtaactgttttaggcgtgaggcgcctgtttttggtcatcatttcacaaaaaaaagggggcttttttaaaatgctaagctttgtctttcttttcttcttgagagttcgttgg

SEQ ID NO: 7434 - protein, 56 aa, Streptococcus pyogenes
LAGATFWVLVNRNHLFSFSVTVLGVRRLFLVIISQKKGGFFKMLSFVFLFFLRVRW

SEQ ID NO: 7435 - DNA, 165 bp, Streptococcus pyogenes
atgttccatgaaatcagtttcatttggtttctctttctaacagatagtcttgttgttattgtaacaaaaaacgaaacgataagcgactttgggcacctagcccccataaaacagtctagccaaatgaagcatagcagcgtaagaacaagacaaggaggtgatcag

SEQ ID NO: 7436 - protein, 55 aa, Streptococcus pyogenes
MFHEISFIWFLFLTDSLVVIVTKNETISDFGHLAPIKQSSQMKHSSVRTRQGGDQ

SEQ ID NO: 7437 - DNA, 1185 bp, Streptococcus pyogenes
atgtcaatggcacaaaaaacagtcatcaccgaagaaacaaccgattttgttatggatttcaaaacaagtagcgctgagggaaatgttgattttattaacgtttttgaccttgagaaaatggcacaacaggtcatccctaaaggagcctttggttatattgctagtggtgctggtgatacctttaccctccatgaaaatattcgctcatttaatcataaattaattgtccctcactccctcaaaggggttgaaaatccgtcaacagagattacgtttgatggtgattacttaacctctcctcttattttagcacctgtagcggctcataaactggccaatgaacaaggagaagtagcgtctgctaaaggattgaaggaatttggaagtatctacaccactagttcctactcaacaactgacctgccagaaatcagtgctgccttaggtgggacaccccattggtttcaattttattacagtaaagacgatggcattaatcgtaatattatggatcgtgtcaaagcacaaggttgcaaagctatcgttttgacagcagatgcaacagttggaggaaaccgcgaagttgataggcgaaacggttttgtttttccggtcggtatgccaattgttcaagaatatttacctgatggtgcaggtaaaacaatggattatgtctataaatcagctaaacaagcgcttacctcaaaagatattgaatatatcgcaacttactcaggcctgcctgtttatgtcaaaggaccacagtgtgctgaggataccttgcgggcattggacgcaggagcatcaggtatctgggtaaccaatcatggtggccgtcaattagatggtggtccagctgcttttgattccttacaagaagtcgctgaagcagttgatcaaaaagttcctattgtctttgactcaggtataagacggggtcaacatattttcaaagctcttgcttcaggtgctgaccttgttgccttggggcgtccagcgatttacggcttggctatgggaggaagcattggtactcgtcaggtctttgaaaagttaaatgacgagttaaaaatggttatgcaactggctgggacacaaactatccaagatgttaaagcctttaaccttcgccacaatccgtatgattcatcgattccatttgatcaaaatgcgctacgcttagat

SEQ ID NO: 7438 - protein, 395 aa, Streptococcus pyogenes
MSMAQKTVITEETTDFVMDFKTSSAEGNVDFINVFDLEKMAQQVIPKGAFGYIASGAGDTFTLHENIRSFNHKLIVPHSLKGVENPSTEITFDGDYLTSPLILAPVAAHKLANEQGEVASAKGLKEFGSIYTTSSYSTTDLPEISAALGGTPHWFQFYYSKDDGINRNIMDRVKAQGCKAIVLTADATVGGNREVDRRNGFVFPVGMPIVQEYLPDGAGKTMDYVYKSAKQALTSKDIEYIATYSGLPVYVKGPQCAEDTLRALDAGASGIWVTNHGGRQLDGGPAAFDSLQEVAEAVDQKVPIVFDSGIRRGQHIFKALASGADLVALGRPAIYGLAMGGSIGTRQVFEKLNDELKMVMQLAGTQTIQDVKAFNLRHNPYDSSIPFDQNALRLD

SEQ ID NO: 7439 - DNA, 117 bp, Streptococcus pyogenes
atgtggttaaataatcaaatattattaacgaaaaatgagttaatgattaacattaaactggttttagttaaaacatttaggagggtatcaggtggagaaaaagcaacgtttttccct

SEQ ID NO: 7440 - protein, 39 aa, Streptococcus pyogenes
MWLNNQILLTKNELMINIKLVLVKTFRRVSGGEKATFFP

SEQ ID NO: 7441 - DNA, 192 bp, Streptococcus pyogenes
atgttgaatgacaaagccaaagcttctttttttgacacctgctcagatagtgacaagtcagtctgctttaccaccttgatcacagcaaaggcatcgtttgcagctactcatctggagtttttggatagattagtgtcctttttttcagtcttttccacaaaaggagtccttcttgaaagaataggcttagta

SEQ ID NO: 7442 - protein, 64 aa, Streptococcus pyogenes
MLNDKAKASFFDTCSDSDKSVCFTTLITAKASFAATHLEFLDRLVSFFSVFSTKGVLLERIGLV

SEQ ID NO: 7443 - DNA, 138 bp, Streptococcus pyogenes
gtgatcaaggtggtaaagcagactgacttgtcactatctgagcaggtgtcaaaaaaagaagctttggctttgtcattcaacatactgagcttcagtctttcagaacggagacacccccagttttgtactcaaaaagca

SEQ ID NO: 7444 - protein, 46 aa, Streptococcus pyogenes
VIKVVKQTDLSLSEQVSKKEALALSFNILSFSLSERRHPQFCTQKA

SEQ ID NO: 7445 - DNA, 177 bp, Streptococcus pyogenes
ttgtactcaaaaagcataaacagctctgctgatgtgacatctgatttctacgtgcgcagtgagccaaaacagctgctgtttgctatggaaaaagtggcgccaatcgagatttttgagaccctaggctcaaaaataaggcatagaattccaaaggaagtcgctgccgtgagcacaacc

SEQ ID NO: 7446 - protein, 59 aa, Streptococcus pyogenes
LYSKSINSSADVTSDFYVRSEPKQLLFAMEKVAPIEIFETLGSKIRHRIPKEVAAVSTT

SEQ ID NO: 7447 - DNA, 165 bp, Streptococcus pyogenes
gtgctcaagtcaaaaagagacatcccatcaaaccattgctgtttagcaggtctttttgtgttgctcaaaaaaacaattcctgtctgtttggcgtctagtgatgacttaggcttagcgctactagacttttgtttgaaaaatacctcaagccttgaaggagacaaa

SEQ ID NO: 7448 - protein, 55 aa, Streptococcus pyogenes
VLKSKRDIPSNHCCLAGLFVLLKKTIPVCLASSDDLGLALLDFCLKNTSSLEGDK

SEQ ID NO: 7449 - DNA, 765 bp, Streptococcus pyogenes
gtgtcagggggaactatgctaaaaaagcgctatcaactggctattgtccttcttcttagctgttttagtctgatctggcaaactgagggcttggtcgagctttttgtctgtgagcactatgagcgggcggtttgtgaggggacgcctgcttattttaccttttcggatcaaaagggcgctgagacactgattaaaaagcgatggggcaagggtctcatctacccaagggctgagcaagaggcgatggctgcttatacctgtcagcaggcaggccctatcaacaccagcctagacaaagccaaaggtgagctcagccaactcacgcctgagctaagggatcaggtggcccagctcgatgctgcgactcaccggctagtcatcccgtggaacattgtagtataccgctatgtatacgagacgtttttgcgtgatatcggtgtttcacatgctgatctcacgtcttactaccgtaaccatcagtttgaccctcatatcctttgtaagatcaagcttggtacacgctacaccaagcacagttttatgagcacgacagccttgaaaaacggcgccatgacccatcgaccggtggaggtgcgcatctgtgtcaaaaaaggggccaaggcagcctttgtcgagccttattcggctgtgccttcagaggttgagctcttgtttccaagaggctgtcagctggaggtcgttggagcttacgtgtcacaggaccaaaaaaagctccacatagaagcgtatttcaagggcagtttg

SEQ ID NO: 7450 - protein, 255 aa, Streptococcus pyogenes
VSGGTMLKKRYQLAIVLLLSCFSLIWQTEGLVELFVCEHYERAVCEGTPAYFTFSDQKGAETLIKKRWGKGLIYPRAEQEAMAAYTCQQAGPINTSLDKAKGELSQLTPELRDQVAQLDAATHRLVIPWNIVVYRYVYETFLRDIGVSHADLTSYYRNHQFDPHILCKIKLGTRYTKHSFMSTTALKNGAMTHRPVEVRICVKKGAKAAFVEPYSAVPSEVELLFPRGCQLEVVGAYVSQDQKKLHIEAYFKGSL

SEQ ID NO: 7451 - DNA, 90 bp, Streptococcus pyogenes
ttgctgtggtggctaataaggactaacacaaaatctcaaacgctttcaaaaacagctcctaagcttaaaaaagctgatgaacagatttgt

SEQ ID NO: 7452 - protein, 30 aa, Streptococcus pyogenes
LLWWLIRTNTKSQTLSKTAPKLKKADEQIC

SEQ ID NO: 7453 - DNA, 552 bp, Streptococcus pyogenes
atgaaatggagtggttttatgaaaacaaaatcaaaacgctttttaaacctagcaaccctttgcttggccctactaggaacaactttgctaatggcacatcccgtacaggcggaggtgatatcaaaaagagactatatgactcgcttcgggttaggcgatttagaagatgattcagctaactatccttcaaatttagaagctagatataaaggatatttagagggatatgaaaaaggcttaaaaggagatgatatacccgaacggcccaagattcaggttcctgaggatgttcagccatctgaccatggcgactatagagatggttatgaggaaggatttggagaaggacaacataaacgtgatccattagaaacagaagcagaagatgattctcaaggaggacgtcaagaaggacgtcaaggacatcaagaaggagcagattctagtgatttgaacgttgaagaaagcgacggtttgtctgttattgatgaagtagttggagtaatttatcaagcatttagtactatttggacatacttaagcggtttgttc

SEQ ID NO: 7454 - protein, 184 aa, Streptococcus pyogenes
MKWSGFMKTKSKRFLNLATLCLALLGTTLLMAHPVQAEVISKRDYMTRFGLGDLEDDSANYPSNLEARYKGYLEGYEKGLKGDDIPERPKIQVPEDVQPSDHGDYRDGYEEGFGEGQHKRDPLETEAEDDSQGGRQEGRQGHQEGADSSDLNVEESDGLSVIDEVVGVIYQAFSTIWTYLSGLF

SEQ ID NO: 7455 - DNA, 288 bp, Streptococcus pyogenes
ttgggttttagtgacccgtgtgttgagaaaggagcatttatgccagaaaagaaagtgttgcccgtcctaagcatagtggtgagttttgtctgcctgcttgatcatatcttcttttttgctacttatagttatctctacttaccgcttgtagcaagtagtctagctcttatcggtctggtgcaaaacaaaggcaggcaaaaggtgtggtcgctagctggactcgtcctagctgctctagccgtggcagtagtggcctatgcctactatgacccaaccgtcatcccctac

SEQ ID NO: 7456 - protein, 96 aa, Streptococcus pyogenes
LGFSDPCVEKGAFMPEKKVLPVLSIVVSFVCLLDHIFFFATYSYLYLPLVASSLALIGLVQNKGRQKVWSLAGLVLAALAVAVVAYAYYDPTVIPY

SEQ ID NO: 7457 - DNA, 630 bp, Streptococcus pyogenes
atgaaaaagacattaactttgctactggcactctttgccatcggggtaactagtagcgtcagagcggaggatgaacaaagtagtacacaaaagccagtaaaatttgatttggatggacctcaacaaaaaattaaagattatagtggcaacacaatcactctagaagacttatatgttggtagtaaagtagtaaaaatatatatccctcaaggatggtgggtatatctttacagacaatgtgatcataacagtaaagaacgaggaattttagctagtcctattctcgaaaaaaatataacaaaaacagatccttatcgtcaatattatacaggagtaccttatattcttaacttaggagaagatcctttgaagaaaggagaaaaattaactttctcatttaaaggagaagacggattttatgtcggtagctatatctatagagactctgatactataaaaaaagaaaaagaagctgaagaagcacttcaaaaaaaggaagaggaaaagcaacaaaaacagctagaagaaagcatgctaaagcagataagagaagaagaccataaaccttggcatcagcggttaagtgagagcatccaagatcagtggtggaactttaagggactgtttcag

SEQ ID NO: 7458 - protein, 210 aa, Streptococcus pyogenes
MKKTLTLLLALFAIGVTSSVRAEDEQSSTQKPVKFDLDGPQQKIKDYSGNTITLEDLYVGSKVVKIYIPQGWWVYLYRQCDHNSKERGILASPILEKNITKTDPYRQYYTGVPYILNLGEDPLKKGEKLTFSFKGEDGFYVGSYIYRDSDTIKKEKEAEEALQKKEEEKQQKQLEESMLKQIREEDHKPWHQRLSESIQDQWWNFKGLFQ

SEQ ID NO: 7459 - DNA, 318 bp, Streptococcus pyogenes
atgaaaaaaacactattattaagtactgctgttttgacgctagccggtactgtcgccctattaactcattctgtagatgcatcgacttattcttactacagcactagtcattttttaagacaagatggaagagagactcttagagaagctaaatatgcggcagagttacaaattagaaacttgttaagtcagtatcatattaatggaaaagaatataataattatttcagatattattatagacaagctatgcaagctagaaatatagacgaagttaataaaatcattgaagatttagaaaaaaacttgcaagcacaa

SEQ ID NO: 7460 - protein, 106 aa, Streptococcus pyogenes
MKKTLLLSTAVLTLAGTVALLTHSVDASTYSYYSTSHFLRQDGRETLREAKYAAELQIRNLLSQYHINGKEYNNYFRYYYRQAMQARNIDEVNKIIEDLEKNLQAQ

SEQ ID NO: 7461 - DNA, 696 bp, Streptococcus pyogenes
atgaaaagaataataaaaacaataattttagttataataatctttcatgggtacggaagtgtaaaatcagatagtgaaaatattaaagacgttaagctacaattaaattacgcatacgaaatcataccagtagattatacgaattgtaatattgattacttgactactcatgatttttatattgatatttccagttataaaaagaaaaatttttcagttgattctgaggtcgagagctatattacaacaaagtttacgaaaaatcaaaaagtaaatatttttggtcttccgtacatatttactcgttatgatgtttattatatatatggtggggttacaccatcagtaaacagtaattcggaaaatagtaaaattgtaggtaatttactaatagatggagtccagcaaaaaacactaataaatcccataaaaatagataaacctatttttacgattcaagaatttgacttcaaaatcagacaatatcttatgcaaacatacaaaatttatgatcctaattctccatacataaaagggcaattagaaattgcgatcaatggcaataaacatgaaagttttaacttatatgatgcaacctcatctagtacaaggagtgatatttttaaaaaatataaagacaataagactataaatatgaaagatttcagccattttgatatttacctttggactaaa

SEQ ID NO: 7462 - protein, 232 aa, Streptococcus pyogenes
MKRIIKTIILVIIIFHGYGSVKSDSENIKDVKLQLNYAYEIIPVDYTNCNIDYLTTHDFYIDISSYKKKNFSVDSEVESYITTKFTKNQKVNIFGLPYIFTRYDVYYIYGGVTPSVNSNSENSKIVGNLLIDGVQQKTLINPIKIDKPIFTIQEFDFKIRQYLMQTYKIYDPNSPYIKGQLEIAINGNKHESFNLYDATSSSTRSDIFKKYKDNKTINMKDFSHFDIYLWTK

SEQ ID NO: 7463 - DNA, 612 bp, Streptococcus pyogenes
atgaaaaaaacattaaccttgctactggcactctttgccatcggggtaactagtagcgtcagagcggaggatgaacagaataagtttatacttgatggattacaggaaaaagtaaaagaagttagtgtatcagatttttctgttggagaatctaaaatcaaagtctggcttcctcaagcttggtcggtcaaaatttctagagaacattcaccaaaatcaagcatttctaattctggagaacaaaaacctttaagcaatagctcagagaataaagaaggtcaattttctaaaagattaccttatggtacccaacatactattaaattatcatcccaacttacaaaaggtgagagagtcactttgacattcagagatgaagatttttggggagcaggttactgcttctatagagattcactatccataaaagaagacaaacaatacgaagaagaaattaagaaaattgaggatgacctagagagacaagatcttgaaaatgatgcactagagatgtttaaaaaacaaaccgaaagagaggctaataaaccttggcatcagcggttaagcgaaaacatccaagatcagtggtggaactttaagggactgtttcag

SEQ ID NO: 7464 - protein, 204 aa, Streptococcus pyogenes
MKKTLTLLLALFAIGVTSSVRAEDEQNKFILDGLQEKVKEVSVSDFSVGESKIKVWLPQAWSVKISREHSPKSSISNSGEQKPLSNSSENKEGQFSKRLPYGTQHTIKLSSQLTKGERVTLTFRDEDFWGAGYCFYRDSLSIKEDKQYEEEIKKIEDDLERQDLENDALEMFKKQTEREANKPWHQRLSENIQDQWWNFKGLFQ

SEQ ID NO: 7465 - DNA, 339 bp, Streptococcus pyogenes
atgacactaaaaaaacactattatcttctcagcctgctagctcttgtaacggttggtgctgcctttaacacaagccagagtgtcagtgcacaagtttatagcaatgaagggtatcaccagcatttgactgatgaaaaatcacacctgcaatatagtaaagacaacgcacaacttcaattgagaaatatccttgacggctaccaaaatgacctagggagacactactctagctattattactacaacctaagaaccgttatgggactatcaagtgagcaagacattgaaaaacactatgaagagcttaagaacaagttacatgatatgtacaatcattat

SEQ ID NO: 7466 - protein, 113 aa, Streptococcus pyogenes
MTLKKHYYLLSLLALVTVGAAFNTSQSVSAQVYSNEGYHQHLTDEKSHLQYSKDNAQLQLRNILDGYQNDLGRHYSSYYYYNLRTVMGLSSEQDIEKHYEELKNKLHDMYNHY

SEQ ID NO: 7467 - DNA, 90 bp, Streptococcus pyogenes
ttggcctttctcttatttataatgattattatatcagaatttttaggaaaaagcttgacaaaaagcctaaaagaggatatccttatagca

SEQ ID NO: 7468 - protein, 30 aa, Streptococcus pyogenes
LAFLLFIMIIISEFLGKSLTKSLKEDILIA

SEQ ID NO: 7469 - DNA, 111 bp, Streptococcus pyogenes
gtgccagttgacgaacaagctactaaaagaaaaacagataaaaaagcacccaaaatgaggctcattctctttcccatcatttctctccttaggatatattatttatttaat

SEQ ID NO: 7470 - protein, 37 aa, Streptococcus pyogenes
VPVDEQATKRKTDKKAPKMRLILFPIISLLRIYYLFN

SEQ ID NO: 7471 - DNA, 351 bp, Streptococcus pyogenes
atgatgatctataaattaactgccttagctttcttgatagtaacgcctctttttgccatgattgtaacctctttatttaaacttaataaaaagggatttaaatttccagatgtcgcacttttactttttgcgatagaaattgtgcttgtctcaggaaaatttttcacccataatttactgccttattaccttattatcatgtcgctgctagccatcgtcatttcactactgctagtcatccgaactcagtcgttttcttaccatcgctttatgaagctattttggcgagttggctttttagtcaccgttattttctacctgattctagttatctttatttttacattagca

SEQ ID NO: 7472 - protein, 117 aa, Streptococcus pyogenes
MMIYKLTALAFLIVTPLFAMIVTSLFKLNKKGFKFPDVALLLFAIEIVLVSGKFFTHNLLPYYLIIMSLLAIVISLLLVIRTQSFSYHRFMKLFWRVGFLVTVIFYLILVIFIFTLA

SEQ ID NO: 7473 - DNA, 252 bp, Streptococcus pyogenes
atgtcaggtttattttatcataaatcatacttttttaaatctaagcaagtatatgaccttctaaacgaaatacgtatgcgttatcctcatgctcatattattctaatcggaaatcatattaattacgaggaaatatttaaaaatcattatcgagtttttggtgttattgacacaacaagtcataaatcattaaggtccattcgagaccaaattcaactttacttagacgaactttacaattcgaataatgga

SEQ ID NO: 7474 - protein, 84 aa, Streptococcus pyogenes
MSGLFYHKSYFFKSKQVYDLLNEIRMRYPHAHIILIGNHINYEEIFKNHYRVFGVIDTTSHKSLRSIRDQIQLYLDELYNSNNG

SEQ ID NO: 7475 - DNA, 243 bp, Streptococcus pyogenes
atgataaaatttgcagaagaaatacaaaaagaagagttgttccatattattggaggttatagtgctacagattgtaaaaatcatttaattggtggtattacttcaggtgctattgcaggtggtgttggagcaggtatggctactttaggtgttggaggagttgcaggtgcgtttgcaggtgcacatgtaggtgctattgcgggtggattaacttgcgttggtggtatgttatttaatggaaaa

SEQ ID NO: 7476 - protein, 81 aa, Streptococcus pyogenes
MIKFAEEIQKEELFHIIGGYSATDCKNHLIGGITSGAIAGGVGAGMATLGVGGVAGAFAGAHVGAIAGGLTCVGGMLFNGK

SEQ ID NO: 7477 - DNA, 180 bp, Streptococcus pyogenes
atggataattttttagaattacagtttgaagaattagtaaatatttctggtggaaaaggaaatattggatctgctatcggagggtgcttaggtgggatgcttatagctgcagcaggaggtccaataactggaggtgcggcagcatttgtatgtgtagcatctggaattgcagcttatcaa

SEQ ID NO: 7478 - protein, 60 aa, Streptococcus pyogenes
MDNFLELQFEELVNISGGKGNIGSAIGGCLGGMLIAAAGGPITGGAAAFVCVASGIAAYQ

SEQ ID NO: 7479 - DNA, 246 bp, Streptococcus pyogenes
atgatactgttctttatgatattctgtactagctcgaggttgcaacgagacaaatttaagaattatgaaaagaagttattcgatatggagataaagaaactggaaacatttcaccaaatgactatagaaaagcttgccaaggttgagggtggtaagaataattggcaggcaaatgtcagtggggttatcgctgcaggtagtgctggagctgctataggttttccagtttgcggtgtagcctggagc

SEQ ID NO: 7480 - protein, 82 aa, Streptococcus pyogenes
MILFFMIFCTSSRLQRDKFKNYEKKLFDMEIKKLETFHQMTIEKLAKVEGGKNNWQANVSGVIAAGSAGAAIGFPVCGVAWS

SEQ ID NO: 7481 - DNA, 198 bp, Streptococcus pyogenes
atgacaacaatgaaggaattaacaattaatgacatgtctagtataagtggaggaaacgctccaggagatgctgtaattggtggtcttggaggcttagcttctggattgaaattttgtaaactgccacatccagtattgacaggtggatgtgttgtaggatttacagttggtggagcatatttgggatatacagcaaat

SEQ ID NO: 7482 - protein, 66 aa, Streptococcus pyogenes
MTTMKELTINDMSSISGGNAPGDAVIGGLGGLASGLKFCKLPHPVLTGGCVVGFTVGGAYLGYTAN

SEQ ID NO: 7483 - DNA, 99 bp, Streptococcus pyogenes
atgatctatacgatttttattattatgcatgcgtctataatgtttttaatgattgttgatgccattcataaaaaaatgttgataaatctataccatatt

SEQ ID NO: 7484 - protein, 33 aa, Streptococcus pyogenes
MIYTIFIIMHASIMFLMIVDAIHKKMLINLYHI

SEQ ID NO: 7485 - DNA, 192 bp, Streptococcus pyogenes
atggaagtgctaaaaaatggtctggctatcataaatggaggcggaaaagacggagcaaatatctttttgacagggatggcaggtgctgcgcagggagtgacagtttgtgctcagacaggcgtatttatcccttggcaaggttatattttgtgtggagcagctggtgctgctacaaatattatctggcctcac

SEQ ID NO: 7486 - protein, 64 aa, Streptococcus pyogenes
MEVLKNGLAIINGGGKDGANIFLTGMAGAAQGVTVCAQTGVFIPWQGYILCGAAGAATNIIWPH

SEQ ID NO: 7487 - DNA, 993 bp, Streptococcus pyogenes
ttgcggcagattcagtccattcgtctgatagacgttttggagttggcttttggagttggctataaggaagaaacaacctctcagttttcttcggatcagccctcccaagtggttttgtatcgaggtgaggctaacacggttaggtttgcctataccaatcagatgtctctgatgaaagatattcgcattgctttggatggttctgataagtctttgaccgctcagattgttcctggtatgggtcatgtttatgagggctttcaaacttctgctagagggatttttacgatgtcaggagttcctgaaagcactgttcccgttgctaaccctaatgtacaaaccaaatatataaggtatttcaaagtcattgatgatatgcataacacaatgtataaaggaactgtttttcttgttcaaccgcaagcttggaaatacaccatgaaatctgttgatcagttaccagtagatgacttgaaccatattggcgttgctggtattgaacgaatgacaactctcattaaaaatgcgggtgcccttttaaccacaggaggtagtggggctttcccagacaatattaaagtatctattaatccaaaggggaggcaggccacgattacttatggggacggctctacggatattattcctccagcagttttatggaaaaaaggctccgtaaaagagcctactgaagccgatcaatctgtcggaacaccgactcctggtattcctggtaaattcaaacgagaccagagccttaacgagcatgaagctatggtaaatgtcgaaccactgtctcatgtagtaaaagacaatataaaggtcatagatgaaaaatcaacagggcggtttgagccttttagacctaatgaagatgagaaggagaagcctgccagcgatgttaaggtaagaccagcagaagttggtagctggctagaaccagcgacagctcttcctagtgttgaaatgagcgctgaggacaggttaaaaagt

SEQ ID NO: 7488 - protein, 331 aa, Streptococcus pyogenes
LRQIQSIRLIDVLELAFGVGYKEETTSQFSSDQPSQVVLYRGEANTVRFAYTNQMSLMKDIRIALDGSDKSLTAQIVPGMGHVYEGFQTSARGIFTMSGVPESTVPVANPNVQTKYIRYFKVIDDMHNTMYKGTVFLVQPQAWKYTMKSVDQLPVDDLNHIGVAGIERMTTLIKNAGALLTTGGSGAFPDNIKVSINPKGRQATITYGDGSTDIIPPAVLWKKGSVKEPTEADQSVGTPTPGIPGKFKRDQSLNEHEAMVNVEPLSHVVKDNIKVIDEKSTGRFEPFRPNEDEKEKPASDVKVRPAEVGSWLEPATALPSVEMSAEDRLKS

SEQ ID NO: 7489 - DNA, 480 bp, Streptococcus pyogenes
ttgccggttgctttagacaggcaaacaggaaagggcttggaggtttcttctgaagtagctgtgagcgcctcacagccggaagaattgcatcgattgcctaaccgtttgatacctgaggaagacaataataaactatcacgagtagccaaggaagtcgttactgagccaaggctaaataacccctttttgttacccaagaaggttctttcgttagaagatgatgctgctatccttaatcatttggaggaagaccgtgatgtcaataagttgttcctcgagccagttgcggctgaagccaagagagaaattaattttcatccaagtgaccagcaggtgactgctaaagttaaggagtcatctgattttcatcagaaacagcaccaaacagggattacttatggagatgatactctggcagatctgacgcatcatttgcttcattcagatggtgttattcctagtctaaatgataagagtgct

SEQ ID NO: 7490 - protein, 160 aa, Streptococcus pyogenes
LPVALDRQTGKGLEVSSEVAVSASQPEELHRLPNRLIPEEDNNKLSRVAKEVVTEPRLNNPFLLPKKVLSLEDDAAILNHLEEDRDVNKLFLEPVAAEAKREINFHPSDQQVTAKVKESSDFHQKQHQTGITYGDDTLADLTHHLLHSDGVIPSLNDKSA

SEQ ID NO: 7491 - DNA, 165 bp, Streptococcus pyogenes
gtggacactaccatttcggtagtgttcttttttaagctaatctcatcaccacgctttcttcaagctaaaaaactgatcatgaaagagcaaccccatcaccctaacagcccactttgcccgcactttcttaaaaagttaggagaaaacgatataccaattattttc

SEQ ID NO: 7492 - protein, 55 aa, Streptococcus pyogenes
VDTTISVVFFFKLISSPRFLQAKKLIMKEQPHHPNSPLCPHFLKKLGENDIPIIF

SEQ ID NO: 7493 - DNA, 99 bp, Streptococcus pyogenes
gtggcctatggtcatcgcagtccttttcctttcaatagtgtgtttaagaattggtggtttagggctgacggcaagaataaaacacagtatgctaatagc

SEQ ID NO: 7494 - protein, 33 aa, Streptococcus pyogenes
VAYGHRSPFPFNSVFKNWWFRADGKNKTQYANS

SEQ ID NO: 7495 - DNA, 267 bp, Streptococcus pyogenes
atgaccaaaaaacagttttatcttatcttagctattagcatactgtgttttattcttgccgtcagccctaaaccaccaattcttaaacacactattgaaaggaaaaggactgcgatgaccataggccactcaaaacaaaaccctcacaaaaaagaagcccttaaacacaaaaaaaacaaaaataaggctctttttcttccaagtggggacagcgctatcaaatctgttattagcatgacagttagactcctgttagatgaccaatct

SEQ ID NO: 7496 - protein, 89 aa, Streptococcus pyogenes
MTKKQFYLILAISILCFILAVSPKPPILKHTIERKRTAMTIGHSKQNPHKKEALKHKKNKNKALFLPSGDSAIKSVISMTVRLLLDDQS

SEQ ID NO: 7497 - DNA, 105 bp, Streptococcus pyogenes
atgaatggtaacgatgtttcaagcatggtgctcattcaatccttttttatcacataccaagctgataagcctgcagcttctgccatatctttaaacatgacggca

SEQ ID NO: 7498 - protein, 35 aa, Streptococcus pyogenes
MNGNDVSSMVLIQSFFITYQADKPAASAISLNMTA

SEQ ID NO: 7499 - DNA, 114 bp, Streptococcus pyogenes
ttgacaaacaccacacttgtcacgataaagagctttaggagtatgattgttgatgctgcttacggttttgcaattggtgctaagttattttgtggcgtaagtgtattcgttgat

SEQ ID NO: 7500 - protein, 38 aa, Streptococcus pyogenes
LTNTTLVTIKSFRSMIVDAAYGFAIGAKLFCGVSVFVD

SEQ ID NO: 7501 - DNA, 93 bp, Streptococcus pyogenes
atgcgtatgcgtcttggaatgagccgaaacaaattcgtcaatcgtaatattcagtttatccaaaagattaagcaagcgactgcaggtgatttc

SEQ ID NO: 7502 - protein, 31 aa, Streptococcus pyogenes
MRMRLGMSRNKFVNRNIQFIQKIKQATAGDF

SEQ ID NO: 7503 - DNA, 108 bp, Streptococcus pyogenes
ttgccttttgcaattgtcattgtagtcataggcttcctcttttttgatgatcatacttatcgatatgtgtttacccataagttaaagtgtttagaagggtctcactct

SEQ ID NO: 7504 - protein, 36 aa, Streptococcus pyogenes
LPFAIVIVVIGFLFFDDHTYRYVFTHKLKCLEGSHS

SEQ ID NO: 7505 - DNA, 1500 bp, Streptococcus pyogenes
atgactacaatgacaattgcaaaaggcaatcaaccgatagccttacaattagggatgctaaatcgtcacggtttgattgctggagcgactggaacaggtaaaactgtgaccttaaaagtgctagcagagcaattaagtttagctggtgtgccagtctttttggcagatatcaaaggagacctgtctaatcttactaaagcaggagaggtgactgataaattggctgcgcgtttagccacaatcggggtaagtgattaccagcctcaggcctttcctgtaagaatgtgggatgtttttggtcaaaacggtcaacccttacggacaacgatttctgagctgggacctatgatgttgtcgcgtttattgaatcttaatgatacccagacaggtgtcttaaacatcgtctttaaaatcgccgacgagaaaggttggcttttgattgatttgaaagacttgcaggctatcttaaaagaagttggtgaccatgcctcagactactccagccattacggtaatatcgctaagcaatctatcggggctatccaaagaagtctcttgactttggaacaagaaggggcccaccaattttttggagagcctgctttagatgtggctgatttgatgcaattagatgttgcttcgggttatggagccattaacattttgtcagcgactaagctttttcaatctcctaccctttacacaaccttcttactttggttattatcagagctgtacaaattattgccagaagttggggatttggacaaacctaagatggttttcttttttgatgaagctcacttgctcttcaaagatgcccctaaagttttcttggaaaaagttgaacagattgtgcgacttattcgttcaaagggagttgggattttctttgtgactcaaaacccacttgatttgccagaaacggttttggctcagcttggaaatcgtattcagcatgcctttcgcgcttatacaccgaaagaacaaaaggcggttcgtgtcgctgcggatactttccgacaaaatcctgacttagatgtggcaagggtgattacagaactagaagtcggtgaggccttgatttctgttttgaatgataagggacaaccatccatcgttgaacgtgcctatatcatgccgcctaagagtagctttgctgttttgtcagagatagagagtcagcagcttgtgcagtcctcaccttttgccagtaaatatagtcagtccattgaccgtgaatctgcttatgaaaaattagctgctaaggttttagaagacaaccgactggcccaagaagcgatagcgacagcacaacgcgaaaaagaagctaaagaagccatcaaggcgcaagcagctaccaaaaaagctaatcggcgttctgttgggcgttcccacaaaacagtcgtcgaaaaagcaacagatgcgtttattagtacgacggttagaacaattgggcgagaactggtcagaggtttactgggtagtttacgtaaacga

SEQ ID NO: 7506 - protein, 500 aa, Streptococcus pyogenes
MTTMTIAKGNQPIALQLGMLNRHGLIAGATGTGKTVTLKVLAEQLSLAGVPVFLADIKGDLSNLTKAGEVTDKLAARLATIGVSDYQPQAFPVRMWDVFGQNGQPLRTTISELGPMMLSRLLNLNDTQTGVLNIVFKIADEKGWLLIDLKDLQAILKEVGDHASDYSSHYGNIAKQSIGAIQRSLLTLEQEGAHQFFGEPALDVADLMQLDVASGYGAINILSATKLFQSPTLYTTFLLWLLSELYKLLPEVGDLDKPKMVFFFDEAHLLFKDAPKVFLEKVEQIVRLIRSKGVGIFFVTQNPLDLPETVLAQLGNRIQHAFRAYTPKEQKAVRVAADTFRQNPDLDVARVITELEVGEALISVLNDKGQPSIVERAYIMPPKSSFAVLSEIESQQLVQSSPFASKYSQSIDRESAYEKLAAKVLEDNRLAQEAIATAQREKEAKEAIKAQAATKKANRRSVGRSHKTVVEKATDAFISTTVRTIGRELVRGLLGSLRKR

SEQ ID NO: 7507 - DNA, 234 bp, Streptococcus pyogenes
atgtacaacttactacttacgatattgctagtactgtcgggattgcttgagattgctatttttatgcaacctcaaaaaaacccaagtagcaatgtttttgatagcagcggttcagaagccttgtttgaacgtacaaaagctcgtggctttgaagcattcatgcaacgattcacagcagttctagtatttttttggctagcgattgcacttgtgcttgccattttatcaagtaaa

SEQ ID NO: 7508 - protein, 78 aa, Streptococcus pyogenes
MYNLLLTILLVLSGLLEIAIFMQPQKNPSSNVFDSSGSEALFERTKARGFEAFMQRFTAVLVFFWLAIALVLAILSSK

SEQ ID NO: 7509 - DNA, 717 bp, Streptococcus pyogenes
atgagtattatgataactaaaggacaagttcgtttgttacgaacttattcttatgatagcaacttatacacgcagggattagaacaactcaacaacaatcatatattacttagtgccggtcgttatggtttctcaaaagtaggggtgtatgaccttactcaagagatcttttcagaaaaaatagcttttccagatacagtttttgcagaagggctaacagttgttgaggattatttttggttactaacctataaagagggtgtagcctacaagtttgataaggctacctgcaattgtttaggggcctatccatttgaaggagatggctggggattagcctatgataaggaaaaccagtgtctttggatgactagtggaaatgcttttttgcaaaagcgagaccccaaagattttgctttattggataccgtactagttgctatagaaagtgtccccatctcaatgcttaacgaattagagtatgtagatggttatctctatgccaatatttggcaaaccaatactattgtcaaactccaacctgattctggaaaggtggtagccacctatgatattagccctttgttaaaagccttaaatcttgataagtcccattaccctgaccttaatgttttgaatgggattgctcatttagatcaacaacgtttcttaattactggcaaactatacccgctgatgttagaagtagtattagat

SEQ ID NO: 7510 - protein, 239 aa, Streptococcus pyogenes
MSIMITKGQVRLLRTYSYDSNLYTQGLEQLNNNHILLSAGRYGFSKVGVYDLTQEIFSEKIAFPDTVFAEGLTVVEDYFWLLTYKEGVAYKFDKATCNCLGAYPFEGDGWGLAYDKENQCLWMTSGNAFLQKRDPKDFALLDTVLVAIESVPISMLNELEYVDGYLYANIWQTNTIVKLQPDSGKVVATYDISPLLKALNLDKSHYPDLNVLNGIAHLDQQRFLITGKLYPLMLEVVLD

SEQ ID NO: 7511 - DNA, 645 bp, Streptococcus pyogenes
atgaaaattcttgtaacaggctttgatccctttggcggcgaagctattaatcctgcccttgaagctatcaagaaattgccagcaaccattcatggagcagaaatcaaatgtattgaagttccaacggtttttcaaaaatctgccgatgtgctccagcagcatatcgaaagctttcaacctgatgcagtcctttgtattgggcaagctggtggccggactggactaacgccagaacgcgttgccattaatcaagacgatgctcgcattcctgataacgaagggaatcagcctattgatacacctattcgtgcagatggtaaagcagcttatttttcaaccttgccaatcaaagcgatggttgctgccattcatcaggctggacttcctgcttctgtttctaatacagctggtacctttgtttgcaatcatttgatgtatcaagccctttacttagtggataaatattgtccaaatgccaaagctgggtttatgcatattccctttatgatggaacaggttgttgataaacctaatacagctgccatgaacctcgatgatattacaagaggaattgaggctgctatttttgccattgtcgatttcaaagatcgttccgatttaaaacgtgtagggggcgctactcac

SEQ ID NO: 7512 - protein, 215 aa, Streptococcus pyogenes
MKILVTGFDPFGGEAINPALEAIKKLPATIHGAEIKCIEVPTVFQKSADVLQQHIESFQPDAVLCIGQAGGRTGLTPERVAINQDDARIPDNEGNQPIDTPIRADGKAAYFSTLPIKAMVAAIHQAGLPASVSNTAGTFVCNHLMYQALYLVDKYCPNAKAGFMHIPFMMEQVVDKPNTAAMNLDDITRGIEAAIFAIVDFKDRSDLKRVGGATH

SEQ ID NO: 7513 - DNA, 924 bp, Streptococcus pyogenes
atggctaacattgcaaaccttgttttagaaacgatatatatccttatcggcttgcaactgtttcacacagcctactgcacctttaaagataaaaccaaccctgtctattttgggacagctctgttctggggattgctgggtgttaccttcgttggcggtgcctttttgcctaataaagttatcggttttatcgtgattgtcctagctcttttaaccttgtttaagcaagttcgtattggaacattaccagcttttaatgaacaaaaagctgaagaaagtgctcaccgcattggtaactggattttcttaccagttatgttaatggctatgatttctctacttcttgccttgatccttcctgatttcagtaaaagtgccattgggattgctggtatcttagccactattgctattttaataatcactaagcaaaaaccatctgctcttttagctgaaaataatcggatgaaccaacaagtgtccacaagcggtattttgccacagctcttaggagctttaggagctatttttgcagctgctggtgttggtgatgtgattgcttctctcattcgggagattgtacctgctgatagccgcttctttggcgttctcgcttatgtgcttggcatggttatttttactatgattatgggaaacgcttttgctgcctttaccgttattacaaccggtatcggtgttccttttgtttttgctttaggagctgaccctattattgccggtgctttagctatgactgctggtttttgtggtaccttattaacaccaatggcagcaaactttaacgccttgcctgttgctttgatggagatcaaagatcgaaatgcagttatcaaaaagcaagctcctatcgcccttgttttaattattagtcacattgccttaatgtatttacttgcttattat

SEQ ID NO: 7514 - protein, 308 aa, Streptococcus pyogenes
MANIANLVLETIYILIGLQLFHTAYCTFKDKTNPVYFGTALFWGLLGVTFVGGAFLPNKVIGFIVIVLALLTLFKQVRIGTLPAFNEQKAEESAHRIGNWIFLPVMLMAMISLLLALILPDFSKSAIGIAGILATIAILIITKQKPSALLAENNRMNQQVSTSGILPQLLGALGAIFAAAGVGDVIASLIREIVPADSRFFGVLAYVLGMVIFTMIMGNAFAAFTVITTGIGVPFVFALGADPIIAGALAMTAGFCGTLLTPMAANFNALPVALMEIKDRNAVIKKQAPIALVLIISHIALMYLLAYY

SEQ ID NO: 7515 - DNA, 738 bp, Streptococcus pyogenes
ttgcaaatcctagcgactaatgttataatcgtcatactattgaaaaaggagttctttatggagtggattaaattaatcggtattgtgattatcgtattagggtttattttaaaatgtgatgctatcgctaccgtagttgttgcaggacttgttaccgcgctggtttcaggaatttcgtttattgattttctagatattttaggaaaagaatttaccaatcaacgtttgctaaccattttcttcatcactttaccgcttatcggcttgtcagaaacttatgggctgaaacaccgagctactcagttgattcaacgtgttcaagcccttaccgtcggccgtttattgactctctaccttattattcgagaattagcaggtctcttttcgattcgactagggggacatccacagttcgttcgacccttgattcaacctatgggagaagctgctgctaaagccaacattggagaagagttgaccgatgcagaaaaagatgacatcaaagctatggcagctgccaatgaaaactttggcaatttctttgcccaaaatacctttgttggcgcaggaggtgtcctacttatcgctggaactttagaacagcttggctatgatggtaaccaagctaaaattgcattttcttctattttaattgctattatctctattattatagttgctatttacaattacctctttgagaaaaaaatggaacgtcaacatcagaaaggagataac

SEQ ID NO: 7516 - protein, 246 aa, Streptococcus pyogenes
LQILATNVIIVILLKKEFFMEWIKLIGIVIIVLGFILKCDAIATVVVAGLVTALVSGISFIDFLDILGKEFTNQRLLTIFFITLPLIGLSETYGLKHRATQLIQRVQALTVGRLLTLYLIIRELAGLFSIRLGGHPQFVRPLIQPMGEAAAKANIGEELTDAEKDDIKAMAAANENFGNFFAQNTFVGAGGVLLIAGTLEQLGYDGNQAKIAFSSILIAIISIIIVAIYNYLFEKKMERQHQKGDN

SEQ ID NO: 7517 - DNA, 90 bp, Streptococcus pyogenes
ttggttactggtgatggtagtcttatcgcaagtcatctggaaaaaggttcagtaccatttaacgattcaaggagggtgagatggcaaaat

SEQ ID NO: 7518 - protein, 30 aa, Streptococcus pyogenes
LVTGDGSLIASHLEKGSVPFNDSRRVRWQN

SEQ ID NO: 7519 - DNA, 90 bp, Streptococcus pyogenes
atgcctacgcttggtaaaccatcacaaaaaaaggcagccgtttttacaacagctgccttccttcattatctaggttttcatattctgacc

SEQ ID NO: 7520 - protein, 30 aa, Streptococcus pyogenes
MPTLGKPSQKKAAVFTTAAFLHYLGFHILT

SEQ ID NO: 7521 - DNA, 147 bp, Streptococcus pyogenes
atgcaattgctagataacgtttatggaactttgagatcttttgcctttatgagacctgccaaatctagtaacgataccagcttagcagatgccttgcaggctggtacagacatggcttttattttagttagaggcattaactatcaa

SEQ ID NO: 7522 - protein, 49 aa, Streptococcus pyogenes
MQLLDNVYGTLRSFAFMRPAKSSNDTSLADALQAGTDMAFILVRGINYQ

SEQ ID NO: 7523 - DNA, 132 bp, Streptococcus pyogenes
atgggccgggggatgtctggttttaagccaaaagctgtctttgaaaacgtggttaagcttatggcaagcaaaaaaggtgagtcacctttaccttttaccgacctacctaaatcgcttgctaccttatttgac

SEQ ID NO: 7524 - protein, 44 aa, Streptococcus pyogenes
MGRGMSGFKPKAVFENVVKLMASKKGESPLPFTDLPKSLATLFD

SEQ ID NO: 7525 - DNA, 834 bp, Streptococcus pyogenes
atgacttttcacattacagtaaatcttgatgaaatatcagacaaactagatgattcattgaaatttttaaatagattatcaattaaaagttgtgaattacgaatgataaacactaaaaatattatacaacttagtgatgcagagttaattaatttaaaagaacggttacaaaagtataatatcactccaatttcaattgcaagcccactttttaaatggaatatagaagaaaatcatttagagagtaatcttgatttatacggtatttcagctaatgttacgttaaatgaacaatggctttatgtaaggaaaattatttttattgcaaaatttttaaatatcaaatatgtaagaatatttggtgggattgggtgctcagtagatgacttcttgaataatgaactatttttgaatttgttaaaagagactgaaattatctttttaattgagaacgagttaggaacttcagtgagcactgcagacgatttgttaaaaataggacattttatagatgaaaaatctataaaaaatctaaaaatctggtttgatattgcaaattattacatagttgaacctcaggtagacaaggttattccaaaattgaaaaaatatatttactatattcactgtaagaactatgttaacaatgatttaggaatacattatgtagaactaggtaaaggaattatcgattataaaacaatcattcatgaaatccatgaacattttatagacttaatttttagtttagaagtacatgaaaaagaaatagacaaaaaggcagaagtagtgaggaagtcttatctgacactaaatgagtatattaatggaggc

SEQ ID NO: 7526 - protein, 278 aa, Streptococcus pyogenes
MTFHITVNLDEISDKLDDSLKFLNRLSIKSCELRMINTKNIIQLSDAELINLKERLQKYNITPISIASPLFKWNIEENHLESNLDLYGISANVTLNEQWLYVRKIIFIAKFLNIKYVRIFGGIGCSVDDFLNNELFLNLLKETEIIFLIENELGTSVSTADDLLKIGHFIDEKSIKNLKIWFDIANYYIVEPQVDKVIPKLKKYIYYIHCKNYVNNDLGIHYVELGKGIIDYKTIIHEIHEHFIDLIFSLEVHEKEIDKKAEVVRKSYLTLNEYINGG

SEQ ID NO: 7527 - DNA, 756 bp, Streptococcus pyogenes
atgagtatattaatggaggctaaaatgaatttgagtatatttggtttaaagaatattccttatttgaaagaaggggatagtatagaaaagcttattgaagaaagcattaaaacttcagaattttttatcgaagacaatgatgtgctttgcatagcttctaaagttgtatctatcgcagaaggccaggtgatgtctttaaacgagatacaagtgagtgatgtagcaaaagaaatccacaggaatattcctcgtaaagatcctagaataattgaaattatgctaaatttagtcaatagagatctgtcacgtttagatatcaaaaaaaattacattggttgtcgcttggaaaatggtttaaagttgacaagtggtggaatcgatagaaaatcagtagatgaagtatttcttttacctaataatccggatgcttctgcaaaaagaatttcggaatatcttaaaaaatcacttggaaaaaatgttgcagttgttataacagatagtgatggtagagaggataaaagaggtgctactcaagtagcaattggtatttatggtattcatcctttgagaaaaacagaagtaatagattcacaaggagagacaataaaattccaagaagagactttgtgtgatatgattgcagcttgtgctggcttagtaatggggcaacgtggaactggaattccagctgtcctcattaggggcttggattataaatggtctgaaaatactagtattaaggaagcattaaatgag

SEQ ID NO: 7528 - protein, 252 aa, Streptococcus pyogenes
MSILMEAKMNLSIFGLKNIPYLKEGDSIEKLIEESIKTSEFFIEDNDVLCIASKVVSIAEGQVMSLNEIQVSDVAKEIHRNIPRKDPRIIEIMLNLVNRDLSRLDIKKNYIGCRLENGLKLTSGGIDRKSVDEVFLLPNNPDASAKRISEYLKKSLGKNVAVVITDSDGREDKRGATQVAIGIYGIHPLRKTEVIDSQGETIKFQEETLCDMIAACAGLVMGQRGTGIPAVLIRGLDYKWSENTSIKEALNE

SEQ ID NO: 7529 - DNA, 984 bp, Streptococcus pyogenes
atgagtagaaatcaggactgtaagaatattctaatcattggttttggaaaaattgggaaaattaaagcgtacaagtggctatcacgcggatatgaggtatatgtcaaagatttgaaattctccagcatgaaataccttaatacaaatagtgatgtgttggatgatttatcacgacaatattttactattgagatttgtactccgacaaatcaccaccttacgctattgaaaaccgttataacaaggtatgtctattcttatattagcattgaaaaaccactgtgtaataggttagaagatttagaagaaatgaagtcgctagtagaaagtcacccacatctagcaaaaaaaatttttgccagtgaacaatacttcttttcgaaaattttggaaaaactgttacaagtagattgtttctctctagataaaatcaaggaaataacagttgatttttctaaagataggattgaggataacgagaatgggagatttttagataaagagatattgggctatggaatagagattcctcatatcattgctgtcatttcttatttaggaatttcattagaagaattcaaaaaaggaatctttgtgaatgctatttatataaaagacttagagaaacacgattattcaatagaaatcttatcttgtattaatcaaacagtgattaaaattattagtaatttgggaagttttgcaataagagagggcaagattgaaggaggtgatgctaaaacagtaagaagagttaccattgatgacaaaacaatactatttgatccacatcctaaactcgagaggtataagagtgaattggtaactgggacaaatacgtttcaaatacacgatgatatgatggacacgtatatcagtttgttagaaggaaatgctattcctgaagattgctatatcaataatgcaattgagataacaaaattattaattaacttatattcagaatgtgaaaaaatttattta

SEQ ID NO: 7530 - protein, 328 aa, Streptococcus pyogenes
MSRNQDCKNILIIGFGKIGKIKAYKWLSRGYEVYVKDLKFSSMKYLNTNSDVLDDLSRQYFTIEICTPTNHHLTLLKTVITRYVYSYISIEKPLCNRLEDLEEMKSLVESHPHLAKKIFASEQYFFSKILEKLLQVDCFSLDKIKEITVDFSKDRIEDNENGRFLDKEILGYGIEIPHIIAVISYLGISLEEFKKGIFVNAIYIKDLEKHDYSIEILSCINQTVIKIISNLGSFAIREGKIEGGDAKTVRRVTIDDKTILFDPHPKLERYKSELVTGTNTFQIHDDMMDTYISLLEGNAIPEDCYINNAIEITKLLINLYSECEKIYL

SEQ ID NO: 7531 - DNA, 1197 bp, Streptococcus pyogenes
atggatttaaaaattacaaacggcttttatgacccaagtcatttatcatacgaagtagtagaacgcaaaggcttaggtcaccctgataccttagcagatggaattgctgagcaaattgaaattgattactcactttattgtttggacaagtttggtgttattccacatcataattttgataagattattatccgagggggacattcagttcaggattttggtggaagtgactttattgaaccaattaaaattatttttctaggtagggcgagcaaaaaatgttttaatagttcaattccactttttaaaattcagaaaaaggctgcaactaaatatttaaatagaattttacctaatttagatgttgaaaattatgtagaatttgagacattgacctcagattttactacaaaaactaattggttctcgcctgaagcaatagaagatttaccggagtatctagatgtaccaaaggcaaatgatacagctacaatgataagttattggccattaacaatttctgaagaattagcattaatgattgaagggtatttttataaattagataagaatgaattaccaacgccaagatttactaaaatgggtggtgatattaaagtaatggtcgtaaggaacgatttagaatattctattagaataaattttcctttaataagtaaattttttaacaatgatattgaaagtcagttgtatgttgataaacacgtagaaaaaattaagaaatatattgaacaaaagtataaaaacataagcttttctattgattaccattattatttaactactacaggttcttgtattgattttggagaagaaggtgcagttggtcgaggtaataaaactcatggtatcatatcaagttttaggccaaatactatggaagcaccagctggaaaaaattgtacttattttgtaggaaaggtttggggatttttgtctgatactattgccaaagaaatttatgaagcattcaatactccctgtcaaatcattatgcaattaaatattggatcaaaattgtatagaccaacccatttatttattcagacagaagaaagtgttgatcaagaaagagtattagaaattgttaacaggcatttaaataatggtaaacaaaatactaatttaatcttgtcaactcaacattttattcctaaaaccaatgtctatgatgga

SEQ ID NO: 7532 - protein, 399 aa, Streptococcus pyogenes
MDLKITNGFYDPSHLSYEVVERKGLGHPDTLADGIAEQIEIDYSLYCLDKFGVIPHHNFDKIIIRGGHSVQDFGGSDFIEPIKIIFLGRASKKCFNSSIPLFKIQKKAATKYLNRILPNLDVENYVEFETLTSDFTTKTNWFSPEAIEDLPEYLDVPKANDTATMISYWPLTISEELALMIEGYFYKLDKNELPTPRFTKMGGDIKVMVVRNDLEYSIRINFPLISKFFNNDIESQLYVDKHVEKIKKYIEQKYKNISFSIDYHYYLTTTGSCIDFGEEGAVGRGNKTHGIISSFRPNTMEAPAGKNCTYFVGKVWGFLSDTIAKEIYEAFNTPCQIIMQLNIGSKLYRPTHLFIQTEESVDQERVLEIVNRHLNNGKQNTNLILSTQHFIPKTNVYDG

SEQ ID NO: 7533 - DNA, 966 bp, Streptococcus pyogenes
atgtctatgatggataaaactgttttatattttgggttggttgaaatttcttttgatgtgcctgactttatatttcaaaaaataaaagagcagaataataaaattagatattatagcaaatcaataaatatattaggtagtgtaaaatttattaacagcaatcagcaatttatagaatatgatggcaatggaaatattttagtttatggaagattaaagtattttaaagaaggaatttcattatactacattggagagtacttagctgaatgtctcttgattgaacatagtgacaccttattaattcatgcagcagcagtttataatcctttatctggccattcaattttactattaggagataaaggtgctggaaaaactacggttgcaataaggctttgtatagaacatgggtatcaccttattggtaatgaccaagtaatatttggttcgaactctggaatactactaacttatgcagggacatctttctttaaaataagaaggacagctgttttgtcggacaatttactgtttaaattatttagcaaattttttaatcgttcattacaatttaataaggcaagttgggatgataaaatttcaattttcccaaaggagttgggaatacgaacttgtaatttttctactgaaatctcaaaaatttattatataaagacagacaagaaagaaaagcaaatttatcattcaatttggagtgatagtttagcaagtctatatctaaatgagctattgggaaggcatatttctggacaggttgcatgttttcaatcagataatggaaaatatttttctacaatgcctttgataaattatgaaaaaaataatcgggtacgagaacagatagtgaagggtattttcgctaaacaaaaattatttaaaattacagcagctacgccagctaagattgcagaagcgattatagaaaatgttaagaaaaactca

SEQ ID NO: 7534 - protein, 322 aa, Streptococcus pyogenes
MSMMDKTVLYFGLVEISFDVPDFIFQKIKEQNNKIRYYSKSINILGSVKFINSNQQFIEYDGNGNILVYGRLKYFKEGISLYYIGEYLAECLLIEHSDTLLIHAAAVYNPLSGHSILLLGDKGAGKTTVAIRLCIEHGYHLIGNDQVIFGSNSGILLTYAGTSFFKIRRTAVLSDNLLFKLFSKFFNRSLQFNKASWDDKISIFPKELGIRTCNFSTEISKIYYIKTDKKEKQIYHSIWSDSLASLYLNELLGRHISGQVACFQSDNGKYFSTMPLINYEKNNRVREQIVKGIFAKQKLFKITAATPAKIAEAIIENVKKNS

SEQ ID NO: 7535 - DNA, 987 bp, Streptococcus pyogenes
atgtttgtgataggcattccaactttaaatgaggcagataatatcagtagattagttaaacaaattgatgagtatgctgtaaatttagggaaagaaattattattattaattcggatagtaaaagtacagatggaactccgcagatttttttagaaaccaaaacttataacaccaaagtttcgatagtatcagaagctaaaggaaaaggttataatgtgagaaatattttcgaatatgcaataaatcatgtgccgaatttctccggtttaattttgattgatggagacgttgtctcaatgaaaaaaatgtggttagaaaagatgtttatagcaattgaatctggaaatgatcttataatcccaaattatgctagaaaatcttttgaaggaaatgcgacaaaccattttatttatcccatgttagtgaaaattttcaaacgtgatatgccttatcaatgcatctctggtgattttggattttcaagaggattgataaaagatttaactttgaaatgtaattggcacaaatatacattaggttacgggatagatatttttttaaccttaacagctatattaaagtcatacaaaattaaggaaatcgatttacaatcaaagattcataaaaaaagctttgagaaaattgaaaaaatttttttagaagtttcacaaagtttcttcgaaactattaatgataattctttgaatcaagataagttacgtttaaatataaattttgaaagtcattcaagacagtttattaagtccagtgatatcctatccagcaatgatatcgagaatttaaagttaagagcgttgtttttattacaggaagaaaaacagtatctacatgggctgtcagaggtagaatgggacggaattttgtctaatacaattaacaatatttatagatatagtagtgaggaacattcgttatatttattaccactttatttattgagagtatacaattatctaaagtacaac

SEQ ID NO: 7536 - protein, 329 aa, Streptococcus pyogenes
MFVIGIPTLNEADNISRLVKQIDEYAVNLGKEIIIINSDSKSTDGTPQIFLETKTYNTKVSIVSEAKGKGYNVRNIFEYAINHVPNFSGLILIDGDVVSMKKMWLEKMFIAIESGNDLIIPNYARKSFEGNATNHFIYPMLVKIFKRDMPYQCISGDFGFSRGLIKDLTLKCNWHKYTLGYGIDIFLTLTAILKSYKIKEIDLQSKIHKKSFEKIEKIFLEVSQSFFETINDNSLNQDKLRLNINFESHSRQFIKSSDILSSNDIENLKLRALFLLQEEKQYLHGLSEVEWDGILSNTINNIYRYSSEEHSLYLLPLYLLRVYNYLKYN

SEQ ID NO: 7537 - DNA, 1155 bp, Streptococcus pyogenes
atgaaaattacagttgtaggcattggatacgttggattatcgatagggctcctacttgcaaaggaacacgacgtcaccttttttgatattgataataaaaaaattgatttaataaataaaaggcaatcccctcttaaagaagcagctataaacaaacttttatgtaaggcaaaaaatattaatgcaacttcttctgaagaattagcatataaggatgcgactttcataatcttgtctttgccaaccaacctaaaatttaataagcttgatacttccattatcgaaatttctgtaagtaatattttaaagataaacaaaaaggctacaattgtaataaagtcgacagttccaattggttttacagaatatttaaggaatcgatttcactacaacgatatcattttttcacctgagttccttagggaaggatcaactattcatgatcaattgtatccttcgagaactatagttggaaatgaatctagaaattctcaattattcttagacatactaacagatatatcggttgaaaaagactcgccatctttattagttggctcttctgaagcagaagcgataaagttattttcgaatgcatacttggcacaaaaaattgctttttttaatgagttggatacgtttgctgaaatgcaaaatttggactcaaaaaaaattattgaggctatgggatatgaccagagaataggaaattcgcacaataatccttctttcggttttggtgggtactgtcttcctaaggatattaagcaattagagtatcattttaaagaaattccagcaccaattattaccagtataagtgaatctaatttattaagaaaaattcatatagcaaaaatgattttgaacagctcagctaaaacaataggaatttatagaattaattccaaaaaagattcggataattgtagggaatcttctacaattgatgttgctaaacttctaaaaagcagtggtaaggatgttatcatctttgagcccttaattaaccaaaaaaagtttttggggtgccctttaagtaatgattttaatgaatttattaaatattcggatattatagttgccaatagaatagatgatgctctgagaaaatgtaattcaaaagtttttacacgtgatatttttcagtatgat

SEQ ID NO: 7538 - protein, 385 aa, Streptococcus pyogenes
MKITVVGIGYVGLSIGLLLAKEHDVTFFDIDNKKIDLINKRQSPLKEAAINKLLCKAKNINATSSEELAYKDATFIILSLPTNLKFNKLDTSIIEISVSNILKINKKATIVIKSTVPIGFTEYLRNRFHYNDIIFSPEFLREGSTIHDQLYPSRTIVGNESRNSQLFLDILTDISVEKDSPSLLVGSSEAEAIKLFSNAYLAQKIAFFNELDTFAEMQNLDSKKIIEAMGYDQRIGNSHNNPSFGFGGYCLPKDIKQLEYHFKEIPAPIITSISESNLLRKIHIAKMILNSSAKTIGIYRINSKKDSDNCRESSTIDVAKLLKSSGKDVIIFEPLINQKKFLGCPLSNDFNEFIKYSDIIVANRIDDALRKCNSKVFTRDIFQYD

SEQ ID NO: 7539 - DNA, 207 bp, Streptococcus pyogenes
atgagatttagttacaataaattatggaaacttcttattgataaaggttggaccaaaacaaagctcaggcaagaagctgggattagttcttccacgatcgcaaaattgggaaaaggggaaaatatcactactgatattttattggaaatttgtattgcacttgattgtaagattgaagatatagtagaaattgtagataataatatc

SEQ ID NO: 7540 - protein, 69 aa, Streptococcus pyogenes
MRFSYNKLWKLLIDKGWTKTKLRQEAGISSSTIAKLGKGENITTDILLEICIALDCKIEDIVEIVDNNI

SEQ ID NO: 7541 - DNA, 843 bp, Streptococcus pyogenes
ttggacatcagtatcgaatttggcttatatcctactgaatctgacttaacagagcttcaacaatacttcccagatactaatctcaaaaaattatatgaagttgaagcttaccacaaaaaattggaaactattttagattccgaattctcaactgaacgtgaatccctaatagctgagatcgacgaattagagagtcaattaacaactctaaaccaagaacttcaagaactaggaaacatcccaaatctttcaagtgagtacttagaaaactattctaaactaacagctacaatcaatgcactaaaagaacaaaacgaggcctacttaaaggagtctggtctatccaaagaaaaatcagaaacggacgctgacttgaaacgcagtacagaagatatccttctagatctagaagtaaaaatcaacagtaagatgcgtgaagtcaataacattctatatccagatattcgcaaagctcctcaaattaacctaaatgctcacaatagctactccttctatacaccagatgatgatggtacaggaactaagtttaaagggatgattgtattcgacttagtaatgctctaccttactaatctgccagcactcgcacacgattcattactcttgagtaatgttagctaccaagcgactgaagcacttttgaagctatatgaccagtcaaggtcattgaacaaacaagtctttttagtcttcgataaagccagctcttattctccagatgctaatcaactcttgtcagaaaatacggtattgagactctctagtaacggaaatgaactctacggtatttcatggaacaaaggagaaaactcagatgagatt

SEQ ID NO: 7542 - protein, 281 aa, Streptococcus pyogenes
LDISIEFGLYPTESDLTELQQYFPDTNLKKLYEVEAYHKKLETILDSEFSTERESLIAEIDELESQLTTLNQELQELGNIPNLSSEYLENYSKLTATINALKEQNEAYLKESGLSKEKSETDADLKRSTEDILLDLEVKINSKMREVNNILYPDIRKAPQINLNAHNSYSFYTPDDDGTGTKFKGMIVFDLVMLYLTNLPALAHDSLLLSNVSYQATEALLKLYDQSRSLNKQVFLVFDKASSYSPDANQLLSENTVLRLSSNGNELYGISWNKGENSDEI

SEQ ID NO: 7543 - DNA, 726 bp, Streptococcus pyogenes
atgcttatagaaatgtggtctccagtatttaagaaacacggagaaattcgggaaccaatctgcttccaccatgggttaaacgtgattatggggatggatttagctgataactctatcggcaaatcctcctcactattagccattgatttcatctttggaggtaatagctatctaaaatcaattgcggttaaaaaattaggtgatcatcctatctacttctgctttcaatttgagaaaaagttttatttttcaagagatacggccaacccagatatcattctagtgtgtgacaagagctactctccaaccggtgaaacaatggacctaggaatttttcttaacaaacttaagaaacgatatcatttagattctccagagctatcattccgattagctatgagtggcttctttaggattgcaggaaaaagtaatcaaaataccgatttccccttacaagtttattcgagccaaaaatcttctgaatctattactactctcatccaactgtttaatttgtatgataacattgcacgatacaaagaacgtctgaaagataagagcgaccagttaacaacttttcgtaatgctcgcaggtatgccttcatctccaacctggttggcggtaaaaagcaatttgaagcaaatgtctcagaaataaaaagattggaatatgatttagcacatctccaagatactcatcaagataaaattgactctgatgatatt

SEQ ID NO: 7544 - protein, 242 aa, Streptococcus pyogenes
MLIEMWSPVFKKHGEIREPICFHHGLNVIMGMDLADNSIGKSSSLLAIDFIFGGNSYLKSIAVKKLGDHPIYFCFQFEKKFYFSRDTANPDIILVCDKSYSPTGETMDLGIFLNKLKKRYHLDSPELSFRLAMSGFFRIAGKSNQNTDFPLQVYSSQKSSESITTLIQLFNLYDNIARYKERLKDKSDQLTTFRNARRYAFISNLVGGKKQFEANVSEIKRLEYDLAHLQDTHQDKIDSDDI

SEQ ID NO: 7545 - DNA, 222 bp, Streptococcus pyogenes
atgcaattaccaaataaactttactcctatcaaaaaagcacccttgcttatttgcctagagtgctaaatgaaatcaaaagtagaaactcaaacgtcaaagatatctttcacgctatctcagaagagttggatgatcctacagattttctatccataatggattgcttgtatgcattgaacgctattgaaatgtctaatgaaggagaagtaaaattatgctta

SEQ ID NO: 7546 - protein, 74 aa, Streptococcus pyogenes
MQLPNKLYSYQKSTLAYLPRVLNEIKSRNSNVKDIFHAISEELDDPTDFLSIMDCLYALNAIEMSNEGEVKLCL

SEQ ID NO: 7547 - DNA, 174 bp, Streptococcus pyogenes
atgggacaaaacgtggtgatgcgacaagcccctggaggcaacatcaagccagataaggaaaaatctgttgagaagattgacggtattgtaggtcttatcctggggcttgaccgttgcatttgccgccaaggtgatgaagctagcgtctatgatgagcgagggatattgagtttt

SEQ ID NO: 7548 - protein, 58 aa, Streptococcus pyogenes
MGQNVVMRQAPGGNIKPDKEKSVEKIDGIVGLILGLDRCICRQGDEASVYDERGILSF

SEQ ID NO: 7549 - DNA, 1092 bp, Streptococcus pyogenes
ttgactcaactaaaaactcaatatccctcgctcatcatagacgctagcttcatcaccttggcggcaaatgcaacggtcaagccccaggataagacctacaataccgtcaatcttctcaacagatttttccttatctggcttgatgttgcctccaggggcttgtcgcatcaccacgttttgtcccatccatttaaggactggatgaccaacatgttagattttccctaccatcatgagtttatagagttccttggacggtggactcatatccttatagccctgcccaaaaggcaccatggtcaagtcgacaccgcaattccaaggtatcttctggtaaccatcagagagaagacagggattgtaaaattaaccactgtgcaaaatacagcgttcactacccagtcgaatcaactcaaaaaacaatacgggcagttcttgttaacagaatctaataactgttgtgcatgcccaggctgtgatagaccactcattctaaccagtggcaacttagcagcagaaaattacgaggtttcagccattgaaaaagataaggacgctgaagcactgaatctgatagccctctgcccagatggttttttaacctatcaagcagataggcgcaaaaaaattgtaacaactctaaaaaatgttaaaaagattctagtctctgcacataacagccaacaagcgatttctgatatgaagttagacagtggaattgtttcagttttgactagtctcaataaactaaaatgtgatgaatataatatctcctatgactcgaagcaattgactgataagatatcacctgagaacaatcgtacgctttatcaattggttaaaaaccaagttattgataactacttaaccattcaaaaaatcatcgtaaatttggacaaacaaggaaaaattgattacgagaaaatccaatatcaaacgcgatcgatgtataaaaagttaaaagcagccaagcataataatctggctattttcaatactatttcggaaaaactccatctggctacactacaggacatctacttctgtcagatgattgtctcttactttatccaaaaatgcgaggtacttgaa

SEQ ID NO: 7550 - protein, 364 aa, Streptococcus pyogenes
LTQLKTQYPSLIIDASFITLAANATVKPQDKTYNTVNLLNRFFLIWLDVASRGLSHHHVLSHPFKDWMTNMLDFPYHHEFIEFLGRWTHILIALPKRHHGQVDTAIPRYLLVTIREKTGIVKLTTVQNTAFTTQSNQLKKQYGQFLLTESNNCCACPGCDRPLILTSGNLAAENYEVSAIEKDKDAEALNLIALCPDGFLTYQADRRKKIVTTLKNVKKILVSAHNSQQAISDMKLDSGIVSVLTSLNKLKCDEYNISYDSKQLTDKISPENNRTLYQLVKNQVIDNYLTIQKIIVNLDKQGKIDYEKIQYQTRSMYKKLKAAKHNNLAIFNTISEKLHLATLQDIYFCQMIVSYFIQKCEVLE

SEQ ID NO: 7551 - DNA, 321 bp, Streptococcus pyogenes
atgaagggaaattgcttattgaaagaatatcaggtcaccatgtcggatgatgctaaagcagatttgctgagcatctatcactatgttcgtgatgaactctgtgcaccacaggcagcggatgatcttcttgagaggttatcccaaggaatgttatcactatccatttttcctgaacgttgtgccatcattgaggatctgattggaaaaggctataccttcagacaactgattgtcaaaaaatatcgcattgtatatcatgttctggaagatgaagttataattgttgcggtcgtctatggatcacgtcatatgaataattgg

SEQ ID NO: 7552 - protein, 107 aa, Streptococcus pyogenes
MKGNCLLKEYQVTMSDDAKADLLSIYHYVRDELCAPQAADDLLERLSQGMLSLSIFPERCAIIEDLIGKGYTFRQLIVKKYRIVYHVLEDEVIIVAVVYGSRHMNNW

SEQ ID NO: 7553 - DNA, 270 bp, Streptococcus pyogenes
atggaactcgtaaagacgatacaaattggtgatgacatctatcctccgatacctgacctatttggcattcaagagaatcaggagtttaacctttataaatcaactgatggaactttggtgttaagtccatctgatagcaaactatcagcggatcaccaaagtataagcagtgatgagcagatgacaacagctgttgaacaagcaaggttagatgagattgcgacttcagtattatcacgacatcttgacgcatttaaggaattgacagaa

SEQ ID NO: 7554 - protein, 90 aa, Streptococcus pyogenes
MELVKTIQIGDDIYPPIPDLFGIQENQEFNLYKSTDGTLVLSPSDSKLSADHQSISSDEQMTTAVEQARLDEIATSVLSRHLDAFKELTE

SEQ ID NO: 7555 - DNA, 93 bp, Streptococcus pyogenes
ttgattactttgaaagaaatataccgaaagcacttcaaaggaggtgctttttttgtaccccaaaataaggagggcttatgggactacttgatt

SEQ ID NO: 7556 - protein, 31 aa, Streptococcus pyogenes
LITLKEIYRKHFKGGAFFVPQNKEGLWDYLI

SEQ ID NO: 7557 - DNA, 450 bp, Streptococcus pyogenes
atgggactacttgatttaattggaagaaaaagggctagagataagccccaaaacagttatgaaggtcaggacttttcctacctctttggtcgcacgactagtggcgagaatgtggatgagtttaagactatgcagacgacggcagtctatgcctgtgtgcgtgttcttgctgaagcggtggcgtcacttcctattcacatctatgaacggacagaaaatgggaaggagaaaaagctggaccacccactgtactttcttcttcatgatgaacccaatccagagatgtcctcctttatctttcgagagacaatcatgagccatcttttgatatggggaaatgcctatgtacagattatacgagataaaagtggtatggtatcgctactgctaaagcagaaggcgagcgttctgataagaaagctgctcttgattatctggcaacggatgcct

SEQ ID NO: 7558 - protein, 150 aa, Streptococcus pyogenes
MGLLDLIGRKRARDKPQNSYEGQDFSYLFGRTTSGENVDEFKTMQTTAVYACVRVLAEAVASLPIHIYERTENGKEKKLDHPLYFLLHDEPNPEMSSFIFRETIMSHLLIWGNAYVQIIRDKSGMVSLLLKQKASVLIRKLLLIIWQRMP

SEQ ID NO: 7559 - DNA, 336 bp, Streptococcus pyogenes
ttgaccgtctctagttcagcatggatgccaaggcttatctcccaacagattctatcagagtatgtgaagagcctagaagttgaagctgataaggtcgttattccaggacagaatactccagtctttagttgggatagggatgggaatgggaatctttccattgacacaccgctcctaaaggtgagaggggaaagtctagcgacacaagctgaccttacaaccatctctttaactcctggtccaaagggagaactctggcagacaagtgttgaaaggttggatataaaagtagacaagcacatcagcctaaccttcaaaaatggcgtacggattgat

SEQ ID NO: 7560 - protein, 112 aa, Streptococcus pyogenes
LTVSSSAWMPRLISQQILSEYVKSLEVEADKVVIPGQNTPVFSWDRDGNGNLSIDTPLLKVRGESLATQADLTTISLTPGPKGELWQTSVERLDIKVDKHISLTFKNGVRID

SEQ ID NO: 7561 - DNA, 339 bp, Streptococcus pyogenes
atgatgaaaccaccttttacagttacgaataccatgttaaataaggtagtagagatttctaaaattattggtaatttagaattacaagtacagaaagatttaaaattaagaaaagaaaatcgtattcagtctattcactcatcactcgctattgaacaaaattctttaacagtagaacaaataacagccattattgatgggaaaagagtgttagggaacccccgtgagataagagaagtaaaaaacgcttatgaagcttatgaagaaattttaacgctaactccctatgatgaatcacatttttttaaaatgaagaaatttcaacagtacatttaccga

SEQ ID NO: 7562 - protein, 113 aa, Streptococcus pyogenes
MMKPPFTVTNTMLNKVVEISKIIGNLELQVQKDLKLRKENRIQSIHSSLAIEQNSLTVEQITAIIDGKRVLGNPREIREVKNAYEAYEEILTLTPYDESHFFKMKKFQQYIYR

SEQ ID NO: 7563 - DNA, 1281 bp, Streptococcus pyogenes
atgggattgattatttaccataaaggaggaagaaaaatgaaaaagaatattttaattgtaggtggaggtccagagataactatatgttatgatttaattaacaatagtacggagtataatttcttttcagtatcagaaattcctacgatgtatccagagttgtttgtagaaacaattgaaaccagctttagaaattttggaaagacgattgaacaaattaaagagctcaaatattctattgatgctgttgcttgttgggatgaagctttaacgcatatagctgatgatatttcaaaagaattaggattgaaccctatttcatcgctagattctcaatcattcaggtttaaagatcgaatgagaatggtatgtgaagctggtggactaaaaatgcccaaatataaaattatcaatcaattttcagatacaaataaaataatcaattggaaatatccattaatagtgaaaccaacctcttttttagcaagtataggagtgaaaaaagtttataatttttcagaattacaacaagcagtttctcaaatgcttaatgtaaaatttccggtttacatagcttcaggggtatatgaattgggggaattatataatttagaacctagagttttggtggaagagtttattgatggagaagaatatagcttagagagcgtggtaagaaatggaatctatacacctctagggataactaaaaaaatagtggatgaaaaattatttatggatgaaataggccatattttcccttcaaatttaaacaaagaagaaaaaagtagagtatattcttgggcagaaaaattacatcaaattttgcaattaaatcatattacgactcatacagaatttagaattggaagaaatggagatattattttaatagaaattggagcaagaatcggtggagattgtattccaaacttaatgaaaaacagctttatagtcaagggatttgatttttataatacttatttaaaagctagactaggtttacaagaagagttaaatacagacactaataagttttcaggaattgtatttttcagactcaatccagagaattacggaaaaatatttaatggagtgagttacgatgcacctaaaacttcactaatatttgaagaaaagatatataaaaaggaaggaactgtattgccaaatccgattaattggagtaatgagagagtaggatatgtctgtttggaaaacaaggaatacgctgtgctagaaaaggagatgaaagaaatattaaaatcattgtcaatagag

SEQ ID NO: 7564 - protein, 427 aa, Streptococcus pyogenes
MGLIIYHKGGRKMKKNILIVGGGPEITICYDLINNSTEYNFFSVSEIPTMYPELFVETIETSFRNFGKTIEQIKELKYSIDAVACWDEALTHIADDISKELGLNPISSLDSQSFRFKDRMRMVCEAGGLKMPKYKIINQFSDTNKIINWKYPLIVKPTSFLASIGVKKVYNFSELQQAVSQMLNVKFPVYIASGVYELGELYNLEPRVLVEEFIDGEEYSLESVVRNGIYTPLGITKKIVDEKLFMDEIGHIFPSNLNKEEKSRVYSWAEKLHQILQLNHITTHTEFRIGRNGDIILIEIGARIGGDCIPNLMKNSFIVKGFDFYNTYLKARLGLQEELNTDTNKFSGIVFFRLNPENYGKIFNGVSYDAPKTSLIFEEKIYKKEGTVLPNPINWSNERVGYVCLENKEYAVLEKEMKEILKSLSIE

SEQ ID NO: 7565 - DNA, 198 bp, Streptococcus pyogenes
atgaacaatagagaaagtaaattaacgggtttctatgatgtttttgaggaagaagtagaaaaaataaatcatattcataatgtttttgtagaggagtcagaaaaatttggctttcaacagatgaagattgctatggtagagcatagaaaaaaatacttagatgcaaccgatgttcattatacaaaatacaaaaatatt

SEQ ID NO: 7566 - protein, 66 aa, Streptococcus pyogenes
MNNRESKLTGFYDVFEEEVEKINHIHNVFVEESEKFGFQQMKIAMVEHRKKYLDATDVHYTKYKNI

SEQ ID NO: 7567 - DNA, 897 bp, Streptococcus pyogenes
gtgttatttagagatagaattcctacatataaaggttatagaagacaatttaatcaaatattattaggtgcatggggaatagaatcagcttatgtggatgcagaaataatagttgcaacttggcgaggcttgcaacgatttaaaggaattaaagtagaatttattcaactgtctaacaaaaatatatttgatgttttggagaaagatttatctaaaaagttaagatttgaagatatttcaattgaagcaatattgggtaaatatttgtgtaataatgacatagaaatcataaaatgtctttatgaaaaagataaaataaatatggaactcttaattagtcttatttcaaaaataagtaacaaactggtgaaacaggaatttataaaagttttagtcttgtatgagtatgtaaaaaactttttaccagtagattgcatttacttttcattatctaatttatatggaacaggacattattcaagtatgaactataaaatcttcatacgaactaagtcaggtgacatatttgatattgctgatggtggtagaattgatgatatggtttctaaatttaataaagtaaacgtattaggagtttgcatgggaataggaaccactgttttatcacaagagattgagtatgaaattgaagatagaataatgatattagttgaaaaaatagatgtgaaaatctataagaattgtcttgaattagcaaataaattaagtgggtatcattgttccgtttttgagtttccttataaaaaaatcaaaaagttttttaaacatgaattatattcgagacatcattatattattgttcgattagatggaagtatggaatacagattttcatctgtagctttaaaaaataaaattaaaagcatacttgatagt

SEQ ID NO: 7568 - protein, 299 aa, Streptococcus pyogenes
VLFRDRIPTYKGYRRQFNQILLGAWGIESAYVDAEIIVATWRGLQRFKGIKVEFIQLSNKNIFDVLEKDLSKKLRFEDISIEAILGKYLCNNDIEIIKCLYEKDKINMELLISLISKISNKLVKQEFIKVLVLYEYVKNFLPVDCIYFSLSNLYGTGHYSSMNYKIFIRTKSGDIFDIADGGRIDDMVSKFNKVNVLGVCMGIGTTVLSQEIEYEIEDRIMILVEKIDVKIYKNCLELANKLSGYHCSVFEFPYKKIKKFFKHELYSRHHYIIVRLDGSMEYRFSSVALKNKIKSILDS

SEQ ID NO: 7569 - DNA, 216 bp, Streptococcus pyogenes
gtgtcttttaaaacagattgtaacacacaaagttttgtctacttttatagtatacatccagtggtcatttataaaaataaaaaaagtagcagttcacttcaaaaacggtcaggttatcgaaatataatctggctgttttttacgaatggaatgaaagctgctttttatgatataataagaaaaattgaacagaatgcagaaatgatggggcttatt

SEQ ID NO: 7570 - protein, 72 aa, Streptococcus pyogenes
VSFKTDCNTQSFVYFYSIHPVVIYKNKKSSSSLQKRSGYRNIIWLFFTNGMKAAFYDIIRKIEQNAEMMGLI

SEQ ID NO: 7571 - DNA, 195 bp, Streptococcus pyogenes
atgagacaaactagctatggtttgcttggttttgtttgttctgtcgttttttctttggtcgctagtttaccatcagtattgacttccaaaggcttatcaaaactagggattgatgcaaagcctgctagcattttttcaagttcatcattttttttatgggtaattgccatatctatgaccttctttcattcaaga

SEQ ID NO: 7572 - protein, 65 aa, Streptococcus pyogenes
MRQTSYGLLGFVCSVVFSLVASLPSVLTSKGLSKLGIDAKPASIFSSSSFFLWVIAISMTFFHSR

SEQ ID NO: 7573 - DNA, 126 bp, Streptococcus pyogenes
gtgattattgttattttccataatattgctattataacacaaaccatgttaatgcaaaaaatgatagcgaaacattgtcctaatataaagttgcgtaaagaatcaaaaaaagctacttttagtaaa

SEQ ID NO: 7574 - protein, 42 aa, Streptococcus pyogenes
VIIVIFHNIAIITQTMLMQKMIAKHCPNIKLRKESKKATFSK

SEQ ID NO: 7575 - DNA, 435 bp, Streptococcus pyogenes
gtgacactcactaattatgtccaagaagtttccctggctgattttggcaaaccacttcaccacaaggcttattggaacaagcgcctaaaaacaactggcggtcgcttttttccaaaagatggtcatttggattttaaccctaggatgcttgaggagcacggtgagcttatttttcggaaaattgttcgccatgagctctgccattaccatctttattttgaaggaagagggtaccatcataaagatagggatttcaaagatctgctagctcaagtaaacgggcttcgttatgtcccaactagctctaaatcaaagactaatcatcattatagttgccaaacctgtgggcaggtttatcaacgaaaaaggcgtatcaatctggctaaatatgtttgtggaaattgccacgggaaacttatggaaaaaaatcagtcg

SEQ ID NO: 7576 - protein, 145 aa, Streptococcus pyogenes
VTLTNYVQEVSLADFGKPLHHKAYWNKRLKTTGGRFFPKDGHLDFNPRMLEEHGELIFRKIVRHELCHYHLYFEGRGYHHKDRDFKDLLAQVNGLRYVPTSSKSKTNHHYSCQTCGQVYQRKRRINLAKYVCGNCHGKLMEKNQS

SEQ ID NO: 7577 - DNA, 282 bp, Streptococcus pyogenes
atgcctgcaccgttaaagaagcataattcggttgaacaggatgattcttaccaagaatctcaaagtaaatttcgagattttcaagagttcaatggccaaagtgcaaagctaaaagaattagtcttctttgctcgtatcgctagtttcagccttattaccgttttatttgcatttgtcctgctcgtaatgaatttagcgccaatgtttgctttcttatttgcaagcatcatcagcttaggcattacttccttattcgccaaggttatcaaatcattactgatg

SEQ ID NO: 7578 - protein, 94 aa, Streptococcus pyogenes
MPAPLKKHNSVEQDDSYQESQSKFRDFQEFNGQSAKLKELVFFARIASFSLITVLFAFVLLVMNLAPMFAFLFASIISLGITSLFAKVIKSLLM

SEQ ID NO: 7579 - DNA, 126 bp, Streptococcus pyogenes
atgactcattctcctattattctatcaagttttgagaaaataagctattgtgatatccaattttcaaaaaaaacaggctctcttttcccaactatggtcgtataccatttggaaaaagagggcctc

SEQ ID NO: 7580 - protein, 42 aa, Streptococcus pyogenes
MTHSPIILSSFEKISYCDIQFSKKTGSLFPTMVVYHLEKEGL

SEQ ID NO: 7581 - DNA, 138 bp, Streptococcus pyogenes
atgaccaaagaatatatctcctacattagtgctgctatcttcttgctttatggccttttagctgccaaatggatttttcttgggctaggcttaattttggtacttgtcggccttgctgatcgcctcaattcaaaaaaa

SEQ ID NO: 7582 - protein, 46 aa, Streptococcus pyogenes
MTKEYISYISAAIFLLYGLLAAKWIFLGLGLILVLVGLADRLNSKK

SEQ ID NO: 7583 - DNA, 96 bp, Streptococcus pyogenes
atgtcactatctcttatagttggtagctatattctttacaatattagtttagtctttgactatatcatgacagtcagcaagtactgttttgttatt

SEQ ID NO: 7584 - protein, 32 aa, Streptococcus pyogenes
MSLSLIVGSYILYNISLVFDYIMTVSKYCFVI

SEQ ID NO: 7585 - DNA, 402 bp, Streptococcus pyogenes
gtggttttggtcgtgaatacagctaccaaatgtgggctaaccccacaataccaggccttgcaagcactatatgacacataccatgacaagggatttgaggtcttagattttccttgcaaccaatttttaaatcaagctccaggagatgctgaggagattaatcacttttgcagtctgacctatcacactactttccctcgctttgcaaaaatcaaagtgaatggtaaagacgctgatcctttgttcacctggttaaaagaagaaaaaagtggtccccttgggaaacgcatcgaatggaatttcactaaatttctcattgaccaaaatggtcaagtcattaaacgctattcctcaaagacagatcctaaactaattgaagaagaccttaaagcacttcttggt

SEQ ID NO: 7586 - protein, 134 aa, Streptococcus pyogenes
VVLVVNTATKCGLTPQYQALQALYDTYHDKGFEVLDFPCNQFLNQAPGDAEEINHFCSLTYHTTFPRFAKIKVNGKDADPLFTWLKEEKSGPLGKRIEWNFTKFLIDQNGQVIKRYSSKTDPKLIEEDLKALLG

SEQ ID NO: 7587 - DNA, 93 bp, Streptococcus pyogenes
atggagactaaacctatccaaacattctttaaaataaagcgcttacttttgttaaaaaacaaacgttatgaacatgatcacttttatttttgg

SEQ ID NO: 7588 - protein, 31 aa, Streptococcus pyogenes
METKPIQTFFKIKRLLLLKNKRYEHDHFYFW

SEQ ID NO: 7589 - DNA, 138 bp, Streptococcus pyogenes
ttggaattccacgctttatttttgccacagcaaaaagcagctgtttgggctcatgtcacacgcaaaaataagaaatcagcagagcagttcaagttttttgagcatcaaactgggattgtctatattctaaaatctcct

SEQ ID NO: 7590 - protein, 46 aa, Streptococcus pyogenes
LEFHALFLPQQKAAVWAHVTRKNKKSAEQFKFFEHQTGIVYILKSP

SEQ ID NO: 7591 - DNA, 102 bp, Streptococcus pyogenes
gtggtttatcttaaaaatgttctccctcctatcttactaaaaataggtgcttttgtcatgggatgggaaaggaaacttaaggaaaaacgagagaaaacgttt

SEQ ID NO: 7592 - protein, 34 aa, Streptococcus pyogenes
VVYLKNVLPPILLKIGAFVMGWERKLKEKREKTF

SEQ ID NO: 7593 - DNA, 231 bp, Streptococcus pyogenes
ttggaattctatgctttatttttgagcctagggtctcaaaaattccgcgtaacgtcactgccagtattgacaccacttttgccacagcaaaaagcagctgttttggctcacgtcacacgcagaaataagaaatcagttgtcaaatcagcagagcagttcatgctttttgagcatcaaactgggtttgtctccattctaagattgaagaaagagtactttcttcaatctttt

SEQ ID NO: 7594 - protein, 77 aa, Streptococcus pyogenes
LEFYALFLSLGSQKFRVTSLPVLTPLLPQQKAAVLAHVTRRNKKSVVKSAEQFMLFEHQTGFVSILRLKKEYFLQSF

SEQ ID NO: 7595 - DNA, 96 bp, Streptococcus pyogenes
ttggcaagaatcaactttttaatgtcaggcataccaatagtccttatcattgtaacgattataaaaaaaggtttgagacaattgtctcaaaccttt

SEQ ID NO: 7596 - protein, 32 aa, Streptococcus pyogenes
LARINFLMSGIPIVLIIVTIIKKGLRQLSQTF

SEQ ID NO: 7597 - DNA, 447 bp, Streptococcus pyogenes
atgccttctttagaacatgttataagtcctgatactaagtcgtcaaaagaagctgctgtttgtcttgcaaaactagcttcaatcagcatggctaagttaaggccagaaagaacattacacgtcgtgtttggaagagattccattaaggttgcagcgactttaaaaggggtacctcctagaaggtcacaaagaactaaggtttcctcttctgggattaaagcacgagataattggtcctgcacatcagcggcggtcatctcagtagtaaaatcaattgcagttaccttttcttgtttgcctgcgatcaattctaaggctgaaacaataccactcgcaaaatgtccatgtcccataacgataatagcaatcataaataaatctccttcggtttaccggtttactcaaaaatattgtagcgctttcaaaattctttgtcaatactttttt

SEQ ID NO: 7598 - protein, 149 aa, Streptococcus pyogenes
MPSLEHVISPDTKSSKEAAVCLAKLASISMAKLRPERTLHVVFGRDSIKVAATLKGVPPRRSQRTKVSSSGIKARDNWSCTSAAVISVVKSIAVTFSCLPAINSKAETIPLAKCPCPITIIAIINKSPSVYRFTQKYCSAFKILCQYFF

SEQ ID NO: 7599 - DNA, 153 bp, Streptococcus pyogenes
gtgatttctgaccaagtagaggtaaccagaaaagggacttttacgatggaattgaatttacttgttgcattcttgtgcatgttaagagagaaaacccagataaatcaggaagtaaaatggttatgtttgattagaattgtccttctttttcct

SEQ ID NO: 7600 - protein, 51 aa, Streptococcus pyogenes
VISDQVEVTRKGTFTMELNLLVAFLCMLREKTQINQEVKWLCLIRIVLLFP

SEQ ID NO: 7601 - DNA, 1413 bp, Streptococcus pyogenes
atgagaaaagtagctatttactctagagtatcaacaataaatcaagccgaagaaggatattccattcaaggacagattgaagctttaacaaagtattgtgaggcaatggaatggaaaatttacaaaaactactctgatgcaggtttttcaggcggtaaacttgaacgaccggcaataacagaattgattgaagacggtaaaaacaataaatttgatactattttagtctataaactagacaggctatcaagaaatgtaaaagacacactttacttagtcaaagatgtatttactgctaacaatatccattttgtcagcttaaaagaaaatatcgacacttcttcagcaatgggaaatctctttctcactctcttgtcagctattgcagagtttgaaagagaacagattaaagagcgaatgcagtttggtgttatgaatagagcaaaatctggaaaaacaacggcttggaaaacaccaccttatggatatagatacaacaaagacgaaaaaacattgtcggtcaacgagttagaggctgctaatgtcaggcagatgtttgacatgataatctctggctgctcaatcatgtcaattacaaattacgcgagagacaatttcgtcgggaatacgtggacacatgtaaaagtaaaaagaatattagaaaacgaaacatataaaggattagtgaagtatagggaacaaactttctcaggtgatcatcaagccattatcgacgaaaaaacatataataaagcgcaaatagctttagcacataggacagatacgaaaacaaatactagaccttttcaagggaaatatatgctttctcacatagcaaaatgcggttattgtggtgcccctttaaaagtatgcacaggaagagctaagaacgatggtacgagaaggcaaacttacgtttgtgttaataaaacagaaagtttggctagacgaagtgttaataattataataaccaaaagatttgtaacactggtcgatatgaaaaaaaacacatcgaaaaatatgttattgatgttctttataaacttcaacacgataaagaatatcttaaaaaaataaaaaaagatgacaatataattgatattacacctttaaaaaaagaaatagagataatcgataaaaaaatcaatcgtctaaacgatttatatattaatgatttgattgacctaccaaaactaaaaaaagacatcgaagaactcaatcatttaaaagatgattataacaaagcaattaaattgaattatttagacaagaaaaacgaagactctcttggaatgctgatggataaccttgacattagaaaatcttcgtatgatgttcaatctaggatagttaagcaattgatagatagagtcgaggttactatggataacatcgatattatttttaagttt

SEQ ID NO: 7602 - protein, 471 aa, Streptococcus pyogenes
MRKVAIYSRVSTINQAEEGYSIQGQIEALTKYCEAMEWKIYKNYSDAGFSGGKLERPAITELIEDGKNNKFDTILVYKLDRLSRNVKDTLYLVKDVFTANNIHFVSLKENIDTSSAMGNLFLTLLSAIAEFEREQIKERMQFGVMNRAKSGKTTAWKTPPYGYRYNKDEKTLSVNELEAANVRQMFDMIISGCSIMSITNYARDNFVGNTWTHVKVKRILENETYKGLVKYREQTFSGDHQAIIDEKTYNKAQIALAHRTDTKTNTRPFQGKYMLSHIAKCGYCGAPLKVCTGRAKNDGTRRQTYVCVNKTESLARRSVNNYNNQKICNTGRYEKKHIEKYVIDVLYKLQHDKEYLKKIKKDDNIIDITPLKKEIEIIDKKINRLNDLYINDLIDLPKLKKDIEELNHLKDDYNKAIKLNYLDKKNEDSLGMLMDNLDIRKSSYDVQSRIVKQLIDRVEVTMDNIDIIFKF

SEQ ID NO: 7603 - DNA, 363 bp, Streptococcus pyogenes
atgacgttaaaacaacttttaaaatcaaaaaatctgggagaatattttgaagcaaaaaacaatgcagaaaagatgaatgagattgaaaaccgtggcttaaagcaagtaatgaaaaactcagtacgacagacccaattaaatagcgaaataaaacaagtgataaaaaaagaaaaagaggcggtaagatgtccaaaatgtaaaagtactaatgttggatttatgcagcaaggtaaaaagacattttctgttaaaaaggccgtcgcaggaactcttttaataggtggaacagttatgggatttttaggagaaaaagggaagaagcaatggcactgtaacgagtgcagctgtatatttgagacaaaa

SEQ ID NO: 7604 - protein, 121 aa, Streptococcus pyogenes
MTLKQLLKSKNLGEYFEAKNNAEKMNEIENRGLKQVMKNSVRQTQLNSEIKQVIKKEKEAVRCPKCKSTNVGFMQQGKKTFSVKKAVAGTLLIGGTVMGFLGEKGKKQWHCNECSCIFETK

SEQ ID NO: 7605 - DNA, 303 bp, Streptococcus pyogenes
ttgacaatttggaacgtaggttttataataaaggtgttccaaaacgggaacaaaaataaaaaaaggagtatgtatatgacaatcaatttgaagcgactaaaagccgagcgaattgctagcggtatgacacaatgtgaagttgcacaatctatggggtggaaaacacgaacaccatatgcaaaaagagagaacggtattgtttcaattggagctgatgagcttgcaaaaattactttgatttttggattaccaatcgaaaaaatagcaattttttttgataaagacgttcccgtaatggaacga

SEQ ID NO: 7606 - protein, 101 aa, Streptococcus pyogenes
LTIWNVGFIIKVFQNGNKNKKRSMYMTINLKRLKAERIASGMTQCEVAQSMGWKTRTPYAKRENGIVSIGADELAKITLIFGLPIEKIAIFFDKDVPVMER

SEQ ID NO: 7607 - DNA, 135 bp, Streptococcus pyogenes
atgaaaaacaaaaaagagcaatggaccccaaaagttcactgttttcgaaaagatggttcacaatgtgagccagaaaatataacagtgccaatttcttttgcaggttactatcaaattttattagaactaggagta

SEQ ID NO: 7608 - protein, 45 aa, Streptococcus pyogenes
MKNKKEQWTPKVHCFRKDGSQCEPENITVPISFAGYYQILLELGV

SEQ ID NO: 7609 - DNA, 123 bp, Streptococcus pyogenes
atgaaactattagattttatttttacaaaaccaaaaaaacaggaaccgattaaacacgatactaagcgattgtcatctgaaaagcagtatgatgcattccacgcttatatgagaaaaaaagta

SEQ ID NO: 7610 - protein, 41 aa, Streptococcus pyogenes
MKLLDFIFTKPKKQEPIKHDTKRLSSEKQYDAFHAYMRKKV

SEQ ID NO: 7611 - DNA, 225 bp, Streptococcus pyogenes
atgaaacaacaactaattaacgacaacgaatttttgcgagacgaaaatcgcaggttaaataatgaattggcggaacattactttgtagttacagctaaagcaaatttattagatgtcattattgctagtgattttatcttgaaaagtacgctagataaatgcattgctgaattggatgaaattgatcaaatagccctgttaaaagcatggaacaagggagaatta

SEQ ID NO: 7612 - protein, 75 aa, Streptococcus pyogenes
MKQQLINDNEFLRDENRRLNNELAEHYFVVTAKANLLDVIIASDFILKSTLDKCIAELDEIDQIALLKAWNKGEL

SEQ ID NO: 7613 - DNA, 1338 bp, Streptococcus pyogenes
atggaacaagggagaattataatgtcaataacaataaacaaacttgaaatcgaaaacgttaagcgtattaaagcggtaaagattgaaccatctgcaacaggcttgaccattatcggtggtaataataaccaaggcaaaacaagcgtattagatgctattgcttgggcactaggcggtaataaatacaagcctagtcaagctatgcgcgaaggatcgcaagtgccacctacgcttaaaattaccatgtcaaatggacttattgttgaacggaaaggcaaaaatgccagtcttaaagtaattgatccaaacggccaaaaaggtggtcagcagttgctagatagctttgtagaagaattggctattaacttgccgaaatttatggatagtacaccaaaagagaaagcagatgtcttgcttgaaattattggtgtcggtgatcagctagcagagttagagctaaaagaaaaagaaatatacaatcaacgtcacgctatcggtgttatagcagaccaaaaagaaaagtttgctaaggagatgacatattatcctgacgcacctaaacaactggtaagtatttctgagcttatccaacaacaccaagctatcttagccaaaaacggagagaatgctcaaaagcgtcaaaatgtagaacgtattcgctatgattataatcaatctatcttggaagttgaccgtttacgcaagttattagcagatgcagaagctaagacgaataagttaagcgaggatttaaaaatagcaaatactgacgctatggatttacatgatgaatcaacagctgaaatcgaggcgaatattgccgatattgatgaagtcaaccgcaaagtgcgcgctaactttgataaagataaagctgaagaagatgctaaacagcagcgtgaacaatataacatattgactaatgatattgagtcaattcgtcaacaaaaaagagacttattgattaatgcagatttgccgcttgaaggcttatcagtagatgatggaaagttactttaccttggtcaagagtgggataacatgtcaggcagccaacaactaatagtagcaactgctattgtacgtaaactaaaaccagattgtggctttgttttgattgataaactcgaacagatggacaacatcacacttgaacaatttggtaaacggctagagcaggagggtttgcaagctattgcaacccgtgtatcaattggtgaagagtgtgccatcattatagaagatggatactcagtggaaaacaaagctcataactttaaaacagcagagggtggtaattttgctgaaacagtagcaccgacttggaaaggtgagttt

SEQ ID NO: 7614 - protein, 446 aa, Streptococcus pyogenes
MEQGRIIMSITINKLEIENVKRIKAVKIEPSATGLTIIGGNNNQGKTSVLDAIAWALGGNKYKPSQAMREGSQVPPTLKITMSNGLIVERKGKNASLKVIDPNGQKGGQQLLDSFVEELAINLPKFMDSTPKEKADVLLEIIGVGDQLAELELKEKEIYNQRHAIGVIADQKEKFAKEMTYYPDAPKQLVSISELIQQHQAILAKNGENAQKRQNVERIRYDYNQSILEVDRLRKLLADAEAKTNKLSEDLKIANTDAMDLHDESTAEIEANIADIDEVNRKVRANFDKDKAEEDAKQQREQYNILTNDIESIRQQKRDLLINADLPLEGLSVDDGKLLYLGQEWDNMSGSQQLIVATAIVRKLKPDCGFVLIDKLEQMDNITLEQFGKRLEQEGLQAIATRVSIGEECAIIIEDGYSVENKAHNFKTAEGGNFAETVAPTWKGEF

SEQ ID NO: 7615 - DNA, 1089 bp, Streptococcus pyogenes
atgcaaattacaagaggtaaacgagcacgtgctcaacgtgtcatcatttatggaccagaaggaatcggtaaatctagttttgctgctaattttcctgaaccattgttcattgatacggagggatcaacagacaatatggatgtggcccgtatggataaaccaacaagctacactatgctaaaaaatcaaattgcatggattaaagcgaatccaacatgttgcaagacactggtcattgacacaatcgattgggcagaaagcttaatagtagatgatgtctgtgctcaacatggcaagaaaggtatcgaggactttggttggggcaatggttatacctacacaaaagaggaagtaggtcgattcttgaatatgctccaagaactgattgaactcggtatcaatattgtattaactgcccatgcacaaatgagaaaatttgaacaacctgacgagatgggagcttatgaccgttgggagttgaaacttggtaaaaagacaagctcacagactgcccccttggtcaaagaatgggctgatatggtcttgtttgccaactacaaaacagtagttatgactagcgaatcaaaaaagaaaaaggcaactggtggtcaacgtgtgctatacacgcaacatcacccagcgtgggatgcaaaaaaccgtcatgggttaccagacgaaatgcctcttgactatgcagtaatcgcacatctattcgcacaagtaccaactcaaccagtgccacaaacgccaccagtacaggaaactcctgcatcacaaaccgcacatgaatccgtacatgagcaagctgaaaaagcaccagaacaaccacctatgcaaccgacatctgcgccggtagcctacccaccaagtatgccaaaagcattgactgacttgatgtcggcagagcaggtcactcctgatgagcttgtggcagtagcaaacatccgaggacacttcccgccaatgacaccaattgaaaacttcccgtcagattattggaatatgattgtggccaattggttagctacgttagaagtgattaaaacgcaagtgcgtactgtcgagccaccctttactgtggaaggcgca

SEQ ID NO: 7616 - protein, 363 aa, Streptococcus pyogenes
MQITRGKRARAQRVIIYGPEGIGKSSFAANFPEPLFIDTEGSTDNMDVARMDKPTSYTMLKNQIAWIKANPTCCKTLVIDTIDWAESLIVDDVCAQHGKKGIEDFGWGNGYTYTKEEVGRFLNMLQELIELGINIVLTAHAQMRKFEQPDEMGAYDRWELKLGKKTSSQTAPLVKEWADMVLFANYKTVVMTSESKKKKATGGQRVLYTQHHPAWDAKNRHGLPDEMPLDYAVIAHLFAQVPTQPVPQTPPVQETPASQTAHESVHEQAEKAPEQPPMQPTSAPVAYPPSMPKALTDLMSAEQVTPDELVAVANIRGHFPPMTPIENFPSDYWNMIVANWLATLEVIKTQVRTVEPPFTVEGA

SEQ ID NO: 7617 - DNA, 420 bp, Streptococcus pyogenes
atgaataaaacaatcaaattagacttgtctgccatcggagaaggtggcttacaagaaaaagtagacaaggaattggaaaaagtctttgacaatatcttagatcctaatacagaaacaaaagtagcccgtaaagtaactattacgttaactatgaaaccagacgatgcccgtcaaactgtttcaacagctatggaagttaagtcaacgctagcaccacagacaggcgtggctacaacggtccttgttggtcaaaaagatggtaaggtttatgctaacgagctcaaaagcgcgatgcctggtcaaacttattttgacgatgaggcagtgctaagaactgacatcggtgaaccaattgatcaccttgaaaaaggtattaatgaagatgttattgattttaataagcaaaagaaagtaggaaac

SEQ ID NO: 7618 - protein, 140 aa, Streptococcus pyogenes
MNKTIKLDLSAIGEGGLQEKVDKELEKVFDNILDPNTETKVARKVTITLTMKPDDARQTVSTAMEVKSTLAPQTGVATTVLVGQKDGKVYANELKSAMPGQTYFDDEAVLRTDIGEPIDHLEKGINEDVIDFNKQKKVGN

SEQ ID NO: 7619 - DNA, 732 bp, Streptococcus pyogenes
atgacagaaaacattaaagaagctttggaatatgcagtaaatacagctcacgaaaaacctaagactatcttgggtagtgatggtaaagagtattatgatcgcaacaaatattctttggttgaacttaaaactaagtattatccaaaaacattgaatttaaacacgcttgacagtttaattgattatcttaaatcagatatgaacaatattaattccaagcgtcttatggtcattgtagaaggccctcgtgaagttattgtttgcgaagaagatgatgacgaccttaatcgaaatgtgttagtaactgtggaggcaattattccaaatgttcaatttggccactatgattcaccttctgattttaatattagtctgcaatcattattcgttaacgctgacgatcgtaacacagttattgaattcgctagtgcattaaaaatcgaaaatggctcagaaattgttgatgatggcattggtcaaactgccacaattaaacaaggtgtggcaagccttgcaaaagctaaggcgccaaacccagttacattacgtccataccgcacattttctgaagtagaacaaccttcaagtgagttcattttccgcattaatcaacttgctaatatggctttgtttgaagcagatggtggaaagtggcgcttagatgctatcaataatattgctaactacttaaaagaagaacttgctgatcaaactaacattacaattttagct

SEQ ID NO: 7620 - protein, 244 aa, Streptococcus pyogenes
MTENIKEALEYAVNTAHEKPKTILGSDGKEYYDRNKYSLVELKTKYYPKTLNLNTLDSLIDYLKSDMNNINSKRLMVIVEGPREVIVCEEDDDDLNRNVLVTVEAIIPNVQFGHYDSPSDFNISLQSLFVNADDRNTVIEFASALKIENGSEIVDDGIGQTATIKQGVASLAKAKAPNPVTLRPYRTFSEVEQPSSEFIFRINQLANMALFEADGGKWRLDAINNIANYLKEELADQTNITILA

SEQ ID NO: 7621 - DNA, 633 bp, Streptococcus pyogenes
atgactgaatacaataacaactttgaccgtgaattgggatgggatgatgaaattacacaagacagtgtaggttttgttcaattagtgcctggtgattatcaattcacagtaaccaatatggagcgtgctcgtcacacacctaatccgaagagtccaggaaaattaccagcgtgtaacaaggcggtcgttacgattcaaatagaaacatcagaaggaatcgcgcaattaactcataacttattcctacatactacaacagaaggtatgctatcagctttctttggagctattggtcaaaagaaacatggggaaccacttaaaatgaactggaataccgtcatcggagctaagggggttgctcgtattaataaacgtaaaggcaccggcgattatgctgatcgcgaatacgataacatcaaatctatgatttacgctgatgaagttgattggacaaaagtattaaataaagatgtcgcacaaccacagcaaatgacacatcaacaatctgctcaacctacatatcagggacaacaggcacaaggcactaattttgcacaacaaccagcaacgcagtcatatcaacaaggtcaaatgcaaacacctcaacaacctcaaggcggatggggaggattc

SEQ ID NO: 7622 - protein, 211 aa, Streptococcus pyogenes
MTEYNNNFDRELGWDDEITQDSVGFVQLVPGDYQFTVTNMERARHTPNPKSPGKLPACNKAVVTIQIETSEGIAQLTHNLFLHTTTEGMLSAFFGAIGQKKHGEPLKMNWNTVIGAKGVARINKRKGTGDYADREYDNIKSMIYADEVDWTKVLNKDVAQPQQMTHQQSAQPTYQGQQAQGTNFAQQPATQSYQQGQMQTPQQPQGGWGGF

SEQ ID NO: 7623 - DNA, 627 bp, Streptococcus pyogenes
atgggagaatattgtcacttaaaagaattagatggacttagatttggatcattgacagtcattaatagaaaccgtaacaattctaagggtggcaatgcacgatggaattgtctttgcgactgcggaaataaaacagttgttattggaagtaaattaagaagtggttatacaaaatcatgtggatgtgcacgtaaaaatgacaacgctaaaggttattcatctacaagactttacagaatttggaaaggcatgatgaatagatgctataaccacaaaaacgataattacaaatattatggtggaaaaggtatttcaatctgtgatgaatggctaacttttattaattttagaacatggtcgctctctaatggatataaagaatcattaaccattgatagaataaatccaaaaggtaactatactccactaaattgcagatgggtaagtatgaaaatgcagcaaaacaataaaacgaataataggtatttatcatatttaggtcaagaatatactattgctgaattttcagagaagttaaatgttacctattggactgtaataaatcaattgaaattaggttggagtgtagaaagaatagtagaagaagcgagaatgaaaaatgacaga

SEQ ID NO: 7624 - protein, 209 aa, Streptococcus pyogenes
MGEYCHLKELDGLRFGSLTVINRNRNNSKGGNARWNCLCDCGNKTVVIGSKLRSGYTKSCGCARKNDNAKGYSSTRLYRIWKGMMNRCYNHKNDNYKYYGGKGISICDEWLTFINFRTWSLSNGYKESLTIDRINPKGNYTPLNCRWVSMKMQQNNKTNNRYLSYLGQEYTIAEFSEKLNVTYWTVINQLKLGWSVERIVEEARMKNDR

SEQ ID NO: 7625 - DNA, 2271 bp, Streptococcus pyogenes
atgacagatgataaatttgatttattacctttacttgattatattgatccatcaaaactatcatatcaagactgggtgaatgttggttttgccctaaaacacgaaggatatactgctatggattgggacatttggtcacagtctgacagtagatacaaaaagggtgaatgtttcgctaaatgggatagtttccaaggtaatggacttgggactgtcactggcgcaactatcacacagttagcgaaagaaaacgggtggacatctgactaccgtacgagtgatgaagcccacgagcttgattgggatagcactattgatcgtgactataaaattattgacaagaactggatcgaagcaaaagaaattagagaacctactaactggtcacccgttcacgatttgattacttacatcaacactctttttgaatcaactgacaaagtcggatatgtaacagaaacatacccgattgaaatagataagggcattatctataaaccaacaaaaggagcctatgacaggacagctggtcagcttatccaagaattacaaaaaaatcctaatgacattggtgctgtcctcggtgactataaagaagaagctggtgcatggatacgatttaaccctttagatggcaatggtgtcaaaaacgacaatgtaacagactttaggtatgccttggttgaatccgatagtatggaacttggtaagcagtatgctttatttaaagaactagaattgccaatagcgacattggtccatagcggtaaaaaatcattacacgctattgtcaaagtagatgctaaagattatcaggagtaccgcaaacgggttgattacatctatcaaatctgtaagaaaaacggccttgatattgacacacagaatcgtaatccaagtcgtctatcacgaatgccaggtattatgcgaaatggtcacaagcaatttttgattgatacaaatattggtaaaaccaattatgaagaatggtatcaatggattgaagatttaaatgatgatttaccagagccagaaacgctagctgatgaatgggataatttgccagagctggctcctgaattaattaaaggagtgttacgccaaggacataaaatgctaattgcaggaccatcaaaagccggtaagtcatttgcattgattgagttatctattgctttggctgagggacagaaatggttaggttggcaatgtgaacaagggaaagtcctctatgtcaatttggagctagacagaccatcagctttgcaccgctttaaagatgtttatgatgcgatgggattacctcccgctaatgtggcaaacattgacatttggaacctccgtggaaaaacagtaccaatggataaattagcacctaaacttatcagacgctcactgaagaaaaattaccaagctgttattatcgaccctatttataaagttctcactggcgatgaaaacagtgctgatcagatggcccattttacaaatcaatttgataaggtggccactgaacttggatgtagcgtaatttattgccaccaccattctaaaggaagtcaaggtggcaaaaaatccatggacagggcaagtggttctggagtatttgctcgtgaccctgatgcattgattgacttagtggagcttgagttgactgaagaccttatcaaggcacgctcagaaaaagcagctgctaagatttaccaacaagcgttgcaggaaaaagctctaggatactatcaacaggaagtaacgctagacgacctagaaagtcgttatcagatgcaacaacattttgacaaagctatcaaggatatcatggttaaacagccatatcttgaggccgtcaaaaaagcccagcatgaggtagaaattgccacagcgtggcgagttgatggaacgctacgtgagtttgcgaagtttcagccagttaatatgtggtttagttatcccaagcacgaggtggatacaactggcgtgttggctgatattcagttggaagatagtaaacctctttggaaaaaagctaaagaagctaggaaaagtaaagaagagaatctcaaggaacggaaccaaaaacttgagacagcttatagcgccttatttgatggttcaacaccggttacagtgcaagaaattcgtgaatacttggatttaaaatccaataaaagcgttgaaaattatatcaaggaacacgatggttacgatgtcaaaaaaggtgttgtgttccaaatttctgataacaaagaaacggaaaagaaagaaaataac

SEQ ID NO: 7626 - protein, 757 aa, Streptococcus pyogenes
MTDDKFDLLPLLDYIDPSKLSYQDWVNVGFALKHEGYTAMDWDIWSQSDSRYKKGECFAKWDSFQGNGLGTVTGATITQLAKENGWTSDYRTSDEAHELDWDSTIDRDYKIIDKNWIEAKEIREPTNWSPVHDLITYINTLFESTDKVGYVTETYPIEIDKGIIYKPTKGAYDRTAGQLIQELQKNPNDIGAVLGDYKEEAGAWIRFNPLDGNGVKNDNVTDFRYALVESDSMELGKQYALFKELELPIATLVHSGKKSLHAIVKVDAKDYQEYRKRVDYIYQICKKNGLDIDTQNRNPSRLSRMPGIMRNGHKQFLIDTNIGKTNYEEWYQWIEDLNDDLPEPETLADEWDNLPELAPELIKGVLRQGHKMLIAGPSKAGKSFALIELSIALAEGQKWLGWQCEQGKVLYVNLELDRPSALHRFKDVYDAMGLPPANVANIDIWNLRGKTVPMDKLAPKLIRRSLKKNYQAVIIDPIYKVLTGDENSADQMAHFTNQFDKVATELGCSVIYCHHHSKGSQGGKKSMDRASGSGVFARDPDALIDLVELELTEDLIKARSEKAAAKIYQQALQEKALGYYQQEVTLDDLESRYQMQQHFDKAIKDIMVKQPYLEAVKKAQHEVEIATAWRVDGTLREFAKFQPVNMWFSYPKHEVDTTGVLADIQLEDSKPLWKKAKEARKSKEENLKERNQKLETAYSALFDGSTPVTVQEIREYLDLKSNKSVENYIKEHDGYDVKKGVVFQISDNKETEKKENN

SEQ ID NO: 7627 - DNA, 216 bp, Streptococcus pyogenes
atggaaatttacaaacaaagaatgattgaagaatataaacagttaaaaaaacgcgcagaaaaactatctattgtgctaaacagatactaccttgatgagttagattttgaattatcttgcccaattgaacttttacaaacgcaatggcatattatgggagcgtatttgaaaattctagaacaaagatttttggttgaagggatttattttaatgat

SEQ ID NO: 7628 - protein, 72 aa, Streptococcus pyogenes
MEIYKQRMIEEYKQLKKRAEKLSIVLNRYYLDELDFELSCPIELLQTQWHIMGAYLKILEQRFLVEGIYFND

SEQ ID NO: 7629 - DNA, 411 bp, Streptococcus pyogenes
ttgaagggatttattttaatgattgaattttttttgcctatggataaaatcccgacgacaactcatcagcaaaagaaagtgactgtcataaatggcaagcctcacttttacgagcctgagagtttgaaaaatgctagggataagtttacaagtcttttggctcagcatgtaccacccagtaagttagatggtcctatccgtctgacagtcaagtggctatttcccaaaatcaagggcagcacaaacggacagtacaaaacgacaaaaccagataccgacaacctgcagaagctgcttaaagactgcatgaccgaattgggattttggaatgatgatgcgcaggttgcttcggaaattattgagaagttctgggctgatacagtaggaatatacgtaaaggtggaagagtta

SEQ ID NO: 7630 - protein, 137 aa, Streptococcus pyogenes
LKGFILMIEFFLPMDKIPTTTHQQKKVTVINGKPHFYEPESLKNARDKFTSLLAQHVPPSKLDGPIRLTVKWLFPKIKGSTNGQYKTTKPDTDNLQKLLKDCMTELGFWNDDAQVASEIIEKFWADTVGIYVKVEEL

SEQ ID NO: 7631 - DNA, 219 bp, Streptococcus pyogenes
atgaaaattgattatattaatttttttgaacaagtggttcctgactggatgagagagagtaatgtcaaaatgcaagaagttggatttaatactgaagcgtattggcaatgggcaaatcaatctattgttgcaatctgcgaaaagtacggaaatgacagtctgatcaatgggcagtttcatctgatttgggaatggttggaggataaagcaaacggaggt

SEQ ID NO: 7632 - protein, 73 aa, Streptococcus pyogenes
MKIDYINFFEQVVPDWMRESNVKMQEVGFNTEAYWQWANQSIVAICEKYGNDSLINGQFHLIWEWLEDKANGG

SEQ ID NO: 7633 - DNA, 426 bp, Streptococcus pyogenes
atgaaactgcccattgatcagactgtcatttccgtacttttcgcagattgcaacaatagattgatttgcccattgccaatacgcttcagtattaaatccaacttcttgcattttgacattactctctctcatccagtcaggaaccacttgttcaaaaaaattaatataatcaattttcataactcttccacctttacgtatattcctactgtatcagcccagaacttctcaataatttccgaagcaacctgcgcatcatcattccaaaatcccaattcggtcatgcagtctttaagcagcttctgcaggttgtcggtatctggttttgtcgttttgtactgtccgtttgtgctgcccttgattttgggaaatagccacttgactgtcagacggataggaccatctaacttactgggtggtacatgc

SEQ ID NO: 7634 - protein, 142 aa, Streptococcus pyogenes
MKLPIDQTVISVLFADCNNRLICPLPIRFSIKSNFLHFDITLSHPVRNHLFKKINIINFHNSSTFTYIPTVSAQNFSIISEATCASSFQNPNSVMQSLSSFCRLSVSGFVVLYCPFVLPLILGNSHLTVRRIGPSNLLGGTC

SEQ ID NO: 7635 - DNA, 699 bp, Streptococcus pyogenes
gtgctagcgaagatagagctagacagacaaagcgaattgcggaacttacgcacaacggagggtaacatgattaagatcgatgagatacatcgcatactaggcatcgacgaagtttataaagcacccaaacgacttacggacatactctttgataaagatagtcgtgaggatatatttagacagtttttgaaatatgaaacagatgtatcttacgactggtttatgcaatattttgaggaagaacaagctgaccgcaaaaataaaaagcaagactttactcctaaatcggttagtacactattatctaaaataataagtggtaatcaatactacgaggtagcagtcgggacgggtgggatacttatccaagcatggcaagaacaacgattaaatgacagtccatttacttatcgtccgagtaaatactggtatcacgtagaagagttatcggacaaagcagtaccgtttctactctttaatatgtctataagagggataaatggtgtggtggtgcatggcgactctttaacaagacaagttaaaaacatttattttttgcaaaatacaaaagacgacatgctgagttttagtgatattaacgttatgccaaggactcaagatattgagcgagaatttaatgtcaaagagtggattggtgatgggatagaacacattgaaaatccactaattgaatggata

SEQ ID NO: 7636 - protein, 233 aa, Streptococcus pyogenes
VLAKIELDRQSELRNLRTTEGNMIKIDEIHRILGIDEVYKAPKRLTDILFDKDSREDIFRQFLKYETDVSYDWFMQYFEEEQADRKNKKQDFTPKSVSTLLSKIISGNQYYEVAVGTGGILIQAWQEQRLNDSPFTYRPSKYWYHVEELSDKAVPFLLFNMSIRGINGVVVHGDSLTRQVKNIYFLQNTKDDMLSFSDINVMPRTQDIEREFNVKEWIGDGIEHIENPLIEWI

SEQ ID NO: 7637 - DNA, 432 bp, Streptococcus pyogenes
atgacgttttttcctgagattgatatccaaaaaacaaaatccaatgccaagcgtaaattgagagagtatccacgctggcgaaggatagctaatgacgtagatactcaaaaagttacagctacttactcctttgagccaaggcaatcacatggggttcctagcaaaccggttgagagactagcgctaaaccgtgtgtcagcagaacaagagctggatgcgattgagcaagccgtcagtatgatactagagccagagagacgcaggattttgtatgacaaatacttagcgccttataaaaaggcagataaggttatttatacagaattgtgtatgtcagagagcttttactatgatacacttgacattgctttgttagcttttgcagagctgtacagagagggtgtgttgcttgttgaggaaggagtttttagc

SEQ ID NO: 7638 - protein, 144 aa, Streptococcus pyogenes
MTFFPEIDIQKTKSNAKRKLREYPRWRRIANDVDTQKVTATYSFEPRQSHGVPSKPVERLALNRVSAEQELDAIEQAVSMILEPERRRILYDKYLAPYKKADKVIYTELCMSESFYYDTLDIALLAFAELYREGVLLVEEGVFS

SEQ ID NO: 7639 - DNA, 144 bp, Streptococcus pyogenes
gtgggacgtgcaggttcgattccgactgttcctgtgaaaagctctaagaagcctacgggccttaggagcgatgaagttagagaattgcatatcgctctaactcaatatgcactagtcatcacaccgtggtggctttttattatg

SEQ ID NO: 7640 - protein, 48 aa, Streptococcus pyogenes
VGRAGSIPTVPVKSSKKPTGLRSDEVRELHIALTQYALVITPWWLFIM

SEQ ID NO: 7641 - DNA, 1164 bp, Streptococcus pyogenes
atggagtttgtggacaaaaaattaagtgaaataacaccttataaaaataaccctagaaacaatgatgaggctgttggaccagttgctgaatctattaaagagtttggttttaaagtgcctattgtcgttgataaaaacggcgaaatcgtaaacggccacactcgttataaagcagcccaaaaattagggctagaaacagttcctgttattgtcgcagatgacttatctgaagagcaaattaaagcgttcagacttgctgacaataaagttggtgagattgcggtttgggatttagatttgttaaacgaagaattaaacgacattttagacctcgatatgtctgcttttggatttgacgttttagataatttagatgatttaatcgaagatgaaaaagatttagacgattttacagggactgtgccagatgagccaaagtcaaaacttggtgacatttatcaacttggtagtcacaagttgatgtgcggcgacagtacaaatggagccgatgttaaaaaacttatgaatggagaattagctgatttactacttacagacccaccatacaacgtggcttatgagggtaaaacaaaagatagtttaactataaaaaacgacagtatggataatgacagttttagacagttcttggttaatgcttttagttctgcaaatgaagttatgaagccaggcgctgttttttatatttggcatgctgattcagaaggctataattttagaggtgcttgttttgatatcggttggacagtacgtcaatgcttaatttggaataaaaactcaatggttctcggtcgccaagattatcattggaagcacgaaccttgtctttatggctggaaagatggcgctggtcacttgtgggcttcagacagaaagcaaacatcagttattgattatgagaaacctcaacgaaatggcgttcatccaacaatgaaacctgtcggactttttgattaccaaatcaaaaacaacacaaagggaagcgacattgtccttgatttgtttggtggctctgggacaacgttaattgcttgtgagtcaaatggtcgtcacgctagattaatggaatatgacccaaaatatgtagatgtcattataaaacgctgggaagaattaactggagaaagtgttatacaactaaac

SEQ ID NO: 7642 - protein, 388 aa, Streptococcus pyogenes
MEFVDKKLSEITPYKNNPRNNDEAVGPVAESIKEFGFKVPIVVDKNGEIVNGHTRYKAAQKLGLETVPVIVADDLSEEQIKAFRLADNKVGEIAVWDLDLLNEELNDILDLDMSAFGFDVLDNLDDLIEDEKDLDDFTGTVPDEPKSKLGDIYQLGSHKLMCGDSTNGADVKKLMNGELADLLLTDPPYNVAYEGKTKDSLTIKNDSMDNDSFRQFLVNAFSSANEVMKPGAVFYIWHADSEGYNFRGACFDIGWTVRQCLIWNKNSMVLGRQDYHWKHEPCLYGWKDGAGHLWASDRKQTSVIDYEKPQRNGVHPTMKPVGLFDYQIKNNTKGSDIVLDLFGGSGTTLIACESNGRHARLMEYDPKYVDVIIKRWEELTGESVIQLN

SEQ ID NO: 7643 - DNA, 474 bp, Streptococcus pyogenes
atggcaaatgaagataatttgataccaaactccaaacgaaccccgagcgaactccgagaaattgcaaaaaaaggaggcatagcttccggcaaagctaggagggaaaaagcgaatttgagaaaagctgtggagctggtgttaggatcaactgtaccaagcgccttgcttcgagaacaattagaacaattggatatttcccccacaaatcaatcagctattgcactcaagcttgtggaaaatgctttaaagggtgatgttagatctgcagagctattagctaaaattacaactaccgaggtcaaagatagcctggatagaaaagaacaaagacagcgaattaaggccgcggagctcgccacagacgagcaacgaacgcgcatcgagctgcttaaagtcaaacttgacgcagagaagggcgctaagcctgatactagcttaatgagagccttgttagatgctgtggaaggaggtgat

SEQ ID NO: 7644 - protein, 158 aa, Streptococcus pyogenes
MANEDNLIPNSKRTPSELREIAKKGGIASGKARREKANLRKAVELVLGSTVPSALLREQLEQLDISPTNQSAIALKLVENALKGDVRSAELLAKITTTEVKDSLDRKEQRQRIKAAELATDEQRTRIELLKVKLDAEKGAKPDTSLMRALLDAVEGGD

SEQ ID NO: 7645 - DNA, 1209 bp, Streptococcus pyogenes
ttgacccctcgtagcggaaagaccacagctgggcattttcgttatgctaggtatctgattgagtcagaagatgaaaatcaccttgtgactgcttataatcaagaacaagcttatcgtttgtttatcgacggcgatggtacgggtttgatgcatatatttgacggtaactgtgaaataaaacacgacgagcgtggagatcacttgttaatcacgacaccaaaaggcaataagcgcgtttattataaaggcggcggtaaagttaacagtgttggtgctattacaggtatgtctttaggatcagtagtattctgcgagattaacttactgcacatggattttatccaggagtgttttaggcgtacttgggcggctaagctacgttatcatctagcagatttaaatcccccagcacctcaacatccagtaattaaagatgtctttgatgttcagaacacgaggtggactcattggaccatggatgataacccaatactaaccgcagagcgtaaacaaaacattatcaacagtcttaaaaaaaatccatatctatacaaacgagatgtacttggacagcgggtcatgcctcagggagttatttatggcctttttgacacggaaaaaaatgttttggatgctttgattggcgaaccagtagagatgtatttctgtgcagatggaggtcaatcagatgccacctctatgtcttgtaatatcgtaacaagagttagagataacggtaggataagcttcagacttaatcgtgtagctcactactaccacagcggagctgacactggccaagtaaaagctatgtcaacctacgctttagagttaaaagtttttatagactggtgcgttaaaaagtatcagatgcgctatacagaggtatttgtggatcctgcctgtaaatctttgagagaggagctgcataagttaggagtatttactctgggagctccgaacaattctaaagatgtatctagcaaagcaaaaggtattgaggtcggtatcgaacgcggccaaaacattatctcagatggcgctttttatcttgttaatcatagcgaagaagagtatgaccactaccactttttaaaagagatagggctgtacagtcgtgacgacaatggcaaacctattgataaagataaccatgccatggacgagtttagatacagcgtcaacgtgtttgtgcatcggtattacaac

SEQ ID NO: 7646 - protein, 403 aa, Streptococcus pyogenes
LTPRSGKTTAGHFRYARYLIESEDENHLVTAYNQEQAYRLFIDGDGTGLMHIFDGNCEIKHDERGDHLLITTPKGNKRVYYKGGGKVNSVGAITGMSLGSVVFCEINLLHMDFIQECFRRTWAAKLRYHLADLNPPAPQHPVIKDVFDVQNTRWTHWTMDDNPILTAERKQNIINSLKKNPYLYKRDVLGQRVMPQGVIYGLFDTEKNVLDALIGEPVEMYFCADGGQSDATSMSCNIVTRVRDNGRISFRLNRVAHYYHSGADTGQVKAMSTYALELKVFIDWCVKKYQMRYTEVFVDPACKSLREELHKLGVFTLGAPNNSKDVSSKAKGIEVGIERGQNIISDGAFYLVNHSEEEYDHYHFLKEIGLYSRDDNGKPIDKDNHAMDEFRYSVNVFVHRYYN

SEQ ID NO: 7647 - DNA, 1500 bp, Streptococcus pyogenes
atgggagtaatccaaaaaataaaaaatcttgttacaaggagtaaatacgtgatgacaacgcagagtcttacaaatataactgatcatcctaaaatagctatcagtaagctagagtacgatcgtataacaaccaatctaaagtattataagagcgattgggatagtgttttatacttaaacacggacggcgagactaaaaaaagagatcttaaccatctaccaattgcacggacagctgctaaaaagattgccagtctagtctttaacgagcaggcagagattaaggttgatgatgatgcggctaacgaatttattagtgagacactaaaaaacgacaggtttaataaaaacttcgagcggtatctggagagttgtttagcgttaggcggattagctatgaggccttatgtggatggtgataaagttagggtagcatttgttcaagcgcctgtttttttgccgctgcagagtaatacgcaagacgtttcgagtgccgccgtcgtcattaagtccgttaagacaatcaacggcaaagaggtctactataccttgatagagttccatgagtggcagagctctgatgattatgttatctcaaatgagttatatcgctcggatgataaagccaaagtaggtagccgagtgccgttatctgaggtatacaaggacttaaaagacgaggcaaaagttacagatgtgactaggcctatctttacttatctcaagacccctggaatgaataacaaggatattaatagcccacttgggctatctatctttgataacgccaagacaacgattgactttatcaatacgacctatgacgaatttatgtgggaagttaagatgggtcaacgtcgagttgctgtgccagagagtttgaccgctttaactgttcgtaccgctgatggcgatgttgttccaaggcctcggttcgagtctgatcaaaacgtttatatccgtatgggcggcagggatttagactcaagcgcaatacaggacctaacaacccctattagagctgatgactatatcaaggctatcaacgagggcttgtcgttgtttgaaatgcaaataggcgtatccgctgggttatttagttttgatggcaaaagcatgaagactgcaacagaaatcgtctctgaaaactcagacacctaccaaatgcgtaacagtattgttactttagtagagcaatcgctaaaagagttagttatctctatttttgagattgctaaagcttatgatttgtaccaaagcgaagttccaagcatggataacatcagcataagtcttgatgacggtgtttttacagatcgagacgctgagttagactactggataaaagttgttaatgctggctttggcactcgtgagatggccatccaaaaagtgctaaacgtgacagaggaaaaagcccaagaaatagctgcagaaattaatactggaatcgttgacgaaatcaatcaacagcgcactgatacacatttatacggagag

SEQ ID NO: 7648 - protein, 500 aa, Streptococcus pyogenes
MGVIQKIKNLVTRSKYVMTTQSLTNITDHPKIAISKLEYDRITTNLKYYKSDWDSVLYLNTDGETKKRDLNHLPIARTAAKKIASLVFNEQAEIKVDDDAANEFISETLKNDRFNKNFERYLESCLALGGLAMRPYVDGDKVRVAFVQAPVFLPLQSNTQDVSSAAVVIKSVKTINGKEVYYTLIEFHEWQSSDDYVISNELYRSDDKAKVGSRVPLSEVYKDLKDEAKVTDVTRPIFTYLKTPGMNNKDINSPLGLSIFDNAKTTIDFINTTYDEFMWEVKMGQRRVAVPESLTALTVRTADGDVVPRPRFESDQNVYIRMGGRDLDSSAIQDLTTPIRADDYIKAINEGLSLFEMQIGVSAGLFSFDGKSMKTATEIVSENSDTYQMRNSIVTLVEQSLKELVISIFEIAKAYDLYQSEVPSMDNISISLDDGVFTDRDAELDYWIKVVNAGFGTREMAIQKVLNVTEEKAQEIAAEINTGIVDEINQQRTDTHLYGE

SEQ ID NO: 7649 - DNA, 1491 bp, Streptococcus pyogenes
atgaaaaagaagcctattaagttaaatgacgaacagcttcttttggaagctagtcagttatctgatatgtatcatcagctgactcttgatttatttgatcaagtgattgagaggataaaagccagaggctcagcgagcttagccgataatccttatctttggcaagctaataagttacatgacgttggactgcttaatgcagataacatcaagcttattgcaaagtattctggcattgcggaagctcaacttcgctatattatcaagaatgaaggatttaaaatttataaaaacacgtctgagcagctagaagaggctctaggtagagagtctggggtaaacagtactatccaagacgacctatctaactatgctagacaagctattgatgatgtgcataatttgactaacaccaccttgccatttagtgttataggagcttatcaagggataatccaagacgctgttgctggtgtggtgacaggcttaaaaacgcctgaccaagctatcaatcaaactgtgattaaatggtttaaaaaggggttttatggttttacagataaagctgggagaaagtggagagcagactcttatgctcgtaccgttatcaatactacgacttggcgagtctttaacgaagccaaagaagcccctgctagggagtttggcattgataccttctattactcaaaaaaagctacagctagagagatgtgtgcacctttgcaacatcaaattgtcactactggcgaagcgagagaagaaggagggataaaaatcttagctttatctgattacgggcatggtgagcctgatggatgcttgggaatcaactgcaagcacactaaaacgccgtttgtcgtcggtgtgaatagtaagccagaattgccagagcatctaaaaaatatcactcctgcacaagctaaagctaatgcgaatgcgcaagctaagcagagggcaatcgagagatcaatacgtaagagtaaagagctactgcacgttgcgaagcaattgggtgataaagagttgattaggcaatatcaatcggatgttagaagtaaacaagatgcactcaattatctgataaacaacaatgcctttttacatcgcaatcaagccagagaaaagcgttacaataatccttataccaaaactcaaagtgaagtcgaagttagaaaagaaaaagctaaattagataaacgtagggatgttgaaagtgctataataggagtagaaactagtgaagggataccgctaaaaataacaaagcatttagccgaaagggcggtgctgagaaatatagcacctattgatattgtcgattctataaaagaaccgttgaagatagctcctattaagtacgataaccttgatagaccttcccagaaatacattggtaagtgtgtctcgacagtaataaacccgatagacggaaatattgttacagttcatgctactagcacgagaatccgcaaaaaatatggaggaaat

SEQ ID NO: 7650 - protein, 497 aa, Streptococcus pyogenes
MKKKPIKLNDEQLLLEASQLSDMYHQLTLDLFDQVIERIKARGSASLADNPYLWQANKLHDVGLLNADNIKLIAKYSGIAEAQLRYIIKNEGFKIYKNTSEQLEEALGRESGVNSTIQDDLSNYARQAIDDVHNLTNTTLPFSVIGAYQGIIQDAVAGVVTGLKTPDQAINQTVIKWFKKGFYGFTDKAGRKWRADSYARTVINTTTWRVFNEAKEAPAREFGIDTFYYSKKATAREMCAPLQHQIVTTGEAREEGGIKILALSDYGHGEPDGCLGINCKHTKTPFVVGVNSKPELPEHLKNITPAQAKANANAQAKQRAIERSIRKSKELLHVAKQLGDKELIRQYQSDVRSKQDALNYLINNNAFLHRNQAREKRYNNPYTKTQSEVEVRKEKAKLDKRRDVESAIIGVETSEGIPLKITKHLAERAVLRNIAPIDIVDSIKEPLKIAPIKYDNLDRPSQKYIGKCVSTVINPIDGNIVTVHATSTRIRKKYGGN

SEQ ID NO: 7651 - DNA, 228 bp, Streptococcus pyogenes
ttgatgaaattaaaaagtattttaaatgatagtcaaatcgattttgtcaaaaatgaacttccgggattacctgtggatatagatgttaattccgaaaagtatgatgttttttgtgaaggtatagagacttactaccagacagaaagctttgatgaaaagtacaatataacagctaaaggtaaactagctgagagtattattgatttactgactgataaaggttattgg

SEQ ID NO: 7652 - protein, 76 aa, Streptococcus pyogenes
LMKLKSILNDSQIDFVKNELPGLPVDIDVNSEKYDVFCEGIETYYQTESFDEKYNITAKGKLAESIIDLLTDKGYW

SEQ ID NO: 7653 - DNA, 264 bp, Streptococcus pyogenes
atgaataaacgcattaagaaaaaacgtaaactagaaacagcagttgtgatgcttgttgcagaaaatgccatgcaggttgaagcaattaaaaatcaaaacaaacaaatcatggagctaaaatcaatcgttcaacgaaacgctctggcaacaaacgaagagttagcgactgttaaagctgctactttagataaccaatcagttatcaaggcaattggtgacacggttgactatattaagaaaaactacaaacggaagtgggggaaa

SEQ ID NO: 7654 - protein, 88 aa, Streptococcus pyogenes
MNKRIKKKRKLETAVVMLVAENAMQVEAIKNQNKQIMELKSIVQRNALATNEELATVKAATLDNQSVIKAIGDTVDYIKKNYKRKWGK

SEQ ID NO: 7655 - DNA, 612 bp, Streptococcus pyogenes
atgcacatggaaaatgtgacaaacgaaaatgtcgaccaagagactactgacttggaaaataatcaacaagaagataaagcatttacacaagatgatctcaaccgagtgggaactaaagagcattctaaaggctataacaaagcagttaaagacttgggttttgatgatgtagagtctgccaaggatgcactaaaagccttccaagagtggcaagagtcacaaagaagcgagtcagaaaaacaaacagaaatcttgaatgctaaagacaaagagcttgaggaagctcgggcaaacaataaggctcttaatgcaaagctagcagcaatgtctttaggtgtgaacgctgaatctattgatgatgtgattgcactatctgagcgtcttgtcactgacgagacaagcatagaggatgcaatcaaaacggttttgggtaagtatcctcactttggccaaacaaaggataaagctcccaaaatcacagtggcaggcaacccgtctgctgataacggacaaggttcggtgtctaaggaagactttgcaaagatgtcttaccaagaaaaactggacctaaaactaaaaaataagaatctttatgaccaattgaaaggaaat

SEQ ID NO: 7656 - protein, 204 aa, Streptococcus pyogenes
MHMENVTNENVDQETTDLENNQQEDKAFTQDDLNRVGTKEHSKGYNKAVKDLGFDDVESAKDALKAFQEWQESQRSESEKQTEILNAKDKELEEARANNKALNAKLAAMSLGVNAESIDDVIALSERLVTDETSIEDAIKTVLGKYPHFGQTKDKAPKITVAGNPSADNGQGSVSKEDFAKMSYQEKLDLKLKNKNLYDQLKGN

SEQ ID NO: 7657 - DNA, 816 bp, Streptococcus pyogenes
atggcagtaggaacaactaaaatggcacaaatgctagaccctgaggttctagcggatatgattgacgcagaggtagggaaagcgattcgctttgctcctcttgctgaagtagatacaactttagaaggacaaccaggtacaactttaacagtgcctaaatgggattacattggtgacgcagaagatgttgccgagggtgaagctatcccaatgactcaacttggcttcaaaaagactactatgaccattaaaaaagccggaaaaggtgtagaaatcactgacgaagctatcttatctgggtatggggatcctgtaggtcaggcagcaaagcaaatcgttgaggctattgaccacaaagtcgatgcagacgtgcttgatgcgttaagtaaatcgactcaaactgtggaagctactgctacggttgatggtgtatctaaagcgctagatatttttaatgacgaagatgacgcagagacagtcattgtcatgaatccggcggatgcctctaccctacgtttagatgccgcgaaggagtggttaggtgctaccgaggttggagcaaatcgtgttgtctctggtgtttatggtgaagttttaggggtacaaattgtgcgttctcgcaaatgccctaaaggaactgcctacatggttcgcaaaggtgcactacgtatcatgcttaaacgtaacacaatggttgaaacagaccgagatatcacaaaagcgattaatcaaatcgtagctaataagcattatggtgtttatctttataaggcagaaaaagccgtcaaaattacacttaaagatgccgcaaaaaag

SEQ ID NO: 7658 - protein, 272 aa, Streptococcus pyogenes
MAVGTTKMAQMLDPEVLADMIDAEVGKAIRFAPLAEVDTTLEGQPGTTLTVPKWDYIGDAEDVAEGEAIPMTQLGFKKTTMTIKKAGKGVEITDEAILSGYGDPVGQAAKQIVEAIDHKVDADVLDALSKSTQTVEATATVDGVSKALDIFNDEDDAETVIVMNPADASTLRLDAAKEWLGATEVGANRVVSGVYGEVLGVQIVRSRKCPKGTAYMVRKGALRIMLKRNTMVETDRDITKAINQIVANKHYGVYLYKAEKAVKITLKDAAKK

SEQ ID NO: 7659 - DNA, 414 bp, Streptococcus pyogenes
atggaggtggttattatcgcttttttaacgcaaaaagaatttgaagatttgggttttgacgaggtagaagattttgaaaaaatggaaaaacgtgctagccacgctgtcaatctttactgtcgtaatcgctatgattacaaagatttaaaaaaagaaatagccctagtgcaaaaggctgtaaagcgggcaatcgcttatcagatagcatatttaaatgactcaggagtaatgacagcagaggataaacaatcctttgctggaatatctctaggacggacaagtattagctacactgtcgggcatggccaaggcagccaacaaaaaactctggcagacaggtttaatctctgtctagatgcagagaatgagttactagctgttgggttgggatatacgggtattagctatgatcga

SEQ ID NO: 7660 - protein, 138 aa, Streptococcus pyogenes
MEVVIIAFLTQKEFEDLGFDEVEDFEKMEKRASHAVNLYCRNRYDYKDLKKEIALVQKAVKRAIAYQIAYLNDSGVMTAEDKQSFAGISLGRTSISYTVGHGQGSQQKTLADRFNLCLDAENELLAVGLGYTGISYDR

SEQ ID NO: 7661 - DNA, 357 bp, Streptococcus pyogenes
ttgggttgggatatacgggtattagctatgatcgataaaagactgcttattgacgaactgcaggtaaaacttgtcaaagataaaggtgattatggagggtttgtctatgacgaaccttttacactctctcccgttaggtttgaccgtaatcttgcaaccgcaggtaaagataatgcaaggcaagagactaagccgtcggttatctttatttatcctaaatactgtaagacagtagccgataggtcatgggttgatgctgttgtcattgatggtgatactgagtacaccgttgataaagtgataccagtctaccacccactaacaaacaaaattttttgttttgaagtggaggttatc

SEQ ID NO: 7662 - protein, 119 aa, Streptococcus pyogenes
LGWDIRVLAMIDKRLLIDELQVKLVKDKGDYGGFVYDEPFTLSPVRFDRNLATAGKDNARQETKPSVIFIYPKYCKTVADRSWVDAVVIDGDTEYTVDKVIPVYHPLTNKIFCFEVEVI

SEQ ID NO: 7663 - DNA, 354 bp, Streptococcus pyogenes
atggctaaggtagtggtagagttgggaggcatcaagcgtaaagtatctccgcaagcattagctaaaggaaagctcatcatgaacaaccaagtcatgatgtccatgaacccttatgttccttacagagacggagctttgagaggaagctcgagagctaacagtgtaggtgtaacgtggagcggaccacacgccagagcccagttttatggtggtgcttacaacaagtacaagtcctttaaatttaaaaagtacacaacaccaggtacaggcaaacgttgggataaacgtgcgttagctaatgcaacaattgtcaaggattgggaaaaatccttactgagaggaatgggatttaaa

SEQ ID NO: 7664 - protein, 118 aa, Streptococcus pyogenes
MAKVVVELGGIKRKVSPQALAKGKLIMNNQVMMSMNPYVPYRDGALRGSSRANSVGVTWSGPHARAQFYGGAYNKYKSFKFKKYTTPGTGKRWDKRALANATIVKDWEKSLLRGMGFK

SEQ ID NO: 7665 - DNA, 396 bp, Streptococcus pyogenes
atgacaaatgactttgcaactgttttgaggcaatttgtcgaaggattagacttaggcataaagcccagacttgactatctaacaagacaagaagatttagccatttatccaatgccaggtgggaaggtaaataacgagtacatggacggtactcgtgagataagcctgccttttgagattgcaatcaaaactaaaaatcaggagttagcaagcactgtgatgtggactattaacagtgctttgtctaactttgacttaaaattaccaagtcttaatcattcgtacacatttattagccttgatgtcgaaaagccgtttttaaatgacttaagcgatcaaggtttttatatttatgtgctggatattacagcacacttagaaatagaagggaataac

SEQ ID NO: 7666 - protein, 132 aa, Streptococcus pyogenes
MTNDFATVLRQFVEGLDLGIKPRLDYLTRQEDLAIYPMPGGKVNNEYMDGTREISLPFEIAIKTKNQELASTVMWTINSALSNFDLKLPSLNHSYTFISLDVEKPFLNDLSDQGFYIYVLDITAHLEIEGNN

SEQ ID NO: 7667 - DNA, 393 bp, Streptococcus pyogenes
atgagacaaaagaacgccctacgtgggcattttatcgcaccttatgtaaaaggtgaggaaaagacagaagttacaaaagagaagcttttggaattggctagatggattaaagacatctcagacgataccgacgaaaagacagaagatgaggcgtactatgacggagatggaacagaagaaacaaccgttgtaggagttaagggcgcgtacactttcgaagggacgtatgatccagaagacaaagctcaagctcacattgcaagtcttaagtataagctaggagatgagcgaaaagtttggcatttgattgtatcggctgatgggaaaacccagtggctaggggttgcaacagtgacagaaattattgctggttctggtgctgccgcacgattt

SEQ ID NO: 7668 - protein, 131 aa, Streptococcus pyogenes
MRQKNALRGHFIAPYVKGEEKTEVTKEKLLELARWIKDISDDTDEKTEDEAYYDGDGTEETTVVGVKGAYTFEGTYDPEDKAQAHIASLKYKLGDERKVWHLIVSADGKTQWLGVATVTEIIAGSGAAARF

SEQ ID NO: 7669 - DNA, 432 bp, Streptococcus pyogenes
atgtctggaattgtagttgacctaaagcgcacagggtttccggtcaaaattgggcaggtagagctttggtttgatacaagccaagagcgattgattgagttttttgatattgagacagaagtaaatcgtcgcctcaatgaatacgaaaaacaggttatcgaagccaacttagacaacgaaattgaagataaaggggttacgaaagatgttgcccaaagtgctttagatttggaagctaaatacttagaaatcaattatgatctactattcggagaaggtacatttgcacagctctacgcggagtatcccgacaaagaagcactcgagaatactctggaaattgtttgcagggaaatcgaggtcaaactcaaagagttagctatcgaaagagaaaaaatcgttaagcagaaaacgaaaaagtacaaaaaggag

SEQ ID NO: 7670 - protein, 144 aa, Streptococcus pyogenes
MSGIVVDLKRTGFPVKIGQVELWFDTSQERLIEFFDIETEVNRRLNEYEKQVIEANLDNEIEDKGVTKDVAQSALDLEAKYLEINYDLLFGEGTFAQLYAEYPDKEALENTLEIVCREIEVKLKELAIEREKIVKQKTKKYKKE

SEQ ID NO: 7671 - DNA, 579 bp, Streptococcus pyogenes
atgaaactaaacgatccattagtagagtcgtttgagtttagaggtgaaatctatcctattgatttgagctttaacaaggttttagatgtctttgatgttattgatgatgattttttaaacgaggcggaaaagtgttttttgtgccttgatattttgctagataggacagatttaccttttacttacgcggtggatctttgggtttatatcaaaaccaattttatcgatgcagaaaggcccgagaaacctcagctcgacatcaaagggaatccaatgcctgtagtaaaagaaaaagaggataacaaaaaagtcattgatttgagtttagacgctgagtttatctatgcgagctttaggcaagcctaccaaatcaatcttttaaaagagcaaaacagattgtcttggattgaattcaaggctcttttaaatgctcttccagacgatactgtcatgcagcgtatcatagccattagacagtgggaagatgatggtgaaggcagtaaaaaatacagagataacatgcgtaagctaaaggctaagtacagtttagatgaaagagaggaggaggacgatggcagc

SEQ ID NO: 7672 - protein, 193 aa, Streptococcus pyogenes
MKLNDPLVESFEFRGEIYPIDLSFNKVLDVFDVIDDDFLNEAEKCFLCLDILLDRTDLPFTYAVDLWVYIKTNFIDAERPEKPQLDIKGNPMPVVKEKEDNKKVIDLSLDAEFIYASFRQAYQINLLKEQNRLSWIEFKALLNALPDDTVMQRIIAIRQWEDDGEGSKKYRDNMRKLKAKYSLDEREEEDDGS

SEQ ID NO: 7673 - DNA, 714 bp, Streptococcus pyogenes
atgacagcttttatcaagtttgatggtaaaaaatcttcagattttgatttgagaattattaatgacgttgagcatgactcgtccttttacgatgttgatcaagttaaggtacctggtcgtgatggtgtggttttaaaggacaataaaaggcttgaggctattgaacggtcttaccctttacgtctatatagcaaaagacgactcaccgaagtagaaactgacataagcaattggctgaatgtaaaaggttggaaagacttagagttgtcatgggagcctgattatatctataaagcaacacatatcaccccttttagcataaaggaggttttaaggaatttcggcagactgaaaatcaacttcttaatccaccctatcaaatatttaaaaacaggtaagcaagaggtgcctctcgttaatggcggtactctacaaaatcccggcaatgttcaagctaaacctatcctaaaaatcaaaggcacaggcaatggtattttaaccattaatgactttgagacaggacttgaaaatgtgcagagcgagcttgttatagatatggaaaggcacctagtctataaagatgtcctatctgcttgggataatatcgtaagaacagaacgccaccgcatgccgttatttgacgttggacaaaataaaatctcgtggactggtagctttacaattaccgcagtgccaaactggggggttaaagta

SEQ ID NO: 7674 - protein, 238 aa, Streptococcus pyogenes
MTAFIKFDGKKSSDFDLRIINDVEHDSSFYDVDQVKVPGRDGVVLKDNKRLEAIERSYPLRLYSKRRLTEVETDISNWLNVKGWKDLELSWEPDYIYKATHITPFSIKEVLRNFGRLKINFLIHPIKYLKTGKQEVPLVNGGTLQNPGNVQAKPILKIKGTGNGILTINDFETGLENVQSELVIDMERHLVYKDVLSAWDNIVRTERHRMPLFDVGQNKISWTGSFTITAVPNWGVKV

SEQ ID NO: 7675 - DNA, 105 bp, Streptococcus pyogenes
atgtcactagctgttcttcgggttgtttatgctcgcctacatgcggcttaccagggggttcctcttgcggttttggttgtggcgtatatcttacgtaaggataga

SEQ ID NO: 7676 - protein, 35 aa, Streptococcus pyogenes
MSLAVLRVVYARLHAAYQGVPLAVLVVAYILRKDR

SEQ ID NO: 7677 - DNA, 1011 bp, Streptococcus pyogenes
atgagtgaaaatataccgctgcgagtccaatttaagcgcatgaaagccgccgagtgggctcgtagtgatgtcatcttactggagagcgagataggctttgagacagacacaggttttgccagagcaggtgatggccacaatcgatttagtgaccttggatacattagcccactcgattacaatctactgactaacaagccaaatatcgatggattagcgacaaaagtcgagaccgctcagaaactacaacaaaaagcagataaagagaccgtctatacaaaagctgaatcgaagcaagagcttgacaagaaattaaatctcaaaggtggcgttatgacaggtcaactaaaatttaagccagccgccactgttgcttattcctcgtcaacgggtggagcggtcaatattgacttgtcgtctaccagaggtgctggtgttgttgtctattctgacaatgataccagtgatgggccgttaatgagcttgcggacgggtaaagagacctttaatcaatcggcgctttttgtcgactataaggggacaacaaatgctgttaatattgcgatgcgtcagccaaccacccccaatttttcatcggcgcttaatattactagcggcaatgaaaatggtagtgcaatgcagctacgagggtcagaaaaagcgctaggaacgctaaaaattactcatgagaacccaagtattggagcggattatgataaaaatgcggcagcgttatccattgatattgtcaaaaagacaaacggtgcaggaacagccgctcagggaatctacattaactcaacctcaggcacgacagggaagttgcttaggattagaaaccttagtgatgataagttctacgtcaagtctgacggtggtttttatgccaaggaaacttcgcagattgatggcaacctgaaactcaaggaccccacagcgaatgatcatgcggcaaccaaagcttatgtagataaagcaatttctgagttaaaaaaactcatactaaaaaaa

SEQ ID NO: 7678 - protein, 337 aa, Streptococcus pyogenes
MSENIPLRVQFKRMKAAEWARSDVILLESEIGFETDTGFARAGDGHNRFSDLGYISPLDYNLLTNKPNIDGLATKVETAQKLQQKADKETVYTKAESKQELDKKLNLKGGVMTGQLKFKPAATVAYSSSTGGAVNIDLSSTRGAGVVVYSDNDTSDGPLMSLRTGKETFNQSALFVDYKGTTNAVNIAMRQPTTPNFSSALNITSGNENGSAMQLRGSEKALGTLKITHENPSIGADYDKNAAALSIDIVKKTNGAGTAAQGIYINSTSGTTGKLLRIRNLSDDKFYVKSDGGFYAKETSQIDGNLKLKDPTANDHAATKAYVDKAISELKKLILKK

SEQ ID NO: 7679 - DNA, 1884 bp, Streptococcus pyogenes
atgagcagagacccaacacttattttagacgagtcaaacctcgttattggtaaggatggacgtgtgcattacacatttaccacagaggacgacaacccaaaagtcagactagctagcaagtgtctaggcacagcgcattttaatcagctcatgattgagcgaggagaccaagctactagctatgttgcgccagtagtagttgagggtacaggtaatccgactggactatttaaagacctcaaagagattagcttagagctgacagatactgctaattcccagctttggtcaaaaatcaagctgactaaccgtggtatgttgcaggaatactacgacggtaagatcaagaccgagatagtcaactccgccagaggtgtcgctacacgtatcagcgaggatactgataaaaagctagcgctcatcaatgacaccattgatggtatcaggcgtgagtatcgagatgctgataggaagctatccgcaagctatcaggcaggcatcgaggggctaaaagccacaatggccaatgataaaatcggtttacaagctgagattaaagcctcagcacaagggctatcgcaaaagtatgatgatgagttgcgcaagctatcggctaagatcacaacaacctcaagcggcactacagaggcctacgagagtaagcttgcgggcttacgtgctgagtttactcgctcaaatcaaggcacgaggacagagctcgagtcacaaattagcgggctaagagcggtacagcagtcaacagctagccaaatctctcaagagattagagaccgtgaaggtgctgtcagtcgtgtgcagcagagtttggagagttaccaaaggcggatgcaggacgcagaagaaaactatagtagcttgacccatacggttagagggctacagagcgacgttggatctccgactggtaaaatccaatcgcgccttactcaactagcaggacaaattgagcagcgggttactagagatggtgtcatgagtattattagtggcgctggagacagcattaaattagctatccaaaaggctggcggcattaatgccaaaatgtctggtaatgagattatctcagcaattaacctcaactcctacggagtaacaatcgcaggtaaacacatcgctctcgatgggaatacgacggttaatggcacctttaccacaaaaatagccgaggctatcaagattagggctgatcagattattgcaggcacgattgacgctgctaggattagagtgattaaccttaacgcaagtagtatcgttggtttagacgctaactttatcaaagctaaaattggctatgctatcactgatttgctcgagggtaaggtcattaaggctcgtaatggagcgatgcttatcgacttaaatacagctaagatggactttaatagcgatgccacaattaattttaatagcaaaaacaatgccttagtacgtaaagatggcacacatactgcctttgtacattttagtaatgcgacgcccaaaggttatacagggtcagcgttgtatgcatcgatcgggataacctcatctggtgacggtgttaactcggcttcttccggtcgttttgcagggctaaggtcatttaggtacgctacgggatataatcacactgcggcagtcgaccagactgaaatttacggtgataatgttttagttgtggatgattttaatattactcggggatttaagtttagaccagacaagatgcaaaaaatgcttgacatgaacgacttgtatgcggctgtagtagccttaggccgctgttgggggcacttggctaacgtcggctggaatactgctcatagcaattttacaagtgctgtgaatagggaattgaataactacatcacaaaaatt

SEQ ID NO: 7680 - protein, 628 aa, Streptococcus pyogenes
MSRDPTLILDESNLVIGKDGRVHYTFTTEDDNPKVRLASKCLGTAHFNQLMIERGDQATSYVAPVVVEGTGNPTGLFKDLKEISLELTDTANSQLWSKIKLTNRGMLQEYYDGKIKTEIVNSARGVATRISEDTDKKLALINDTIDGIRREYRDADRKLSASYQAGIEGLKATMANDKIGLQAEIKASAQGLSQKYDDELRKLSAKITTTSSGTTEAYESKLAGLRAEFTRSNQGTRTELESQISGLRAVQQSTASQISQEIRDREGAVSRVQQSLESYQRRMQDAEENYSSLTHTVRGLQSDVGSPTGKIQSRLTQLAGQIEQRVTRDGVMSIISGAGDSIKLAIQKAGGINAKMSGNEIISAINLNSYGVTIAGKHIALDGNTTVNGTFTTKIAEAIKIRADQIIAGTIDAARIRVINLNASSIVGLDANFIKAKIGYAITDLLEGKVIKARNGAMLIDLNTAKMDFNSDATINFNSKNNALVRKDGTHTAFVHFSNATPKGYTGSALYASIGITSSGDGVNSASSGRFAGLRSFRYATGYNHTAAVDQTEIYGDNVLVVDDFNITRGFKFRPDKMQKMLDMNDLYAAVVALGRCWGHLANVGWNTAHSNFTSAVNRELNNYITKI

SEQ ID NO: 7681 - DNA, 429 bp, Streptococcus pyogenes
atgcaattaactattaaaaacaaagatttaaacacactatatcgtgtactagacaaaatcaaaatcactaatatgcgtgctaatcgtggccgtgctaagctactcgcaaaagtagtcgataaaatcaacgagtatgcaaaagatgagaccgacttaattgatatgtatgcagctaaggataaagatgacaaatttgtcattgatgagcacaaaaacatcaagctagcagaccccgctaaactcgacgagctcaacgacctactcaacgagctagcagacgaagaaattgtgattaaagggggtgagtactccaagcgatttattgactttttaaactttttagaagagtgtgaagatgaatttacatcatctgaaatcattcttatcgacaacattttggaacaatttgaagaaagtaaaaaaggagaa

SEQ ID NO: 7682 - protein, 143 aa, Streptococcus pyogenes
MQLTIKNKDLNTLYRVLDKIKITNMRANRGRAKLLAKVVDKINEYAKDETDLIDMYAAKDKDDKFVIDEHKNIKLADPAKLDELNDLLNELADEEIVIKGGEYSKRFIDFLNFLEECEDEFTSSEIILIDNILEQFEESKKGE

SEQ ID NO: 7683 - DNA, 615 bp, Streptococcus pyogenes
atgagaaattggaaagtgacaggaaaatacccacaatttgacagcacaggagcagtcgcaagcacacatattattatcactgctgaggatggctcagtcatctctcaaccaatcaagcaggacttaacctcaactaatgacacagagattatcaaagctactttggaagaatttaaaaaatctgaatacgttgaaatcgctatgggcgaagccgtgcaaaaagtagacgaccttgaaaaaatctcacaggaaaccgctaagaccgctaaaacagcccaaacagccgcaggattagctaaggtgtccgcagagcgtacacagcgaatgattaacttgcaaaccatccacatgttaacgagcggcggcaagattgattctgacatttataaaggcatgcttgagctaatcgagccagcccaaaaaggtgagtatcaagcctatgatgtctttacggtggtcgacagtactaaagaggaagacggagaggctggtgaaggtaacctagtcttcgtacacgttaacgaagcatttgagtatgacaaacaaaccttagaggagctagagtcagaagccaaagtaacagttatcaagtacgctgatttggttaaacaagat

SEQ ID NO: 7684 - protein, 205 aa, Streptococcus pyogenes
MRNWKVTGKYPQFDSTGAVASTHIIITAEDGSVISQPIKQDLTSTNDTEIIKATLEEFKKSEYVEIAMGEAVQKVDDLEKISQETAKTAKTAQTAAGLAKVSAERTQRMINLQTIHMLTSGGKIDSDIYKGMLELIEPAQKGEYQAYDVFTVVDSTKEEDGEAGEGNLVFVHVNEAFEYDKQTLEELESEAKVTVIKYADLVKQD

SEQ ID NO: 7685 - DNA, 273 bp, Streptococcus pyogenes
atggcaacagagttgatatttggcgttggtggctttattttagctatcgtcacgacttacaatatttttaatgcaaaatccatcaagcatgcgacagatattactttgttgcaatctgaggtagagcatttaaaaattgttacacgccaaaatgctcggcggcttgaagagcacgctgagcaaaataaaacgttgattacaatgacagagcaaattaaaaatttaacagatgatgttaaagatttaaaagatatgatgagaggagaaatcaaa

SEQ ID NO: 7686 - protein, 91 aa, Streptococcus pyogenes
MATELIFGVGGFILAIVTTYNIFNAKSIKHATDITLLQSEVEHLKIVTRQNARRLEEHAEQNKTLITMTEQIKNLTDDVKDLKDMMRGEIK

SEQ ID NO: 7687 - DNA, 225 bp, Streptococcus pyogenes
atgatcaatttaaaattacgactacaaaacaaagtaaccttgatggctattttgggagctatctttttactggcacagcaattaggtattaaactaccatcaaacatcgcagatattgcaaacacagctgtaacgcttttggtattgctcggtgttgtcacagatccaaccacgaaaggcctgtcagatagtgagcaagcattgacttaccatgagcccaaaaaa

SEQ ID NO: 7688 - protein, 75 aa, Streptococcus pyogenes
MINLKLRLQNKVTLMAILGAIFLLAQQLGIKLPSNIADIANTAVTLLVLLGVVTDPTTKGLSDSEQALTYHEPKK

SEQ ID NO: 7689 - DNA, 705 bp, Streptococcus pyogenes
atgaaaaagattaacatcatcaaaatagttttcataattacagtcatactgatttctactatttcacctatcatcaaaagtgactctaagaaagacatttcgaatgttaaaagtgatttactttatgcatacactataactccttatgattataaaaattgcagggtaaatttttcaacgacacacacattaaacattgatactcaaaaatatagagggaaagactattatattagttccgaaatgtcttatgaggcctctcaaaaatttaaacgagatgatcatgtagatgtttttggattattttatattcttaattctcacaccggtgagtacatctatggaggaattacgcctgctcaaaataataaagtaaatcataaattattgggaaatctatttatttcgggagaatctcaacagaacttaaataacaaaattattctagaaaaagatatcgtaactttccaggaaattgactttaaaatcagaaaataccttatggataattataaaatttatgacgctacttctccttatgtaagcggcagaatcgaaattggcacaaaagatgggaaacatgagcaaatagacttatttgactcaccaaatgaagggactagatcagatatttttgcaaaatataaagataatagaattatcaatatgaagaactttagtcatttcgatatttatcttgaaaaa

SEQ ID NO: 7690 - protein, 235 aa, Streptococcus pyogenes
MKKINIIKIVFIITVILISTISPIIKSDSKKDISNVKSDLLYAYTITPYDYKNCRVNFSTTHTLNIDTQKYRGKDYYISSEMSYEASQKFKRDDHVDVFGLFYILNSHTGEYIYGGITPAQNNKVNHKLLGNLFISGESQQNLNNKIILEKDIVTFQEIDFKIRKYLMDNYKIYDATSPYVSGRIEIGTKDGKHEQIDLFDSPNEGTRSDIFAKYKDNRIINMKNFSHFDIYLEK

SEQ ID NO: 7691 - DNA, 99 bp, Streptococcus pyogenes
ttgccaagagatttaggatttttaaaaaataaggaaagaaaagccttgtcaagtcattcaagttttgttacactagaatggttaataactatgatgcat

SEQ ID NO: 7692 - protein, 33 aa, Streptococcus pyogenes
LPRDLGFLKNKERKALSSHSSFVTLEWLITMMH

SEQ ID NO: 7693 - DNA, 99 bp, Streptococcus pyogenes
ttgttaaatgctcaaagacgtagctttgcagctttgctattttcaaaggaaacgaatccatttgccttgaaatcgcagcaaagtcgaactcgaaatgtc

SEQ ID NO: 7694 - protein, 33 aa, Streptococcus pyogenes
LLNAQRRSFAALLFSKETNPFALKSQQSRTRNV

SEQ ID NO: 7695 - DNA, 111 bp, Streptococcus pyogenes
gtgttaaaaaacaagaaagaaagtgatttttcttgcaaaaaacaaaggaagcttttcatgagattgctttttaagttgattaaaggcctagtttgtggtattatgaacatg

SEQ ID NO: 7696 - protein, 37 aa, Streptococcus pyogenes
VLKNKKESDFSCKKQRKLFMRLLFKLIKGLVCGIMNM

SEQ ID NO: 7697 - DNA, 588 bp, Streptococcus pyogenes
ttgtcagctatcatccgtcaatctacctctaaacgtatctctgacaagcgtgggatctacttagtggaaaaacttgtctcattagccaagcagtcttattttactgttacgaaaacctctccgatgatagaagaggttcgctactatgccaaagaattacttagactttctgaacgtcgtcaagctatttttgataagatggtggcgtcggctcaacctttaccagaagacaagattctacgctctattccaagtatcgtagaaacaactgcaacaagtattattggcgaactcggtgctattcgtcgttttcaatctgctaatcaaattaatgctttcattgggattgactttagacattatgagtctggcaactatctagctcaagagcacattaccaaacgtgggaatccttatgctccaaagattcttttcaagtgtatccatgacattgcttttgctagtcataccaatccttgtcatatcgcagacttctatgagaaacgaaaaaggcaatcgcaaacagcttcaaccaagccacatacgattgcctctagacattgccttgtcagacaatgctttacctca

SEQ ID NO: 7698 - protein, 196 aa, Streptococcus pyogenes
LSAIIRQSTSKRISDKRGIYLVEKLVSLAKQSYFTVTKTSPMIEEVRYYAKELLRLSERRQAIFDKMVASAQPLPEDKILRSIPSIVETTATSIIGELGAIRRFQSANQINAFIGIDFRHYESGNYLAQEHITKRGNPYAPKILFKCIHDIAFASHTNPCHIADFYEKRKRQSQTASTKPHTIASRHCLVRQCFTS

SEQ ID NO: 7699 - DNA, 249 bp, Streptococcus pyogenes
gtgcgtaaagcggataagttagacactgaaaaattggctcagtctcaatttattctagttagaaaaccaacttacgttcaggaagaagtttatcagctgctacgtgacttgagtcgcttctatcaaaacttgactgaggataatattgttcgagagttaagaatcgccttcacaagatcttacaagtcacttttcctgaactggaacacatcttatttgcaccaactggtgagtaatactggaatgtgg

SEQ ID NO: 7700 - protein, 83 aa, Streptococcus pyogenes
VRKADKLDTEKLAQSQFILVRKPTYVQEEVYQLLRDLSRFYQNLTEDNIVRELRIAFTRSYKSLFLNWNTSYLHQLVSNTGMW

SEQ ID NO: 7701 - DNA, 123 bp, Streptococcus pyogenes
atggatgagcgcagaaggcatcgtggggaaactgccgtcttatcatttattgctcttcacgatacagttagaggaactcctaaaaacatatttgccaccgatacctgtctatcttttgaccaa

SEQ ID NO: 7702 - protein, 41 aa, Streptococcus pyogenes
MDERRRHRGETAVLSFIALHDTVRGTPKNIFATDTCLSFDQ

SEQ ID NO: 7703 - DNA, 948 bp, Streptococcus pyogenes
atgtcattttttacaaaggaacaacaacctaaagagaattgtccgccaataactgttgaaaaagcaaggcaattgtttgaatttaatacaaaccacttgtccttatcggattaccatcatcaaacggtgctaaaaacgtcaaagcagctagttgctcaacatttaatgcctaatgcaaccgataatcttagtcaacattttttgatgaactataaagctaataataattatttaggcttccaagctagtattgtcgacttttttacagattctgccgttgctaatttttcaagtagttacgtttatgaaagtcaggaaaagataattcgtttaccaaaacctaccaagatatcaactgctctgtcgacatgtattataaaacgaagaagtcatcgtcaattttcagatagacaaatgcctcttcaagatttatcaaacattctttattatgcatgtggtgttagttcacaagcatcaattagagatggagcatcagataagattacactcagaaactgtgcttcaggtggaggtttataccctattcatttagttttttatgctagaaacatcagtaaattaatagatggtttctatgaatatctaccctatcagcatgcactaaggtgttatcggcatagctctgaggaaaacgttagagattttgcggaatacggtgctattaatgctgaaaattgtaatattattattatttatgtctaccattacatgaaaaatacacgtaaatatgggaatcaggcgactgcctatgcttttattgaatcaggagaaatagcccagaatattcaattgactgcaactgccttaacttatggaagtattgatattggtggttataataaggaatatctccaagaattattagatttagatgggctaggagagcatgtgattcacatgacactcgtaggaactaaggagtctcaa

SEQ ID NO: 7704 - protein, 316 aa, Streptococcus pyogenes
MSFFTKEQQPKENCPPITVEKARQLFEFNTNHLSLSDYHHQTVLKTSKQLVAQHLMPNATDNLSQHFLMNYKANNNYLGFQASIVDFFTDSAVANFSSSYVYESQEKIIRLPKPTKISTALSTCIIKRRSHRQFSDRQMPLQDLSNILYYACGVSSQASIRDGASDKITLRNCASGGGLYPIHLVFYARNISKLIDGFYEYLPYQHALRCYRHSSEENVRDFAEYGAINAENCNIIIIYVYHYMKNTRKYGNQATAYAFIESGEIAQNIQLTATALTYGSIDIGGYNKEYLQELLDLDGLGEHVIHMTLVGTKESQ

SEQ ID NO: 7705 - DNA, 1056 bp, Streptococcus pyogenes
atgaaatatcaacttaatagtaatgttcgtgtcgtgacatttcaagatacattttgttttagaaaaggaatctgggactttaatgaagccattctagatttgacacaagaacctcaaaatttaaagatagtttatcaagaaatagtttcacagttggttaagggagtagccattgatactgaaacttatgaaaatactttagaacctgagacgttcgctaatttaatggaagtcatttcaggcttgtattacaatgatatgctgatgcttgaggatgactacaatcttgaagaaaatgtcatgaaaattttaatgggtaatttccgttttatggcgcaagcaggtcatatggtaagcaatgatcctgttttgtttatcagtgattcgacttatgttaatgaatctgctgagttgctagctgaacaactgcatttacaattgcaagtggctagtgatgacttaaaaatgttaattcagcagacagatgttagttcgcgtttagatgctttggagcatcgccgtaacatgaattgtttatcagatgccttgtgcgattaccaaagtattattatttgtcaagaacgcttgaatattatgatgttgcgacacttgaatgaagttagcgtagctatgaaaaaacaattagtgattggttttgtagatggaccattcttgcacacttgtactttgaatcctccccatagtgctgactttgatagcttagaaagaagagttttggcacgtttacaagactcaactctctatcaacattttgctaatcaggttttaccagccacacaagatgtgagccaggcctatttaccattgttaaatgttttaatgaatttagtcgttagcgaagctttcattattgctcaaacaggtagttctaaatttgagggacgtttattaagcatttacttaccgacgcttgagattcaggtccaagatattttgaaaatgtctaattcacagacacaaggagctttggcaaaattaaagtatgaggatcagcagatatcaacacgtgagattgttaaaaaactccttgacgag

SEQ ID NO: 7706 - protein, 352 aa, Streptococcus pyogenes
MKYQLNSNVRVVTFQDTFCFRKGIWDFNEAILDLTQEPQNLKIVYQEIVSQLVKGVAIDTETYENTLEPETFANLMEVISGLYYNDMLMLEDDYNLEENVMKILMGNFRFMAQAGHMVSNDPVLFISDSTYVNESAELLAEQLHLQLQVASDDLKMLIQQTDVSSRLDALEHRRNMNCLSDALCDYQSIIICQERLNIMMLRHLNEVSVAMKKQLVIGFVDGPFLHTCTLNPPHSADFDSLERRVLARLQDSTLYQHFANQVLPATQDVSQAYLPLLNVLMNLVVSEAFIIAQTGSSKFEGRLLSIYLPTLEIQVQDILKMSNSQTQGALAKLKYEDQQISTREIVKKLLDE

SEQ ID NO: 7707 - DNA, 1356 bp, Streptococcus pyogenes
atgttatactattatccttcttttaatcatatttttgatgaattaaaaagtttaagtggcaatcgaacaggtatcttaaatcaatctcaagttccagtttgcaaccatcctcacgatgtttacttaaaaagtattactggccaaatgccagattatcataaacaatttataggtgagttgagtcaagttagttatcacattattggttacggcagttactatgaagaagcacttatcaagtatttaggagaaagtattgaacgctatgctactgtaattgccggagacttactatcagatcggattgtctatgcttcttataatgagttaaaactgttacataaagtgatgcctttagaatacttgcaagtgtttacccaagaacagatcgcattatcttgtgacttgcaaatgatgatgtgcgataaaatggtaactgagaacgatgtattgggctgggttaaatgtcccatgttctttgaggacgcagagatgtatgttccagctcaaatgctttgtgttgggtataaaacaaatgagactgtaggagaaagacggataataccaggattttctacgggaacagcttctcacaaaacgttagaagcggctatgtgcaacagtttgattgaatacatccagatcgattcaatgatgcttagctggtatactaagaagccttgccccaagattattgttgatgatcctgatattgaagtgattttagaagaagctagactgggaaaagacagtctatacgacattattcctattgatatgactgtaggagaagataatcctctttatacgtttggaatcattctcaaaaataaatatgatgaagggccttacctcttgtttggagtgcaggctgggttagatcctaaacatgctttgctaagagggatcatggaagcttcagctattagctatagttactactataatcttttatatcaaaaagcttcccttgcaaatattgaatgcgaagaacctttgtttttagatttagatagtaatgtcttctattatgcacatcccaaggaccaagaccataaatggaaggcctttgaacctttgatttcaggagaagttctgttaagtgatttggaagatcattctggtaaagataaaaaagaagatttgaagactttattagcttatgctaagaaagtcagtcctaatgctgtctttttagatattacacctcctgaagctctagaaaaaggctggtacgtcacgcgagttctgatgccagaacttcttgaaatgtgtataccagcatttccttttgctaatcatccacgaatgagacagtttggaggtgtaacaaatgcctttgtccatccaatgcct

SEQ ID NO: 7708 - protein, 452 aa, Streptococcus pyogenes
MLYYYPSFNHIFDELKSLSGNRTGILNQSQVPVCNHPHDVYLKSITGQMPDYHKQFIGELSQVSYHIIGYGSYYEEALIKYLGESIERYATVIAGDLLSDRIVYASYNELKLLHKVMPLEYLQVFTQEQIALSCDLQMMMCDKMVTENDVLGWVKCPMFFEDAEMYVPAQMLCVGYKTNETVGERRIIPGFSTGTASHKTLEAAMCNSLIEYIQIDSMMLSWYTKKPCPKIIVDDPDIEVILEEARLGKDSLYDIIPIDMTVGEDNPLYTFGIILKNKYDEGPYLLFGVQAGLDPKHALLRGIMEASAISYSYYYNLLYQKASLANIECEEPLFLDLDSNVFYYAHPKDQDHKWKAFEPLISGEVLLSDLEDHSGKDKKEDLKTLLAYAKKVSPNAVFLDITPPEALEKGWYVTRVLMPELLEMCIPAFPFANHPRMRQFGGVTNAFVHPMP

SEQ ID NO: 7709 - DNA, 669 bp, Streptococcus pyogenes
atgcctttgtccatccaatgccttaatctttgttttttgttggtaactttttgtccttcaattcctatgcaagctatttttggaaaggaagatagtggttatgcatttaatttaattggttttctaagagcaactctgatttatgacattttggctttggtaagtatttatgttttgtcacctcaaataaccttgtctcttgaaagtattgatagtaagacgttctttatgggacttgtattttgcgtcttgatagtactgattgaactcgttttcttacatggtttacgttgttggcaaaaaaagcaatggcttcctgcaactttctcgtttgtaggaacgacaaatgattggtctaagattggctatcctttattactagctttatttgaagagacgatttatcgttttttgtggtttaatatattagcttttcaatggcatttaccaacaattattgttttaattgtaactagtttttgctatgctttaaatcacttattgatggggaaatccattttttatgctaagttggtaacaggcatcatttatggtagtatttacatgctgactagtcaattgtggttggttgtgataatgcatgtaggaggtaacttgctagttgagtgtcttagccatcttcaaacaaaaaagaagaaggaggtgaca

SEQ ID NO: 7710 - protein, 223 aa, Streptococcus pyogenes
MPLSIQCLNLCFLLVTFCPSIPMQAIFGKEDSGYAFNLIGFLRATLIYDILALVSIYVLSPQITLSLESIDSKTFFMGLVFCVLIVLIELVFLHGLRCWQKKQWLPATFSFVGTTNDWSKIGYPLLLALFEETIYRFLWFNILAFQWHLPTIIVLIVTSFCYALNHLLMGKSIFYAKLVTGIIYGSIYMLTSQLWLVVIMHVGGNLLVECLSHLQTKKKKEVT

SEQ ID NO: 7711 - DNA, 681 bp, Streptococcus pyogenes
atgatgctattggttttgctgtcgtttttaggtctaactactctttggttgaccagttatcgaagacgttgtttggctagatggcatcttcaatggttagtggccttatcctatcaagattttttagatgtcttactgagtctgtttcaatttgtcgttattatacttgttttattcttttactcagctactattaatctaggagaggttctgacctttttgacacaaactagctggcattggcagattctttgttatttagtgttatatcttatggccatcatagagatgacgcttttagttttaattcttatctttgatgttttgctccagaaagacagtcgattgctctttaaaaaaataacttggctgccttttagacaagataaaccagtcttaagtatacttttactaggcacagttattctagtagacagtctcttttatttgggcttgcttatattattaggagaacagtcgctaacaagtttagcaacgcttattttaggttatgggatagtcaaggcttgtcgctattcaggttggttaaatgtactattagctttttgtcttttcactatagttggactatgggcagttacggcaactttattatatggttggctagtaggtgcgatgatattaacggtgacttatttgatgattagttgcaaagagtat

SEQ ID NO: 7712 - protein, 227 aa, Streptococcus pyogenes
MMLLVLLSFLGLTTLWLTSYRRRCLARWHLQWLVALSYQDFLDVLLSLFQFVVIILVLFFYSATINLGEVLTFLTQTSWHWQILCYLVLYLMAIIEMTLLVLILIFDVLLQKDSRLLFKKITWLPFRQDKPVLSILLLGTVILVDSLFYLGLLILLGEQSLTSLATLILGYGIVKACRYSGWLNVLLAFCLFTIVGLWAVTATLLYGWLVGAMILTVTYLMISCKEY

SEQ ID NO: 7713 - DNA, 2730 bp, Streptococcus pyogenes
atgattaacaagaaatgtataatacctgtttcattgttgacactagctattacgcttactagtgttgaagaagttacttcacgccaaaatttgacttatgccaatgaaatcgtaacacaaaggccaaagagagaatctgttattagtgataaatcgaattttcccgtcatatcaccttacctagcaagtgtggattttggtgagagaaaaacacctttgccaacacctgataaaggagtaaaagtaactactgaacagtctattgctcaagtaagaaaggggcctgaagaaagaccctatactgttactggcaagattacgagtgtgatcaatggctggggaggctatggcttttatattcaagatagtgaaggtattggactttatgtttatcctcaaaaagatttaggatacagtaagggagatattgttcaattaacaggtacacttactcgctttaaaggtgatttacaactccaacaggtgactgcacacaaaaagttagagttatcttttccgacttctgttaaagaagcagtaatatcagaattagaaacaacaacaccctcaacattagttaagttatctcacgtgacagttggagaattatcaactgatcaatataacaacacatctttccttgtaagggatgatagtggtaaaagtatagttgttcatatagatcatcgtacaggggttaaaggggctgatgttgttactaaaataagtcagggtgatttgattaacctcacagccatattgtctattgttgatggtcaattacaattaagaccgttttctcttgaacaattggaagtggttaaaaaggtcacaagctcaaatagtgatgcttcatctcgtaatattgtgaaaataggcgagattcaaggagctagtcatacgtcgccacttctcaaaaaagcggtcaccgtagaacaggttgttgtcacttatttagacgattccactcatttttatgttcaagatcttaatggtgatggtgatttagcgacttcagatggtattcgtgtttttgctaaaaacgctaaggttcaagtcggcgatgttttgaccatttcaggtgaagtggaagaattctttggtcgtggttatgaggaacgtaagcagactgaccttaccatcacccaaattgtggctaaagcagtgaccaaaacagggacagctcaagttccatcaccgcttgttttagggaaagatcgtatcgcgccagccaatattattgataatgatggcttgcgtgtgtttgatccagaagaagacgctattgattattgggaatcaatggaaggcatgttagtggcggttgatgatgctaaaatccttggtccaatgaaaaataaagaaatttatgtcttacctggctctagtacaagaccgttaaataattcaggtggagtattacttccagctaattcttataacacagatgtgattcctgttcttttcaaaaaaggcaaacaaattattaaagcaggagactcttacaaaggaagattagctgggccagtatcttatagctatggtaattacaaggtctttgttgatgacagcaaaaacatgccaagtttaatggatggtcatctaaaacctgaaaaaacaaacttgcaaaaagaccttagcaagttaagcattgcttcttacaatattgaaaacttctcagccaatccttcttcaactaaagatgagaaggtcaaacggattgccgaatcctttattcatgatctgaatgctccagacattattggattaattgaagtccaagataataatgggccgactgatgatgggacaacggatgcgacacaaagcgcgcaacgcctcattgatgctattaaaaaactaggtggcccaacttatcgttatgttgatattgctccagaaaataatgttgacggaggtcaaccaggtggtaatattcgaacaggattcctttatcaaccagagcgcgtcagcctttctgataagccaaaaggcggtgctcgtgatgctctaacttgggttaatggagaattaaaccttagtgttggtcgaattgatccaactaacgccgcttggaaagatgttcgtaaatcactagcagcagaatttatcttccaaggtcgtaaagtcgttgttgttgcaaatcatttgaactctaagcgtggggataatgctctttatggttgtgtgcaaccagtcacttttaaatctgagcaaagacgtcacgtcttggctaatatgctagcacaatttgcgaaagaaggggcaaaacaccaagctaatattgtgatgctaggtgactttaatgattttgaattcacaaagacgattcaattaatcgaagaaggtgacatggttaacttggtgagccgacatgatatttcagatcggtattcttattttcaccaaggcaataatcagacccttgataatatattagtttcacgccatttacttgatcactacgaatttgacatggttcatgtgaattccccatttatggaagctcacggacgcgcatcagatcatgatccattgttacttcaattatcattttccaaagaaaatgataaggcagagtcttctaaacaaagtgtaaaagctaaaaaaacttcaaaaggaaaactgttgccaaaaacaggagatagtcttgtttatgtgataacgctactaggaacggctagtttattagtgcctattttattattgactaaaggcaaaaaggaatca

SEQ ID NO: 7714 - protein, 910 aa, Streptococcus pyogenes
MINKKCIIPVSLLTLAITLTSVEEVTSRQNLTYANEIVTQRPKRESVISDKSNFPVISPYLASVDFGERKTPLPTPDKGVKVTTEQSIAQVRKGPEERPYTVTGKITSVINGWGGYGFYIQDSEGIGLYVYPQKDLGYSKGDIVQLTGTLTRFKGDLQLQQVTAHKKLELSFPTSVKEAVISELETTTPSTLVKLSHVTVGELSTDQYNNTSFLVRDDSGKSIVVHIDHRTGVKGADVVTKISQGDLINLTAILSIVDGQLQLRPFSLEQLEVVKKVTSSNSDASSRNIVKIGEIQGASHTSPLLKKAVTVEQVVVTYLDDSTHFYVQDLNGDGDLATSDGIRVFAKNAKVQVGDVLTISGEVEEFFGRGYEERKQTDLTITQIVAKAVTKTGTAQVPSPLVLGKDRIAPANIIDNDGLRVFDPEEDAIDYWESMEGMLVAVDDAKILGPMKNKEIYVLPGSSTRPLNNSGGVLLPANSYNTDVIPVLFKKGKQIIKAGDSYKGRLAGPVSYSYGNYKVFVDDSKNMPSLMDGHLKPEKTNLQKDLSKLSIASYNIENFSANPSSTKDEKVKRIAESFIHDLNAPDIIGLIEVQDNNGPTDDGTTDATQSAQRLIDAIKKLGGPTYRYVDIAPENNVDGGQPGGNIRTGFLYQPERVSLSDKPKGGARDALTWVNGELNLSVGRIDPTNAAWKDVRKSLAAEFIFQGRKVVVVANHLNSKRGDNALYGCVQPVTFKSEQRRHVLANMLAQFAKEGAKHQANIVMLGDFNDFEFTKTIQLIEEGDMVNLVSRHDISDRYSYFHQGNNQTLDNILVSRHLLDHYEFDMVHVNSPFMEAHGRASDHDPLLLQLSFSKENDKAESSKQSVKAKKTSKGKLLPKTGDSLVYVITLLGTASLLVPILLLTKGKKES

SEQ ID NO: 7715 - DNA, 108 bp, Streptococcus pyogenes
ttgataacaaaagaagataacaataagacagctttacttgctaaagacttttgtcaagctaattgttttatggtacaatgtaaccgttgctttgcaacccttggtgct

SEQ ID NO: 7716 - protein, 36 aa, Streptococcus pyogenes
LITKEDNNKTALLAKDFCQANCFMVQCNRCFATLGA

SEQ ID NO: 7717 - DNA, 255 bp, Streptococcus pyogenes
atggtatgttataataatcctatggaattattaatgaagatcattgccttttcgtgtcatttattttttattggccttagttaccaattattgattagtgtgattgactggacaaaatttagtcattatcatccagaaaatcttggccggctacgactttttgtctttttattagctactgccctagggtatttggtgagccattgtatgctggaattgcttcaaattagccagacgctcttttttgagttccgc

SEQ ID NO: 7718 - protein, 85 aa, Streptococcus pyogenes
MVCYNNPMELLMKIIAFSCHLFFIGLSYQLLISVIDWTKFSHYHPENLGRLRLFVFLLATALGYLVSHCMLELLQISQTLFFEFR

SEQ ID NO: 7719 - DNA, 186 bp, Streptococcus pyogenes
atgacaaatggtttaaaatatgtcttagaacaaatgttattacttttcataattgctgccttggcgtgtctttttttagccattggacttatgattggttatagttttatgggagatggccagagtccatggcatattttatctatggataagtgggcagagttagtgaataaatttactggaaag

SEQ ID NO: 7720 - protein, 62 aa, Streptococcus pyogenes
MTNGLKYVLEQMLLLFIIAALACLFLAIGLMIGYSFMGDGQSPWHILSMDKWAELVNKFTGK

SEQ ID NO: 7721 - DNA, 411 bp, Streptococcus pyogenes
ttggagaaaaacatcagaaggtggaggaaaatcagaatgtatcaaacaaaaataacaggcaaccgcctttaccacacggtttcgaaaggctacggagatagtgtgaccttatttggaaaaactgatcaaggggaaacccctatgagtttactggttatcgccttgtcttcttgtgtgactatgtgtgtgcagggtttttaccatcgtcaatttcagcaagacacacttgctgtttctgttgaggctagttatgaggaagaagtttttgaactacttgttaggattgatgatgttttagatgacaaaaagaaagctgatttattggcttacattggaacttattgtcgtgtgaaacaactcctcaaacctgaagttacggtgaccattacgttggaaggactgtctcatgtc

SEQ ID NO: 7722 - protein, 137 aa, Streptococcus pyogenes
LEKNIRRWRKIRMYQTKITGNRLYHTVSKGYGDSVTLFGKTDQGETPMSLLVIALSSCVTMCVQGFYHRQFQQDTLAVSVEASYEEEVFELLVRIDDVLDDKKKADLLAYIGTYCRVKQLLKPEVTVTITLEGLSHV

SEQ ID NO: 7723 - DNA, 801 bp, Streptococcus pyogenes
atgaattttttaacaaagaaaaaccgtattttactgagagaaatggtaaaaacggattttaaattacgctatcaagggagcgcaattggctatctatggtctatcttaaaaccgcttatgatgtttacgattatgtacttggtatttattcgttttcttcgcctgggtggaaatgtacctcattttccagtagcgcttttattggcaaatgtcatctggtcttttttttcagaagcaactagcatgggaatggtatctattgtatctcggggagacttgttgcgaaaattgaacttttctaagcacatcattgttttttcggcagtgttaggagctttaattaattttcttattaatttggttgttgttttaatttttgcgttgataaatggtgtgactatatcagggtatgcttatctctctctttttctttttatagaattagttgttttagtgcttggaattgcattgttattgtcgaatgtctttgtttattatcgtgacttagctcaagtctgggaagtactattacaagcaggtatgtatgccactccaatcatttatccgatcacttttgttttagatagccaccctttggcggcaaagttgttgatgctaaatccagtagcacaaatgattcaagattttcgttatttattgattgacagggccaacgtaacgatttggcagatgtcaaccaattggttttacattgttattccatatttagtaccatttgttatattatttattggcatctttgtctttaagaaaaatgccgatagatttgcggagattatt

SEQ ID NO: 7724 - protein, 267 aa, Streptococcus pyogenes
MNFLTKKNRILLREMVKTDFKLRYQGSAIGYLWSILKPLMMFTIMYLVFIRFLRLGGNVPHFPVALLLANVIWSFFSEATSMGMVSIVSRGDLLRKLNFSKHIIVFSAVLGALINFLINLVVVLIFALINGVTISGYAYLSLFLFIELVVLVLGIALLLSNVFVYYRDLAQVWEVLLQAGMYATPIIYPITFVLDSHPLAAKLLMLNPVAQMIQDFRYLLIDRANVTIWQMSTNWFYIVIPYLVPFVILFIGIFVFKKNADRFAEII

SEQ ID NO: 7725 - DNA, 1743 bp, Streptococcus pyogenes
atgaatcgtattttattatatgttcacttcaacaaatacaataaaataagtgcacatgtttactatcaattggaacaaatgagatcactgttttctaagattgtttttatctcaaatagtaaagtgagtcacgaagatttaaaacgtctcaaaaaccactgtcttattgatgagtttttgcaacgcaaaaataaaggttttgatttttctgcatggcacgatggcttgattattatgggatttgacaagttggaagagtttgactcattgacgattatgaacgatacttgttttggtcctatttgggagatggctccttattttgaaaattttgaagaaaaagagacagttgacttttggggaattactaataatagaggtacaaaagcttttaaagaacatgtccaaagttattttatgacgtttaaaaatcaagtcattcaaaacaaagtttttcaacaattttggcaatcgataatagaatatgaaaacgttcaagaagtgattcagcattatgaaacgcaattaacatccattctcttaaatgaaggctttagttatcagacggtctttgatactagaaaagctgagtcgtcattcatgccacatccggatttttcatattataatccaacagcaattttaaaacaccatgtgccttttataaaagtaaaagctattgatgctaaccagcatatcgctccttacttattgaatctgatacgagaaacaaccaattatcctatagatcttattgtttcacatatgtcgcaaatctctttgccagatactaagtaccttttatctcaaaaatacctaaactgccaacggttagcaaaacaaacttgtcaaaaggtagctgttcatttacatgttttttacgttgatttgctagatgaatttttaacagctttcgaaaactggaacttccattatgatctttttattacaacagatagtgatatcaaaagaaaagagatcaaagaaatacttcaaagaaaaggtaaaactgctgatatacgcgttacgggaaatagaggaagagatatttatccaatgttattactaaaagataaactttctcaatatgattatattggtcatttccatacgaaaaaatcaaaagaagctgatttttgggcaggagaatcttggcgaaaagaattgattgatatgctcgtgaaaccagcagatagtattcttagcgcttttgagacagatgatattggtattataatcgcagatattccaagtttttttagatttaataagattgtcaatgcttggaatgagcatttaatcgctcaagaaatgatgtctttgtggagaaaaatggatgttaaaaaacaaattgattttcaagctatggatacatttgttatgagttatggaacatttgtatggtttaaatacgatgctctaaaatcactttttgatttagaattaactcaaaatgatattccaagtgaacctttaccacaaaactctatattacatgcgattgagcggttacttgtctatatagcgtggggggattcttatgattttaggattgttaaaaatccctatgagttaacaccttttattgacaataaactgttaaatttacgtgaagatgaaggagctcatacctacgttaactttaatcaaatgggcggtatcaaaggagcattgaaatatattatcgttggtcccgctaaagcaatgaagtatatattcttgcgtttaatggagaaacttaaa

SEQ ID NO: 7726 - protein, 581 aa, Streptococcus pyogenes
MNRILLYVHFNKYNKISAHVYYQLEQMRSLFSKIVFISNSKVSHEDLKRLKNHCLIDEFLQRKNKGFDFSAWHDGLIIMGFDKLEEFDSLTIMNDTCFGPIWEMAPYFENFEEKETVDFWGITNNRGTKAFKEHVQSYFMTFKNQVIQNKVFQQFWQSIIEYENVQEVIQHYETQLTSILLNEGFSYQTVFDTRKAESSFMPHPDFSYYNPTAILKHHVPFIKVKAIDANQHIAPYLLNLIRETTNYPIDLIVSHMSQISLPDTKYLLSQKYLNCQRLAKQTCQKVAVHLHVFYVDLLDEFLTAFENWNFHYDLFITTDSDIKRKEIKEILQRKGKTADIRVTGNRGRDIYPMLLLKDKLSQYDYIGHFHTKKSKEADFWAGESWRKELIDMLVKPADSILSAFETDDIGIIIADIPSFFRFNKIVNAWNEHLIAQEMMSLWRKMDVKKQIDFQAMDTFVMSYGTFVWFKYDALKSLFDLELTQNDIPSEPLPQNSILHAIERLLVYIAWGDSYDFRIVKNPYELTPFIDNKLLNLREDEGAHTYVNFNQMGGIKGALKYIIVGPAKAMKYIFLRLMEKLK

SEQ ID NO: 7727 - DNA, 2472 bp, Streptococcus pyogenes
atgattaaagacacatttttaaaaaccaattggttaaatattagtcaccatattatccttcttgttttcggtttttatttcagtttttacagtttggcgaaagaactagtaagctccacggcacaaccggtaaactattatgctcatttactaaatgtttcttttgtgggatatattatatcactgattggattatcttattatttgagtcgccaagttagtcgacagttgtttttgaaaactagttttattgtgatatcttatctaattgtcagctattgggtacaaataacacagcacctgaatgataaacggtttgatatctggtcattaactaaaaatcaattttatcaatttcaagctctaccttctttactcattattttagtgatggccactttaataaaaatattggcagcatattttgcaatagaaaaagatagatttgggctattaggctatcaaggtaatactttttctgtagctctgattttagcagttgtgccaattaatgacatacatctgttaaaactaataagttctcgattttctgaattagtaacagcaggtaatagccaaattgcactgttaaaaataagtggactgttgatagttttacttgtcatatttgcaacaatcatatacgtggttttaaatgctctaaaacaccttaagtcaaataaaccttcattttcagtagcagctactactagtttgtttttagcattagtttttaactatacgttccagtatggagtaaaaggtgatgaagcattgctaggatattatgttttccctggagctactctttttcagatagtagctattacactagttgctcttttagcatacgtgataacgaatagatattggccaactaccttctttttgcttattctgggaacaattatttctgttgttaatgatttaaaagaatcaatgagaagcgagccgttattagtaactgattttgtttggttacaagaattaggtttagtgacaagctttgttaaaaaatcggtgattgtagaaatggttgtaggacttgctatttgtattgtggtagcttggtatctacatggccgagttttagcagggaaattatttatgagccctgtcaaacgggcaagtgctgtattaggtttatttattgtatcttgtagtatgttaataccattttcttatgaaaaagaaggtaaaatattatctggtcttccgattatttcggctttaaataatgataatgacataaactggttaggtttttcaacaaatgctaggtacaaatctttagcatatgtttggacaagacaggtgaccaagaaaataatggaaaaaccgacaaattatagccaagaaacaatagcgagtatcgctcagaagtaccaaaaattagcagaagatattaataaagacagaaaaaataatattgctgaccaaacggttatttatcttttaagtgaaagcttgtcagatcctgatagagtatcaaatgttactgttagccacgatgttttacctaatatcaaggcaatcaaaaatagcacaactgcgggactcatgcagtcagactcctacgggggtggaacggctaacatggagtttcaaacgttaacaagcttacctttttataatttttcttcttcagtatctgttctttattcagaagtctttcctaaaatggccaaacctcatacgattagtgagttttaccaaggaaaaaatcgtattgcgatgcatcctgctagtgctaacaattttaatagaaaaacagtttatagtaatttaggtttttccaaattcttagctctatcgggttctaaggataagtttaagaacattgaaaatgtcggtttattgactagcgataaaactgtctataataatattttatctttaattaatcctagtgaaagccaatttttctcagttattacaatgcaaaatcatattccttggtcatccgattatcctgaagaaattgttgctgaaggaaaaaatttcacggaagaagaaaatcacaacctaacaagttatgctcggttattatcgtttactgataaggaaacaagagcatttttagaaaaattaacacaaattaacaagcctatcacagtggtgttttacggagatcatttacccggtttatatcctgatagtgcttttaacaagcatattgaaaataaataccttactgattattttatttggagtaatggtactaacgagaaaaaaaatcatccgcttatcaactcaagtgattttactgcagctttatttgagcatactgattcaaaagtatcaccttactatgctttgttaacagaggtactgaataaagctagtgtcgataaatcaccagatagtcctgaagttaaagctattcagaatgatttaaaaaatatccaatacgatgtgactataggaaaaggttaccttttgaaacacaaaactttttttaagatatcacgt

SEQ ID NO: 7728 - protein, 824 aa, Streptococcus pyogenes
MIKDTFLKTNWLNISHHIILLVFGFYFSFYSLAKELVSSTAQPVNYYAHLLNVSFVGYIISLIGLSYYLSRQVSRQLFLKTSFIVISYLIVSYWVQITQHLNDKRFDIWSLTKNQFYQFQALPSLLIILVMATLIKILAAYFAIEKDRFGLLGYQGNTFSVALILAVVPINDIHLLKLISSRFSELVTAGNSQIALLKISGLLIVLLVIFATIIYVVLNALKHLKSNKPSFSVAATTSLFLALVFNYTFQYGVKGDEALLGYYVFPGATLFQIVAITLVALLAYVITNRYWPTTFFLLILGTIISVVNDLKESMRSEPLLVTDFVWLQELGLVTSFVKKSVIVEMVVGLAICIVVAWYLHGRVLAGKLFMSPVKRASAVLGLFIVSCSMLIPFSYEKEGKILSGLPIISALNNDNDINWLGFSTNARYKSLAYVWTRQVTKKIMEKPTNYSQETIASIAQKYQKLAEDINKDRKNNIADQTVIYLLSESLSDPDRVSNVTVSHDVLPNIKAIKNSTTAGLMQSDSYGGGTANMEFQTLTSLPFYNFSSSVSVLYSEVFPKMAKPHTISEFYQGKNRIAMHPASANNFNRKTVYSNLGFSKFLALSGSKDKFKNIENVGLLTSDKTVYNNILSLINPSESQFFSVITMQNHIPWSSDYPEEIVAEGKNFTEEENHNLTSYARLLSFTDKETRAFLEKLTQINKPITVVFYGDHLPGLYPDSAFNKHIENKYLTDYFIWSNGTNEKKNHPLINSSDFTAALFEHTDSKVSPYYALLTEVLNKASVDKSPDSPEVKAIQNDLKNIQYDVTIGKGYLLKHKTFFKISR

SEQ ID NO: 7729 - DNA, 186 bp, Streptococcus pyogenes
atgttaggtaaccacgtaaatagtaaaattaataaagctaaaataaaccacaataaagagtacttaatcgctagtttatcttttttgattaagttaatcaaaaagaaaacaaaggttaatacaataaaacttataaataaactggctgttaccgtcattttaacgatttcctttcaatctaacaac

SEQ ID NO: 7730 - protein, 62 aa, Streptococcus pyogenes
MLGNHVNSKINKAKINHNKEYLIASLSFLIKLIKKKTKVNTIKLINKLAVTVILTISFQSNN

SEQ ID NO: 7731 - DNA, 171 bp, Streptococcus pyogenes
atgtctcacttcctgggtattcattcaccaaccaatatgttattctttttaggtttttgtttgagtttagctattattttttcactgactaataatatttcacttcaaaatgataaagtaaaacgtctgacccaagaagtggcccttatgaaaaaagagaaaaccaatgat

SEQ ID NO: 7732 - protein, 57 aa, Streptococcus pyogenes
MSHFLGIHSPTNMLFFLGFCLSLAIIFSLTNNISLQNDKVKRLTQEVALMKKEKTND

SEQ ID NO: 7733 - DNA, 1284 bp, Streptococcus pyogenes
atgattaatccttcaaaacaaaaccaaacgatttttttatggaatatgttaggaagtttatcaacagctgtaatatcagttatattacttatggtggttactaggttactaacttcggctgattcagatatttacgcctttgcctattcttttgctaatatgatggtagttgttggactttttcaggttcgtaattatcaagcaacagatattaatgaaaaatattcctttagtcagtacttagtggcaagactgatgacttgtttattaatgttagccataacagtaatttatttaacgttaactaagacagatagctacaagagtacaattgtctttctagtctgtttctatagatcgacagatgctttttcggatttatatcagggaatgttccaacaacatgaacggctggatattgcaggtaaatcgctagcctacagaaatactcttatttttatggtgtacacagcaataatattatattccaaaaatcttactttagcattagtagctgtctgtatagtttcattagtttttataatgtattatgacattggtcattcgaaaaaatttcaaaagttgatgtttagtgaattattaagtaatatttcatttcaaaacagtttaaagttattaaaagaaagttttccactttttctaaacggttttttgattatctatatttatactcaaccaaaatacgctattgaactaatgacgactttaggtgaagttgctttgggctctcaaacaatttttaatattttatttatgccagcctttgttatgaatttgctaattttattttttagacctcatattacacagatggctattgctttaatcagaggtcaaataaaagagtttaataagatacaagttcaattgtttgcttatttaggagttttttcactgatagcgttagttggaagtggtttgtttggtattccctttttatcaatactatatggtactaaccttacggattattgggtagattttatgttgattatgctaggaggctcgattggtagttttgcgacagttatcgataatatcttaaccgctatgagaaaacagcaacttcttcttattccatatacaggaggatttttgatttcgttattaattaccaatctttttgttatgaaatatcatattttaggagctgctttgagctttttaataacaatgttggtttggttgggattatccattatgatttatctatttattatgaatagatttaagaagggaagagttaatgcaacaatctatgac

SEQ ID NO: 7734 - protein, 428 aa, Streptococcus pyogenes
MINPSKQNQTIFLWNMLGSLSTAVISVILLMVVTRLLTSADSDIYAFAYSFANMMVVVGLFQVRNYQATDINEKYSFSQYLVARLMTCLLMLAITVIYLTLTKTDSYKSTIVFLVCFYRSTDAFSDLYQGMFQQHERLDIAGKSLAYRNTLIFMVYTAIILYSKNLTLALVAVCIVSLVFIMYYDIGHSKKFQKLMFSELLSNISFQNSLKLLKESFPLFLNGFLIIYIYTQPKYAIELMTTLGEVALGSQTIFNILFMPAFVMNLLILFFRPHITQMAIALIRGQIKEFNKIQVQLFAYLGVFSLIALVGSGLFGIPFLSILYGTNLTDYWVDFMLIMLGGSIGSFATVIDNILTAMRKQQLLLIPYTGGFLISLLITNLFVMKYHILGAALSFLITMLVWLGLSIMIYLFIMNRFKKGRVNATIYD

SEQ ID NO: 7735 - DNA, 1494 bp, Streptococcus pyogenes
atgcaacaatctatgactaaagttaaatatctttggaaagaaaataataactatatttattcgacttttttgacattacttctgacagttattttatatgccaatagtttaaatctacctttaaaatttattagtcttctttttgtggtgagcactttactgatagtgtttttaccaaaaaagttagaggttgctacgatcatttttattttagtatttggaacgatatctgctatcatatcacctataaatgatattcctgatgaatatgttcattattcaaggacagtttatatctcagaaggtgatattaatcttaccaacaataacaaaaagttaagaatatccaaagatgttgataagcttattaaacagtcaggaaaaacatttataacatcaaacttgaaagcaactaaacacagcacaagagagtatagctatccttacatcaaaggaactaatgcatattatagtttttcttatataccacaagctttgggtattttagtaggaaatgcgctggatttacctatacttttaacatattatttcggaagattgtgcaaccttattagctacgctatgcttgcttttatagctatcaagttgtctggttcttttaaacaagtgatagctgttgttactttactacctatgaacatttatttagcagcatcttttaatcaagacggctttgctatcggtttagttttagtaacaattggattgtttattaacttgctctcatcaaaagataaatctaactataataccaaattcttcctttatttagttctatgtgggttactagttctttcaaaattcacatactttttattagtatgccttccattatttattcctaatgaaaaattcggaaaaaataccaagttagtcatcttgaaaaaattgggaggactattactcatttttctttttgctgcaatgtggtttagactttatggacaggttaaaaccccatatgtcgcggattttctaaaagaagtaaacgttagccagcaagttaaaaatatgctagaatcccctatagtctatagcagtattattattagacatatggtaattaatctgattaatatgaataatatttttcagtttggcgcattaagctatggtataacgaaccttttcccgctttatgtgtgtttcttcttttttgtttatattagtaatgctagtaaaataactattaatattgtagaaaaaatgggtataatctttgttatttcagcgattataggtgcaactgtattagctatgtacctgacttggacaccagtagggtcctcaactgtcttaggtgttcaaagtcgttatctgataggaattatcccattagtgttgcttctttttagtagtcaacagcaaaagttcaaacaaatagaggatatcctttctgacaaactggctattcatgtttcgcttttgtttattcttgcaatgttaatgagtactatttttagatattatcat

SEQ ID NO: 7736 - protein, 498 aa, Streptococcus pyogenes
MQQSMTKVKYLWKENNNYIYSTFLTLLLTVILYANSLNLPLKFISLLFVVSTLLIVFLPKKLEVATIIFILVFGTISAIISPINDIPDEYVHYSRTVYISEGDINLTNNNKKLRISKDVDKLIKQSGKTFITSNLKATKHSTREYSYPYIKGTNAYYSFSYIPQALGILVGNALDLPILLTYYFGRLCNLISYAMLAFIAIKLSGSFKQVIAVVTLLPMNIYLAASFNQDGFAIGLVLVTIGLFINLLSSKDKSNYNTKFFLYLVLCGLLVLSKFTYFLLVCLPLFIPNEKFGKNTKLVILKKLGGLLLIFLFAAMWFRLYGQVKTPYVADFLKEVNVSQQVKNMLESPIVYSSIIIRHMVINLINMNNIFQFGALSYGITNLFPLYVCFFFFVYISNASKITINIVEKMGIIFVISAIIGATVLAMYLTWTPVGSSTVLGVQSRYLIGIIPLVLLLFSSQQQKFKQIEDILSDKLAIHVSLLFILAMLMSTIFRYYH

SEQ ID NO: 7737 - DNA, 678 bp, Streptococcus pyogenes
atgaaagcaattaaaattgcgattgatgggccagcttcaagtggaaaaagtacagtagccaagattattgcaaaaaatcttggctatacttatctagatactggtgctatgtatcgctcagcaacttatatcgcactgacacatggctatacgggtaaagaagtagcccttatcttagaggaacttgagaaaaatcctattttctttaaaaaagcaaaagatggctcccaattagtttttcttggggatgaggacgtgaccttagccattaggcaaaatgatgtgactaacaatgtttcttggatctcagctttgccagaaattagagaagagctggttcatcaacaaagacgcattgcacaagctggtggcattatcatggatggtcgtgacattggaacggttgttctcccagatgcggaactaaaaatctttttagtggcttctgtcgaagagcgggcagagcgccgctataaagaaaacctagaaaaaggaattgaatcagattttgagacgctaaaagaagagattgcagctcgtgattacaaggatagtcatcgtaaggtttcacctctaaaagcagctgaagatgcccttatttttgataccacaggtgtttctattgatggcgtggtgcaatttatccaagaaaaagcagaaaaaatagttgacatgtcc

SEQ ID NO: 7738 - protein, 226 aa, Streptococcus pyogenes
MKAIKIAIDGPASSGKSTVAKIIAKNLGYTYLDTGAMYRSATYIALTHGYTGKEVALILEELEKNPIFFKKAKDGSQLVFLGDEDVTLAIRQNDVTNNVSWISALPEIREELVHQQRRIAQAGGIIMDGRDIGTVVLPDAELKIFLVASVEERAERRYKENLEKGIESDFETLKEEIAARDYKDSHRKVSPLKAAEDALIFDTTGVSIDGVVQFIQEKAEKIVDMS

SEQ ID NO: 7739 - DNA, 195 bp, Streptococcus pyogenes
atgccaaaacaaaaaacacaccgcgcatcagctaaacgttttaaacgtacaggttcaggcggtttgaaacgcttccgcgcctttacatcacaccgtttccacggaaaaactaaaaaacaacgtcgtcatcttcgtaaagctggtttggttagctcaggagatttcaaacgtatcaaagcaatggttactggtctt

SEQ ID NO: 7740 - protein, 65 aa, Streptococcus pyogenes
MPKQKTHRASAKRFKRTGSGGLKRFRAFTSHRFHGKTKKQRRHLRKAGLVSSGDFKRIKAMVTGL

SEQ ID NO: 7741 - DNA, 120 bp, Streptococcus pyogenes
ttggtcactttatttgactatatcacaaataagaaagaggctcaactttctgatacaaagaaaataaacactaaaaaacagatcctgacgagctgccagcaatctgtttttttcctatct

SEQ ID NO: 7742 - protein, 40 aa, Streptococcus pyogenes
LVTLFDYITNKKEAQLSDTKKINTKKQILTSCQQSVFFLS

SEQ ID NO: 7743 - DNA, 438 bp, Streptococcus pyogenes
atgtcatcacgttattcccgtcaacaaaaacctcgtaaatcaggaggtgtccctaccgagcatattaaaacaggttttacagctttccaaaaatccattgcacttattggtagtattttgagtatcatcgtggcaaccattaccatttcaagagcactgcagcctgtaccagataagacctctaatgatacacccaaagaatcgagtaataccattgtcaagattattgaaaaagagtcttctcagggtaatcaaaaccatacaggtacttcagaaaccacagatgataataagacaactcttccgtcatcttctaccacaccttctcacaacgagacaactcctacagctcctgagacaccatcagccactgaagggacgcaaattcctaatgcaactggagctgaagatgctaatactggtcttcctacgaaccct

SEQ ID NO: 7744 - protein, 146 aa, Streptococcus pyogenes
MSSRYSRQQKPRKSGGVPTEHIKTGFTAFQKSIALIGSILSIIVATITISRALQPVPDKTSNDTPKESSNTIVKIIEKESSQGNQNHTGTSETTDDNKTTLPSSSTTPSHNETTPTAPETPSATEGTQIPNATGAEDANTGLPTNP

SEQ ID NO: 7745 - DNA, 417 bp, Streptococcus pyogenes
ttgacgatgaccttgtttacggtggctaccttttttaggtttgtatttgaaagttacaactttcttttgttttccttgtttttcaacagttccaacgacagtagctccttcaacaactggagtaccaactacagttttgtcaccacctacaagaacaacttcgttaaaagtgacttctgcgccagcttcagcgtcaattttctcaacgtagattgcttgacctacttcaactttaacttgttttccaccagttttgatgattgcgtatgtgctcatgatgcacctcctataaaatttttgtttgaggtttccctctgtgaagactcgcctggaatcgtgagacttggtctacttgacaacgattttcgcgcggttgcacaggatgtgcatttagtcaacgttactattttagcacca

SEQ ID NO: 7746 - protein, 139 aa, Streptococcus pyogenes
LTMTLFTVATFFRFVFESYNFLLFSLFFNSSNDSSSFNNWSTNYSFVTTYKNNFVKSDFCASFSVNFLNVDCLTYFNFNLFSTSFDDCVCAHDAPPIKFLFEVSLCEDSPGIVRLGLLDNDFRAVAQDVHLVNVTILAP

SEQ ID NO: 7747 - DNA, 99 bp, Streptococcus pyogenes
atgagcgtagatattcatggtagtttggatagtttcacgaccaagtgtattggattttcttctatcctactaaagattgtagttgcttatttagagcaa

SEQ ID NO: 7748 - protein, 33 aa, Streptococcus pyogenes
MSVDIHGSLDSFTTKCIGFSSILLKIVVAYLEQ

SEQ ID NO: 7749 - DNA, 456 bp, Streptococcus pyogenes
atgaaaaaacgattgtttgtgcttagcttgatcctccttgtagctttggatcaacttagtaaattttggattgtttctcatatagcgcttggagaagtgaaaccctttatcccaggtatcgtcagcttgacttacttgcaaaacaatggggctgccttttccatattgcaggaccagcaatggttctttgttgtcataacggttttagttatcggttatgctatttattaccttgctactcatccccatttaaatatctggaaacaattagctctcttgcttattatttctggtggaatcgggaattttattgatcgtttgcgtttagcttacgtgattgatatgattcatttagactttgtggattttgccatttttaatgtggcagattcataccttaccgttggtgtcatattattattgatatgtttatggaaagaagaggattatggaaat

SEQ ID NO: 7750 - protein, 152 aa, Streptococcus pyogenes
MKKRLFVLSLILLVALDQLSKFWIVSHIALGEVKPFIPGIVSLTYLQNNGAAFSILQDQQWFFVVITVLVIGYAIYYLATHPHLNIWKQLALLLIISGGIGNFIDRLRLAYVIDMIHLDFVDFAIFNVADSYLTVGVILLLICLWKEEDYGN

SEQ ID NO: 7751 - DNA, 135 bp, Streptococcus pyogenes
atgctttttagtattttttataatgttaaaaactttacacaaagatataagactaaaaataatggctactcctcgctgtttatttttttcttagcagctttaacaccttttgaaaaatttcgggagcttcaacag

SEQ ID NO: 7752 - protein, 45 aa, Streptococcus pyogenes
MLFSIFYNVKNFTQRYKTKNNGYSSLFIFFLAALTPFEKFRELQQ

SEQ ID NO: 7753 - DNA, 144 bp, Streptococcus pyogenes
ttgacagcctcacaggactgttttaaaggaatattttatttcaatcagtatagcaaaaaaagaaaagaaaaacaagtaaaaaagacaatacctagcatctatttggaatatctcttttctttaaggagtttaaataaagatctc

SEQ ID NO: 7754 - protein, 48 aa, Streptococcus pyogenes
LTASQDCFKGIFYFNQYSKKRKEKQVKKTIPSIYLEYLFSLRSLNKDL

SEQ ID NO: 7755 - DNA, 123 bp, Streptococcus pyogenes
ttgagaagtgctgactttaccgcttcttgtggtattcttggtatcattaattatgccaaaacgaaaagatattcaaaaaatcatggttatcgggtctggcccgattattattggacaagctgc

SEQ ID NO: 7756 - protein, 41 aa, Streptococcus pyogenes
LRSADFTASCGILGIINYAKTKRYSKNHGYRVWPDYYWTSC

SEQ ID NO: 7757 - DNA, 105 bp, Streptococcus pyogenes
ttgagatggattgaaaagcttgttgacttaaagtcaacaagctttttgaatagcaaaaatcttaatatttctgaaatgaaaagattagatttttctgtctttaac

SEQ ID NO: 7758 - protein, 35 aa, Streptococcus pyogenes
LRWIEKLVDLKSTSFLNSKNLNISEMKRLDFSVFN

SEQ ID NO: 7759 - DNA, 117 bp, Streptococcus pyogenes
ttgatatttatctttggactaaataagctaaaagctttggataaatatgatcaattgacctataataacattgataccaaatctaaaactgctcagattgaattgcgccccaaaagt

SEQ ID NO: 7760 - protein, 39 aa, Streptococcus pyogenes
LIFIFGLNKLKALDKYDQLTYNNIDTKSKTAQIELRPKS

SEQ ID NO: 7761 - DNA, 210 bp, Streptococcus pyogenes
ttgatggaatcaaaagaaatttatttgactaagtctccttatataagggggagtttagaaattcacagtaaaaataggaaacatgaaaaaatcaatttatatgacgcaaaacccaatagcaccagatctgatgtctttaaaaaatataaagacaataagactataaatatgaaagatttcagccattttgatatttatctttggactaaa

SEQ ID NO: 7762 - protein, 70 aa, Streptococcus pyogenes
LMESKEIYLTKSPYIRGSLEIHSKNRKHEKINLYDAKPNSTRSDVFKKYKDNKTINMKDFSHFDIYLWTK

SEQ ID NO: 7763 - DNA, 1017 bp, Streptococcus pyogenes
atgagaaaaagatgctattcaacttcagctgcagtattggcagcagtgactttatttgttctatcggtagatcgtggtgttatagcagatagtttttctgctaatcaagagattagatattcggaagtaacaccttatcacgttacttccgtttggaccaaaggagttactcctccagcaaacttcactcaaggtgaagatgtttttcacgctccttatgttgctaaccaaggatggtatgatattaccaaaacattcaatggaaaagacgatcttctttgcggggctgccacagcagggaatatgcttcactggtggttcgatcaaaacaaagaccaaattaaacgttatttggaagagcatccagaaaagcaaaaaataaacttcaatggcgaacagatgtttgacgtaaaagaagctatcgacactaaaaaccaccagctagatagtaaattatttgaatattttaaagaaaaagctttcccttatctatctactaaacacctaggagttttccctgatcatgtaattgatatgttcattaacggctaccgccttagtctaactaaccacggtccaacgccagtaaaagaaggtagtaaagatccccgaggtggtatttttgacgccgtatttacaagaggtgatcaaagtaagctattgacaagtcgtcatgattttaaagaaaaaaatctcaaagaaatcagtgatctcattaagaaagagttaaccgaaggcaaggctctaggcctatcacacacctacgctaacgtacgcatcaaccatgttataaacctgtggggagctgactttgattctaacgggaaccttaaagctatttatgtaacagactctgatagtaatgcatctattggtatgaagaaatactttgttggtgttaattccgctggaaaagtagctatttctgctaaagaaataaaagaagataatattggtgctcaagtactagggttatttacactttcaacagggcaagatagttggaatcagaccaat

SEQ ID NO: 7764 - protein, 339 aa, Streptococcus pyogenes
MRKRCYSTSAAVLAAVTLFVLSVDRGVIADSFSANQEIRYSEVTPYHVTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 7765 - DNA, 117 bp, Streptococcus pyogenes
gtggttgtgcttaaaaatgaacggttttttgatgatatgttgctgcatgaggaagtgagcaataggagagctgtgatagaagaaagaggggaagaagcgttgatgaaattagacaaa

SEQ ID NO: 7766 - protein, 39 aa, Streptococcus pyogenes
VVVLKNERFFDDMLLHEEVSNRRAVIEERGEEALMKLDK

SEQ ID NO: 7767 - DNA, 105 bp, Streptococcus pyogenes
atggcgcttcttttctatatattacgtgaggaaaaatcaagtaaaaaagttaagtcaactgaaaaacttgacagaaatattcagaaaatttataatactaactat

SEQ ID NO: 7768 - protein, 35 aa, Streptococcus pyogenes
MALLFYILREEKSSKKVKSTEKLDRNIQKIYNTNY

SEQ ID NO: 7769 - DNA, 192 bp, Streptococcus pyogenes
gtgaggaaaaatcaagtaaaaaagttaagtcaactgaaaaacttgacagaaatattcagaaaatttataatactaactattaacaacatatcagctattaaagcatttcaaacagcaggtgttttgtttggacctatcaaggctgcaaatgcaagagaaagcagtatctggtttgaaaatctcacaaagcaa

SEQ ID NO: 7770 - protein, 64 aa, Streptococcus pyogenes
VRKNQVKKLSQLKNLTEIFRKFIILTINNISAIKAFQTAGVLFGPIKAANARESSIWFENLTKQ

SEQ ID NO: 7771 - DNA, 168 bp, Streptococcus pyogenes
atgcaacgtagtatttttggagtatttacggcttttttgtgcgtgatttgtgttctttgtgccattccagcttttaaaaagaatcgttatggcttagcaagtctgttcttattaaatgcgtttactaatctggttaatagtattcacgccttctatggtacattgttt

SEQ ID NO: 7772 - protein, 56 aa, Streptococcus pyogenes
MQRSIFGVFTAFLCVICVLCAIPAFKKNRYGLASLFLLNAFTNLVNSIHAFYGTLF

SEQ ID NO: 7773 - DNA, 120 bp, Streptococcus pyogenes
ttgaccaagtccttagcccgaattcaaattaatgaactcagccctcacctttcttatttttttattttttataaggaagaaaaacagttctccgcccgtattcaattcaatgaatacagt

SEQ ID NO: 7774 - protein, 40 aa, Streptococcus pyogenes
LTKSLARIQINELSPHLSYFFIFYKEEKQFSARIQFNEYS

SEQ ID NO: 7775 - DNA, 189 bp, Streptococcus pyogenes
ttgcaacaagatacaagtgaacgtggacaccaagctcattttgtcatgcagagccatcaacagcgaagacgtcaacaccaactctgtctagcaccttttcaaaagaattgtgagtttctgtattacgagatagagaaggtaaaactggattctgaagactgccttaccatcaatcctttgggaatggtt

SEQ ID NO: 7776 - protein, 63 aa, Streptococcus pyogenes
LQQDTSERGHQAHFVMQSHQQRRRQHQLCLAPFQKNCEFLYYEIEKVKLDSEDCLTINPLGMV

SEQ ID NO: 7777 - DNA, 417 bp, Streptococcus pyogenes
ttgccctttatagcgaaacaaaccctgaaatctcagctcattccccaagataatcttttggcagaaagtcggttcaacgaaatcatggacttcttaacaggtgattttccccttgtttttaggccaatgatcaaccctcatcgctacactatttctcaagacaatcaagcgcttgaaaaagtcaaacaagcttcttacaagcggatggatattgctatgacgcatttagatagtcttattggggagagtgggcatgtttatcgagatcaacaaaccattgcagatgcttatgcttacgccatggcgctatggtctcaaaaaacaccaaaatcttacgagaattatccgcatctggcagcttttatggcaaaaatggtggaagattcagctgttcaacaagtgcttaatgcagctcac

SEQ ID NO: 7778 - protein, 139 aa, Streptococcus pyogenes
LPFIAKQTLKSQLIPQDNLLAESRFNEIMDFLTGDFPLVFRPMINPHRYTISQDNQALEKVKQASYKRMDIAMTHLDSLIGESGHVYRDQQTIADAYAYAMALWSQKTPKSYENYPHLAAFMAKMVEDSAVQQVLNAAH

SEQ ID NO: 7779 - DNA, 807 bp, Streptococcus pyogenes
atggatagtaaagcattgaataaacaaaatttaagccgtagcaagaaaattctgttgaatatctctgataatccgaaaaatcccaaattttacaaattatcaagacaagaactcgagcgcgctaaaatttttaaaacagaaaacttaattaaatctcaaaaatatcagagatacaaacgaggaactatcgtctttattcattttggagtaaatatcggcaatgaattttccgattcgcactttgggattgtgctgaataaaaaagatcatcccaataacggaaagctaactatcttaccgctaacatcaaaaaactctaaagagagtctgtcaattaacaaagagatttttacgagcataatggatgatgccgaaaaaacagttcaaacagttcaaaatgtgctaaacctaacaactgaagtagaacggatacaccactcgttaccagttcccccagcgttttttcagattaaaaaagaaaataaatatcatgatatatggatgaaatattacaataggaatgaccctaaagggattcatgtccccgtagcaaacattaccgtccgaaaatggatacaatcagacttagacaaaattaacttcctcaaaaaaagatatgcaaattatgacaaggtgtcctacgccaagctggactcaatcacttctgtcagtaaactaaaaatcgctaaaccaattaacgatcttgaccctgtcggaaaaataacattgtctaaagaaatcatggacaacattgataaagctctcgcaaggcagttattatctggccagtgggggaaacttgacaat

SEQ ID NO: 7780 - protein, 269 aa, Streptococcus pyogenes
MDSKALNKQNLSRSKKILLNISDNPKNPKFYKLSRQELERAKIFKTENLIKSQKYQRYKRGTIVFIHFGVNIGNEFSDSHFGIVLNKKDHPNNGKLTILPLTSKNSKESLSINKEIFTSIMDDAEKTVQTVQNVLNLTTEVERIHHSLPVPPAFFQIKKENKYHDIWMKYYNRNDPKGIHVPVANITVRKWIQSDLDKINFLKKRYANYDKVSYAKLDSITSVSKLKIAKPINDLDPVGKITLSKEIMDNIDKALARQLLSGQWGKLDN

SEQ ID NO: 7781 - DNA, 150 bp, Streptococcus pyogenes
ttggatgatcgcttggtttattacaaaataaaaactcccaagagggagtggaaaggaggaaaatatgatattcatagcaataattctatctgtattaatatcgtttctggtatcactggttatgatgaaatggcatatatggaatgccaa

SEQ ID NO: 7782 - protein, 50 aa, Streptococcus pyogenes
LDDRLVYYKIKTPKREWKGGKYDIHSNNSICINIVSGITGYDEMAYMECQ

SEQ ID NO: 7783 - DNA, 150 bp, Streptococcus pyogenes
gtgggggagaaaatggagaaaatgaaagcacctagcctagaagttaatctacggctaggcgaaaaggaaatcaaggcagttgtttctggatcaactcatcaatcctctgagcaatcaaaggttgaagttgatgagcaaaatcttgagaaa

SEQ ID NO: 7784 - protein, 50 aa, Streptococcus pyogenes
VGEKMEKMKAPSLEVNLRLGEKEIKAVVSGSTHQSSEQSKVEVDEQNLEK

SEQ ID NO: 7785 - DNA, 234 bp, Streptococcus pyogenes
gtgaatgtgatggatccattaaaaattaacataaagtttgacggcgatttccgtcaagttgttttaaaacttgcaaatacttttgaaccttctgaattgccacaattagacagttttagtaatctgcaagaactaacagaagagctttcgatttctatttctcaagattttgctcatcaacttcaacctttgattgctcagaggattgatgagttgatccagaaacaactgcct

SEQ ID NO: 7786 - protein, 78 aa, Streptococcus pyogenes
VNVMDPLKINIKFDGDFRQVVLKLANTFEPSELPQLDSFSNLQELTEELSISISQDFAHQLQPLIAQRIDELIQKQLP

SEQ ID NO: 7787 - DNA, 204 bp, Streptococcus pyogenes
atgcaggaaaatgctttcgagcaattaattgatgatagcggaattaaaaagaaagttatcgcaactaaaatgggttttacgcgctctggattttatcagaaacgtaaaaaacccaaaaaatcattcgatgcgtcagaagtggcaatgctagcggatattttaggggtagaccccggaaaagtcctggaagccattttaatttca

SEQ ID NO: 7788 - protein, 68 aa, Streptococcus pyogenes
MQENAFEQLIDDSGIKKKVIATKMGFTRSGFYQKRKKPKKSFDASEVAMLADILGVDPGKVLEAILIS

SEQ ID NO: 7789 - DNA, 264 bp, Streptococcus pyogenes
atggaagagaaaaaattttttactacatatgaaatggatctgatgaattcagttgtaactcttcaaaaatcaatcttaacgcaaacggaacatttgtcagatcaactaacaaaaaagcttcatcacctagaagactacaatagtccgattgatgatgaagcaattagattggctgaggtaacagcagaattttacaagttgttaatcaagtctcctagtgttggagcaactgtcaaggagattgtgagcgagggacataagcgt

SEQ ID NO: 7790 - protein, 88 aa, Streptococcus pyogenes
MEEKKFFTTYEMDLMNSVVTLQKSILTQTEHLSDQLTKKLHHLEDYNSPIDDEAIRLAEVTAEFYKLLIKSPSVGATVKEIVSEGHKR

SEQ ID NO: 7791 - DNA, 804 bp, Streptococcus pyogenes
atgttaaatattgacacccaattcgttgatacaatcggtaaaatactatctgactatgtttcgcattctgaaataacccgaatgggcgaagttttaggttatccccaaaacgaccaaaattctggatttaacaagcacaaacgggtgcacaatctcgtgtccgatatattaaataggacacagaatacagataatataaaacttgtgattgaatacgtctgtaatcctttaagatacattaatgaagtttcaatttttgaacagttaagaaccgccattaacattccgctctcgctaaaaggtttgattgtatcagatagcggacaaattgttactactactacttcaaaaactttatcagaggccaaaaaacgcttcgaaacacttgatagtagattaaaagaattaaaagtacaccctcacgttttaaaattctgcactcaagagctcttacaagaaaactattttcatgccgtatttgaagcaagtaaaggtgtttttcatcgtattcgtctgctaacgggctcagcaatggactcagctagtctgatagatcaatgtttcaaacccggagaacccattgtgattatcaacggtaataaattgcagactctagacgaacaaagtgagtataagggattaaaaaatttgctacttgcaatcgctcacctttatcgcaactctaaagctcacaaactcaaatactacaatccagataatctcaatgacgctcttacggccttaacgcttatgtccctcgctcacaatctccttgacagttgctccaacactaggagacttgat

SEQ ID NO: 7792 - protein, 268 aa, Streptococcus pyogenes
MLNIDTQFVDTIGKILSDYVSHSEITRMGEVLGYPQNDQNSGFNKHKRVHNLVSDILNRTQNTDNIKLVIEYVCNPLRYINEVSIFEQLRTAINIPLSLKGLIVSDSGQIVTTTTSKTLSEAKKRFETLDSRLKELKVHPHVLKFCTQELLQENYFHAVFEASKGVFHRIRLLTGSAMDSASLIDQCFKPGEPIVIINGNKLQTLDEQSEYKGLKNLLLAIAHLYRNSKAHKLKYYNPDNLNDALTALTLMSLAHNLLDSCSNTRRLD

SEQ ID NO: 7793 - DNA, 135 bp, Streptococcus pyogenes
atgaatgcacctattacacaaaagcaagctcagcatatcgttaatattttggagtatgtctctaagtcaacctctaaatctactatcgcagctatgacaaatgcattgttagagcttggcgtacttaagggagat

SEQ ID NO: 7794 - protein, 45 aa, Streptococcus pyogenes
MNAPITQKQAQHIVNILEYVSKSTSKSTIAAMTNALLELGVLKGD

SEQ ID NO: 7795 - DNA, 93 bp, Streptococcus pyogenes
ttgagacaacagaaaggaagaaaaaaatcattgaaatttgatgatgtcgttaaaatcgccgatgtcttaggtgtcagcttggacgaattcaga

SEQ ID NO: 7796 - protein, 31 aa, Streptococcus pyogenes
LRQQKGRKKSLKFDDVVKIADVLGVSLDEFR

SEQ ID NO: 7797 - DNA, 237 bp, Streptococcus pyogenes
ttgattcaacaatgggaggggttgacagttgctactgcaaagcagtgggcgacagaaatgcgtgatcatccagactttaaacagtttgtattaaatccaacgcatagaatcgtattcattgattacgaaggattcaaactgtttgtacagtggaaatctcgcaatcgttataaaacaaaaaaagagacactgtcagaaatgcttgaaaatattaaattcgaaaaaagagtaggagca

SEQ ID NO: 7798 - protein, 79 aa, Streptococcus pyogenes
LIQQWEGLTVATAKQWATEMRDHPDFKQFVLNPTHRIVFIDYEGFKLFVQWKSRNRYKTKKETLSEMLENIKFEKRVGA

SEQ ID NO: 7799 - DNA, 183 bp, Streptococcus pyogenes
atgaacaaattagaactatttttattagtaacaacgatcatcttagcaatcatcactagagtacaacacgaagtcattaaaaaacataattcgccagagaataaacgcagaatttttagagaagtggctttagaaaacagcaaagggtggagcgagaagcgttctggaggaaaggtggtcagc

SEQ ID NO: 7800 - protein, 61 aa, Streptococcus pyogenes
MNKLELFLLVTTIILAIITRVQHEVIKKHNSPENKRRIFREVALENSKGWSEKRSGGKVVS

SEQ ID NO: 7801 - DNA, 204 bp, Streptococcus pyogenes
atgacaccagaacaagtagaaaaagcaaaaatcagagctaaacaagaacttgaaacgtttagcatataccttgaccaggcagttgatgaactcggtggagttttaacttcgcgagaagtctttttggcagcgggattcacctaccttggcgcaggtcagacagatatacatgctgcagtcgagggattatgtgagcaaatccaa

SEQ ID NO: 7802 - protein, 68 aa, Streptococcus pyogenes
MTPEQVEKAKIRAKQELETFSIYLDQAVDELGGVLTSREVFLAAGFTYLGAGQTDIHAAVEGLCEQIQ

SEQ ID NO: 7803 - DNA, 327 bp, Streptococcus pyogenes
atgaacatcaaagaaaaaattgtagtgctaagaaacactgaagacggaagttttttaaagagtttcaaaaacaaaaaagatgtacttgcttataatgtggaacttacagatagcattcaactggcatcatttttaccagaagaagcttacaacatacaaaaagaaaaaattgataatttggcagaaacgcttgggtgtgatgttgtagttatcgaagcatcatatgacctaaaatttgttgatggcgaggatgttccagagttaacaaaagagcaaaaagttaaaagtatggtaaacggaatgtttgagcaggtttttggaggtgaa

SEQ ID NO: 7804 - protein, 109 aa, Streptococcus pyogenes
MNIKEKIVVLRNTEDGSFLKSFKNKKDVLAYNVELTDSIQLASFLPEEAYNIQKEKIDNLAETLGCDVVVIEASYDLKFVDGEDVPELTKEQKVKSMVNGMFEQVFGGE

SEQ ID NO: 7805 - DNA, 789 bp, Streptococcus pyogenes
atggcaaatcaattatcaacacaacaagttaaacgtgatatcacaactgatccaactttgctgacaggagctgatattaaaaaatattttgatcctcagaacttgcttagcgaaaaacaagtagggcaagctctggctttgtgtaaggggcgcaaccttaatccatttgcaaacgaagtttatattgtggcctataaaaataatagcggcacagatttcagtttgattgtatctaaagaggcatttatgaaacgtgctgaacgttgtgaaggatatgatggattcgaggctggcattactgttatgagaaatggtgagatggttgaaattgagggctctctaaaactacctgatgatgttttgataggtggatgggccattgtttaccgcaaagaccgctcacatcgatacaaagttactgttgactttaacgaatatgtcaaacttgacaaatatggtaatccacgaagtacttggaaatcaatgccaggaacaatgattagaaaaacagcacttgttcagacacttagagaggcttttcctgatgaactcggtaatatgtacaccgatattgacggtggcgatacttttgatgctattaaagatgtgactcctcaggaaacacaggaagaagtcagagcacggaagatggcacagattgagcagtacaagcaagaacagactcagaaacaaactcaaaaagcagacactagctatcccgttgatgaagtgtctgaacatactgatgatccagtacaaggagaactacttgatggagaactggagtat

SEQ ID NO: 7806 - protein, 263 aa, Streptococcus pyogenes
MANQLSTQQVKRDITTDPTLLTGADIKKYFDPQNLLSEKQVGQALALCKGRNLNPFANEVYIVAYKNNSGTDFSLIVSKEAFMKRAERCEGYDGFEAGITVMRNGEMVEIEGSLKLPDDVLIGGWAIVYRKDRSHRYKVTVDFNEYVKLDKYGNPRSTWKSMPGTMIRKTALVQTLREAFPDELGNMYTDIDGGDTFDAIKDVTPQETQEEVRARKMAQIEQYKQEQTQKQTQKADTSYPVDEVSEHTDDPVQGELLDGELEY

SEQ ID NO: 7807 - DNA, 663 bp, Streptococcus pyogenes
atgcaagaattacaattaaaagtcacacaggcacaagttgaaattattgatcgtgaaaaatttgaacaaaacatcaacgaagttgtggcaaaataccaaaattatgcagtcacagctggaactatcaaagatgacaagcaagtcctagctgatctacgcaagctcaaaaaacagttgtctgatgagcgtatcaaagtaaaaaaggaactctcaaagcctgctgacgacattgatggatatatcaaacaggcaagcaagccactagatgacacgattgacaagattgcaactgatgtcaaagaattcgaagaccatcaaaaagcgctgcgattagatacagtaaagagctacttgtctaataaggcatccgagtatatgcttgacccccgtatttttgacgaaaaagctatggagtacaccaaagctggcaattttatggcggacggtgtaaccctcaaaaaagtcaccatgaaatctcttgaggacttggttacctttgaatatcaaaaggagcaagaggtcgaaaaagcaaaagctaccatctcaggacaatgtgctgagtatggtatgactgaccaaccttacatccgtatgctaaaagagatgacgcttgtagaggtgctaggtcagattaaagctgattatctcgctgaaaagcaaaag

SEQ ID NO: 7808 - protein, 221 aa, Streptococcus pyogenes
MQELQLKVTQAQVEIIDREKFEQNINEVVAKYQNYAVTAGTIKDDKQVLADLRKLKKQLSDERIKVKKELSKPADDIDGYIKQASKPLDDTIDKIATDVKEFEDHQKALRLDTVKSYLSNKASEYMLDPRIFDEKAMEYTKAGNFMADGVTLKKVTMKSLEDLVTFEYQKEQEVEKAKATISGQCAEYGMTDQPYIRMLKEMTLVEVLGQIKADYLAEKQK

SEQ ID NO: 7809 - DNA, 357 bp, Streptococcus pyogenes
atgcgaaaagccgaggaggaaagagagcaacttttagcagctcagcaaactaaagaacaagaacaggctcagaaatcagcagaaataccacaaatcgacaaggaaacaggcgaaatcttggatggttggcaattatcccaaaacaaccaagaaacgctcacaggagctgaaaacgagtttaaaaagtacaatcaaaaaatgacacttgaggtgtactttgaagatacggctgaaaaagaccgtttcaagaccggtctaactcagctaggttttgattttaaaaaaaattatcaagtcagcggttatcaaaatatagagcctcttactcaagctgaattggctcggcggtgcggatgg

SEQ ID NO: 7810 - protein, 119 aa, Streptococcus pyogenes
MRKAEEEREQLLAAQQTKEQEQAQKSAEIPQIDKETGEILDGWQLSQNNQETLTGAENEFKKYNQKMTLEVYFEDTAEKDRFKTGLTQLGFDFKKNYQVSGYQNIEPLTQAELARRCGW

SEQ ID NO: 7811 - DNA, 345 bp, Streptococcus pyogenes
gtgagaaatatggaacaaatcaaaattacagaaacaggaatggtcgttataagcgataaagcactcaaaacttttgtgattgcaggacatttatcggagaggtgggaatttacctctaaatttaaaaaattagatgagccatcacttgatgaaaacggagatttgtttgagcctgtatacgagttgatgcttgaagccaggtcgaagggacaaattagcataacatcatcatattgtggcaaaaatcacaaaaaagacacagacgaaatcataaaagtattctcgtttatcgaagataacaagagaaatatttttgaaaaccttggtattcgtggggtgcttgaa

SEQ ID NO: 7812 - protein, 115 aa, Streptococcus pyogenes
VRNMEQIKITETGMVVISDKALKTFVIAGHLSERWEFTSKFKKLDEPSLDENGDLFEPVYELMLEARSKGQISITSSYCGKNHKKDTDEIIKVFSFIEDNKRNIFENLGIRGVLE

SEQ ID NO: 7813 - DNA, 510 bp, Streptococcus pyogenes
atgagcaatctagttttatcgttagacatctcaacatctggaacagggtgggccttatttaaaggctcagaccttatccagagtggtgtcttaaaacataagagtaaatcctactttgagcgcggacgctatatggctagccaattaggactaatccagtcacgagcattaaaaaaatacgattgctattttagtacaatcgcagtcgaaaaaaattcagttatgggacctaaccagcaatccatgcttaaaatcggtattgttacaggaattatcttaggaagattaatagctgataacgtcgcctttataaatgtatcaacgtggcgtaagcactggaagtttagctacaaagaccgctctaaaaaagcgatgaaagcacaatcgaaagaaaaagctctcgaatattgcggaaaaacagtaaaagatgatgaagcggatgctattttgattggctcatactatgtcaatcaaggctatcttgatgaattggagacacatgactactac

SEQ ID NO: 7814 - protein, 170 aa, Streptococcus pyogenes
MSNLVLSLDISTSGTGWALFKGSDLIQSGVLKHKSKSYFERGRYMASQLGLIQSRALKKYDCYFSTIAVEKNSVMGPNQQSMLKIGIVTGIILGRLIADNVAFINVSTWRKHWKFSYKDRSKKAMKAQSKEKALEYCGKTVKDDEADAILIGSYYVNQGYLDELETHDYY

SEQ ID NO: 7815 - DNA, 141 bp, Streptococcus pyogenes
ttgtggaaaagtgcaacagaccacctgaacgattttatcgacaaaaacaagtacgcaaaagtgacaggcgacttatggcaaggcagtgatcaagtcattgctgagcagtgttttttaaaagtattagaggagatgcaaaaa

SEQ ID NO: 7816 - protein, 47 aa, Streptococcus pyogenes
LWKSATDHLNDFIDKNKYAKVTGDLWQGSDQVIAEQCFLKVLEEMQK

SEQ ID NO: 7817 - DNA, 123 bp, Streptococcus pyogenes
gtgattatccaaggcgtcgctaatgctttaacacgacatcgtgcgcctgtgtcaaaaaacaaaggaaagagaggacttttctccacaaaacaaaaagacgtccatacggaacgcccccttggt

SEQ ID NO: 7818 - protein, 41 aa, Streptococcus pyogenes
VIIQGVANALTRHRAPVSKNKGKRGLFSTKQKDVHTERPLG

SEQ ID NO: 7819 - DNA, 438 bp, Streptococcus pyogenes
atgacgttttttcctgagattgatatccaaaaaacaaaatccaacgccaagcgtaaattgagagagtatccacgctggcggaggatagctaatgatgtagatactcaaaaagttacagctacttactcctttgagccaagacaaccgcatggaacgccaagcaagcctgttgagagactagcgctcaaccgtgtgtcggcagaacaggagctggatacgattgagagagcagtcaacgggatatttgatccagagtatagattgatactgattgacaagtatttgctcacatatccaaagactgattgtgatatttatacaaaacttggttatgaaaaaagccagtattacaacatgctagataatgctttgttgtcgttctcagagctatataaagagggaatgttgcttgtcgaaaaattggaaaaaagctggaat

SEQ ID NO: 7820 - protein, 146 aa, Streptococcus pyogenes
MTFFPEIDIQKTKSNAKRKLREYPRWRRIANDVDTQKVTATYSFEPRQPHGTPSKPVERLALNRVSAEQELDTIERAVNGIFDPEYRLILIDKYLLTYPKTDCDIYTKLGYEKSQYYNMLDNALLSFSELYKEGMLLVEKLEKSWN

SEQ ID NO: 7821 - DNA, 912 bp, Streptococcus pyogenes
atggaaaacaaacccgcaaaagcaagtttctttaaattaagttcttctaaagaatctaatttaaaattgtttatcgaaaagatggaggaaatgtttgataattttagaaaaaaacaatatagtaacattccaacattagagataaatgatcttatgtattatataaatgcaatgcagaaggtaacaagtgaagaagaattaaatggaacgaatctattttattggttagtcaccatttcacgggtggacacagaatctccaattattcttgcgaatcttgaaaaaaatattgatgtaagaaaaagggaaattgaacatggggataatgagggccttgtggttgatacaagattattatttgatccatttagacaaattttagttgtttataatcaaagaggtacaattaataattacgacttaagaaggtttttttgtcaaataattggagttagaggattgaagtttgatattatattaaacagtgatgctttcaaaagggttggtaagcttgacgttgtaaattcaattagttatactgttgcaagcccaacaaactttaaggagtttcgagatgatactcaaagtgaaaatgccgatttaaagtttgcaaattctatgctaggagagtcaatgcaggttgttataaagtcaaaccatctttctaaaaaaaatatatttgataaattttcagatatgttagttaatgactcagttaatgtaaaaaatgctaaagttgaaggttttaccgatggtcatccggaattaatagacttaataaaaaataaattggaatataagggaactattttttatgaaaatactttagacgatgaggctgtttatgcatttctgaataccgcgtatagctttcattttagtcatttaaaaagaatgtttactataacttta

SEQ ID NO: 7822 - protein, 304 aa, Streptococcus pyogenes
MENKPAKASFFKLSSSKESNLKLFIEKMEEMFDNFRKKQYSNIPTLEINDLMYYINAMQKVTSEEELNGTNLFYWLVTISRVDTESPIILANLEKNIDVRKREIEHGDNEGLVVDTRLLFDPFRQILVVYNQRGTINNYDLRRFFCQIIGVRGLKFDIILNSDAFKRVGKLDVVNSISYTVASPTNFKEFRDDTQSENADLKFANSMLGESMQVVIKSNHLSKKNIFDKFSDMLVNDSVNVKNAKVEGFTDGHPELIDLIKNKLEYKGTIFYENTLDDEAVYAFLNTAYSFHFSHLKRMFTITL

SEQ ID NO: 7823 - DNA, 210 bp, Streptococcus pyogenes
atgaaagataaaaaagtagcaactaataggcggtccattatttttatctctgtccctaaatcttccatcatcactactaatttattagaaccggaagttggtatcaatgaaaaactagcaaagaatattgcggttacaattgctgaaaatgatagagatgccgacattatatcagtaaaattttttaaactttttggagaaattttaaaa

SEQ ID NO: 7824 - protein, 70 aa, Streptococcus pyogenes
MKDKKVATNRRSIIFISVPKSSIITTNLLEPEVGINEKLAKNIAVTIAENDRDADIISVKFFKLFGEILK

SEQ ID NO: 7825 - DNA, 471 bp, Streptococcus pyogenes
ttgaggtatgcgatgaaaaaaggaaggtttaaaagaaactggccgattatactatttggtataatagtttttatatttagtttttattttaaaatttctccaaaaagtttaaaaaattttactgatataatgtcggcatctctatcattttcagcaattgtaaccgcaatattctttgctagtttttcattgataccaacttccggttctaataaattagtagtgatgatggaagatttagggacagagataaaaataatggaccgcctattagttgctacttttttatctttcattagttctttattatcttttatttctctattctttagtaagactgatactgatttaatttcaattttagtagtttcaagttggttgagctcaacagtaatgatgttcctaagttcgttctttgtgctaagaacattaattttgttagttgaaacttataataatttcaaaaataaa

SEQ ID NO: 7826 - protein, 157 aa, Streptococcus pyogenes
LRYAMKKGRFKRNWPIILFGIIVFIFSFYFKISPKSLKNFTDIMSASLSFSAIVTAIFFASFSLIPTSGSNKLVVMMEDLGTEIKIMDRLLVATFLSFISSLLSFISLFFSKTDTDLISILVVSSWLSSTVMMFLSSFFVLRTLILLVETYNNFKNK

SEQ ID NO: 7827 - DNA, 498 bp, Streptococcus pyogenes
ttgtggtggctttttattatggattggaggtggtggaaaatcgcatacgaggaattaaccgaaaaacaacagcgttttgtggataagtacatcaccacatttaacgctactgagtctgcaaaacaagctggatattctgaaaaaagcgcttatagccaaggtcaacgcttgttgaaaaatgttgaaattcaaaaagcaatgaaggaacgttttttggaggcaaaagatactaaaggagaccgtattcaagatgttgcagaaacgttggaacaagatacatcgatagcccgtggagaaatccaaatatctgaattcaaagaaacagatatgctgacaggtcaagtggttatccacacgaaaagagaatataccccaagtcacgaagaacagggtagggctagggatagaatttataaagttaatggagcttactcagaaaaacgtgaattagagcattctggaacggtggtgtttgcaaatgaagacaacatccctgat

SEQ ID NO: 7828 - protein, 166 aa, Streptococcus pyogenes
LWWLFIMDWRWWKIAYEELTEKQQRFVDKYITTFNATESAKQAGYSEKSAYSQGQRLLKNVEIQKAMKERFLEAKDTKGDRIQDVAETLEQDTSIARGEIQISEFKETDMLTGQVVIHTKREYTPSHEEQGRARDRIYKVNGAYSEKRELEHSGTVVFANEDNIPD

SEQ ID NO: 7829 - DNA, 1293 bp, Streptococcus pyogenes
ttgcaaatgaagacaacatccctgattaaagtagatttgccatcaacaatcggtataggttatggcgctttttggcggtctagaaatttttatcgagtagttaaaggcagccgtggatctaaaaaatctaaaacgactgctttaaattttatcgtcagactgctgaagtacccttgggctaacttattggtcatccgtagatactcaaacactaacaaacaatctacttataccgattttaaatgggcgtgtaatcaattaaaggttacacacctttttaagtttaatgagagtttgccagaaataactgtaaaggcaacgggccaaaagatactgttccgtggacttgatgatgagttaaaaatcacatctattactgtcgatgttggcgctttgtgctgggcttggtttgaagaggcttatcaaattgagaccgaagataagttttcaacagttgtcgaatcaatccgcggtagtttagatgctcctgatttttttaaacagataacagtcacgtttaacccgtggtcagaaagacattggcttaaacgtgtcttttttgatgaagaaactaaacgggctgatacattttctgggactacaacatttagagtaaacgaatggcttgatgatgtcgataaaagacgctacgaagatttgtacaagactaatccaaggcgggctagaatcgtgtgcgatggtgaatggggcgttgctgaaggtcttgtttttgataactttgaagtcgtagattttgatgttgaaaaaacaattcaacgcgttaaagagacctcggccggtatggactttgggtttactcaagaccctacaactcttatatgtgttgcagttgacctcgcaaacaaagagttatggctttacaacgaacattatcaaaaggctatgttaacagatcatattgtcaaaatgataagagataaaaacttgcataggtcttacatcgcaggggatagcgccgaaaaacgcctcattgcagaaataaaaagtaaaggggtgtctggaattgtcccgagtattaaaggtaaagggtcaatcatgcaagggattcaattcatgcaggggtttaagatatatattcacccatcttgcgaacacacaatagaagagtttaatacttacacttttaagcaagacaaagaaggtaattggttaaacgaaccgatagataagaataaccacgttattgatgcgattagatatgcgcttgaaaaataccatatcagaagcaacgagtcaaatcagtttgaagttcttagggctggttttggttac

SEQ ID NO: 7830 - protein, 431 aa, Streptococcus pyogenes
LQMKTTSLIKVDLPSTIGIGYGAFWRSRNFYRVVKGSRGSKKSKTTALNFIVRLLKYPWANLLVIRRYSNTNKQSTYTDFKWACNQLKVTHLFKFNESLPEITVKATGQKILFRGLDDELKITSITVDVGALCWAWFEEAYQIETEDKFSTVVESIRGSLDAPDFFKQITVTFNPWSERHWLKRVFFDEETKRADTFSGTTTFRVNEWLDDVDKRRYEDLYKTNPRRARIVCDGEWGVAEGLVFDNFEVVDFDVEKTIQRVKETSAGMDFGFTQDPTTLICVAVDLANKELWLYNEHYQKAMLTDHIVKMIRDKNLHRSYIAGDSAEKRLIAEIKSKGVSGIVPSIKGKGSIMQGIQFMQGFKIYIHPSCEHTIEEFNTYTFKQDKEGNWLNEPIDKNNHVIDAIRYALEKYHIRSNESNQFEVLRAGFGY

SEQ ID NO: 7831 - DNA, 360 bp, Streptococcus pyogenes
atgtacacagaatcatttagagatagtacgggaaagactaaaacattagagtttaggttccaccgtgaagctcgcatgaggtatcaagcggaaagtctagaaagcttgttaaccgaaaaatataagctactccgtgaaatgattgaacaccacgataaagtccaaaaaccacgcatacaagagcttctagattatgcagagggaaataaccacaccatcagcgaaataggccgtaggaaagacgatgacatggctgatgttcgtgctgtgcataactatggtaagtatatttcaacgctcaaacagggctatttggtgggtaatcctattcgtgtagagtatattgatggtaccgagcag

SEQ ID NO: 7832 - protein, 120 aa, Streptococcus pyogenes
MYTESFRDSTGKTKTLEFRFHREARMRYQAESLESLLTEKYKLLREMIEHHDKVQKPRIQELLDYAEGNNHTISEIGRRKDDDMADVRAVHNYGKYISTLKQGYLVGNPIRVEYIDGTEQ

SEQ ID NO: 7833 - DNA, 1041 bp, Streptococcus pyogenes
ttgatttatcgcagcatggatgacaagacagaggtcgttagactagatccacgggaagtatttgttatctatcaaaataacctagagcaatcaagcttagctggtgtgcggtactataacaaaaatcaattagatggtactacaaaaattgtcgagctttacaccgataataaaatcctgaagtttgaatatgatggtgatttaacacctatcggagagacttcctctcatgcgtttggttcggtgccaatcacggagtacctcaacacagatgacggcatgggtgactacgagacagagttgtctttaatcgacttgtatgatgcagcgcagtctgacacagctaactacatgcaggatttgtcagacgcgattctggcaatcattggtcgtgtatcattccctggctatgtcgacactgccgaaaaagccattgaatacttacgtaagatgcgtaaagctagattacttaacttagagcctcctgtcgaccaagacgggcgtgagggatctgtagatgccaaatatctatataaacaatatgacgtacaaggaaccgaagcctataaaaatcgtattgtgtccgacatccataaatttaccaatacgccagacatgacagacagtaagtttgccggtcaacaatctggcgaggcgttgaaatggaaggtgtttggacttgaccaggaacgtgtagatatgcaagctttatttgagcaatctcttaaacgtaggtacaaactaatcgctcgtgtaagccaactgcttaaagagattgatgactttgacatcagcaagcttaaaatcacatttacgccaaacctacctaagtcgctacaagaaaagattgaagcctttaaagcattgggtggagagttgtcgcaagagacagctatggctattacagacatcgtggaagatgctaagaaagaaattagccttatcaacagcgagtcgaaatcacgtagtcaactagcgcagaagttagaagaaaccagtagattgactgatagggagttagctcatgaccaccagaaagag

SEQ ID NO: 7834 - protein, 347 aa, Streptococcus pyogenes
LIYRSMDDKTEVVRLDPREVFVIYQNNLEQSSLAGVRYYNKNQLDGTTKIVELYTDNKILKFEYDGDLTPIGETSSHAFGSVPITEYLNTDDGMGDYETELSLIDLYDAAQSDTANYMQDLSDAILAIIGRVSFPGYVDTAEKAIEYLRKMRKARLLNLEPPVDQDGREGSVDAKYLYKQYDVQGTEAYKNRIVSDIHKFTNTPDMTDSKFAGQQSGEALKWKVFGLDQERVDMQALFEQSLKRRYKLIARVSQLLKEIDDFDISKLKITFTPNLPKSLQEKIEAFKALGGELSQETAMAITDIVEDAKKEISLINSESKSRSQLAQKLEETSRLTDRELAHDHQKE

SEQ ID NO: 7835 - DNA, 1623 bp, Streptococcus pyogenes
atgaccaccagaaagagtaaatactggcgtgaccgtatcaagaaagaaatggatgctaaagaggcagacgatatctctcttgagcaatccatgaagcaattgcacgattatcatttcaggaatatcgaaaaagaaattgagtcgttttatcaacgttatgctgacaaagagaaaatagacctttcagaagcccgtaagagagcttctgagcttgatatttctgcttaccagaagaaagctaaggaacttgttgcaaaggctgagaaactacgaagagaaggtaagatagtaacaagagatgactttacccaccaagaaaatgcagacatgtctatttacaacttagccatgaaaacgaatgctttggaactattgcgcttaaacattgatttagaaatgcaagaacttgccaacggcgaacacaagctaaccaagaaatttcttgatgaaggctatcgcaaagaaaccgagtttcaagctgggctattaggattatcagttgctagccaagcgagtgtgaaaagcttagctgatgccgttattaatgctaatttcaaaggagcaaaatggtcagataacatttgggacagacaagataagttacgtagcatcatatctcaaagcgtccaaagtgctatcctaaaaggtaaaaatggcttaactattgcaagggatatcagacgagaatttgatgtgtcagcgtcttacgcaaagcgactagcgataacggagcatgcaagggttcagatggaagttggtagattatccatggcggagaatggctttgctatgtttgatatattgcctgagcctaaagcatgtgatgtttgcaaggatatagctaagcatggtccatatcaccttgacaagtggagaataggggaaaactctccgccgtttcatccgtattgtcgttgtgcgattgtaggggtagatgaaagtggtgttgcaacagacaggcaattggactataatcgaaacatgaacaatattgatttgatggctaaaactcaatcttttatcattaacaaagatgtccgagtaagtgccaagaaagttgtcggcacaagatatgatttttgggcgcaagataataccaaaaaaattagagatacgattcaaagtgttggagagcacttagacaacttagaagggtatagcattcctaaaattgtatttgttaaaaaagctaagctccaaggctgggcgggatatgattataaacaagacactttgtttataagtgatttgttgaattcaaaagccgctgtgagtgatatgctgctggataactactttgcggctgtcgacttaaacggtattctagtgcatgagttaacccacaaaaaacattgggatactgctaaacaattttacaaacataataaaaagcgttataatacacttgaagaggcaaaaaatgcacttgattcgtctctagtttcctatattaaagaacaaaagcaatctgattataattatttatataaaataagcgagtatgctgatgttgctagtttacaagggaaatataacgaagttatagccgaggcaatgactgcgggagataaattatcagatccgctattgttagaaaaaataaaggaggtattcagatggaaa

SEQ ID NO: 7836 - protein, 541 aa, Streptococcus pyogenes
MTTRKSKYWRDRIKKEMDAKEADDISLEQSMKQLHDYHFRNIEKEIESFYQRYADKEKIDLSEARKRASELDISAYQKKAKELVAKAEKLRREGKIVTRDDFTHQENADMSIYNLAMKTNALELLRLNIDLEMQELANGEHKLTKKFLDEGYRKETEFQAGLLGLSVASQASVKSLADAVINANFKGAKWSDNIWDRQDKLRSIISQSVQSAILKGKNGLTIARDIRREFDVSASYAKRLAITEHARVQMEVGRLSMAENGFAMFDILPEPKACDVCKDIAKHGPYHLDKWRIGENSPPFHPYCRCAIVGVDESGVATDRQLDYNRNMNNIDLMAKTQSFIINKDVRVSAKKVVGTRYDFWAQDNTKKIRDTIQSVGEHLDNLEGYSIPKIVFVKKAKLQGWAGYDYKQDTLFISDLLNSKAAVSDMLLDNYFAAVDLNGILVHELTHKKHWDTAKQFYKHNKKRYNTLEEAKNALDSSLVSYIKEQKQSDYNYLYKISEYADVASLQGKYNEVIAEAMTAGDKLSDPLLLEKIKEVFRWK

SEQ ID NO: 7837 - DNA, 177 bp, Streptococcus pyogenes
atggaaatgatgtcaagaccgactcaagaagtgctaacgttttctaaaatcatccgccgatggattgtaggcgatgaaaccattggcggcaagaaaaaattcattttcagagatgatactccggaagatgttttagagctatatcaaaaaataaaaaataagttagattttgcatat

SEQ ID NO: 7838 - protein, 59 aa, Streptococcus pyogenes
MEMMSRPTQEVLTFSKIIRRWIVGDETIGGKKKFIFRDDTPEDVLELYQKIKNKLDFAY

SEQ ID NO: 7839 - DNA, 267 bp, Streptococcus pyogenes
gtgaataaacgaatcaagaaaaaacataaattggaaacagcagttgtgttgcttatcgcagaaaatgctatgcaggctgaagctattaagaatcaaaacagacaaattgcagagctgagatcgattatacaacaaaacgcccaagcaataaatagagagtttgcagcagttaaaggtgtgtgtcttgataatcaagcagctattacaaacattgcagttgatattaactacgtcaagaaaaactacaaacggaagtgggggaagaaa

SEQ ID NO: 7840 - protein, 89 aa, Streptococcus pyogenes
VNKRIKKKHKLETAVVLLIAENAMQAEAIKNQNRQIAELRSIIQQNAQAINREFAAVKGVCLDNQAAITNIAVDINYVKKNYKRKWGKK

SEQ ID NO: 7841 - DNA, 171 bp, Streptococcus pyogenes
gtgatgaacttgactgacaaaaagaaaatggggcgacctactagcgaccctaagactgttaaattgactgttagaattaacgaggatacgaacaaaactttggaagaatattgtaagaataataatgtttccaaagctgacggtgttagagaagctattagtcgtctgaaa

SEQ ID NO: 7842 - protein, 57 aa, Streptococcus pyogenes
VMNLTDKKKMGRPTSDPKTVKLTVRINEDTNKTLEEYCKNNNVSKADGVREAISRLK

SEQ ID NO: 7843 - DNA, 246 bp, Streptococcus pyogenes
atggcgaaaattgatattattgataattatgagacattgctaattagtgtcgaagaaattagagcaagtttggaatccttgcatgcctggctggataaagacattgattgggatagtcagtgtgattggtacgattttatttctcaacacagttcccaaattgcgattctaaacttgattatgtaccgtttagacagtttagaagtggaacacagaagcgttatcgaaaacacaatgaaaggtaaa

SEQ ID NO: 7844 - protein, 82 aa, Streptococcus pyogenes
MAKIDIIDNYETLLISVEEIRASLESLHAWLDKDIDWDSQCDWYDFISQHSSQIAILNLIMYRLDSLEVEHRSVIENTMKGK

SEQ ID NO: 7845 - DNA, 540 bp, Streptococcus pyogenes
gtgccaaccatggcagaagaaacacaaacagttgaaacggttgaagagcaagtggtaccagaagcaaaacaaccgcaagacgaaaaaaagtacacagatgcagatgtggacgctatcatcgacaaaaagtttgcgaagtggaagtcagaacaagaagcggagaaatcggaagctaaaaaaatggctaagatgaatgaaaaagagaaagcagactacgaaaagcagaagctgttagacgaattgcaagagctaaaaaacgataagacacgcaatgagttaacagcagtagctcgtcaaatgtttgcagaatctgaaatcaacgtcaacgatgacgtacttggtttagttgtgactttggacgcagaacaaacaaaagcaaatgtaacaacgctagcaaacgcatttgctaaagttatcgctgatgaccgcaaggctcttgtacgccagactactccgtcaacaggtggtggattgagcaaacaaaccaattacggtgctaacttggctagtaaggcagcacaacaaagcaccaaacttttt

SEQ ID NO: 7846 - protein, 180 aa, Streptococcus pyogenes
VPTMAEETQTVETVEEQVVPEAKQPQDEKKYTDADVDAIIDKKFAKWKSEQEAEKSEAKKMAKMNEKEKADYEKQKLLDELQELKNDKTRNELTAVARQMFAESEINVNDDVLGLVVTLDAEQTKANVTTLANAFAKVIADDRKALVRQTTPSTGGGLSKQTNYGANLASKAAQQSTKLF

SEQ ID NO: 7847 - DNA, 378 bp, Streptococcus pyogenes
atgaataaacgtaaagtaacaacatctaaagagattctacacaatctcgactatgaagctatttcagtaactttggattcaaacaaaatcggcaagaaagttgttccagctgggacaattttggcaggcaaagataaatccatttttgaagaccgcaaacagaaagtagaaaccgtgacaaatgaagaagtctctacaaaagaatatgtcgatggtattttacttacagatgtcgatttaacaaatggcgatgcagtcggttcctgtgtttatcgtgggactatcaatgcagacaagcttgctgattcatctgttgcggaaaattatgatgatttggaagaagtactaccacacattgtctttatcaaaggaggtaaa

SEQ ID NO: 7848 - protein, 126 aa, Streptococcus pyogenes
MNKRKVTTSKEILHNLDYEAISVTLDSNKIGKKVVPAGTILAGKDKSIFEDRKQKVETVTNEEVSTKEYVDGILLTDVDLTNGDAVGSCVYRGTINADKLADSSVAENYDDLEEVLPHIVFIKGGK

SEQ ID NO: 7849 - DNA, 1047 bp, Streptococcus pyogenes
atggcattgatccacgaaattatcacatcggaaaatatcaaaggtttttataacgctaaaaacgaaaatgttgaaaatacattgggagaaaaagcattcccgccaaaacaacaactgggccttaagttgtcatttattaaaggtgcagcaggaaaaccggttactcttaaagcggccgcttttgacactaaggtgcctctacgtgaccgcatggctgttgaattgattgacgaagaaatgccattctttaaagaggctatgcttgttaaagaggctgaccgtcaacaactcaacatgttagcgcaaactaaaaataacgaacttatcgacaccatcttggcatctatctacaatgaccaggctacgcttattgcaggtgctaaagcacgccttgaagcaatgcgcatggaagtgttatctaaaggtaaaattcatatccagtctaacggcgtgatgaaagacatcgactatggattggccgaagatcaaacgaccaaaccagacgccaaatgggatagcgcaggaacagctacaccacttaaagacattgaaaaggctatcgaaaaaatggcagagcgtggttttgtgccagaagctatcatcatgaactctaagacatttagtttgattaaaaacgcagagagcaccttagatgtcgtgaagcctatggcaccaaatggggcagcggttactaaacgtgacctaaacacatatcttgaagatgaactacaaatcaaagtcatcctaaaagatggcatgtttgttggtgatgatggtgaatctcgtaaatacttcccagatggttttgcaacattagtacctaacggcaaccttggctacactgtatttggcacaactccagaacagtcagacttgcttggtggtgaagcgacagatgcaaatgtctcaattgtcgaaactggtatcgcaatcacaacaaccaagacaactgatccagtaaacgtccaaaccaaggtatctatgattgccttgccatcatttgaacgcttggaagaagtacatattattaatggcttgcaagatgca

SEQ ID NO: 7850 - protein, 349 aa, Streptococcus pyogenes
MALIHEIITSENIKGFYNAKNENVENTLGEKAFPPKQQLGLKLSFIKGAAGKPVTLKAAAFDTKVPLRDRMAVELIDEEMPFFKEAMLVKEADRQQLNMLAQTKNNELIDTILASIYNDQATLIAGAKARLEAMRMEVLSKGKIHIQSNGVMKDIDYGLAEDQTTKPDAKWDSAGTATPLKDIEKAIEKMAERGFVPEAIIMNSKTFSLIKNAESTLDVVKPMAPNGAAVTKRDLNTYLEDELQIKVILKDGMFVGDDGESRKYFPDGFATLVPNGNLGYTVFGTTPEQSDLLGGEATDANVSIVETGIAITTTKTTDPVNVQTKVSMIALPSFERLEEVHIINGLQDA

SEQ ID NO: 7851 - DNA, 264 bp, Streptococcus pyogenes
atggccaaagttattaagacttttagagataaagtgacgactaatgcttattatgtaggcgatgattacaaaggagatcgtatcgaggaattgacagccaatggttacttggccggaaatactcctaaactggatactgtcgaagaagttgacctagataaactcaaaagcgatgaaatcaaggcaaaacttgacgaattgggcattgagcacgattctaagcttaaaaaggcggaattgttggagcttttaaaagctaacatt

SEQ ID NO: 7852 - protein, 88 aa, Streptococcus pyogenes
MAKVIKTFRDKVTTNAYYVGDDYKGDRIEELTANGYLAGNTPKLDTVEEVDLDKLKSDEIKAKLDELGIEHDSKLKKAELLELLKANI

SEQ ID NO: 7853 - DNA, 357 bp, Streptococcus pyogenes
gtgtttatggcaaatgtaaacacatttagcattgtaaaaaatgtcaagctcgatttaggcattgaggacgacaatcaagaccagttgttggagatgttgctaaatcgtattacagaccacttcaaagcaaattatggcgtgttagaaattgacaatgctttttcttttgtcttggaagattgtctgattgctcgttttaaccgtagaggttcagagcgtgccaaaacagaggaagtggaaggtcataaaacaacctactacgaccatttgaatgagtttgaaccctacgatgccatgattatggcaaagcttaatttaatcaaagacaaatctcgtaaagggggactgtacttttta

SEQ ID NO: 7854 - protein, 119 aa, Streptococcus pyogenes
VFMANVNTFSIVKNVKLDLGIEDDNQDQLLEMLLNRITDHFKANYGVLEIDNAFSFVLEDCLIARFNRRGSERAKTEEVEGHKTTYYDHLNEFEPYDAMIMAKLNLIKDKSRKGGLYFL

SEQ ID NO: 7855 - DNA, 306 bp, Streptococcus pyogenes
atgagatatgcagatagagttacatttgttaaaacgacggatgagcaatacaatcccgatttaggtgagtatacgcacacagaggtcataagtatcacaaaaccttgttttgtgatggacatgggcatggaaaagtccgtacagatttttggagattatcaaaaggatcgtaaagttatctacctaaagcagccttatacaaaagcatttgattattgcgagtatgagggcaggagatacaaaacgcaggcaaataagcttggcgctattgttttttatctggaaggagatgactctattggtggc

SEQ ID NO: 7856 - protein, 102 aa, Streptococcus pyogenes
MRYADRVTFVKTTDEQYNPDLGEYTHTEVISITKPCFVMDMGMEKSVQIFGDYQKDRKVIYLKQPYTKAFDYCEYEGRRYKTQANKLGAIVFYLEGDDSIGG

SEQ ID NO: 7857 - DNA, 363 bp, Streptococcus pyogenes
atgactctattggtggctgatatatctttaaaagtagttggaacagctggtttaaaaaagaaacttgagcttattatcaaaaaagatgccgtcaagaagattgtcagagacaatgggacgcagcttcaaaggaaaatgattaataaagcggtatttacaaaaggctattcaacaggtgcaactagacgttctattaccatgcaaatcggcgatggtggattgagtgtcaaggttaaaccaggaactcattatgccggctaccttgaaagaggaactcgccttatgagcaaacaaccgtttgttttgccagctctaaaagagcaaaaagtaaaatttagaaaagatttggaggcgcttgtcaaa

SEQ ID NO: 7858 - protein, 121 aa, Streptococcus pyogenes
MTLLVADISLKVVGTAGLKKKLELIIKKDAVKKIVRDNGTQLQRKMINKAVFTKGYSTGATRRSITMQIGDGGLSVKVKPGTHYAGYLERGTRLMSKQPFVLPALKEQKVKFRKDLEALVK

SEQ ID NO: 7859 - DNA, 387 bp, Streptococcus pyogenes
atgattaaaactagagatcagtctatttttgacgaaatgtttaaacgcatccagtctttaggttttaaggtttacgattataaaccgatgacggaagttccatatccatttgtggaaatggaatctactgatgcggaatatattccaaataaagatgacattaaaggttctgttgaacttatgttgtctgtttggggggtgcagaaaaaacggaagcaggtgtctgacatggcatctgctattttttcgcaagctttgacagtagagagttctgacgttttccgctggtcattaaatactcgtcaatcatctattcaaatgttagatgacacaacaactgtgacacctcttaaacgagcgattgtcacacttagatttaatttgaga

SEQ ID NO: 7860 - protein, 129 aa, Streptococcus pyogenes
MIKTRDQSIFDEMFKRIQSLGFKVYDYKPMTEVPYPFVEMESTDAEYIPNKDDIKGSVELMLSVWGVQKKRKQVSDMASAIFSQALTVESSDVFRWSLNTRQSSIQMLDDTTTVTPLKRAIVTLRFNLR

SEQ ID NO: 7861 - DNA, 114 bp, Streptococcus pyogenes
atgtcaggggataatgtttctgattctggcatttctacctcctatctcaaattaaatctaagtgtgacaatcgctcgtttaagaggtgtcacagttgttgtgtcatctaacatt

SEQ ID NO: 7862 - protein, 38 aa, Streptococcus pyogenes
MSGDNVSDSGISTSYLKLNLSVTIARLRGVTVVVSSNI

SEQ ID NO: 7863 - DNA, 564 bp, Streptococcus pyogenes
atggaaacacaattagaagcaaaacaagggattcattcaatcttgttatttcgtttgttgaaagaagcatctagtgaggcagcaactaaacttgcttttcaaacagagcatgaagtaggtaaaagccgtgacgtagatggacaaaaaactaaagatggtattatccagtccgtgggggctttggagtacgactttaaagcaacatctattttagctaaaggtgacgtactagcagctaaactagaaaaagccatggagaatggtgagcttgtagaaatttgggatattgatttagaagaaacaagcaaaaacggcgacagcgacaataagcttgcaaacgtttggggtattgataaaaatggaacaaacagaggaaacggtaaatacctagcgacttattaccaagggtacatctcaagcttcagtgctaagaaaaatgctgaggaaaatattgaaattgaaatggaatttgccatcaacggtgttggccaaaaaggattcgctacattaacagatgcccaaaaagcagctgtacagtacgcatttaaagatacaacgaaaggt

SEQ ID NO: 7864 - protein, 188 aa, Streptococcus pyogenes
METQLEAKQGIHSILLFRLLKEASSEAATKLAFQTEHEVGKSRDVDGQKTKDGIIQSVGALEYDFKATSILAKGDVLAAKLEKAMENGELVEIWDIDLEETSKNGDSDNKLANVWGIDKNGTNRGNGKYLATYYQGYISSFSAKKNAEENIEIEMEFAINGVGQKGFATLTDAQKAAVQYAFKDTTKG

SEQ ID NO: 7865 - DNA, 351 bp, Streptococcus pyogenes
atgcaattggaaattaaaggtaaaactcataacgtaaaatttggtacacgatttgttgccgagatggacaaaaatcatatagcagaacgtcagggatttaaatttggagctggtctacaatctagcgttccgtttttaatcgaccacagcgttgttactcttgcggaagtaatttatacaggtacaatcaccgaaccaccacgtcctagtttgaatgatatttacgactatattgacgaagttgaagatattgaaaagctttttgatgatgttttagacgaactacgtcaatcaaacgcatcaaagttgtttatggctcaggtggaaaaagacctggcggaagccaaagcg

SEQ ID NO: 7866 - protein, 117 aa, Streptococcus pyogenes
MQLEIKGKTHNVKFGTRFVAEMDKNHIAERQGFKFGAGLQSSVPFLIDHSVVTLAEVIYTGTITEPPRPSLNDIYDYIDEVEDIEKLFDDVLDELRQSNASKLFMAQVEKDLAEAKA

SEQ ID NO: 7867 - DNA, 327 bp, Streptococcus pyogenes
atgattgtgcttaattgcattagataccttggcatgactgacatcaatgaaatcgggcgattaactttgtatgaatatgatttattaatgacaggcaaagcactagcggctgttgatgaatcacataaagctcacaaacaagcttggataaaccaccaagttacggcaacaaaacttgttggtggcaagaaaaataaaaaagaagtccctgtttataaaaaattcaaggacttttttgattatgaggaagaaatccgaaaaatcactcaagaaattgatgaaggttacgacaagaaaggtatggatttacttctcaaagctaacctt

SEQ ID NO: 7868 - protein, 109 aa, Streptococcus pyogenes
MIVLNCIRYLGMTDINEIGRLTLYEYDLLMTGKALAAVDESHKAHKQAWINHQVTATKLVGGKKNKKEVPVYKKFKDFFDYEEEIRKITQEIDEGYDKKGMDLLLKANL

SEQ ID NO: 7869 - DNA, 777 bp, Streptococcus pyogenes
atgtacgaatttaacgatactatcagaggtactccgaaagttacttttaatttaaagacaacaattggtggaaaggtattagaagacgaactcaataatggtttcggtacctttaggacattgactgtttctggtcgtgatgtggtggacttagagcatcaaacaacaagtgtgttaggacgaaacggagagtatttccacaatgccacagttgaagtcagaaaactagaaataaaagctaaaatcagtggaaaagataacaagtcaatgcgtttacaatatgaaaaattaaacaaattaattgttagtcacaatcaagtttttttatcattttcagacgaacctgacagaaattatctaggcatctttaaatctaaagatgtcccagaagaagtttctaacgagcagattataggactaacattcatctgctacaatccgtttaaaatgtctgatgtaaaaactaaaaaaggaacatctatccaaaatggtgggttatttcaaacaaagcctatcatcactctcaacctatcatcaccaacaaaagaaattaagttgttgcatgtcgaaagccagaagtatatcagattgactggaacttataccactgacgaaatcaagattgatatggccacgggtaagattacccagaacggacgcaatatccttggcgatttagatatgattaatagtaggtattttgagctattacctggtaataatacattacagtgtgccaatgccgccataaccgcagagtttagagaggtttatcta

SEQ ID NO: 7870 - protein, 259 aa, Streptococcus pyogenes
MYEFNDTIRGTPKVTFNLKTTIGGKVLEDELNNGFGTFRTLTVSGRDVVDLEHQTTSVLGRNGEYFHNATVEVRKLEIKAKISGKDNKSMRLQYEKLNKLIVSHNQVFLSFSDEPDRNYLGIFKSKDVPEEVSNEQIIGLTFICYNPFKMSDVKTKKGTSIQNGGLFQTKPIITLNLSSPTKEIKLLHVESQKYIRLTGTYTTDEIKIDMATGKITQNGRNILGDLDMINSRYFELLPGNNTLQCANAAITAEFREVYL

SEQ ID NO: 7871 - DNA, 2046 bp, Streptococcus pyogenes
atgatatacctgtttgataaacttgagcgattggtcgctactgttggtactgatgacttgctctcatggcactttaaggtcaaaaacaatgattgggaccaggctagttttgaggtgccagttgattatgacgtagagccatttgtctactttggtttttttaactacgaccctcatcaaaaagaagatgtctttaagctctttaaagtcattgattacaacctagaagatagcaagttttacaaaggcttagacaaagctgagagtgatcttgataccattgccattatcaaagataagcgatttagacaatcgtccgcagatgcttgtattgatggtgctttagagggtacgggttatcaagtcggcaaagttgagggaataacaaatgttagaacacttagttattactacatcagtccacgagcggctctgattaagattgtggaagcttttaactgcgagttcaatgtcaggtatacctttattaataacaaaatcactagtcgttatatcgacctcaaaaagcgctttggaaagccaacaggcaagcaatttgaacatggcaacaacctactaaaagtcgtctacgaggaatcaacagatgacattgtgacttgtctgattggcagaggtaagggtgaggaaatccaacacgaagaagctgagcctaaagatgtcgagggacacttgccacaggaagaaaggcggcaaggctacggtcgaagaatcgaatttactgatgttgtctggtcggtcgaaaaaggcgacccgatagacaaaccagctggtcaaaactttgtagcactagatagtgcaagggaagaatacggtttgtctcaaaatggtgagctaaaacaccgctggggtgtctttgtcaatgaggaaatcgaggataagacagaactcttaaaagcaacttgggaagaattgcagcgtttgtcaatccctatcagaatttacaaggcagaaatcttagacattggtccagagacgtggaaaggcgactcagtagccattatctatgatgaggtaaaaatagcttttgaaactcgggttgatgagattgatattgacaagcttaattttaacaggtcagtcgtaacacttggtgattacagcgttgtccaaaatcgtgagtcacggtctcgtaaagaggctgtccaaaacatgatagatgaatctttagagactatcacagacttagggatgacatttcaggaatttttgcaaggcatcgaaaaacgcatcgagactggcaaaaaggagatggaagacaattggcgcaaagttaaccttgaatttgataactttaaaaagaaggttgagcaagaaggcttgcaattcaacaccttgaaagaacaaatcaaagaagttgatgaacgcaccgataaagagcttgaagagttccgagccaccctcaaaaacctagcgttaccggaagaagccatcaaaaaaatcaccgaggctatcaaagttgatgacatcccgtctattaaacaaagctttgatgacctaaaaaacaaagtcagtgaaacgagcgagacgtcccgtctaaacgccgaaattttaggtaacaacggtaagacccgctacaacaaaaatttgctggttggcgaccctaaccgcaccaaaacctatgatgaggattacatagaagtagaagctaacgacggtggttttaagcgtggcgagacctacacgattagctttagccagacttgtgagctactcaaaaaagtggctgtcacgctgacacaggctaacaacaagggagttaagttagtgctgacacctaccaaggctaagatggaagcacagacgtttgaggtcgctaaggataaacagtctatagaggtttatcctttgagctacacggctgttttaactggcgactggtataaatctaagcagatagatttaaacgcgtcggaggtgcaggaattggccctggatatgagctataaagatgttgtggacggtaaaggagcaactatcacaggggcatggtcagacagcccacaaattatattagacggaggtaat

SEQ ID NO: 7872 - protein, 682 aa, Streptococcus pyogenes
MIYLFDKLERLVATVGTDDLLSWHFKVKNNDWDQASFEVPVDYDVEPFVYFGFFNYDPHQKEDVFKLFKVIDYNLEDSKFYKGLDKAESDLDTIAIIKDKRFRQSSADACIDGALEGTGYQVGKVEGITNVRTLSYYYISPRAALIKIVEAFNCEFNVRYTFINNKITSRYIDLKKRFGKPTGKQFEHGNNLLKVVYEESTDDIVTCLIGRGKGEEIQHEEAEPKDVEGHLPQEERRQGYGRRIEFTDVVWSVEKGDPIDKPAGQNFVALDSAREEYGLSQNGELKHRWGVFVNEEIEDKTELLKATWEELQRLSIPIRIYKAEILDIGPETWKGDSVAIIYDEVKIAFETRVDEIDIDKLNFNRSVVTLGDYSVVQNRESRSRKEAVQNMIDESLETITDLGMTFQEFLQGIEKRIETGKKEMEDNWRKVNLEFDNFKKKVEQEGLQFNTLKEQIKEVDERTDKELEEFRATLKNLALPEEAIKKITEAIKVDDIPSIKQSFDDLKNKVSETSETSRLNAEILGNNGKTRYNKNLLVGDPNRTKTYDEDYIEVEANDGGFKRGETYTISFSQTCELLKKVAVTLTQANNKGVKLVLTPTKAKMEAQTFEVAKDKQSIEVYPLSYTAVLTGDWYKSKQIDLNASEVQELALDMSYKDVVDGKGATITGAWSDSPQIILDGGN

SEQ ID NO: 7873 - DNA, 1116 bp, Streptococcus pyogenes
atggctgaaaatataccgctacgagtccaatttaagcggatgaaagccgccgagtgggcaagtagtgatgtcgtcttactggagggtgagattggctttgagactgacactggttttgctaagtttggcgatggtcaaaacacttttagtaagcttaagtaccttactggtcccaaaggtcctaaaggagacactggtctccaaggtaaaactggaggaactggttctcggggccctgctggcaagcctggaacgacagattatgatcaactccaaaataaaccagatctaggtgcgtttgcacaaaaagaagaaactaatagtaaaatcaccaaattagaatcaagcaaagcagataaaaacgctgtttacttaaaagcagagtcaaatgcaaagctagacgaaaaattaaatctcaaaggcggcgtcatgacaggacaactacagtttaaacctaatagtggtattaaaccctcatcttccgtaggaggagcgattaacattgatatgtctaaatcggaaggtgctgctatggtgatgtatacaaataaagatactactgatggaccattgatgattttacgctctaacaaagatacgtttgatcagtcagttcaatttgtcgattataagggaacaacaaatgccgttaatattgtgatgcgtcagccaaccacccccaatttttcatcggcacttaatataaccagtgctaacgaaggcggtagtgcgatgcaaattagaggcgtcgaaaaagcattgggaacgctcaaaatcacacacgaaaacccaagcgttgacaaagaatacgataaaaacgctgcagcgttatccattgatattgtcaaaaaacagaaaggcggaaaaggtactgctgcccaaggaatctacattaactcaacatcaggcacgacagggaagttgcttaggattagaaaccttaatgatgataagttctacgtcaagcctgacggtggtttttatgccaaggaaacttcgcagattgatggcaacctgaaactcaaggatcccatagcgaatgatcatgcggcaaccaaagcttatgttgatggtgaagtcgaaaaattaaaagcactcttagcggctaagcaaatg

SEQ ID NO: 7874 - protein, 372 aa, Streptococcus pyogenes
MAENIPLRVQFKRMKAAEWASSDVVLLEGEIGFETDTGFAKFGDGQNTFSKLKYLTGPKGPKGDTGLQGKTGGTGSRGPAGKPGTTDYDQLQNKPDLGAFAQKEETNSKITKLESSKADKNAVYLKAESNAKLDEKLNLKGGVMTGQLQFKPNSGIKPSSSVGGAINIDMSKSEGAAMVMYTNKDTTDGPLMILRSNKDTFDQSVQFVDYKGTTNAVNIVMRQPTTPNFSSALNITSANEGGSAMQIRGVEKALGTLKITHENPSVDKEYDKNAAALSIDIVKKQKGGKGTAAQGIYINSTSGTTGKLLRIRNLNDDKFYVKPDGGFYAKETSQIDGNLKLKDPIANDHAATKAYVDGEVEKLKALLAAKQM

SEQ ID NO: 7875 - DNA, 159 bp, Streptococcus pyogenes
atgcaagaaaaattattaggtaaaattattaacgatttagcacttaaagttgctaatttaacgctagaaaatgctcaattaaaagcacagcatgaaatcgaattggaagaactaaacgcacaattggatgaagcaacagcaccgaaggaagaaggtaaa

SEQ ID NO: 7876 - protein, 53 aa, Streptococcus pyogenes
MQEKLLGKIINDLALKVANLTLENAQLKAQHEIELEELNAQLDEATAPKEEGK

SEQ ID NO: 7877 - DNA, 609 bp, Streptococcus pyogenes
atgagaaattggaaagtaacaggaaaatatccacaacttgatggcacaggagcagtcgcaagcacacatattattatcgctgctgaggatggagctgttatcccgcaacttattaagcaagacttaacctcaactaatgacacagagattatcaaagccgctttggaagaatttaaaaaatctgaatacgttgaaattgcaatgggcgaagccgtgcaaaaagtagacgaccttgaaaaaatctcacaggaaaccgctaagaccgctaaaacagcccaaacagccgcaggattagctaaggtgtccgcagagcgtacacagcgaatgattaacttgcaaaccatccacgtattgacaagtggtgggaacgttgaacccgatatctacaaaggtatgttagagcttattgagcctgctaaacaaggcgagtatcaggcttatgacgtgtttactgttgtagatgagtcgcacgaagatcaagcggtagaagggaaccttgtctttgtacatgtcaacgagccgtttacttatgaggcgcaaactcttaaagatttggaatcagaggataaagtcacagttattaaatatgcggatttggttaaacaagat

SEQ ID NO: 7878 - protein, 203 aa, Streptococcus pyogenes
MRNWKVTGKYPQLDGTGAVASTHIIIAAEDGAVIPQLIKQDLTSTNDTEIIKAALEEFKKSEYVEIAMGEAVQKVDDLEKISQETAKTAKTAQTAAGLAKVSAERTQRMINLQTIHVLTSGGNVEPDIYKGMLELIEPAKQGEYQAYDVFTVVDESHEDQAVEGNLVFVHVNEPFTYEAQTLKDLESEDKVTVIKYADLVKQD

SEQ ID NO: 7879 - DNA, 294 bp, Streptococcus pyogenes
atgatagattttgtacaaattggtgctttttgtggcgctgctttgtctatcttgggtgtttggggatttatcgtcaatccctttaaaaaagccatggaagctaatgagtttgccatggctcaactcaaggactcaattaaggagttagcttatgagcttaaaaatcttgatcgtgaacgtgagattaccaaaaaaattatcgacagacacgaggagcgtttaggtcgcgtagaagacgaagttattatcaacaaggagcgtattattacgctatttaaaaaaggagaagaaaaa

SEQ ID NO: 7880 - protein, 98 aa, Streptococcus pyogenes
MIDFVQIGAFCGAALSILGVWGFIVNPFKKAMEANEFAMAQLKDSIKELAYELKNLDREREITKKIIDRHEERLGRVEDEVIINKERIITLFKKGEEK

SEQ ID NO: 7881 - DNA, 183 bp, Streptococcus pyogenes
atgaataactggtttaaaaaagtagcaattaaaacaattaaaacaatggcacaaatggccgttggtctaatcgggtcaagcgtgttaatcacggatattaattggccaacaatgttgtcagcagtgctgttgtcaggactaacatgtatcctgatgaatgtgtcacaaatcaaggaagaggaa

SEQ ID NO: 7882 - protein, 61 aa, Streptococcus pyogenes
MNNWFKKVAIKTIKTMAQMAVGLIGSSVLITDINWPTMLSAVLLSGLTCILMNVSQIKEEE

SEQ ID NO: 7883 - DNA, 219 bp, Streptococcus pyogenes
gtgattgctcgcatgacctattcctcttccttgatttgtgacacattcatcaggatacatgttagtcctgacaacagcactgctgacaacattgttggccaattaatatccgtgattaacacgcttgacccgattagaccaacggccatttgtgccattgttttaattgttttaattgctacttttttaaaccagttattcatttttcttctccttttt

SEQ ID NO: 7884 - protein, 73 aa, Streptococcus pyogenes
VIARMTYSSSLICDTFIRIHVSPDNSTADNIVGQLISVINTLDPIRPTAICAIVLIVLIATFLNQLFIFLLLF

SEQ ID NO: 7885 - DNA, 105 bp, Streptococcus pyogenes
atgcgagcaatcacacgattagcattagttatagcaatcgcaatactgtatgtgccattatctgtggttgctttgattttttatccatttttagataaggaggga

SEQ ID NO: 7886 - protein, 35 aa, Streptococcus pyogenes
MRAITRLALVIAIAILYVPLSVVALIFYPFLDKEG

SEQ ID NO: 7887 - DNA, 102 bp, Streptococcus pyogenes
atgcaacacaagtataaaataggaggtaaagctcctttagataagacaaatgccctcgcttttgcgggggctgtttttgttataaagattttaattgttatt

SEQ ID NO: 7888 - protein, 34 aa, Streptococcus pyogenes
MQHKYKIGGKAPLDKTNALAFAGAVFVIKILIVI

SEQ ID NO: 7889 - DNA, 777 bp, Streptococcus pyogenes
gtgagaaaaattgtaaatgttaattttaaaaagtttttaacttcatcttttctattgtgggtatttatatcagctataattccaacgtgttacgcgtatgagatgagtagtgtgggagttattaatttaaggaatttatactctacatatgatccaacagaagtaaaaggaaaaataaatgaaggtccgccattttcaggtagtttgttctacaaaaatattccttatggcaatagttcgattgaattaaaagtagaacttaatagcgtagaaaaagctaattttttttctggtaaaagggtggatatatttactttggagtattctcctccctgtaactctaatataaaaaagaattcatatggaggtattactttaagcgacggtaatagaattgataaaaaaaatatacctgttaatattttcatagacggcgttcaacaaaaatatagctatacagatataagtacagggagtactgataagaaagaggttacgattcaggaacttgatgtgaaatcaagatattatcttcaaaaacattttaatatatacggattcggtgatgttaaagattttggccgctcctctagatttcaatctggctttgaggaaggaaatattatttttcatttgaatagtggagagagaatttcttataatctttttgatacaggacatggtgacagagagagtatgctaaaaaaatacagtgataataagaccgcttattctgatcaacttcatattgatatatacttagttaaatttaataaa

SEQ ID NO: 7890 - protein, 259 aa, Streptococcus pyogenes
VRKIVNVNFKKFLTSSFLLWVFISAIIPTCYAYEMSSVGVINLRNLYSTYDPTEVKGKINEGPPFSGSLFYKNIPYGNSSIELKVELNSVEKANFFSGKRVDIFTLEYSPPCNSNIKKNSYGGITLSDGNRIDKKNIPVNIFIDGVQQKYSYTDISTGSTDKKEVTIQELDVKSRYYLQKHFNIYGFGDVKDFGRSSRFQSGFEEGNIIFHLNSGERISYNLFDTGHGDRESMLKKYSDNKTAYSDQLHIDIYLVKFNK

SEQ ID NO: 7891 - DNA, 708 bp, Streptococcus pyogenes
atgagatataattgtcgctactcacatattgataagaaaatctacagcatgattatatgtttgtcatttcttttatattccaatgttgttcaagcaaattcttataatacaaccaatagacataatctagaatcgctttataagcatgattctaacttgattgaagccgatagtataaaaaattctccagatattgtaacaagccatatgttgaaatatagtgtcaaggataaaaatttgtcagttttttttgagaaagattggatatcacaggaattcaaagataaagaagtagatatttatgctctatctgcacaagaggtttgtgaatgtccagggaaaaggtatgaagcgtttggtggaattacattaactaattcagaaaaaaaagaaattaaagttcctgtaaacgtgtgggataaaagtaaacaacagccgcctatgtttattacagtcaataaaccgaaagtaaccgctcaggaagtggatataaaagttagaaagttattgattaagaaatacgatatctataataaccgggaacaaaaatactctaaaggaactgttaccttagatttaaattcaggtaaagatattgtttttgatttgtattattttggcaatggagactttaatagcatgctaaaaatatattccaataacgagagaatagactcaactcaatttcatgtagatgtgtcaatcagc

SEQ ID NO: 7892 - protein, 236 aa, Streptococcus pyogenes
MRYNCRYSHIDKKIYSMIICLSFLLYSNVVQANSYNTTNRHNLESLYKHDSNLIEADSIKNSPDIVTSHMLKYSVKDKNLSVFFEKDWISQEFKDKEVDIYALSAQEVCECPGKRYEAFGGITLTNSEKKEIKVPVNVWDKSKQQPPMFITVNKPKVTAQEVDIKVRKLLIKKYDIYNNREQKYSKGTVTLDLNSGKDIVFDLYYFGNGDFNSMLKIYSNNERIDSTQFHVDVSIS

SEQ ID NO: 7893 - DNA, 126 bp, Streptococcus pyogenes
atgaaaaacatcaatttaaactatcaaaagaaccttgtcatatcaattatcgttgatatgacaaggttctttaatgttttatttaatcacttcttgagtttattcccgaaaaaacacaaggaacaa

SEQ ID NO: 7894 - protein, 42 aa, Streptococcus pyogenes
MKNINLNYQKNLVISIIVDMTRFFNVLFNHFLSLFPKKHKEQ

SEQ ID NO: 7895 - DNA, 111 bp, Streptococcus pyogenes
atggacgaaagagcttgcaatttttttgatttaggttataatgttaaaaaaacgagaaaggaagtcaatgatggtaaaaacacaacacttagcaaattggcaaagctggca

SEQ ID NO: 7896 - protein, 37 aa, Streptococcus pyogenes
MDERACNFFDLGYNVKKTRKEVNDGKNTTLSKLAKLA

SEQ ID NO: 7897 - DNA, 177 bp, Streptococcus pyogenes
ttgagaattaatacaatgacatgtgatataaaaggtcaagaaaaaaccataaaaaacaccctcactgagatgaatttggatgccaagttagacaatcgttttgaggatgtaacggttatttttatcatttttagttttaaaatgctctattttagacacgtaaaaaatcttgccttt

SEQ ID NO: 7898 - protein, 59 aa, Streptococcus pyogenes
LRINTMTCDIKGQEKTIKNTLTEMNLDAKLDNRFEDVTVIFIIFSFKMLYFRHVKNLAF

SEQ ID NO: 7899 - DNA, 90 bp, Streptococcus pyogenes
gtgggtgcgtcaacgaaatcaaagatttctgacttaccgcaaaaattcaatcgctttctccttgctcttggtatcttaaattatggctgt

SEQ ID NO: 7900 - protein, 30 aa, Streptococcus pyogenes
VGASTKSKISDLPQKFNRFLLALGILNYGC

SEQ ID NO: 7901 - DNA, 639 bp, Streptococcus pyogenes
atgacaaaacagcaaatcgaaaaactagcggacttactgcctccttttgcagccacactttacttagacatgattcctgaatttcaagaaggttatgcttcttatgtttatcaaacaccaaaacaagatattcaaaagcgccgcatcaagcagttaactaaaaattttgaacgattactagataccccatctttttatgtgatgcctgtgacaagaaaaacagcagagcaattgctagcagataaaggcctagcttatcatttgttatcgacagttgcagctaatcaagtgtttgcggctgctgttaacgaggatcagatgctttttcaagtgcttcgaaatggagcaagagtagcctttgtgattcttcaagaaaagggggaatttctagaaatgactttagggattcttgaaacagtgacagaaaacgaggttccagcagctattgtggaggctgtccagacatatcttctggcagatatgcaagagaaactcccttctttaagcattatggtcagtcaagaatcaagcaagcttttttaccaagaacaagggtttgttttgctagctaagggttgcaagccaggaaacgaaaatgattctgacgtttgtcagctcgtaaaatacttttccaagcca

SEQ ID NO: 7902 - protein, 213 aa, Streptococcus pyogenes
MTKQQIEKLADLLPPFAATLYLDMIPEFQEGYASYVYQTPKQDIQKRRIKQLTKNFERLLDTPSFYVMPVTRKTAEQLLADKGLAYHLLSTVAANQVFAAAVNEDQMLFQVLRNGARVAFVILQEKGEFLEMTLGILETVTENEVPAAIVEAVQTYLLADMQEKLPSLSIMVSQESSKLFYQEQGFVLLAKGCKPGNENDSDVCQLVKYFSKP

SEQ ID NO: 7903 - DNA, 102 bp, Streptococcus pyogenes
ttgaagagatattttgaaaaagaaaaattaaagcatattaaactaatttcggaggtcattaaaactattattgaaatcatcaaactcattatggatttaatt

SEQ ID NO: 7904 - protein, 34 aa, Streptococcus pyogenes
LKRYFEKEKLKHIKLISEVIKTIIEIIKLIMDLI

SEQ ID NO: 7905 - DNA, 345 bp, Streptococcus pyogenes
atgccaccaaaaactattgatattgaaaagtaccaccagcttgcttggcaaaggcaggctgaacaccgaaagtttttagcgactttaaagaaaaaaccacctaaacatctagacaaaattgtccaggacattcatcaggaggtttttcaagagattgattgcacgtcctgtgctaattgttgcaaagaccttggacctgatttgacagagaccgatattgtcaaaatcgctaaactattccgaatgaaattagcgacttttgaaaagacttacttgcgcgtggatgaggatgatgataaggttttccggttcatgccctgtccttttttaggaggggataacctt

SEQ ID NO: 7906 - protein, 115 aa, Streptococcus pyogenes
MPPKTIDIEKYHQLAWQRQAEHRKFLATLKKKPPKHLDKIVQDIHQEVFQEIDCTSCANCCKDLGPDLTETDIVKIAKLFRMKLATFEKTYLRVDEDDDKVFRFMPCPFLGGDNL

SEQ ID NO: 7907 - DNA, 138 bp, Streptococcus pyogenes
atgaataacacaattaaagactttgatctcgatttgaaaacaaataaaaaagacactgctacaccttatgttggtagccgttacctatgtacccctggttcttgttggaaattagtttgctttacaacaactgttaaa

SEQ ID NO: 7908 - protein, 46 aa, Streptococcus pyogenes
MNNTIKDFDLDLKTNKKDTATPYVGSRYLCTPGSCWKLVCFTTTVK

SEQ ID NO: 7909 - DNA, 747 bp, Streptococcus pyogenes
atggtacaaatttttttatcaaatttattaaaaataaaaaatacgagtattagcaagttgattcttattttccctattatttgtgtgatgttatctttattgttttcagcattaggtggtgaaaatatcctacgtttaactgcggaaacaacagtaaatcagtggggagttatttggattaatgttattattgctgtaaattctggtttgttaaataaattagaattagattctaataagtattctgtttttttatcaagggatgttgatttaaaaaaggtagaatatgccagagttctattgatagctcttataaatctaataattagtatgattttaagcttaatgcttattgtaattagttttgtcctacctactccaagtcttattagtataggtaggatactattaactatcttgttaatttggttgactacactatggcaaatcccgtttattttatggctatcaagaaaaattaatgtgtattttgctatgattattaatattatatctccactaattattggtacaagtttttctctcttaaataaatggtatttgttcccttatgattggtcgttgaagttgcttgagccaatgacaagaatgagaataaatagtataccttttggagcggagtttgttccagactactcacagatttttatatcattgttcctaggaattgcttttttcatcttactgaccaatctatttgctatctctttcaaaaaacaggtgaaa

SEQ ID NO: 7910 - protein, 249 aa, Streptococcus pyogenes
MVQIFLSNLLKIKNTSISKLILIFPIICVMLSLLFSALGGENILRLTAETTVNQWGVIWINVIIAVNSGLLNKLELDSNKYSVFLSRDVDLKKVEYARVLLIALINLIISMILSLMLIVISFVLPTPSLISIGRILLTILLIWLTTLWQIPFILWLSRKINVYFAMIINIISPLIIGTSFSLLNKWYLFPYDWSLKLLEPMTRMRINSIPFGAEFVPDYSQIFISLFLGIAFFILLTNLFAISFKKQVK

SEQ ID NO: 7911 - DNA, 720 bp, Streptococcus pyogenes
atgaaatcatatttatgttctaattttttaaaaatcaaaaatacttcatatttactaatacatattttagctgcactattatttcccttacttctatttttctattggagtcaacgtggaggtttacaaagcaggactgtattattctcctactttcaaatagtaggtgtacttcttccttttgttgcaagtattgtgtgcattcaactaaaaaatttggaagaatcatctggaaaatataaatatttattgggttactcacagtcgaattataagccatttattgtagaattagtatttctatggttatgctattgtatagtattaattatttcaattactatatttattcttttattgaaaactattggtataaatgtatctctcagactacttattttgaatagtttaatttatatcatttttgcctatgtaacctatctgatcaatcatattattagctatatatttagtacaggtgtggcattaggtatttcaatggtaggtgttattgctgcagcattttgtgaaacgagccttggtgataaggtatggtttcttattccatgggcatggcttttaagaatatcagatactctatataaccaacagaaaatggcaattgttccacttattgttatattttttgtttcatgcacagtagctttacttcatatacgaatatttaaaaggtggaatcaagactgtttgacaagtagt

SEQ ID NO: 7912 - protein, 240 aa, Streptococcus pyogenes
MKSYLCSNFLKIKNTSYLLIHILAALLFPLLLFFYWSQRGGLQSRTVLFSYFQIVGVLLPFVASIVCIQLKNLEESSGKYKYLLGYSQSNYKPFIVELVFLWLCYCIVLIISITIFILLLKTIGINVSLRLLILNSLIYIIFAYVTYLINHIISYIFSTGVALGISMVGVIAAAFCETSLGDKVWFLIPWAWLLRISDTLYNQQKMAIVPLIVIFFVSCTVALLHIRIFKRWNQDCLTSS

SEQ ID NO: 7913 - DNA, 153 bp, Streptococcus pyogenes
ttggaagaacgtgtattaaggagtaaaaaaattattgtcacagataacactttaggaggtagcaaagactatgtggggctggtattcttatcacgtaaaaaaagcaatgaagataaaagtgtagtgtactttagaacttatttgagtgtttgg

SEQ ID NO: 7914 - protein, 51 aa, Streptococcus pyogenes
LEERVLRSKKIIVTDNTLGGSKDYVGLVFLSRKKSNEDKSVVYFRTYLSVW

SEQ ID NO: 7915 - DNA, 111 bp, Streptococcus pyogenes
atggttcatcaatcaattaagaaaaaagttatcaagatatcattaaaaatagttgctcaaagttctttcaaatcaaaagattatgatatcgctatgttgagttttagtgta

SEQ ID NO: 7916 - protein, 37 aa, Streptococcus pyogenes
MVHQSIKKKVIKISLKIVAQSSFKSKDYDIAMLSFSV

SEQ ID NO: 7917 - DNA, 345 bp, Streptococcus pyogenes
atggcttttgaaaaagaaattaagcttaaagactgtaaatacctttatacaatcagtccaaacattaaaaaatataccctaagagatactacatttagtcaaactaaagtagggcactaccaattaatacgtttactcgaaaaaatacctaattcaggggatggtttccctttaaaaatcactattaataaagaactcacagggtttaaattagctatcaccgatcagtctggtcttagattagttaatatttttaaaacaaaagataatcaaatccttcaagataaattttatttcttgatggacagccttgtagaacgtgaaatttttagcaaaacagtcgtc

SEQ ID NO: 7918 - protein, 115 aa, Streptococcus pyogenes
MAFEKEIKLKDCKYLYTISPNIKKYTLRDTTFSQTKVGHYQLIRLLEKIPNSGDGFPLKITINKELTGFKLAITDQSGLRLVNIFKTKDNQILQDKFYFLMDSLVEREIFSKTVV

SEQ ID NO: 7919 - DNA, 129 bp, Streptococcus pyogenes
gtgaagtctattatgaaaaaaagaaattttaaacttacagaaatgttacaattggttttattagtggttcctgctgtaaaacttgctaaaaaaatgtttaacgatagtaaaacaccgtctaaaagaaag

SEQ ID NO: 7920 - protein, 43 aa, Streptococcus pyogenes
VKSIMKKRNFKLTEMLQLVLLVVPAVKLAKKMFNDSKTPSKRK

SEQ ID NO: 7921 - DNA, 366 bp, Streptococcus pyogenes
atgactaaaaaaaatcatggcgttttttgggggttgttgcttggatcagcagcagctagcattgcttacttaagtttatcgtcttccaaaaaagatcaactcttgaaagatagtgctaaaaaaatagatgatctcaacgcttacttgcaagataaaagtaagcaagttctggatgcagtatcggaaaaagtccaagaatccaaagatgctgttgaagtttacggtggtatcgccgcagaaacagttgaagaatctttgggacaggctaaagaaaaggtagaaggaattggcgaagctactagccaaactatccaatctaaaatggaaaaactcactagcgataagacagatgctgatgatgaaaaa

SEQ ID NO: 7922 - protein, 122 aa, Streptococcus pyogenes
MTKKNHGVFWGLLLGSAAASIAYLSLSSSKKDQLLKDSAKKIDDLNAYLQDKSKQVLDAVSEKVQESKDAVEVYGGIAAETVEESLGQAKEKVEGIGEATSQTIQSKMEKLTSDKTDADDEK

SEQ ID NO: 7923 - DNA, 105 bp, Streptococcus pyogenes
ttgctgaatatccgcaacaatttgattaaagtcatccacaaggtctttgcctttgtgataaaatatctccagcttcggttagtagtagctgtcaatcactttgtg

SEQ ID NO: 7924 - protein, 35 aa, Streptococcus pyogenes
LLNIRNNLIKVIHKVFAFVIKYLQLRLVVAVNHFV

SEQ ID NO: 7925 - DNA, 1404 bp, Streptococcus pyogenes
ttgattcagtttggaggttttagcatgcagcagcaagtcgcaataacagaaacagttttacgggacggtcatcaaagtttgatggcaacgcgtttatctattgaagatatgcttcctgtccttaccatcttagacaagattggttattattccctagagtgttggggaggagcaacctttgatgcctgtattcgttttttgaacgaagacccttgggaaaggctgcgcacgttaaaaaaaggcttacctaatacccgtttacaaatgttattaagaggccaaaaccttttaggctaccgtcattatgcagatgacatcgttgacaaattcattagtttatcagctcaaaatgggattgatgttttccgcatttttgatgccctaaatgacccacgaaatatccagcaagccttaagagctgtgaaaaagacgggtaaagaggctcaactgtgtattgcctatacaactagcccagtgcacacgcttaactattacctttctttagtgaaagaattggttgagatgggagctgattctatctgcatcaaagatatggctggtattctaactcccaaagcggctaaagagttggtatctggtatcaaagccatgactaacttacctcttattgtgcatacccatgcaactagtggcatttctcagatgacctatctagcagcagtagaagctggtgctgatagaattgatacggctttgtcaccttttagcgaaggaacttcacaacctgctacagaatccatgtatttagccttaaaagaagcaagttatgatatcacattagatgaaacgctactggaacaggctgctaatcaccttcgacaagcccgtcaaaagtacttagcagatggcattctggatcccagtcttctctttccagacccaaggacactacaataccaagttcctggaggcatgttgtctaatatgctatctcagctgaaacaagccaatgccgaatcaaaattagaagaagttttagcagaagttcctcgggtaagaaaagacttgggttatcctcccttagtaacaccgcttagccaaatggtcgggactcaagctgctatgaatgtgattttaggaaaaccttaccagatggtgtctaaggaaattaaacaatacttggcaggcgactatggcaaaacaccagcaccagtcaacgaagacttaaaacgaagtcaaattggctcagctcctgtcaccacaaatcgtcctgcagatcaactaagtcctgaattcgaggtgttaaaagcagaagtagcagatttagcccaaacggacgaagatgtgctgacttatgccctcttcccaagcgtagcaaaaccgtttttaacaaccaaataccaaactgatgacgtcattaaagtgactgcctttatcaaagca

SEQ ID NO: 7926 - protein, 468 aa, Streptococcus pyogenes
LIQFGGFSMQQQVAITETVLRDGHQSLMATRLSIEDMLPVLTILDKIGYYSLECWGGATFDACIRFLNEDPWERLRTLKKGLPNTRLQMLLRGQNLLGYRHYADDIVDKFISLSAQNGIDVFRIFDALNDPRNIQQALRAVKKTGKEAQLCIAYTTSPVHTLNYYLSLVKELVEMGADSICIKDMAGILTPKAAKELVSGIKAMTNLPLIVHTHATSGISQMTYLAAVEAGADRIDTALSPFSEGTSQPATESMYLALKEASYDITLDETLLEQAANHLRQARQKYLADGILDPSLLFPDPRTLQYQVPGGMLSNMLSQLKQANAESKLEEVLAEVPRVRKDLGYPPLVTPLSQMVGTQAAMNVILGKPYQMVSKEIKQYLAGDYGKTPAPVNEDLKRSQIGSAPVTTNRPADQLSPEFEVLKAEVADLAQTDEDVLTYALFPSVAKPFLTTKYQTDDVIKVTAFIKA

SEQ ID NO: 7927 - DNA, 312 bp, Streptococcus pyogenes
atgacctattcctttattgatatcttacaagttaccttagtatccttgttcttagtgttaacctgtttaacagggattatgggattaatgatgctaagtggtaaattattgtcacaagaaaaaaaaactctctctcaacaagcttccagcattcctcaagagcaagaagctgacaagttgagtggagaagctctcgaaactcttttagccaaagacgaattggctagaattgctgttatgactagtcttgcttatgctagccaagaagagtcaggaaaacggtttgaagttattgccgtggaaaggaaatcc

SEQ ID NO: 7928 - protein, 104 aa, Streptococcus pyogenes
MTYSFIDILQVTLVSLFLVLTCLTGIMGLMMLSGKLLSQEKKTLSQQASSIPQEQEADKLSGEALETLLAKDELARIAVMTSLAYASQEESGKRFEVIAVERKS

SEQ ID NO: 7929 - DNA, 1128 bp, Streptococcus pyogenes
atgctagacgtactcaatcaaatggtccaatcgtcaggattggctcatctaactgttaataatcttatcatgatttgcttggccagtttctttttataccttggtatcaaaaaggaatatgagccttaccttatggtaccaatcgcctttgggattttactcgttaatttgcctatggcgggattgatggaccaccctgccaatggtaatcctggtggccttctttattacctatataagggaactagcctagggatttacccacctttaatttttctttgtttgggggcatcaactgactttggtcccttgattgccaatcctaaaaccattttactaggaggcgcagcacaagttgggattttcttagcctttttccttgctattatgttaggcatgacacctcaagaagcggcttctgtcgggattattggtggtgccgatggaccaacagctatttatgtgacgacaaagttggcgcctgatttactctctactatcgccctagcagcttattcttacatggctctggtacctattattcaacctcccatcattaaactcttgactaccaaggcggaacgccaagtgaaaatgactcaagcaagaactgtttcacaaaaagaaaaaatcattttcccgattatggtaacaatctttgtcagccttttggttccaagtgctacaaccttggttggctgtttgatgctgggaaatctggtcagagaaattaaaattgttcctaaaattgtagagaatctccaacaagtggttatgttttgcattactatcattttagggttaaccgttggtgctaaggccaatggagatctctttttatcagccacaaccttgaaaattattgcccttgggctaatcgcctttgctgctgggacagcagggggtgtcttgatggggaaggtcatgtactatttatctggtaacaaagtgaaccctatgataggagcagcaggtgtttcagctgttccgatggcagcacgagtggtccaaaagatcggacaagaagaagatccaagtaatttcttactcatgcacgccatggggcccaatgtagctggcgttattggctcagccattgcctcaggtgccttgctggccttctttggc

SEQ ID NO: 7930 - protein, 376 aa, Streptococcus pyogenes
MLDVLNQMVQSSGLAHLTVNNLIMICLASFFLYLGIKKEYEPYLMVPIAFGILLVNLPMAGLMDHPANGNPGGLLYYLYKGTSLGIYPPLIFLCLGASTDFGPLIANPKTILLGGAAQVGIFLAFFLAIMLGMTPQEAASVGIIGGADGPTAIYVTTKLAPDLLSTIALAAYSYMALVPIIQPPIIKLLTTKAERQVKMTQARTVSQKEKIIFPIMVTIFVSLLVPSATTLVGCLMLGNLVREIKIVPKIVENLQQVVMFCITIILGLTVGAKANGDLFLSATTLKIIALGLIAFAAGTAGGVLMGKVMYYLSGNKVNPMIGAAGVSAVPMAARVVQKIGQEEDPSNFLLMHAMGPNVAGVIGSAIASGALLAFFG

SEQ ID NO: 7931 - DNA, 882 bp, Streptococcus pyogenes
atgactaaggcagttctaacaagtattagtcaactggccttaaaagctttgctttatgaagtctcactatctccaaaacctggtttagttgatcgatttgataacggtgcccatgatgacatgtcctttataacctttatcgacagtatgatagcactctctcctttttttcaggcttatatcgaaacaggttttgcttatgcaaaagaagagccacttcttctgtttaaccgtcttagacaactaggtcaaaaggccgaggaaaccatgttttgtgctactcagggaattaacactcataaaggcctgaatttttccatggctttacttcttggtgcaactggggcctatctagcaagaacacctcacttaatgactgatttagggcgttttagcaaggaagatactctagctatctgtcgtttagtaaaacctatgacggcacatttgattcaaacagaccttggtcatttgaacactaaaaaagagttcacttatggggagcaactctttgtaacttatggcatcaaaggacctcggggtgaggcaagcgagggattcacgaccttaacagaccatgccttgccctactttcgtcagatgataagtcaaaatgaccccgaaaccagtcagcttcgtcttcttgtttatttgatgtctattgttgaagatggaaatctgattcatcgtggagggattgaagcatggaaaggcgttaaggcagatatgcgactactcctgcaacaagatttatcaacaactgacctaagattggctttgtcctcctacaatcaatgcctcattaatcagcatttaagccctgggggcgcggcagatttattggctctgaccttttattttgcttttttagaaaaactactt

SEQ ID NO: 7932 - protein, 294 aa, Streptococcus pyogenes
MTKAVLTSISQLALKALLYEVSLSPKPGLVDRFDNGAHDDMSFITFIDSMIALSPFFQAYIETGFAYAKEEPLLLFNRLRQLGQKAEETMFCATQGINTHKGLNFSMALLLGATGAYLARTPHLMTDLGRFSKEDTLAICRLVKPMTAHLIQTDLGHLNTKKEFTYGEQLFVTYGIKGPRGEASEGFTTLTDHALPYFRQMISQNDPETSQLRLLVYLMSIVEDGNLIHRGGIEAWKGVKADMRLLLQQDLSTTDLRLALSSYNQCLINQHLSPGGAADLLALTFYFAFLEKLL

SEQ ID NO: 7933 - DNA, 693 bp, Streptococcus pyogenes
atgaatcctattatcgaagccgttaaacaaaatcttgacctattaagaaatatccctttgaaaatagccttttataacgctcttaaaaagaccattattttgcgacaaattcctgttggaagccgcattaatgaaaaagagttttccattgcgcttaatattagcaggacacctattcgctacgctttgggattattgtctgaagaacaccttgtagagcacattcctaaaaaaggcattattgtcaaaggagttagtatcaaggatgcctgtgaaatttttgaaattcgaaaagctctagagactctcgcaacagtgcaagcgatgcatttaatgacagaagaagattttaaagtcatgcataacttgttggaagactgtgaaacctttatcgcagaggatgacaccaatcgtattttggataattttaatgcctttaacaatttgatttacagctatagccaaatggtccgcttaaaagaaattgtgacagaattgcaagcttatttggtctactttagaaaaatttcgatttcttcagttgaacgccgtaaacgagctctatctgaacactggatgatttaccgaggtatgaagaacaaagatcatgagcaaattacgttgattacacatgaacacttgaatagctcacttgaatttatcttaaaagaaatgaggcctgagcaaaatgac

SEQ ID NO: 7934 - protein, 231 aa, Streptococcus pyogenes
MNPIIEAVKQNLDLLRNIPLKIAFYNALKKTIILRQIPVGSRINEKEFSIALNISRTPIRYALGLLSEEHLVEHIPKKGIIVKGVSIKDACEIFEIRKALETLATVQAMHLMTEEDFKVMHNLLEDCETFIAEDDTNRILDNFNAFNNLIYSYSQMVRLKEIVTELQAYLVYFRKISISSVERRKRALSEHWMIYRGMKNKDHEQITLITHEHLNSSLEFILKEMRPEQND

SEQ ID NO: 7935 - DNA, 1422 bp, Streptococcus pyogenes
ttgaaaaaggagataacaatgatgttattaacaatgctggcttatgccatgattattgtctttatgtacgtggtaatgaagaaaaaaatgaccccttttactgctttggtcatgattccattaatcatgacgattgctgttatactgactggttcagctgacttcaatgcagatgccaaatttgttgcctttgttggtgacggtggaattgctaaagacctaacagctatcggaccaatggttatgtatggtatcaacaatactgctaaaacaggtatcatgttgctatttgccattttgttcttctctgtcatgttagatgcaggattgtttgatccgattactgaaaagatgattcgctttgctaaaggtgatccaatgaaggtgcttatcgcaacagctgtcgttgctgctgcagtatctcttaatggtgatggaacaaccactactttaatttgttgctctgctttcttacctatctataaaaaattggacatgaaaatcatgaacctaggtgtcttgattattcttcaaaatactattatgaacttactgccatggggtggccctactgctcgtgcgatgtctgttcttggtgtcggtcctgaaattcttggctatcttgcaccgggtatgattttatctcttctttatgtgatttgttgggttgctccaagcatggggcgtaaagaacgtgcaagacttggtgttattgacttgtctgaagaagacatgcgtcaactcacagacattactgacccagataccctttttattcgtcgtcctaaaaactttgttttcaatgctatcttaaccattggattaatcacttggttagttgctggctctttcaacaaatctattgctatggcaccgcttcttctttttgcggtgggaacttgtatcgccttgatggtcaattacccagtgcttaaagatcaatcaaaacgcattggtgacaatgctggtgatgcggttcaagtggttattctcgtctttgctgctggtatctttatgggtctttttcaaggttctggtatggctagcgctcttgcacaaagttttgcaaccattattccaaaacaactggcaggtttctggggtctcgttattgccttagtttctgcacctggtaccttctttatctccaatgatggtttttactatggtatcttgcctgttcttgcagaagctggtgctgaatatggtttcagtaacatggctatggcacttgcttccctcatgggacaagccttccacttacttagtccattagttgccttcatttatcttcttcttcgcttgacaggtcttgacatgggggaatggcaaaaagaggctgctaaatatgcccttatcatctttgttatctttgtggtaaccattattgccatgggacaaatgccactttacattccacaa

SEQ ID NO: 7936 - protein, 474 aa, Streptococcus pyogenes
LKKEITMMLLTMLAYAMIIVFMYVVMKKKMTPFTALVMIPLIMTIAVILTGSADFNADAKFVAFVGDGGIAKDLTAIGPMVMYGINNTAKTGIMLLFAILFFSVMLDAGLFDPITEKMIRFAKGDPMKVLIATAVVAAAVSLNGDGTTTTLICCSAFLPIYKKLDMKIMNLGVLIILQNTIMNLLPWGGPTARAMSVLGVGPEILGYLAPGMILSLLYVICWVAPSMGRKERARLGVIDLSEEDMRQLTDITDPDTLFIRRPKNFVFNAILTIGLITWLVAGSFNKSIAMAPLLLFAVGTCIALMVNYPVLKDQSKRIGDNAGDAVQVVILVFAAGIFMGLFQGSGMASALAQSFATIIPKQLAGFWGLVIALVSAPGTFFISNDGFYYGILPVLAEAGAEYGFSNMAMALASLMGQAFHLLSPLVAFIYLLLRLTGLDMGEWQKEAAKYALIIFVIFVVTIIAMGQMPLYIPQ

SEQ ID NO: 7937 - DNA, 180 bp, Streptococcus pyogenes
atgcagtttttacaaaaatggtttaaacactctaaaaaagagaagttgaaagaatcctcgtcccttagtacagaaatagaaccttctgaaaactgggcaaagattcccgcttatattcctgcagacaaaagtgattacaaaaaggttactttaattaccagtgttattgctgctgggcga

SEQ ID NO: 7938 - protein, 60 aa, Streptococcus pyogenes
MQFLQKWFKHSKKEKLKESSSLSTEIEPSENWAKIPAYIPADKSDYKKVTLITSVIAAGR

SEQ ID NO: 7939 - DNA, 162 bp, Streptococcus pyogenes
gtgttattgctgctgggcgatagacctaatagtcaattcaaggttaaacgcattctcaagcgcaatcctgaggcaatcactgtttctttaattgcttcaagtatcgctgcaggtgtttacccagaaagtcagtttcgggtgacatccatctattgcaaaagg

SEQ ID NO: 7940 - protein, 54 aa, Streptococcus pyogenes
VLLLLGDRPNSQFKVKRILKRNPEAITVSLIASSIAAGVYPESQFRVTSIYCKR

SEQ ID NO: 7941 - DNA, 1119 bp, Streptococcus pyogenes
gtggacactttaatcgcaggaataacctccatcaccattcctcaaattgttatgatggtcattggtgccctcttaatgtatctaggaattaaaaaagaatacgaaccaaccttacttgtccccatgggacttggaaccattctcgttaacttccctggttcaggagttttaacacaagtggttaacggagtcgagcaagaaggggtttttgaggctctcttcaattttgggattggaacagaacttttcccactgttgattttcattggtataggagccatgattgactttggccccttgcttcaaaacccattcatgctcttgtttggtgatgcagctcaattcggaattttctttgttgtggttgttgccgtactggctggctttgacattaaagaagcagcttcaatcggcattatcggagcagcagacggaccgacttctatctttgttgccaaccaactggccaaggatttactgggtccaattacggttgcagcctattcttacatggctctggttcctattatccaaccatttgccattaaattagtgacaacgaaaaaagagcgccgtatccgtatgacttacaaagctgagaatgtatctcaaatgactaaaatcttattcccaatcatcattaccttagtagcagggttcatcgccccaatttctctacctttagttggctttttgatgttcggtaacttattacgggagtgtggtgtgctcgatcgcctgtcacaaactgctcaaaatgaattggtaaacattattagtatcttgcttggattgaccatctctattaaaatgcaggcagacctgttcttaaatgtacagacactcttaatcatcgtctttggtttacttgcttttatcatggattctatcggtggggtcatgtttgccaaatttctcaatctcttccgaaaagagaagattaatccaatgattggcgctgcgggtatttcagcttttccaatgtcaagtcgtgtcattcaaaaaatggcaacagatgaagacccgcaaaactttatcctcatgtatgctgtaggtgccaatgtctctggccaaatcgcctctgttatcgcaggtggtttgttgctagcttactttagc

SEQ ID NO: 7942 - protein, 373 aa, Streptococcus pyogenes
VDTLIAGITSITIPQIVMMVIGALLMYLGIKKEYEPTLLVPMGLGTILVNFPGSGVLTQVVNGVEQEGVFEALFNFGIGTELFPLLIFIGIGAMIDFGPLLQNPFMLLFGDAAQFGIFFVVVVAVLAGFDIKEAASIGIIGAADGPTSIFVANQLAKDLLGPITVAAYSYMALVPIIQPFAIKLVTTKKERRIRMTYKAENVSQMTKILFPIIITLVAGFIAPISLPLVGFLMFGNLLRECGVLDRLSQTAQNELVNIISILLGLTISIKMQADLFLNVQTLLIIVFGLLAFIMDSIGGVMFAKFLNLFRKEKINPMIGAAGISAFPMSSRVIQKMATDEDPQNFILMYAVGANVSGQIASVIAGGLLLAYFS

SEQ ID NO: 7943 - DNA, 132 bp, Streptococcus pyogenes
atgacaattaatatggaccatttgattagttcctttgagctaatggcgcttggtatggcaggtgtctttatcgtgttaggcattctctatcttgtcgcagagatcctgatcaaacttttcccagttagtaaa

SEQ ID NO: 7944 - protein, 44 aa, Streptococcus pyogenes
MTINMDHLISSFELMALGMAGVFIVLGILYLVAEILIKLFPVSK

SEQ ID NO: 7945 - DNA, 306 bp, Streptococcus pyogenes
atggatattaaacaaactgccgttgctggttcacttgaatcaagtgacctaatgattacagtatcccctaatgacgagcaaaccattacaataaccctagacagtagtgttgaaaaacaatttggcaatcacattcgtcaactcattcatcaaaccctagtgaatttgaaggtgacggctgctaaagtagaggctgttgataaaggtgcattagattgcaccattcaagcgagaaccatcgcagctgttcatcgcgctgctggtattgaccaatacgattggaaggagattgactcatggaacgtt

SEQ ID NO: 7946 - protein, 102 aa, Streptococcus pyogenes
MDIKQTAVAGSLESSDLMITVSPNDEQTITITLDSSVEKQFGNHIRQLIHQTLVNLKVTAAKVEAVDKGALDCTIQARTIAAVHRAAGIDQYDWKEIDSWNV

SEQ ID NO: 7947 - DNA, 885 bp, Streptococcus pyogenes
atggaacgtttaagaagaacaatgatgtttgtgcctggtgccaatgcagccatgcttcgagatgctcctttatttggcgctgattcaatcatgtttgacttggaagattctgtttcactcaaagaaaaagacacctctagagctctcgttcattttgcgcttaaaacttttgattattcaagcgttgaaacggttgttcgtgtgaatggtcttgattcttgtggggctttagacatcgaagctgttgttttggcaggtgtcaacgtgattcgtcttccaaaaacagagactgctcaagatattattgatgtggaggctgttattgaacgtgtcgaacgcgagaacagcattgaagttggtcgcacacgtatgatggcagccattgaatcagccgaaggtgtcctaaatgctcgtgagattgccaaagcttctaagcgcttgattggtattgctcttggagcagaagactatgtcacgaatatgaaaacgcgtcgttacccagatggtcaagaattattctttgctcgtagcatgattttacacgctgctcgtgctgctggaattgctgccattgatactgtttattctgatgtcaataataccgaagggttccaaaacgaagttcgcatgatcaaacagttaggatttgatggtaaatcggtcatcaaccctcgccaaattcctctggtcaatgagatttataccccaacaaaaaaagaaattgaccatgccaaacaagtcatctgggcaattcgtgaagctgaaagcaaaggctctggcgttatttccttaaatggaaaaatggttgataaaccaatcgttgaacgtgcagaacgtgtgattgccctagcaacagcagcaggtgttttatctgaggaggatatt

SEQ ID NO: 7948 - protein, 295 aa, Streptococcus pyogenes
MERLRRTMMFVPGANAAMLRDAPLFGADSIMFDLEDSVSLKEKDTSRALVHFALKTFDYSSVETVVRVNGLDSCGALDIEAVVLAGVNVIRLPKTETAQDIIDVEAVIERVERENSIEVGRTRMMAAIESAEGVLNAREIAKASKRLIGIALGAEDYVTNMKTRRYPDGQELFFARSMILHAARAAGIAAIDTVYSDVNNTEGFQNEVRMIKQLGFDGKSVINPRQIPLVNEIYTPTKKEIDHAKQVIWAIREAESKGSGVISLNGKMVDKPIVERAERVIALATAAGVLSEEDI

SEQ ID NO: 7949 - DNA, 1530 bp, Streptococcus pyogenes
atggtaacaaataaactcggtagagatattcctcaaccatacgccgaccaatacggtgtctttgaaggagaactcgcaaatatcaaacagtatgacgaatcaagtcgccgtattaaaccagttaagcctggagattctaaattactaggatctgttcgtgaagcgattgaaaaaacaggtttaacagatggcatgaccatttctttccaccaccatttccgtgaaggggatttcattatgaatatggtcttggaggaaattgccaaaatgggcattaaaaacctgtctattgccccaagttccatcgctaatgtacatgagcctttgattgatcacatcaaaaatggtgtggtcactaacatcacttcatctggtcttcgtgacaaagtaggggcagccatctcagaaggactaatggaaaatcctgtggttattcgctcccatggtggtcgcgctcgtgccattgctagtggggatatccatattgatgttgcctttctgggcgccccaagttcagatgcttacggaaatgttaatgggacaaaagggaaagcaacctgtggttctttgggctatgccatgattgatgccaaatatgcggatcaggtggttatcttgacagataatttggttccttatcctaataccccaatcagcattcctcaaacagatgttgactatgtggtaacagtggatgctatcggagatcctcaaggaatcgccaaaggggcaactcgttttacgaaaaatcctaaagaactcttaattgcagaatacgccgctaaagtaatcaccaactctccttattttaaagaaggattctctttccaaactggaacaggtggcgcttctttggcagtaacccgtttcatgcgtgaagctatgattaaagaaaatatcaaagctagctttgctcttggtggtattaccaatgctatggtggagttgctcgaagaagaactggttgaaaaaattcttgatgtccaagactttgatcacccatcagctgtttctcttggtaagcatgctgaacattatgaaattgatgccaacatgtatgcctcacctttgagcaagggtgctgttatcaatcaattagacacttgtattttatcagcccttgaagttgatactaacttcaatgttaatgtgatgacaggatctgacggcgtgattcgtggcgcttctggaggacactgcgacactgcctttgcggctaagatgagtttggttatttcaccacttatccgcggacgcatcccaacttttgtagatgaggttaatacggtcattacaccaggaacaagtgtcgatgtgatcgtcacagaagtgggaattgccattaacccaaatcgtcaagacttagtagaccatttcaaatccctcaatgtgccacaatttagtattgaggagctaaaagagaaggcttacgccatcgttggcacacctgagcgtattcaatatggtgataaggttgttgctcttattgaataccgtgacggtagcctcatggatgtggtttacaatgtg

SEQ ID NO: 7950 - protein, 510 aa, Streptococcus pyogenes
MVTNKLGRDIPQPYADQYGVFEGELANIKQYDESSRRIKPVKPGDSKLLGSVREAIEKTGLTDGMTISFHHHFREGDFIMNMVLEEIAKMGIKNLSIAPSSIANVHEPLIDHIKNGVVTNITSSGLRDKVGAAISEGLMENPVVIRSHGGRARAIASGDIHIDVAFLGAPSSDAYGNVNGTKGKATCGSLGYAMIDAKYADQVVILTDNLVPYPNTPISIPQTDVDYVVTVDAIGDPQGIAKGATRFTKNPKELLIAEYAAKVITNSPYFKEGFSFQTGTGGASLAVTRFMREAMIKENIKASFALGGITNAMVELLEEELVEKILDVQDFDHPSAVSLGKHAEHYEIDANMYASPLSKGAVINQLDTCILSALEVDTNFNVNVMTGSDGVIRGASGGHCDTAFAAKMSLVISPLIRGRIPTFVDEVNTVITPGTSVDVIVTEVGIAINPNRQDLVDHFKSLNVPQFSIEELKEKAYAIVGTPERIQYGDKVVALIEYRDGSLMDVVYNV

SEQ ID NO: 7951 - DNA, 627 bp, Streptococcus pyogenes
ttgttgctcttattgaataccgtgacggtagcctcatggatgtggtttacaatgtgtaaagacacttatttttcaggcgaagctatccaacttagtgatatgttaagagcccgcgaagaaagagctctgcgtcagctgcatttattaaaggagtacccagaaggtagcttattatcggtcaccatgaatatccctggaccaattaaaacctctcctaaacttcttgaagcttttgatatagtgattaaggccattcaaactgccttagctgacgataagatttgttaccagttgcgattactgcctacaacgggttatgagtattacctcatcacaagtctacctagccgcgacctgaagttaaaaatgatagccttagagacagagttgccaataggtcgtctcatggatttagatgtcttggtcttgcaaaatgatctgcctcattcaattagcagaaccgtattaggaggctcccctaggcaatgttttatctgttctaaagaggccaaagtctgcggtcgcctacgtaagcacagtgtcgaggagatgcagactgctatttcaaaattactccattcatttttcaataaagacaaccaatcatcgtcatcagataagacaggt

SEQ ID NO: 7952 - protein, 209 aa, Streptococcus pyogenes
LLLLLNTVTVASWMWFTMCKDTYFSGEAIQLSDMLRAREERALRQLHLLKEYPEGSLLSVTMNIPGPIKTSPKLLEAFDIVIKAIQTALADDKICYQLRLLPTTGYEYYLITSLPSRDLKLKMIALETELPIGRLMDLDVLVLQNDLPHSISRTVLGGSPRQCFICSKEAKVCGRLRKHSVEEMQTAISKLLHSFFNKDNQSSSSDKTG

SEQ ID NO: 7953 - DNA, 1410 bp, Streptococcus pyogenes
ttgatgaggagaacaattatgacgaaaatccgtataacggaaacagttttacgtgatggtcaacaaagtcagattgccacacgtatgacaaccaaggaaatgattcctattctcgaaacgctagacaatgctggttatcatgcccttgaaatgtggggaggagcaacctttgattcctgcctacgctttttaaatgaagacccttgggaacggctaagagccatccgtaaagcagtgaaaaagactaaacttcagatgctcttacgcggacaaaaccttcttggatatcgcaattatgctgacgatgtggtcagatcctttattcaaaaatccattgaaaatgggattgatattgtccgtattttcgatgctttaaacgacccacgcaacttgcaaacagctgtttcagcgactaaaaaatttggagggcatgctcaagttgccatttcttacacgacaagtccggtacataccattgactactttgttgaattggcgaaagcttaccaagctatcggagcggactccatttgtatcaaagacatggctggtgtcttaactcctgaaataggttaccaattggtcaaatgtatcaaggagaatacaactatccctcttgaggttcatacccatgctaccagtggtatttcagaaatgacttacttaaaagtagcagaagcaggagctgatattattgatacggcgatttcctctttttcagggggaaccagtcagcctgccacagagtcaatggcgattgccttgacggatttaggctttgacacaggcttggatatgcaagaggtggccaaagttgcagaatatttcaacactattcgtgaccactatcgagaaatagggattttaaatcctaaagtcaaagatactgagccaaaaacattgatttaccaagttccaggtggcatgctatcaaacctattgagccaattaaccgagcaaggcctaactgataaatacgaagaagtcttagcagaagtacctaaagtaagggctgatcttgggtatccgccactcgtaacgccattatcacaaatggttggcacacaggccttgatgaatatcatctcaggggaacgttacaaggtagttccaaatgaaatcaaagactatgttcgagggctatacggtcaatcaccagcgccattagcagaaggtatcaaagagaaaatcattggtgacgaagcagttattacttgcagaccagccgacctaatcgagcctcaaatgatttatctacgtgacgagattgctccatacgctcattcagaagaagacgtgttaagctatgcaagcttcccgcaacaagctagagatttcttgggacgccgtgaagatcctttctatgatgttccggttcaagaagttactgtacaactggacattcaagac

SEQ ID NO: 7954 - protein, 470 aa, Streptococcus pyogenes
LMRRTIMTKIRITETVLRDGQQSQIATRMTTKEMIPILETLDNAGYHALEMWGGATFDSCLRFLNEDPWERLRAIRKAVKKTKLQMLLRGQNLLGYRNYADDVVRSFIQKSIENGIDIVRIFDALNDPRNLQTAVSATKKFGGHAQVAISYTTSPVHTIDYFVELAKAYQAIGADSICIKDMAGVLTPEIGYQLVKCIKENTTIPLEVHTHATSGISEMTYLKVAEAGADIIDTAISSFSGGTSQPATESMAIALTDLGFDTGLDMQEVAKVAEYFNTIRDHYREIGILNPKVKDTEPKTLIYQVPGGMLSNLLSQLTEQGLTDKYEEVLAEVPKVRADLGYPPLVTPLSQMVGTQALMNIISGERYKVVPNEIKDYVRGLYGQSPAPLAEGIKEKIIGDEAVITCRPADLIEPQMIYLRDEIAPYAHSEEDVLSYASFPQQARDFLGRREDPFYDVPVQEVTVQLDIQD

SEQ ID NO: 7955 - DNA, 1050 bp, Streptococcus pyogenes
atgccttactacactatttcaaaagtctttccttcagataaaacgacaatggctagtgtaaagaacctgcttcatcaagaaggtattcgtttggatgctcatttagattatacttgtgccatcatgaatgcgcaaaatgatgtgattgctaccggttcttactttggaaatagcttgcgctgtctttgcgtatccagtgcctatcaaggtgaaggacttcttaataggattgtgagtcatctcattgatgaagaatatgcccttggcaactatcatctttttgtttatacgaagacctcttctgctgcttttttcaaagatcttggttttactgaaattgtccatatcgacaatcacatcagtttcttggaaaataaaaaaactggttttcaagattatctgatgacacttaataagcctgagcaaacacctggtaaagtcgctgctattgttatcaacgctaacccctttaccttagggcatcaatttttagtagagaaagctgcaagagaaaatgattgggttcatctgtttatggtcagtgaagaccgcagtctaattcctttttcggtgagaaagaggttgattcaagaaggtctagctcatcttgataatgtcatatatcatgaaacaggtccttatttgattagccaagcgactttcccagcctatttccaaaaagaagacaatgacgtgattaagagccaagctttgctggatactgctatttttctaaagattgctcaaaccttacagattacaaaaagatacgttggagaagagccaaccagccgagtaactgctatttacaatgaaattatggcagagcagttgcagcaagctggtatcctcctagatattttgccaaggaaagctatcaatcagcagcaagatcctatcagtgcctcaacggctaggcaggcattgaaagataatgattgggaccttctggcaaaactccttcccaaaacgtctttagattatttttgttcgctaaaagcccaacccattattaaaaagatacaagccacttcatctgtcaaacattac

SEQ ID NO: 7956 - protein, 350 aa, Streptococcus pyogenes
MPYYTISKVFPSDKTTMASVKNLLHQEGIRLDAHLDYTCAIMNAQNDVIATGSYFGNSLRCLCVSSAYQGEGLLNRIVSHLIDEEYALGNYHLFVYTKTSSAAFFKDLGFTEIVHIDNHISFLENKKTGFQDYLMTLNKPEQTPGKVAAIVINANPFTLGHQFLVEKAARENDWVHLFMVSEDRSLIPFSVRKRLIQEGLAHLDNVIYHETGPYLISQATFPAYFQKEDNDVIKSQALLDTAIFLKIAQTLQITKRYVGEEPTSRVTAIYNEIMAEQLQQAGILLDILPRKAINQQQDPISASTARQALKDNDWDLLAKLLPKTSLDYFCSLKAQPIIKKIQATSSVKHY

SEQ ID NO: 7957 - DNA, 102 bp, Streptococcus pyogenes
ttgatgagaaccctactagatttaatctataaacatcacaaaaaagtcattcaaagaagggacaaagttagcagtaatattcctttttctaagtggcttgag

SEQ ID NO: 7958 - protein, 34 aa, Streptococcus pyogenes
LMRTLLDLIYKHHKKVIQRRDKVSSNIPFSKWLE

SEQ ID NO: 7959 - DNA, 99 bp, Streptococcus pyogenes
atggctactattaaccgtgacagtttggtgtcaggccgttttccaaactactcaagccacttagaaaaaggaatattactgctaactttgtcccttctt

SEQ ID NO: 7960 - protein, 33 aa, Streptococcus pyogenes
MATINRDSLVSGRFPNYSSHLEKGILLLTLSLL

SEQ ID NO: 7961 - DNA, 156 bp, Streptococcus pyogenes
atgttacacttgctttcgttttatttttttgatactattagtaaagttataactttactaaaggagctaccaaatgttttctggacatcaactaaaaacagcacgattatcaaagggaataactcaatcagaattgggaagattgttgcatgtcaa

SEQ ID NO: 7962 - protein, 52 aa, Streptococcus pyogenes
MLHLLSFYFFDTISKVITLLKELPNVFWTSTKNSTIIKGNNSIRIGKIVACQ

SEQ ID NO: 7963 - DNA, 1431 bp, Streptococcus pyogenes
atgctaagaaaaaagagaattttgggtttatttcgacttgttgaattaattttcctaggattattgttgagtttagttgtttcgtaccttgcgtggaccaatagttttgcaacacttcataatatattagcaactgtcggaatagtggaacgaagcaaagatcaacagcctcgctatcacattggacaagctattcaagtacaaaaaagtggtccatatcatcaatggattggaactattaataaacaggtagaagatatagccgaaaattaccgagtgagttatcattatgaagtggtatttccaataggaaaagtcactgtttctttgccagaacataacctgaaagagcctgataaaccgaggtttaaaaaaggagatatcgttaaattatcttcattaactaaaaagccacatataaaagtatatcaaggtcaattagcgactattaaacaagttaaaaaatgctatgactattcgttaggaggatatcagtacgatattaatctgaaagataatctaagattagatggaatttcagagcaagattttgttaaaccttattatattaggttcaataaaggaaattcccctgagcaaaacaatcgtcttttgcgaaaagctttcgcttatgcaaagcagcatccaaatagcgttatatcttttccaaaggggcaatttcacattggctctttgccttcacaaaaagattattttgagcttccatctgatacagctattattggtcatcagacagagttcattattcacggtaaaatgttgtggtttggattccctacaggaccaaaggctgaacaaggtgttcgtaatctcgtgttgactggagtgcatttcaaagcaaatgatttgaaaaaaggagaccactttatgattatggctgatcatggtactgattggcatatttacgataacaaatttactatggttcataagcgtaatagtcatatttttgatttaggatctctacaaaattcattgtttgagaaaaaccaatttattggctatgcgccagaattagtacaagaccaacagctgctatcaaaggctcaagggcatgattttttttcagaagtcattcagtttgatgctgctgttcatcattttgcatgggatggaggtctacttagtaatattgctccaaactatgaagcatttaaccaaactcgacatctatgtcacaatattactgtaagccaaaatcaatttttaccttatatagatccgactggttgcctgagagcctatagtggttctattggtcagcattcctcaaaagtaggagttattagggttttaaataatgtttttacctcatccattgttactaaagcgaagctcactagttggtttatggaacctattcattttccaccaaattcaccggttattgtcgcaggtaatatcattaat

SEQ ID NO: 7964 - protein, 477 aa, Streptococcus pyogenes
MLRKKRILGLFRLVELIFLGLLLSLVVSYLAWTNSFATLHNILATVGIVERSKDQQPRYHIGQAIQVQKSGPYHQWIGTINKQVEDIAENYRVSYHYEVVFPIGKVTVSLPEHNLKEPDKPRFKKGDIVKLSSLTKKPHIKVYQGQLATIKQVKKCYDYSLGGYQYDINLKDNLRLDGISEQDFVKPYYIRFNKGNSPEQNNRLLRKAFAYAKQHPNSVISFPKGQFHIGSLPSQKDYFELPSDTAIIGHQTEFIIHGKMLWFGFPTGPKAEQGVRNLVLTGVHFKANDLKKGDHFMIMADHGTDWHIYDNKFTMVHKRNSHIFDLGSLQNSLFEKNQFIGYAPELVQDQQLLSKAQGHDFFSEVIQFDAAVHHFAWDGGLLSNIAPNYEAFNQTRHLCHNITVSQNQFLPYIDPTGCLRAYSGSIGQHSSKVGVIRVLNNVFTSSIVTKAKLTSWFMEPIHFPPNSPVIVAGNIIN

SEQ ID NO: 7965 - DNA, 117 bp, Streptococcus pyogenes
atgtccaacggtttagccaaagcttctgctttctcgtcggtatcagaaaggacaataaaaactgctaatattaacttggggatttttaatagctttgaaggcctaaaagcctttcta

SEQ ID NO: 7966 - protein, 39 aa, Streptococcus pyogenes
MSNGLAKASAFSSVSERTIKTANINLGIFNSFEGLKAFL

SEQ ID NO: 7967 - DNA, 90 bp, Streptococcus pyogenes
gtgcttttttgggacttaccgcaagtttggattgccagtcaccatcacaatagaagcaagaatagactaaaaagaactaagtcagcggct

SEQ ID NO: 7968 - protein, 30 aa, Streptococcus pyogenes
VLFWDLPQVWIASHHHNRSKNRLKRTKSAA

SEQ ID NO: 7969 - DNA, 93 bp, Streptococcus pyogenes
atggttgattgtcaccataacaatgacaccttagaagataatgataataatctcttggtaatcagttgttatacacctattttaacattttct

SEQ ID NO: 7970 - protein, 31 aa, Streptococcus pyogenes
MVDCHHNNDTLEDNDNNLLVISCYTPILTFS

SEQ ID NO: 7971 - DNA, 90 bp, Streptococcus pyogenes
ttgctgcaaaacttggctaataaatatccaatgaaaactccagctggagtttttttatacggtaaaaactcaaaaaatacaataaagcgt

SEQ ID NO: 7972 - protein, 30 aa, Streptococcus pyogenes
LLQNLANKYPMKTPAGVFLYGKNSKNTIKR

SEQ ID NO: 7973 - DNA, 954 bp, Streptococcus pyogenes
atgggttcagttgaacgtacattaaaaatgaccttggctaccattgttgccattttaattgcttaccaacttcatctggattatgcaatgtcagcggggatcattgccctgttaagtgttttagacacccgtaagtccagtttggtggtcgctaggaatcgcttgctatcttttttcctggcttttgggattgcgatgatgtgctttagcttgtttggttttacgacagtaggttttatgtgttatttgttaattattattcctttgctctatcactttcagatagaggcaggactggttcctataacagtacttgtgacacatttgattgctaaaaaaagtattgcattacctattttatcgaatgagtttatgctcttttttgtagggactagtgtcgctttactatttaatgcttatatgggtccacaagatcagcaaattcggtactatcaccaaaaagttgaatcggatctgaaaggtatcttataccgttttgaaagctttctactggaaggaaaaggtcaaaatgaagggctcttgatcaaaaaccttgataaaatattagatgaagctctaaaactagtttatcgagaaaggcataatcaactatttcagcagaccaattatcaagttcattattttgagatgcgacgacaacaaaatagactattgggacaaatggctatcaacgtaaacacgttaatgagacaaagtaaggaaagtattcttttgtcacatctttttcacgaaactgcttgtcagctaagcgaacaaaatccggctttaaccttgattgatgacatcgaacaattgcttgaaacctttcgtcatggtgatcttcctcaaactcgggaggaatttgagcgacgtgcggttttatttcagctcttacaagacttagagcgctttatcttattaaaggtagagttttatcaggattatcaaaatgac

SEQ ID NO: 7974 - protein, 318 aa, Streptococcus pyogenes
MGSVERTLKMTLATIVAILIAYQLHLDYAMSAGIIALLSVLDTRKSSLVVARNRLLSFFLAFGIAMMCFSLFGFTTVGFMCYLLIIIPLLYHFQIEAGLVPITVLVTHLIAKKSIALPILSNEFMLFFVGTSVALLFNAYMGPQDQQIRYYHQKVESDLKGILYRFESFLLEGKGQNEGLLIKNLDKILDEALKLVYRERHNQLFQQTNYQVHYFEMRRQQNRLLGQMAINVNTLMRQSKESILLSHLFHETACQLSEQNPALTLIDDIEQLLETFRHGDLPQTREEFERRAVLFQLLQDLERFILLKVEFYQDYQND

SEQ ID NO: 7975 - DNA, 90 bp, Streptococcus pyogenes
gtgacatctcttttatcaaccttaaaattatatcatgtttccaagaaaaatagcaaagaagaccccaaaagtaaagagattccttttttc

SEQ ID NO: 7976 - protein, 30 aa, Streptococcus pyogenes
VTSLLSTLKLYHVSKKNSKEDPKSKEIPFF

SEQ ID NO: 7977 - DNA, 168 bp, Streptococcus pyogenes
gtgctatcatctttctctcctaaaagtcatcgaagacgccaaaagaaaaaagctatctctttctttgagacaacttctgaagcaatgataaaacagcaaacacaaaaaagactaagactgttcttaatggtgtttgtattttaccttctgtccttttgcctgagagat

SEQ ID NO: 7978 - protein, 56 aa, Streptococcus pyogenes
VLSSFSPKSHRRRQKKKAISFFETTSEAMIKQQTQKRLRLFLMVFVFYLLSFCLRD

SEQ ID NO: 7979 - DNA, 771 bp, Streptococcus pyogenes
atgaaacccaaacaccttctctgtctttcaacagttgttgctggattagctttattttcaactatgacgcactcagttttagctgatgatgcttcaaatcccgatgctattttaatgaataacaaccaagcaaattttcaaagagatgctctagtgcaaaagcttgatgagggacatcaacaattagaagctattaaacatgaagctaaaggtactgatattgagactactgttaacaaagctatcgatgctgttgatcacatgaagagttctatacgcttcaatactgaaacgatctatgattttagttcaattggggcaagagtagaagcattatcagatgctatcaaagcaatcgtattttccacaacccaattaactcataaagtagaaaaagcgcatactgatatggggtttgctattactaaattagtcattcgtattatagatccatttgcatctgttgacgctatcaaagctcaagtacaagaaattaaagcacttgaggaaaaagttatcaattatcctgatttacagccaacagaccgtgctactatctatactaaagctaaactaaataaagctatttggaacactcgtttagaaagagataaaaaggttttgggaatcaaaccatttgacgtttacaatagacttaacaaagctatcacacatgcggttggtgtccaactaaatccgacaaccactgttcaacaagttgacgatgaagttattgctgtgcaagatgctttggaaacagctcttaagtca

SEQ ID NO: 7980 - protein, 257 aa, Streptococcus pyogenes
MKPKHLLCLSTVVAGLALFSTMTHSVLADDASNPDAILMNNNQANFQRDALVQKLDEGHQQLEAIKHEAKGTDIETTVNKAIDAVDHMKSSIRFNTETIYDFSSIGARVEALSDAIKAIVFSTTQLTHKVEKAHTDMGFAITKLVIRIIDPFASVDAIKAQVQEIKALEEKVINYPDLQPTDRATIYTKAKLNKAIWNTRLERDKKVLGIKPFDVYNRLNKAITHAVGVQLNPTTTVQQVDDEVIAVQDALETALKS

SEQ ID NO: 7981 - DNA, 156 bp, Streptococcus pyogenes
gtgtccattcaaaagcacacattggacagattaataaaagaccatcttcgtaaacatattcagactggcattgcaaacaatttggtaatgacatcttacactcctaaacatttcttaatgttaccattttactttagaatcaatgatttgacaaga

SEQ ID NO: 7982 - protein, 52 aa, Streptococcus pyogenes
VSIQKHTLDRLIKDHLRKHIQTGIANNLVMTSYTPKHFLMLPFYFRINDLTR

SEQ ID NO: 7983 - DNA, 813 bp, Streptococcus pyogenes
atgccagataaaaaacaatttcctatttcttacatttcacattgcctttctcctagggcaatgtttgccagccgagctcagtttacttggtggcaaaatcttcttattattgtttttttgaacgccttaataatgattccagttacgttacactatgctaacatgacaacgtatcccttggaacggattgtaactaagagtttgtcgcctatcacagacaaaacctatcaagcattgacccaaggaaagattgagaaagatacgtttcagggtcaatctctgattcgacgagatggtgaattggttttggctgttttaccgacaaaggtcgatttagagcaattggcatcagaatcaaccagacaaattattgtgacaaaaaaagaatggcgttttgttacccctgatggcaaggaactccgtgctcacgttagaggccagcagcagtcactcgctgacctgacaacagttaaagcagtgaaggactttgtcaatcagcaatggtatgacagtaataaagccagtgtacttggttttcttttgctgacgtttgttctcatggtgtgtgtgggtacccttattgtgattggtctaggcgctttctttttgactctgactaaacgatcacgactatttatgattcgaaacttctctgaaggacttggattgatggttaattgtttggcttggccgagtctactggcgattgctcttagtttctttattcaggatccagtactgattatgaattgccaagtatttggtaccttattaatgctgacctgggtgttctacaaaacacagtttagagat

SEQ ID NO: 7984 - protein, 271 aa, Streptococcus pyogenes
MPDKKQFPISYISHCLSPRAMFASRAQFTWWQNLLIIVFLNALIMIPVTLHYANMTTYPLERIVTKSLSPITDKTYQALTQGKIEKDTFQGQSLIRRDGELVLAVLPTKVDLEQLASESTRQIIVTKKEWRFVTPDGKELRAHVRGQQQSLADLTTVKAVKDFVNQQWYDSNKASVLGFLLLTFVLMVCVGTLIVIGLGAFFLTLTKRSRLFMIRNFSEGLGLMVNCLAWPSLLAIALSFFIQDPVLIMNCQVFGTLLMLTWVFYKTQFRD

SEQ ID NO: 7985 - DNA, 90 bp, Streptococcus pyogenes
ttgagtgaagaaacgatgcgtatcatgagaatccaaaagattcaagttcatgcgattgacttgccaagtgtttcgcatcaaaatgttgct

SEQ ID NO: 7986 - protein, 30 aa, Streptococcus pyogenes
LSEETMRIMRIQKIQVHAIDLPSVSHQNVA

SEQ ID NO: 7987 - DNA, 141 bp, Streptococcus pyogenes
atgataaaaaacaaatcaagaatgagaggaattgctgtttttattggcaagacaattttattttatctgattttaatgttgctggtctatttctttggttatctaggacatggtcaaagtaactttatttataatgaattt

SEQ ID NO: 7988 - protein, 47 aa, Streptococcus pyogenes
MIKNKSRMRGIAVFIGKTILFYLILMLLVYFFGYLGHGQSNFIYNEF

SEQ ID NO: 7989 - DNA, 150 bp, Streptococcus pyogenes
atgacagaaaaaaatggagcaacttttttaatggctgttggcttttttctcattgccattagtccgatggttggtaacaaatacttacacatagtgacgggactagctcttacgggattaggttattacctcactaaacataaacgccca

SEQ ID NO: 7990 - protein, 50 aa, Streptococcus pyogenes
MTEKNGATFLMAVGFFLIAISPMVGNKYLHIVTGLALTGLGYYLTKHKRP

SEQ ID NO: 7991 - DNA, 447 bp, Streptococcus pyogenes
atgattatttcagcagaaggagatgtttccattcatcattgttttgaagccatgctgatatcgctccaagaagattatcgacaaaataccttgagacagttgtcaagagatgatatcaaagcggggataaactatgttaaacattatggtaaatacaaagaacgtacagtgagggtgcttattacggccctagaagctccgcaattatatactgcttgttttagttccaatcatgggataaaggaattggcttatcaattagaggctctgggggagaatcggactagaattacctattcttatgactatcatcctctagatatttttcaaaaagcaaatcaatttattgttggcaaactgttcaaaaaaagcctagaacgccaatctcaagctcagttagcagcccttatccaatatgctaaacagttgcagcaaccatcgtctttg

SEQ ID NO: 7992 - protein, 149 aa, Streptococcus pyogenes
MIISAEGDVSIHHCFEAMLISLQEDYRQNTLRQLSRDDIKAGINYVKHYGKYKERTVRVLITALEAPQLYTACFSSNHGIKELAYQLEALGENRTRITYSYDYHPLDIFQKANQFIVGKLFKKSLERQSQAQLAALIQYAKQLQQPSSL

SEQ ID NO: 7993 - DNA, 1092 bp, Streptococcus pyogenes
atggttgatttaggattttctctataccctgagcggtatgatgttaccaagagtaaagcttatattgacttatgtcatagctatggagccaagcgcttgtttatgagtctcttacagctggcaccagctgatcaccagatgtttcattgctacgcagagctcattgcttatgcaaatcaattaggcattcgagtgattgctgacgttagtccaagctttattagccaagctggttggtcagatcagcttattgaacgagctcatgccttcgggttagcgggcttacgcttagacgaggctctccctctagcagagattgtaactttaacaagaaatccctttgggcttaaaattgaacttaatatgagcactgataaacaattattgatgtcattgctagcgacagatgcagaacggagcaatattattggttgccataatttttatccacatgaatttaccggtttgtcatggcaacattttaaggatatgtcacgtttttatcatgagcatgatattgaaacggctgcttttattaccgctcagtcagcatctgaaggcccttggctactggcagaaggcttgccgacagtggaagaccataggcacttgcccattggcctgcaagtagaattaatgaaagcgataggaaccattgataatatcctcatatctaaccaattcatttcggaagaagaattggcagcatgtactcaagctttagcaagaccagtcacgacgatcaaggttaggcctatcatcgatttgacagaagttgaggagcaaatcattggctatccgcattgttatcgtggcgatgtatctgattatgtgattcgatcaaccatgccacgtctagtctatgctcaggaatcgattgctccaagagaccaatctaaggaggtcaaacgaggtagcattattattgacaatgaccgctatcatcgatataagggagaactgcaaattgctttgaaaaattttacggtcagttcaaaagctaatgtggttgctgaggtcagagaggactatcttagtttgttagatgatttgcgaccttggcaggaattttgtttggagattgccccatca

SEQ ID NO: 7994 - protein, 364 aa, Streptococcus pyogenes
MVDLGFSLYPERYDVTKSKAYIDLCHSYGAKRLFMSLLQLAPADHQMFHCYAELIAYANQLGIRVIADVSPSFISQAGWSDQLIERAHAFGLAGLRLDEALPLAEIVTLTRNPFGLKIELNMSTDKQLLMSLLATDAERSNIIGCHNFYPHEFTGLSWQHFKDMSRFYHEHDIETAAFITAQSASEGPWLLAEGLPTVEDHRHLPIGLQVELMKAIGTIDNILISNQFISEEELAACTQALARPVTTIKVRPIIDLTEVEEQIIGYPHCYRGDVSDYVIRSTMPRLVYAQESIAPRDQSKEVKRGSIIIDNDRYHRYKGELQIALKNFTVSSKANVVAEVREDYLSLLDDLRPWQEFCLEIAPS

SEQ ID NO: 7995 - DNA, 507 bp, Streptococcus pyogenes
ttgaataggggtatggcttatttaaactactttacaaaaaccgagtgggcactttggttaagctctgtcttggccattttaattagcgcccttttattcggtaagcaagctcccttagctttaatagcttctttgattggtgtgacctctctcatttttagtgctaaagctaatcctattggtcaagggctcgtcattattttttccattatctatgcctatctttcattacgaaacagttactatggagagttaatgacctatctttttatgaccctccctatgactattttttcactttttacttggttaaaccatccttttgaagggaaaaaatcacaagtgactatttcacgattaacacccactgatcgaagatgtcttttcgtttttactatactgatcactcttattttctacagcatcttggcttctatttcaaacagcctatttacttgtctccactttatcgattgccacttctttctcagcggtttatctcagcta

SEQ ID NO: 7996 - protein, 169 aa, Streptococcus pyogenes
LNRGMAYLNYFTKTEWALWLSSVLAILISALLFGKQAPLALIASLIGVTSLIFSAKANPIGQGLVIIFSIIYAYLSLRNSYYGELMTYLFMTLPMTIFSLFTWLNHPFEGKKSQVTISRLTPTDRRCLFVFTILITLIFYSILASISNSLFTCLHFIDCHFFLSGLSQL

SEQ ID NO: 7997 - DNA, 153 bp, Streptococcus pyogenes
atgtcttttcgtttttactatactgatcactcttattttctacagcatcttggcttctatttcaaacagcctatttacttgtctccactttatcgattgccacttctttctcagcggtttatctcagctataagcgcagcccttattttgctt

SEQ ID NO: 7998 - protein, 51 aa, Streptococcus pyogenes
MSFRFYYTDHSYFLQHLGFYFKQPIYLSPLYRLPLLSQRFISAISAALILL

SEQ ID NO: 7999 - DNA, 135 bp, Streptococcus pyogenes
atgcatgctgctcaaacagatgccagccaatatgctgtggtcatctgctttgccacctttcttattaatgatagttacactttttataattggctaatgctccaacgttaccaagaaaaaaaggtcaaaaaagga

SEQ ID NO: 8000 - protein, 45 aa, Streptococcus pyogenes
MHAAQTDASQYAVVICFATFLINDSYTFYNWLMLQRYQEKKVKKG

SEQ ID NO: 8001 - DNA, 363 bp, Streptococcus pyogenes
atgactatttattctcacacttatgaaacccgtcccaatcattcggctaaagccatgggctcaggaacgctgaatgtcctagctactcctgctcttgttgcttttatggaaaatgcttcttacttatttgcccaagaacagctcgacagtgactttacaacggttggcagcgagatagctatccaacatttggcagcttcagccattggagatcctgttacaattatcattacagcccttaaagaagaaggccgaaaatacgatttccgcttggaagcttttgtgggagaacaactcattggaaaagcctgtcatactagagttagggtgaacagtaaacattttatggccaaagtagcggag

SEQ ID NO: 8002 - protein, 121 aa, Streptococcus pyogenes
MTIYSHTYETRPNHSAKAMGSGTLNVLATPALVAFMENASYLFAQEQLDSDFTTVGSEIAIQHLAASAIGDPVTIIITALKEEGRKYDFRLEAFVGEQLIGKACHTRVRVNSKHFMAKVAE

SEQ ID NO: 8003 - DNA, 126 bp, Streptococcus pyogenes
gtgaagcatgaaagtcttaacagtaaagagagtttttttgtcatctcttattatttagtgaactttgatggacttgcggacttgtttccaagtctttttttgacctttggacaaagggtattcaat

SEQ ID NO: 8004 - protein, 42 aa, Streptococcus pyogenes
VKHESLNSKESFFVISYYLVNFDGLADLFPSLFLTFGQRVFN

SEQ ID NO: 8005 - DNA, 1554 bp, Streptococcus pyogenes
atgaggtatccctgcaaaaaaccttttctttcttggaatttctttgttataatgctttacagaggtgaaaaaatgaagactattgcttttgattctaacaagtatttaaacttgcaaagagatcatattttagaacgtatcagccaatttgatggcaagctttacatggaatttggtggtaaaatgttagaagattaccatgctgcccgtgtgcttcctggctatgaacctgacaataagattaaattactcaaagagctcaaagaacaagtcgaaattgtaattgccattaacgctaataatattgaacattctaaagcgcgtggtgatttaggcatttcttatgaccaagaagtctttcgcttaattgacaaatttaacacgttagatatttacgtaggttctgtcgttattactcaatacaataaccaacccgctgcagatgcctttcgcaagcaactcgaaaaaaatggcattgcttcttacctgcattatcctatcaagggctacccgacagatattaatcatattatctcatctgaggggatggggaaaaataattacatcaaaacgagtcgtaaccttatcgttgttacagcaccaggccctgggtctggaaaattagccacttgcatgtcccaaatgtatcacgaccaaatcaatggggttaagtctggctatgctaaatttgaaaccttcccagtttggaatcttcctcttcatcaccctgtcaatctggcttatgaggcagccacggcagacctagatgatgtgaatatgattgaccccttccatttggaaacttatggcaaaacggccgttaattacaaccgtgatatcgaggtctttcctgtcttaaatcggaccttcgagcgtattttgagcaagtctccttatgcctcaccaaccgatatgggtgttaacatggttggtttttctatcgtcaatgaagaagctgctatcgaagcttctaaacaagaaatcatccgtcgttattaccaaaccctcgtggatttcaaggcagagcgagtcacagaatctgctgtcaaaaaaattgagctcttgatgaatgatatcggtgtcacccctgacgatcgtcacgttactgtagctgctcatcaaaaagcagagcaaacaggccaacctgcccttgctctccaactaccaaatgggcagattgtgacaggtaaaacatctgaactctttggaccaactgcagctgttatcatcaatgcgattaaaaccttggcaaagattgataaaaccactcatttgattgaacccgaatacgtgaaacctattcaaggcctcaaagtgaaccacttaggcagtcacaatccgcggcttcattccaatgaaattctgattgcgttggccattactgctatgactagtgaagaagctaatctagccatgaaagaacttggcaatttgaaaggtagcgaagcccattctaccgttatcttaaccgaagaagataaaaatgtactccgaaaacttggggtaaatattacctttgaccctgtttaccaacatcacaaactttaccgtaaa

SEQ ID NO: 8006 - protein, 518 aa, Streptococcus pyogenes
MRYPCKKPFLSWNFFVIMLYRGEKMKTIAFDSNKYLNLQRDHILERISQFDGKLYMEFGGKMLEDYHAARVLPGYEPDNKIKLLKELKEQVEIVIAINANNIEHSKARGDLGISYDQEVFRLIDKFNTLDIYVGSVVITQYNNQPAADAFRKQLEKNGIASYLHYPIKGYPTDINHIISSEGMGKNNYIKTSRNLIVVTAPGPGSGKLATCMSQMYHDQINGVKSGYAKFETFPVWNLPLHHPVNLAYEAATADLDDVNMIDPFHLETYGKTAVNYNRDIEVFPVLNRTFERILSKSPYASPTDMGVNMVGFSIVNEEAAIEASKQEIIRRYYQTLVDFKAERVTESAVKKIELLMNDIGVTPDDRHVTVAAHQKAEQTGQPALALQLPNGQIVTGKTSELFGPTAAVIINAIKTLAKIDKTTHLIEPEYVKPIQGLKVNHLGSHNPRLHSNEILIALAITAMTSEEANLAMKELGNLKGSEAHSTVILTEEDKNVLRKLGVNITFDPVYQHHKLYRK

SEQ ID NO: 8007 - DNA, 510 bp, Streptococcus pyogenes
atggactggctgattggttatggggttaaagaaatgatcagtacaggaacctgtggcgttttggttcctatcgcagaaaaccgttttttagtgccagttaaggctttgcgagatgaaggaacaagttatcattacgtggcaccatctcgttatattgatattgatcctaagatgcttagactgattgagaaaacgcttttagcacaggggttagcttatcaagaggtcatcacctggtcaacagatggtttttaccgagaaaccaaagaaaaagtggctcatcgccaggaagaagggtgttcggttgttgagatggaatgttctgccttagcagcagtagctcaattaagaggcatcctttgggggcaactcttatttacagcagatactctagcagatgtagaggtttacgatcaacgcaactggggcgctgattcctttagttttgcgctccatttatgcttggaagtgctcaatacgctagaaaaggatggaaaggctactgatttt

SEQ ID NO: 8008 - protein, 170 aa, Streptococcus pyogenes
MDWLIGYGVKEMISTGTCGVLVPIAENRFLVPVKALRDEGTSYHYVAPSRYIDIDPKMLRLIEKTLLAQGLAYQEVITWSTDGFYRETKEKVAHRQEEGCSVVEMECSALAAVAQLRGILWGQLLFTADTLADVEVYDQRNWGADSFSFALHLCLEVLNTLEKDGKATDF

SEQ ID NO: 8009 - DNA, 807 bp, Streptococcus pyogenes
gtgaaacaaatcactcaacagaaatggttacgatacggtctttttattgctttagttttaaatggtattgaacttgaattgttaggactgactgctaacaacctttcctttaaagaagcttttgctctaatactaaccattagtctattaggcatttacttaattccatttgcagcagctattttttatttaagtaaaaaatttcatatgaacctgaacgttattattgttagctgtcttagcggactttatatttcaggttttttagcttcttgtgggaaccatctcgtaggacaattttggtcatacatcatcccttctaaagacgctttaaagctttggggagatgctttaactgcccctattgtcgaagagcccattaaggcttcttcggctattttagtaattactttatttcctagacttactcttaaagaaaaattagttgttgctttactttctggcatgggctttcaactaacagaagatatccgttatttgattcaagcaaaatctatagatagtctcgtaccgactgctattgaacgtattagcactgctgtgacttcacattgggtacatacagctatttttaccattggagcatacttattattaaagggttctaaccttttttcaaaacagcaacaaattttctggttattaagtcctctggttctacatttcatctggaactctcctctaacaagcattcctggcatgacagttttactaggaacattaatccttttaatctttggtgatctttttcaaaaaatcaacacccttgacgatgatgtgcttttt

SEQ ID NO: 8010 - protein, 269 aa, Streptococcus pyogenes
VKQITQQKWLRYGLFIALVLNGIELELLGLTANNLSFKEAFALILTISLLGIYLIPFAAAIFYLSKKFHMNLNVIIVSCLSGLYISGFLASCGNHLVGQFWSYIIPSKDALKLWGDALTAPIVEEPIKASSAILVITLFPRLTLKEKLVVALLSGMGFQLTEDIRYLIQAKSIDSLVPTAIERISTAVTSHWVHTAIFTIGAYLLLKGSNLFSKQQQIFWLLSPLVLHFIWNSPLTSIPGMTVLLGTLILLIFGDLFQKINTLDDDVLF

SEQ ID NO: 8011 - DNA, 261 bp, Streptococcus pyogenes
atgttattaatttggcttggattactatttgtttggaatgaactcgtgtttgtcatatatgcctttgataaaagaaaagccataaaaaagaaacggcgtattagtgaaagaaaattattagtgataacagttttgtttggaggttttggagcattacttgcagctaaaaagtaccaccataaaaccagaaagtggtactttgtcatcacttgttatactagtattttgttgacattactagtaacttatatctttatgaag

SEQ ID NO: 8012 - protein, 87 aa, Streptococcus pyogenes
MLLIWLGLLFVWNELVFVIYAFDKRKAIKKKRRISERKLLVITVLFGGFGALLAAKKYHHKTRKWYFVITCYTSILLTLLVTYIFMK

SEQ ID NO: 8013 - DNA, 123 bp, Streptococcus pyogenes
gtgagtggtttaggcagatcgcctaaagcgattgcccaagaagtaatagatgttttagcatcattagggcatatcgaggaattacgacacggagtaaggaaagtcgataatactttccttacg

SEQ ID NO: 8014 - protein, 41 aa, Streptococcus pyogenes
VSGLGRSPKAIAQEVIDVLASLGHIEELRHGVRKVDNTFLT

SEQ ID NO: 8015 - DNA, 291 bp, Streptococcus pyogenes
atgccaagaaaaacctttgataaagccttcaaactctctgctgtaaaactcatccttgaggaagagcagcctgtaaaaatggttagttcaactttagaaattcatcccaatagtctttatcaatggattcaagaatatgaaaaatatggagaaagtgcgttcccaggacatgggagcgcacttcgtcatgctcaatttaagacaaaaaaacttgaaaaagagcacaaactgctacaggaggaattagctcttctaaaaaagttccaggtctttttgaagccaaaccggaaa

SEQ ID NO: 8016 - protein, 97 aa, Streptococcus pyogenes
MPRKTFDKAFKLSAVKLILEEEQPVKMVSSTLEIHPNSLYQWIQEYEKYGESAFPGHGSALRHAQFKTKKLEKEHKLLQEELALLKKFQVFLKPNRK

SEQ ID NO: 8017 - DNA, 138 bp, Streptococcus pyogenes
ttgcttatgggcaagtatcctgactcttttcattttaagttatcatcttatcagggtaatctggtttggagtacccttgagttatctggttttgggctttacaggactagccttgctgttgaatactttttcttattt

SEQ ID NO: 8018 - protein, 46 aa, Streptococcus pyogenes
LLMGKYPDSFHFKLSSYQGNLVWSTLELSGFGLYRTSLAVEYFFLF

SEQ ID NO: 8019 - DNA, 105 bp, Streptococcus pyogenes
ttgactattatagtcatgatgagtccgacttttgctatgtttagtcatcttgttgttacaaaatcaggtaagcaaaaagattcaattcccactgtctccttaacc

SEQ ID NO: 8020 - protein, 35 aa, Streptococcus pyogenes
LTIIVMMSPTFAMFSHLVVTKSGKQKDSIPTVSLT

SEQ ID NO: 8021 - DNA, 225 bp, Streptococcus pyogenes
gtgttaagaaagaagaaaactaccattgtagggattattttaggaatgatgatagtgaccttacttgtcggctgtttgactggtaaaaagaaaggctttcctcctaaagcaggtgagcggcagcaaacggctgacttaaaaatgaaaaaaagattagaaaaactgttcaaaaaccgttacctgaaaaatctaaagaggctaagcaagctgttatggatgcagatt

SEQ ID NO: 8022 - protein, 75 aa, Streptococcus pyogenes
VLRKKKTTIVGIILGMMIVTLLVGCLTGKKKGFPPKAGERQQTADLKMKKRLEKLFKNRYLKNLKRLSKLLWMQI

SEQ ID NO: 8023 - DNA, 129 bp, Streptococcus pyogenes
atgtgtataagccaatcacctgagataactgtaaaaacaagaaaaaataacgatgagattttaacctatatgcttgaaaagtcaaaaaaacaagcaaaagcgctatcaagagtgacgacaagtaaaaga

SEQ ID NO: 8024 - protein, 43 aa, Streptococcus pyogenes
MCISQSPEITVKTRKNNDEILTYMLEKSKKQAKALSRVTTSKR

SEQ ID NO: 8025 - DNA, 117 bp, Streptococcus pyogenes
atgccattgatggttgttatgaataccatgctaaaatattctattgattatttatcagcaacaaggtatcgtttaaaaataccaaaagatacaggtgtcttgatagttattggtttt

SEQ ID NO: 8026 - protein, 39 aa, Streptococcus pyogenes
MPLMVVMNTMLKYSIDYLSATRYRLKIPKDTGVLIVIGF

SEQ ID NO: 8027 - DNA, 96 bp, Streptococcus pyogenes
ttgttaaagaatactaccttggtggtgaataacttaaaaaccagactttggtctggttttttggttctatatcctaagaagaaagaaaaccctgct

SEQ ID NO: 8028 - protein, 32 aa, Streptococcus pyogenes
LLKNTTLVVNNLKTRLWSGFLVLYPKKKENPA

SEQ ID NO: 8029 - DNA, 114 bp, Streptococcus pyogenes
gtggcgagcgaaaaccaattttaccatgagttaatatctccttttaatttaaaggttgctacctttttacaattcctattttacaaaaaatatagcaaaaaagctagtctattc

SEQ ID NO: 8030 - protein, 38 aa, Streptococcus pyogenes
VASENQFYHELISPFNLKVATFLQFLFYKKYSKKASLF

SEQ ID NO: 8031 - DNA, 114 bp, Streptococcus pyogenes
ttgctacctttttacaattcctattttacaaaaaatatagcaaaaaagctagtctattctgactttattgaaaatcataatgtgactatcatgaaaatttcaaatgttcgtcaa

SEQ ID NO: 8032 - protein, 38 aa, Streptococcus pyogenes
LLPFYNSYFTKNIAKKLVYSDFIENHNVTIMKISNVRQ

SEQ ID NO: 8033 - DNA, 171 bp, Streptococcus pyogenes
atgtttactattatgatcattggtttagctgtattttcaataattaaaatcattctatttttctatttttatcagcaatttgagcgcaagcaaaaaagaaaagttgaatcaaacaaccagcaaagacagtcccaagaaagtgacgctgtcccttcaaaaaaattcccattt

SEQ ID NO: 8034 - protein, 57 aa, Streptococcus pyogenes
MFTIMIIGLAVFSIIKIILFFYFYQQFERKQKRKVESNNQQRQSQESDAVPSKKFPF

SEQ ID NO: 8035 - DNA, 492 bp, Streptococcus pyogenes
ttgttgaggatgattgaatcgagtaatatgtatagtagattgaaaaaaaagggtgattttatgaaaaggtccaaaaaagcatcgttacttagtgttattgttggaatggctttagctgtgataccaatttatattgttaattatgacaatgaacttatcgttcttttaatgagtattttttttaatgggataattgtttccgcttttgaacttattaaaacatatgatggtttgcaggaagaatataaaaagctaactgtagatagatggaagaatactattttactggctttcaattcattatattttgcttctattttgacaaatagtctatcaaataatttatcaaccattttatcaactaatcgttctgacaaagtaagtgcaatatttcttacaggttgttctattttagcactacttccattcctccttcataggttaataaaacgagaaatagaaattgaaaatgaaagaaaaaaattaaaaaaa

SEQ ID NO: 8036 - protein, 164 aa, Streptococcus pyogenes
LLRMIESSNMYSRLKKKGDFMKRSKKASLLSVIVGMALAVIPIYIVNYDNELIVLLMSIFFNGIIVSAFELIKTYDGLQEEYKKLTVDRWKNTILLAFNSLYFASILTNSLSNNLSTILSTNRSDKVSAIFLTGCSILALLPFLLHRLIKREIEIENERKKLKK

SEQ ID NO: 8037 - DNA, 225 bp, Streptococcus pyogenes
atgatcaatttaaaattacgactacaaaacaaagtaaccttgatggctattttgggagctatctttttgttagcgcaacaattaggtattaaactaccatcaaacatcgcggatattgccaacacagctgtaacgcttttggtattgctcggtgttgtcacagatccaaccacaaaaggcctgtcagacagtgagcaagcattgacttaccacgaaccaaaacaa

SEQ ID NO: 8038 - protein, 75 aa, Streptococcus pyogenes
MINLKLRLQNKVTLMAILGAIFLLAQQLGIKLPSNIADIANTAVTLLVLLGVVTDPTTKGLSDSEQALTYHEPKQ

SEQ ID NO: 8039 - DNA, 273 bp, Streptococcus pyogenes
atggcaacagagttgatatttggcgtcggtggctttattttagctatcgtcacgacttacaatatttttaatgcaaaatccatcaagcatgcgacagatattactttgttgcaatctgaggtagagcatttaaaaattgttacacgccaaaatgctcggcggcttgaagagcacgctgagcaaaataaaacgttgattacaatgacagagcaaattaaaaatttaacagatgatgttaaagatttaaaagatatgatgagaggagaaatcaaa

SEQ ID NO: 8040 - protein, 91 aa, Streptococcus pyogenes; identical to SEQ ID NO: 7686

SEQ ID NO: 8041 - DNA, 615 bp, Streptococcus pyogenes
atgagaaattggaaagtgacaggaaaatacccacaatttgacagcacaggagcagtcgcaagcacacatattattatcactgctgaggatggctcagtcatctctcaaccaatcaagcaggacttaacctcaaataatgacacagagattatcaaagctactttggaagaatttaaaaaatctgaatacgttgaaattgcaatgggcgaagccgtgcaaaaggtagacgaccttgaaaaaatctcacaggaaaccgctaagactgccaaaactgctcaaacagctgctggactagctaaggtgtccgcagagcgtacacagcgaatgattaacttgcaaaccatccacatgttaacgagcggcggcaagattgatcctgacatttataaaggcatgcttgagctaatcgagccagccaaaaaaggtgagtatcaagcctatgatgtctttacggtggtcgacagtactaaagaggaagacggtgaagcaggcgaagggaacctagtctttgtacacgttaatgaagcatttgagtatgacaaacaaaccttagaggagctagagtcagaagccaaagtaacagttatcaagtacgctgatttggttaaacaagat

SEQ ID NO: 8042 - protein, 205 aa, Streptococcus pyogenes
MRNWKVTGKYPQFDSTGAVASTHIIITAEDGSVISQPIKQDLTSNNDTEIIKATLEEFKKSEYVEIAMGEAVQKVDDLEKISQETAKTAKTAQTAAGLAKVSAERTQRMINLQTIHMLTSGGKIDPDIYKGMLELIEPAKKGEYQAYDVFTVVDSTKEEDGEAGEGNLVFVHVNEAFEYDKQTLEELESEAKVTVIKYADLVKQD

SEQ ID NO: 8043 - DNA, 429 bp, Streptococcus pyogenes
atgcaattaactattaaaaacaaagatttaaacacactatatcgtgtactagacaaaatcaaagtcacgaacatgcgagcaaaccgcggacgtgctaagctactcgcaaaagtagtagataaattcaaagagtacgccaaggatgagggtgaccttattgatctgtatgctcaaaaagacaaagatggcaagtttgtcattgatgagcacaaaaacatcaagctagcagaccccgctaaactcgacgagttcaacggcctactcaacgagctagctgatgaagaaattgtgattaaagggggtgagtactccaagcgatttattgactttttaaactttttagaagagtgtgaagatgaatttacatcatctgaaatcattcttatcgacaacattttggaacaatttgaagaaagtaaaaaaggagaa

SEQ ID NO: 8044 - protein, 143 aa, Streptococcus pyogenes
MQLTIKNKDLNTLYRVLDKIKVTNMRANRGRAKLLAKVVDKFKEYAKDEGDLIDLYAQKDKDGKFVIDEHKNIKLADPAKLDEFNGLLNELADEEIVIKGGEYSKRFIDFLNFLEECEDEFTSSEIILIDNILEQFEESKKGE

SEQ ID NO: 8045 - DNA, 1110 bp, Streptococcus pyogenes
atggctgaaaatataccgctacgagtccaatttaagcggatgaaagccgccgagtgggcaagtagtgatgtcgtcttactggagggtgagattggctttgagactgacactggttttgctaagtttggcgatggtcaaaacacttttagtaagcttaagtaccttactggtcccaaaggtcctaaaggagacactggtctccaaggtaaaactggaggaactggttctcggggccctgctggcaagcctggaacgacagattatgatcaactccaaaataaaccagatctaggtgcgtttgcacaaaaagaagaaactaatagtaaaatcaccaaattagaatcaagcaaagcagataaaaacgctgtttacttaaaagcagagtcaaatgcaaagctagacgaaaaattaaatctcaaaggcggcgtcatgacaggacaactacagtttaaacctaatagtggtattaaaccctcatcttccgtaggaggagcgattaacattgatatgtctaaatcggaaggtgctgctatggtgatgtatacaaataaagatactactgatggaccattgatgattttacgctctaacaaagatacgtttgatcagtcagttcaatttgtcgattataagggaacaacaaatgccgttaatattgtgatgcgtcagccaaccacccccaatttttcatcggcacttaatataaccagtgctaacgaaggcggtagtgcgatgcaaattagaggcgtcgaaaaagcattgggaacgctcaaaatcacacacgaaaacccaagcgttgacaaagaatacgatgaaaacgctgcagcgttatctattgatatcgttaaaaaacagaaaggcggaaaaggtactgctgctcaaggaatctacattaactcaacatcaggcacagctggtaaaatgctcagaatcagaaataaaaataaagacaaattttatgtaggtccagatggtgacttttggtcatgtgcaagttcaattgtggatggtaatctaacagttaaagatccaacatctggaaaacatgctgcgactaaagattacgtagatgaaaaaattgctgagttaaaaaaactcatactaaaaaaa

SEQ ID NO: 8046 - protein, 370 aa, Streptococcus pyogenes
MAENIPLRVQFKRMKAAEWASSDVVLLEGEIGFETDTGFAKFGDGQNTFSKLKYLTGPKGPKGDTGLQGKTGGTGSRGPAGKPGTTDYDQLQNKPDLGAFAQKEETNSKITKLESSKADKNAVYLKAESNAKLDEKLNLKGGVMTGQLQFKPNSGIKPSSSVGGAINIDMSKSEGAAMVMYTNKDTTDGPLMILRSNKDTFDQSVQFVDYKGTTNAVNIVMRQPTTPNFSSALNITSANEGGSAMQIRGVEKALGTLKITHENPSVDKEYDENAAALSIDIVKKQKGGKGTAAQGIYINSTSGTAGKMLRIRNKNKDKFYVGPDGDFWSCASSIVDGNLTVKDPTSGKHAATKDYVDEKIAELKKLILKK

SEQ ID NO: 8047 - DNA, 333 bp, Streptococcus pyogenes
ttgattgaagtaattatcaaaaaatatttagacgagcacttagatgtgccgtctttttttgaacatcaaaaagatgaacctgcacgattcatcatcttagaaaagactagtggggctaagcaaaatcatttgctaagttccacgtttgcttttcaaagttatgccgaatcgttgtatgaggcggctttacttaatgacaaagtaaagcaagtaattgagcagcttgatgtcttgccacaagtttctggtgtacatcttaacgctgactacaattttacagatacagcaactaagcgctatcgttatcaagctgtatttgatattaatcattat

SEQ ID NO: 8048 - protein, 111 aa, Streptococcus pyogenes
LIEVIIKKYLDEHLDVPSFFEHQKDEPARFIILEKTSGAKQNHLLSSTFAFQSYAESLYEAALLNDKVKQVIEQLDVLPQVSGVHLNADYNFTDTATKRYRYQAVFDINHY

SEQ ID NO: 8049 - DNA, 198 bp, Streptococcus pyogenes
atgttatacgttaacagtaagactggagctagtttttatagctccgtccctgtttgtggtggagattggactttggttgaacagcagacaggcgaaaaagcaaaaacagtagcagaaattaaacgtcagttagatgctgctgggataaaatatagctctaaagctaagaaacctgaattagaggcactcttgcctggt

SEQ ID NO: 8050 - protein, 66 aa, Streptococcus pyogenes
MLYVNSKTGASFYSSVPVCGGDWTLVEQQTGEKAKTVAEIKRQLDAAGIKYSSKAKKPELEALLPG

SEQ ID NO: 8051 - DNA, 144 bp, Streptococcus pyogenes
gtgcattgcttgcgcactggatttgttacacaacgaagccaaaaagaaagcaaagaaccagctgttaaaaaacgacatccgaaagggtgtttttttactgctaaaaaatctaccgaactgccgggaaagcaggagaaaggacgt

SEQ ID NO: 8052 - protein, 48 aa, Streptococcus pyogenes
VHCLRTGFVTQRSQKESKEPAVKKRHPKGCFFTAKKSTELPGKQEKGR

SEQ ID NO: 8053 - DNA, 264 bp, Streptococcus pyogenes
atgaataagcgaatcaaaaagaaacgtaaactcgaacgggctattgtgatgctggttgcggaaaatgctatgcaagcagaagcaattaaaaatcaaaacaaagaaatcatggagctaaaatcaatcgttcaacgaaacgctctggcaacaaacgaagagtttgcgtctgttaaagctgctactttagataaccaatcagctattgcagatattgcaattgacgttaactatattaagaaaaattacaagcgaaaatggggaaaa

SEQ ID NO: 8054 - protein, 88 aa, Streptococcus pyogenes
MNKRIKKKRKLERAIVMLVAENAMQAEAIKNQNKEIMELKSIVQRNALATNEEFASVKAATLDNQSAIADIAIDVNYIKKNYKRKWGK

SEQ ID NO: 8055 - DNA, 258 bp, Streptococcus pyogenes
ttggtccagatccagaaaacgcaatatattaagcacctagagcaatctggtgcttttcttatgcccaaaaaggagaaaaatatgaataaaatatcattaaatgtcgaaatgacttgggaaaacaaagacgaatttcaacaaatcatgaataaagtcaatgaaacaaaagaagcttacgaaaaagccttagaagctgcggaaaattttgtccctaaaatgtcgtgtgcaacaaagttaaataaaggagaaggcgatgaa

SEQ ID NO: 8056 - protein, 86 aa, Streptococcus pyogenes
LVQIQKTQYIKHLEQSGAFLMPKKEKNMNKISLNVEMTWENKDEFQQIMNKVNETKEAYEKALEAAENFVPKMSCATKLNKGEGDE

SEQ ID NO: 8057 - DNA, 231 bp, Streptococcus pyogenes
gtgataaatatggaaccaaaattacatcggcaactgcgtcaaaaatatgacgacgctgaaaaacaatatcttgaaaagtttggagaagactcgcttgatagagtatttttttgggagccagacgtttactttgatgagtggaaaaaggttctaccagatgcaacactggaattaaacaaagctattaatagcggggtggcgattggtccagatccagaaaacgcaatatat

SEQ ID NO: 8058 - protein, 77 aa, Streptococcus pyogenes
VINMEPKLHRQLRQKYDDAEKQYLEKFGEDSLDRVFFWEPDVYFDEWKKVLPDATLELNKAINSGVAIGPDPENAIY

SEQ ID NO: 8059 - DNA, 108 bp, Streptococcus pyogenes
ttgctaaccaagcaagcaacgagccaaagacaattggcaacagaaaccttcctcaaagtcgagactggtcatcttttgcatttaaaaagtgattttaggcaaatatat

SEQ ID NO: 8060 - protein, 36 aa, Streptococcus pyogenes
LLTKQATSQRQLATETFLKVETGHLLHLKSDFRQIY

SEQ ID NO: 8061 - DNA, 417 bp, Streptococcus pyogenes
gtgagcaaagctaaggcaattttaaaagacttacgcaatttagatttatatatcgctagtttaatcagacgtcgagataagattgaggcttcgttgctttctagccctaaatggtcgtctgataaggtgaatggtggtataaaacgtaagcaagatgatgtttacgtagagttgattgcaactgccaaagatattgaaaagaagactgctgaagctataagaaaacaaagagagcttcaaaacctgattgatagccttgaaaatacagacagtcaaacgattttgagcatggtctatattgataagatgactagatggcaagtgattgatgagctaaattgcagcgaaagcacctatttcagactgttaagagttgcaactaaggaattaaataatttgacagtaaatgacagcgat

SEQ ID NO: 8062 - protein, 139 aa, Streptococcus pyogenes
VSKAKAILKDLRNLDLYIASLIRRRDKIEASLLSSPKWSSDKVNGGIKRKQDDVYVELIATAKDIEKKTAEAIRKQRELQNLIDSLENTDSQTILSMVYIDKMTRWQVIDELNCSESTYFRLLRVATKELNNLTVNDSD

SEQ ID NO: 8063 - DNA, 633 bp, Streptococcus pyogenes
atgattaagatcgatgagatacatcgcatactaggcatcgacgaagtttataaagcacccaaacgacttacggacatactctttgataaagatagtcgtgaggatatatttagacagtttttgaaatatgaaacagatgtatcttacgactggtttatgcaatattttgaggaagaacaagctgaccgcaaaaataaaaagcaagactttactcctaaatcggttagtacactattatctaaaataataagtggtaatcaatactacgaggtagcagtcgggacgggtgggatacttatccaagcatggcaagaacaacgattaaatgacagtccatttacttatcgtccgagtaaatactggtatcacgtagaagagttatcggacaaagcagtaccgtttctactctttaatatgtctataagagggataaatggtgtggtggtgcatggcgactctttaacaagacaagttaaaaacatttattttttgcaaaatacaaaagacgacatgctgagttttagtgatattaacgttatgccaaggactcaagatattgagcgagaatttaatgtcaaagagtggattggtgatgggatagaacacattgaaaatccactaattgaatggata

SEQ ID NO: 8064 - protein, 211 aa, Streptococcus pyogenes
MIKIDEIHRILGIDEVYKAPKRLTDILFDKDSREDIFRQFLKYETDVSYDWFMQYFEEEQADRKNKKQDFTPKSVSTLLSKIISGNQYYEVAVGTGGILIQAWQEQRLNDSPFTYRPSKYWYHVEELSDKAVPFLLFNMSIRGINGVVVHGDSLTRQVKNIYFLQNTKDDMLSFSDINVMPRTQDIEREFNVKEWIGDGIEHIENPLIEWI

SEQ ID NO: 8065 - DNA, 510 bp, Streptococcus pyogenes
atgagcaatctagttttatcgttagacatctcaacatctggaacagggtgggccttatttaaaggctcagatcttatccagagtggtgtcttaaaacataagagtaaatcctactttgagcgcggccgctatatggctagtcaattaaggctaatccagtcacgagcattaaaaaaatacgattgctattttagtacaatcgcagtcgaaaaaaactcggttatgggacctaaccagcaatccatgcttaaaatcggtattgttacaggaattatcttaggaagattaatagctgataacgtcgtgtttatcaatgtatcaacgtggcgtaagtattggaagtttagctacaaagaccgaagcaagaagtccatgaaattacagtcaaaaataaaagtggagcaagaatttaataaatcggtcaaagacgacgaagcagacgctattttgattggctcatactatgtcaatcaaggctatcttgatgaattggagacacatgactactac

SEQ ID NO: 8066 - protein, 170 aa, Streptococcus pyogenes
MSNLVLSLDISTSGTGWALFKGSDLIQSGVLKHKSKSYFERGRYMASQLRLIQSRALKKYDCYFSTIAVEKNSVMGPNQQSMLKIGIVTGIILGRLIADNVVFINVSTWRKYWKFSYKDRSKKSMKLQSKIKVEQEFNKSVKDDEADAILIGSYYVNQGYLDELETHDYY

SEQ ID NO: 8067 - DNA, 411 bp, Streptococcus pyogenes
ttgctacactcgtccttgccaatgctcacacacaattttagggcgagtgtggattttaaaaaggtgaaaaatatggaacaaatcaaaattacaggaacaggaacagcactaattttagatagagtaaaccgaatctttgccatctctggcagtttgactatgcaatgggattttattagtgattttaaaaagattgacgacgaaccgtcacttgatgaagatggagagttattcgaaacagcctacgacctcattcttgaagctaaacccaaaactaaaatcaatctaacatcatcatattttgctaaagagtataagaaagacgcagacgaaatcataaaagtattctcgtttatcgaagataacaagagaaatatctttgaaacccttggcattcgcggggtgcttgaa

SEQ ID NO: 8068 - protein, 137 aa, Streptococcus pyogenes
LLHSSLPMLTHNFRASVDFKKVKNMEQIKITGTGTALILDRVNRIFAISGSLTMQWDFISDFKKIDDEPSLDEDGELFETAYDLILEAKPKTKINLTSSYFAKEYKKDADEIIKVFSFIEDNKRNIFETLGIRGVLE

SEQ ID NO: 8069 - DNA, 795 bp, Streptococcus pyogenes
atgactagtttagatttactcggaaaggattattatagtcgtgaatcagctatcagatactggtctattagtcagtacaagcgttttagagagtgcgaagcgagggggcttgctgaattacaagggaattggacagataccagagataacactgcgctgctcgtcgggaactatgtccactcttactttgagagtaaagaagctcatgaagaattcaaagcccaaaacggctctgaaatgatttcgaccagaggaacaactaaaggtcagctcaaaaaagactatttagtcgcagaacagatgattgaagcacttaaaaatgacagtaacttcatggccatataccaaggagaaaaagaagcagcaatcacaggatttcttggcgaggttgaattcaagggtaaaatcgactgcttgaatgttgaacgtggctattttgtagacatcaaaacaacaaaagggccgattgacgacacaatctggaatagagaagagcgtgtcagatggtttgaagcttatggatatattttgcagatggctgcttacaaaaccatgctagaagctaaatacaataagccgtttgaaccgattatttacgcagttactaaagagacaccaccagatacaagagccatcaggatccaaaatgtagatgctatgcagatagagttagatagcctagcacaaagcattaagcgattagatgacgttaaaaaaggcatagaaaagcctaagccttgtggaaaatgcgaatattgcagacaaaataaattgtctgtaagggtagagattttt

SEQ ID NO: 8070 - protein, 265 aa, Streptococcus pyogenes
MTSLDLLGKDYYSRESAIRYWSISQYKRFRECEARGLAELQGNWTDTRDNTALLVGNYVHSYFESKEAHEEFKAQNGSEMISTRGTTKGQLKKDYLVAEQMIEALKNDSNFMAIYQGEKEAAITGFLGEVEFKGKIDCLNVERGYFVDIKTTKGPIDDTIWNREERVRWFEAYGYILQMAAYKTMLEAKYNKPFEPIIYAVTKETPPDTRAIRIQNVDAMQIELDSLAQSIKRLDDVKKGIEKPKPCGKCEYCRQNKLSVRVEIF

SEQ ID NO: 8071 - DNA, 198 bp, Streptococcus pyogenes
atgattaaacttgtaaaaatcgaaggatattatattaatccagaatatgttgttggcgtttgggaaagatctgctttaaattttgacaatttagatgaaaaagtagtggttgttcaattcgttggagatagggaaagagaagagtttgtcttttgcgatacacctattgatgaagtaattaagaggttgctagatgac

SEQ ID NO: 8072 - protein, 66 aa, Streptococcus pyogenes
MIKLVKIEGYYINPEYVVGVWERSALNFDNLDEKVVVVQFVGDREREEFVFCDTPIDEVIKRLLDD

SEQ ID NO: 8073 - DNA, 987 bp, Streptococcus pyogenes
atgacaaatcaattagcacaaaacaaccacaacagcttttttaaatcgccagcagtaaaaaacaggattgagcaggttgtcggcgcacgagccgaacaatttacaactagcttattatcaatcatcagcaataataaccttctagccaaagcaacatctgagtcaattatgggagcggctatgaaagcagcagtgcttaatttaccaatcgagcctagtcttggttttgcttacgtggtgccgtacaaccgaaattacaaggatggaaatcgttggatcacagtaaacgaagcgcaatttcaaatcggatatagaggacttatacagctagctcaaagaagtggacaagtccgaaatattgaacacggaatcatatacgaagaggaattccttggttatgacaagattagagggcagttgaagctaacgggcgactacgttgactctggtgttgtaaaaggctactttgcaagtttagaactaatcagcggcttttacaagatgattttctggccgaaagaaaaagtgtacgaacatgccaaaaagtattctaaaacttttgataagaaaacaggagattttaaaccaggaacgccttgggcgacagaatttgatccaatggctatcaagacattactcaaggaattactgagcaagtatgcccctctttctgttgaaatgcaggatgctctagaagcggataacgcagattcaacgattgtcattccaaaagatgtcacaccacaagaaacaaacagccttgatgacttaatcggcacgcagaacgaaaaaaaggacgctcctagcaatttaaaagatgtaattaaagatttacattcagaaccagaaaaaacgctcacagacgaaaataagacggttttagaagacacctcttatccagcagatgagattcctgattttgaccaagaaacaggggaaattaaagctagcgaaggcaacttatttgataacctcggagacttaata

SEQ ID NO: 8074 - protein, 329 aa, Streptococcus pyogenes
MTNQLAQNNHNSFFKSPAVKNRIEQVVGARAEQFTTSLLSIISNNNLLAKATSESIMGAAMKAAVLNLPIEPSLGFAYVVPYNRNYKDGNRWITVNEAQFQIGYRGLIQLAQRSGQVRNIEHGIIYEEEFLGYDKIRGQLKLTGDYVDSGVVKGYFASLELISGFYKMIFWPKEKVYEHAKKYSKTFDKKTGDFKPGTPWATEFDPMAIKTLLKELLSKYAPLSVEMQDALEADNADSTIVIPKDVTPQETNSLDDLIGTQNEKKDAPSNLKDVIKDLHSEPEKTLTDENKTVLEDTSYPADEIPDFDQETGEIKASEGNLFDNLGDLI

SEQ ID NO: 8075 - DNA, 330 bp, Streptococcus pyogenes
atgaacatcaaagaaaaaattgtagtgctaagaaacactgaagacggaagttttttaaagagtttcaaaaacaaaaaagatgtacttgcttataatgtggaacttacagatagcattcaactggcatcatttttaccagaagaagcttacaacatacaaaaagaaaaaattgataatttggcagaaacgcttgggtgtgatgttgtagttatcgaagcatcatatgacctaaaatttattgatggcgaggatgttccagagttaacaaaagagcaaaaagttaaaagtatggtaaacggaatgtttgacgaaattttaagaggtagtatc

SEQ ID NO: 8076 - protein, 110 aa, Streptococcus pyogenes
MNIKEKIVVLRNTEDGSFLKSFKNKKDVLAYNVELTDSIQLASFLPEEAYNIQKEKIDNLAETLGCDVVVIEASYDLKFIDGEDVPELTKEQKVKSMVNGMFDEILRGSI

SEQ ID NO: 8077 - DNA, 204 bp, Streptococcus pyogenes
atgacaccagaacaagtagaaaaagcaaaaatcagagctaaacaagaacttgaaacgtttagcatataccttgatcaggcaattgatgatctcggtggagttctaacttcacgagaagtctttttagcagcgggaataacatatcttggcgcaggtcagacagatatacatgctgcagtcgagggattatgtgagcaaatccaa

SEQ ID NO: 8078 - protein, 68 aa, Streptococcus pyogenes
MTPEQVEKAKIRAKQELETFSIYLDQAIDDLGGVLTSREVFLAAGITYLGAGQTDIHAAVEGLCEQIQ

SEQ ID NO: 8079 - DNA, 183 bp, Streptococcus pyogenes
atgaacaaattagaattatttttgttagcaacaaccgttatcttagcggtcattgctagggtgcaacacgaagtcattaaaaaacacaattcgccagagaataagcggaaaatttttagggaagtagctttaaaaaacagcaaaggatggagcaagaagcgtgcaagaggaggggttgtcagc

SEQ ID NO: 8080 - protein, 61 aa, Streptococcus pyogenes
MNKLELFLLATTVILAVIARVQHEVIKKHNSPENKRKIFREVALKNSKGWSKKRARGGVVS

SEQ ID NO: 8081 - DNA, 309 bp, Streptococcus pyogenes
atgccaaaagcagaaattacttatagagcagttgatgttaatgaaacagcttctcatggtgattataaacacttgattcaacaatgggaggggttgacagttgctactgcaaagcagtgggcgacagaaatgcgtgatcatccagactttaaacagtttgtattaaatccaacgcatagaatcgtattcattgattacaaaggattcaaactgtttgtacagtggaaatctcgcaatcgttacaaaacaaaaaaagagacactgccagaaatgcttgaaaatattaaatttgaaaaaagagtaggagta

SEQ ID NO: 8082 - protein, 103 aa, Streptococcus pyogenes
MPKAEITYRAVDVNETASHGDYKHLIQQWEGLTVATAKQWATEMRDHPDFKQFVLNPTHRIVFIDYKGFKLFVQWKSRNRYKTKKETLPEMLENIKFEKRVGV

SEQ ID NO: 8083 - DNA, 516 bp, Streptococcus pyogenes
atggcaaaagtcatattccaagataactttctcttaatgggaacaaattatcatgaaaaagaagctaataaagttatggctgaaattggtaagaaatcaccatactgggataaggataaagattttatttctgactacataaaatcaaacttcaaggatatctacaagtattacagggtctcaacaaaagatgtagagattgtcagagaacctcttaatcgtcacgatccaaatgccataaaagtcatggtaaacaaaacttttgttggctactttccagcagacttagctaaacgattaaccccttatgtaaaaaaatctagtcattaccaaatggaagcaacccttactggtcgtggtggacaatacaaaacactcaaaaacgatttaaagaccgtggttactaaaaagaaagatataacttataagttacgattgactattttaaaagtagatagagtatcaaaaagtaaaaatgctggattattagagtcgatagcatcttggtttctcaac

SEQ ID NO: 8084 - protein, 172 aa, Streptococcus pyogenes
MAKVIFQDNFLLMGTNYHEKEANKVMAEIGKKSPYWDKDKDFISDYIKSNFKDIYKYYRVSTKDVEIVREPLNRHDPNAIKVMVNKTFVGYFPADLAKRLTPYVKKSSHYQMEATLTGRGGQYKTLKNDLKTVVTKKKDITYKLRLTILKVDRVSKSKNAGLLESIASWFLN

SEQ ID NO: 8085 - DNA, 297 bp, Streptococcus pyogenes
atgggcttttatatatgcaattatttaacagcgtctttaagagctttaccagctttgaaggctggaacttttgaagctgcaatttcaatttctgcaccagtttgtgggttacgacctttacgagctgcacgttcgcgtacttcgaagttaccaaaaccgatcaattgtactttttcaccttcagcaaggaaagcttcgattgtagaaaacacggcatcaactgctgctgctgaatcttttttagtcaattcagttgcttctgcaacctttgcgattaaatcttgtttgttagccatt

SEQ ID NO: 8086 - protein, 99 aa, Streptococcus pyogenes
MGFYICNYLTASLRALPALKAGTFEAAISISAPVCGLRPLRAARSRTSKLPKPINCTFSPSARKASIVENTASTAAAESFLVNSVASATFAIKSCLLAI

SEQ ID NO: 8087 - DNA, 939 bp, Streptococcus pyogenes
atgactagtaaaaaagcgtgtttatcaagcatcattgtgttagcaagtttaacgtgtggaaatgatactgttagtgccaatcatctctcagcaactggagataagtttgatgattgctcaacacttgttgaaaaagatgtggcccctaaagatgaacttgagatgttagcatggtcctcgtctcaaacaactgatgatgctgacagagactatgaagattttctcgatgatgattcttttatttctcaaaatgaaactgataagatgtttgagaatttaactgatgataggttattaaatgaattagatgaattagatgaagaaaatgaagaagatgaagaagatacaattgagccagagcaaaatgtaataatgcctagtgacgatgagctatttgatttaactgatgctgttgagacacgccttactgtttctagtgctccccatttagaggctgaattgccgaaaccacatttgaggagcctatcagatacagcactgcggtctggtgaaattagaggacatttagataacaaactggacgctttgtctgtaacagctacaaagttagcattaacgatggctcaaaaatttgatttgacaacgcatgtctattctataggtgaaagctttagtgaagtattagctgctcattatgaagacagaaaagcagaatcagctttttctaagaaaaagagatttcaccttcctattgctactccagatgttgttatagaggagttaaggcgcctagtctcttctattggaagttcaaaagaagatgtttcagttccttatagtcggaagctaggtatggcagttgcaaaaagaaaaatagccctgccacaaacgggagagaggttctcttattatccagttttacttggtttaatgatattaggattaacgccgattatgataccaaagaagataaataat

SEQ ID NO: 8088 - protein, 313 aa, Streptococcus pyogenes
MTSKKACLSSIIVLASLTCGNDTVSANHLSATGDKFDDCSTLVEKDVAPKDELEMLAWSSSQTTDDADRDYEDFLDDDSFISQNETDKMFENLTDDRLLNELDELDEENEEDEEDTIEPEQNVIMPSDDELFDLTDAVETRLTVSSAPHLEAELPKPHLRSLSDTALRSGEIRGHLDNKLDALSVTATKLALTMAQKFDLTTHVYSIGESFSEVLAAHYEDRKAESAFSKKKRFHLPIATPDVVIEELRRLVSSIGSSKEDVSVPYSRKLGMAVAKRKIALPQTGERFSYYPVLLGLMILGLTPIMIPKKINN

SEQ ID NO: 8089 - DNA, 96 bp, Streptococcus pyogenes
ttgactttatttagattatttgatactattcagttgtctcccttagagaaagcgatttcttgttttggagctgatttttaccatttggtcttagaa

SEQ ID NO: 8090 - protein, 32 aa, Streptococcus pyogenes
LTLFRLFDTIQLSPLEKAISCFGADFYHLVLE

SEQ ID NO: 8091 - DNA, 1440 bp, Streptococcus pyogenes
ttgcattatttgcatagaagaaagggatctgttatggtttcagtgatgtggtttcgtagagatttaaggattgatgatcaaaaagctttagctcatgctattgctagtcaatcaccaaccttatgtgtgtttcaatttaacaaggagcaattaaatctgctacatagtcggaatcaatctagttttattactagcgttttggcttttagaaagttattaaaatgtgaaggtattgacttatatctaatgtatggagacttaatgacctgttttgagcaattattgacacaattaaaagactggacagatgtgtattttaactatgatgaatctggatatggtcgtttacgtgatcaaaaagcagcacaatttttcaaaaaaaatgggattgctgttcatacctaccaagatcactatttacatggtagtcaagagatcattaaccaatcaggtcagccttataaagtttttacgccctactataggatttggcaaaattatccgaaagagactcctattaaagtagaactatcgcaaggcaggtggttaaatcttgagacaccagatgatgttttaaggactgttgagagttttaaagatgaaaaatatcaggatgttgcaacttttgatgaagcgtcaaaacaactaaatcgatttattcaagaccaattagcagcttatcacgctaatcgagattttccagcgcagctagggacgagtcggttgtctccttttttaagaataggagctattggcattcgcacggtatatcacgctgtgcgtcaagcaccaaatagtctagggcaagctacttttttaaaagaattagcttggagagacttttacaatatggtctatgtggcttatcctgatcagaaaactcagcctatccaaaaagccttttctcaaatcgaatgggttaataatcctgactggtttcagttgtggaaagaaggtaaaacgggttaccctattgtcgatgctgcaatgcttcagttacaaaagacaggatggatgcataatcgtttacgaatgatagtagcttcttttttaactaaagatcttttatgtgattggcgtttaggagagcagtattttcaacaacaactaattgattatgatgctgccagtaatatcggaggatggcagtgggctgcttccactggaacagatgctgttccttattttagaatatttaatcctgttactcaaggtaagcgctttgatcctaaaggcgagtttattaaagcgtatttgcctcaactagaacacgttccagagaagtatctccacgaaccgtggaagatgccaaaaaaccttcaagagagtgtgtcctgtattattggcacagactatcctcaaccaattgtcgatcatgctaaacaacgtgaacaagctattgcaaagtatgagtgggcaaaagaaaaagcaaaaatagaa

SEQ ID NO: 8092 - protein, 480 aa, Streptococcus pyogenes
LHYLHRRKGSVMVSVMWFRRDLRIDDQKALAHAIASQSPTLCVFQFNKEQLNLLHSRNQSSFITSVLAFRKLLKCEGIDLYLMYGDLMTCFEQLLTQLKDWTDVYFNYDESGYGRLRDQKAAQFFKKNGIAVHTYQDHYLHGSQEIINQSGQPYKVFTPYYRIWQNYPKETPIKVELSQGRWLNLETPDDVLRTVESFKDEKYQDVATFDEASKQLNRFIQDQLAAYHANRDFPAQLGTSRLSPFLRIGAIGIRTVYHAVRQAPNSLGQATFLKELAWRDFYNMVYVAYPDQKTQPIQKAFSQIEWVNNPDWFQLWKEGKTGYPIVDAAMLQLQKTGWMHNRLRMIVASFLTKDLLCDWRLGEQYFQQQLIDYDAASNIGGWQWAASTGTDAVPYFRIFNPVTQGKRFDPKGEFIKAYLPQLEHVPEKYLHEPWKMPKNLQESVSCIIGTDYPQPIVDHAKQREQAIAKYEWAKEKAKIE

SEQ ID NO: 8093 - DNA, 228 bp, Streptococcus pyogenes
atggaatcacatttggtgagaatcatcaatcgtttggagttgatggtgacagatggcggtaatctcaagcgaaattttgaacgcgatggtgttgttgttgcagaagttgccttttcaaatgatcctgaaaatggacctgttttcacattgcgtgatgttgaagcgcgtgagtcatattcctttgatagcattgacttgattgcaatggaaatctacgatttattatat

SEQ ID NO: 8094 - protein, 76 aa, Streptococcus pyogenes
MESHLVRIINRLELMVTDGGNLKRNFERDGVVVAEVAFSNDPENGPVFTLRDVEARESYSFDSIDLIAMEIYDLLY

SEQ ID NO: 8095 - DNA, 252 bp, Streptococcus pyogenes
atgatattaatactatctattcttcttcgtctgatcaaagtttacacttatttattgattgcttacgcattaatgtcatggtttcctggggcatatgattcaaaaattgggcgtttgattagtggtatcgttgaaccaattttaaaaccttttagagcatttaatttacaatttgccggtcttgacttcactatttttgtcgtcattattagtttgaattttttagctcaagttttggtccgtgtgtttatt

SEQ ID NO: 8096 - protein, 84 aa, Streptococcus pyogenes
MILILSILLRLIKVYTYLLIAYALMSWFPGAYDSKIGRLISGIVEPILKPFRAFNLQFAGLDFTIFVVIISLNFLAQVLVRVFI

SEQ ID NO: 8097 - DNA, 111 bp, Streptococcus pyogenes
ttggctgagactgctgataatagcgttcagaagtgccatgttttggatgcatttgtgaccttgtctgttcttgggatctcgcttgatgatcttgttgtacgtgattgtttc

SEQ ID NO: 8098 - protein, 37 aa, Streptococcus pyogenes
LAETADNSVQKCHVLDAFVTLSVLGISLDDLVVRDCF

SEQ ID NO: 8099 - DNA, 117 bp, Streptococcus pyogenes
atgtccaaaccagtaaaaaagccatttctagccattcacttgacctcacttactttccaaacttttgctattctaaaaactgctaaaaaacagaatcattcagaaaatattatacca

SEQ ID NO: 8100 - protein, 39 aa, Streptococcus pyogenes
MSKPVKKPFLAIHLTSLTFQTFAILKTAKKQNHSENIIP

SEQ ID NO: 8101 - DNA, 249 bp, Streptococcus pyogenes
atgttttaccttattatggctgtctcgattatatcttattatctatacatggctcctaaaagtgtccgtaacacccttgggatgattggtttagttggcttggttgctctgcttattgttttagcgggcttgagttttatcaaaatcatgcaaacccctcctgaattttttattgggatgggaatggtggcattgggctattttgctttaaaagatgtgcgtaaaatgaccaaaaaaccgagagttaaa

SEQ ID NO: 8102 - protein, 83 aa, Streptococcus pyogenes
MFYLIMAVSIISYYLYMAPKSVRNTLGMIGLVGLVALLIVLAGLSFIKIMQTPPEFFIGMGMVALGYFALKDVRKMTKKPRVK

SEQ ID NO: 8103 - DNA, 525 bp, Streptococcus pyogenes
atgacaaacacactcgttgaaaatatttatgcttcagtaactcacaatatttctaaaaaagaagcatcaaaaaatgaaaaaactaaagctgttttaaaccaagctgtcgctgacttatctgtggctgcatctattgtgcaccaagtacactggtatatgcgtggtccaggtttcttgtaccttcaccccaaaatggatgaattacttgatagcttgaatgctaatttagatgaaatgagcgagcgtttgatcactattggcggagcgccttattctaccctagctgagttttctaaacactctaaattggacgaagcaaaaggtacttacgataaaaccgttgctcagcatttagcaagattggtcgaagtttacctttacctcagcagcctttaccaagttggtttggatattaccgatgaagaaggcgatgctggaacaaacgatttgtttacagcagctaagacagaggctgaaaaaaccatttggatgctccaagcagagcgtggacaaggcccagcactc

SEQ ID NO: 8104 - protein, 175 aa, Streptococcus pyogenes
MTNTLVENIYASVTHNISKKEASKNEKTKAVLNQAVADLSVAASIVHQVHWYMRGPGFLYLHPKMDELLDSLNANLDEMSERLITIGGAPYSTLAEFSKHSKLDEAKGTYDKTVAQHLARLVEVYLYLSSLYQVGLDITDEEGDAGTNDLFTAAKTEAEKTIWMLQAERGQGPAL

SEQ ID NO: 8105 - DNA, 624 bp, Streptococcus pyogenes
atgatagctttttttagtatatgttcgggcatcttattgacccatcttttttactgtttactactttattttcctgataatggtcaagagcagctaagtaaacagactgtcattgtttgtgaccaactaacttttgccaaacgcgtttttcggcagttccaaaaccattttataactagccaaaaaatcttctttagcttagagataggtctaataattatcttatgggctagtatggtacattgggttagtgctagttactgttacttgttactcttttctttattatttagtttatttgattggcgttctcaagaatacccttttatcttgtggctttttagctttgtaagtctactcctgttttattcgatcaattatttatcattgatattactgctactaggtttattagctcatttaagacctttttcaattggagcaggcgattttttctaccttgctagcttagctttagtattggatctaacgtcgttgatttggctaattcaacttgctagtttagcaggtattactgcttgcttactattaggcatcaagcgcataccttttattccttatcttagttttggattattttggattgtgcttctagagcatttt

SEQ ID NO: 8106 - protein, 208 aa, Streptococcus pyogenes
MIAFFSICSGILLTHLFYCLLLYFPDNGQEQLSKQTVIVCDQLTFAKRVFRQFQNHFITSQKIFFSLEIGLIIILWASMVHWVSASYCYLLLFSLLFSLFDWRSQEYPFILWLFSFVSLLLFYSINYLSLILLLLGLLAHLRPFSIGAGDFFYLASLALVLDLTSLIWLIQLASLAGITACLLLGIKRIPFIPYLSFGLFWIVLLEHF

SEQ ID NO: 8107 - DNA, 96 bp, Streptococcus pyogenes
atggactttagtgggagtggcgtcactggatcagttgcaccgggtgcagcgccaaattttttggtccttttcttggaacagggcttctaccctgtc

SEQ ID NO: 8108 - protein, 32 aa, Streptococcus pyogenes
MDFSGSGVTGSVAPGAAPNFLVLFLEQGFYPV

SEQ ID NO: 8109 - DNA, 1032 bp, Streptococcus pyogenes
atgaagcgttatcccctactggtccagttgatttcgtatgtttttgtgatcgtaattgccctcattaccacgcttggtttgctttattaccagacgagttctcgtaatatcaggcaactaattgaacgtgatacccggcagagcattcggcaaagttcccaatttattgacgcttacatcaagcctcttaaagaaacaacttcggtgctggcgaaaaatacggaaattcaagcctttgctagtcaaattcatcaagaaaatgacaaacaggttcttcagctcatgaagatggttcttgcgaccaattccgatttacaagcagctgttctggtgactaaggatggtcgaacggtgtctaccaattctcagttgaccatgaaaacctccagtgacatgatggcagaaccctggtataaagcagccatagaccgtcaagccatgccaatcttaaccccagctcggcaattatccctttcttctaaaaaagaatgggtagtttctgtgacccaagaggtagtagatagggctgggcataatttaggtgtgctaagacttgatattgcatacccgaccattaaagcgtctttagatcagcttcagctaggccgccaaggctttgcctttattgtgaatgataagcatgaatttgtttaccatcccaaaaagagtgtttacagttcttctaaggagatggctgcgatgaaaccttatttagcgattcagaatggttacactaaggacaagacatcttttgtttaccaaaaactcattcctaacagtcaatggactttagtgggagtggcgtcactggatcagttgcaccgggtgcagcgccaaattttttggtccttttcttggaacagggcttctaccctgtctgatttgtggctttgcaactgtcttagtcttacgcagatggattcgtcccattcaacaattgcagcaagttattcttgctattcaaaaaggagatcgtcagttacgtgcccaagaaacgggttctccagaattgacagaccttgcccaacagtt

SEQ ID NO: 8110 - protein, 344 aa, Streptococcus pyogenes
MKRYPLLVQLISYVFVIVIALITTLGLLYYQTSSRNIRQLIERDTRQSIRQSSQFIDAYIKPLKETTSVLAKNTEIQAFASQIHQENDKQVLQLMKMVLATNSDLQAAVLVTKDGRTVSTNSQLTMKTSSDMMAEPWYKAAIDRQAMPILTPARQLSLSSKKEWVVSVTQEVVDRAGHNLGVLRLDIAYPTIKASLDQLQLGRQGFAFIVNDKHEFVYHPKKSVYSSSKEMAAMKPYLAIQNGYTKDKTSFVYQKLIPNSQWTLVGVASLDQLHRVQRQIFWSFSWNRASTLSDLWLCNCLSLTQMDSSHSTIAASYSCYSKRRSSVTCPRNGFSRIDRPCPTV

SEQ ID NO: 8111 - DNA, 621 bp, Streptococcus pyogenes
atgaaaaaaggactattagtaacaactggtttggcttgtctcgggctactaactgcttgctcaacccaagacaatatggctaaaaaggaaataactcaggacaagatgagcatggcagctaaaaagaaagataagatgtcaacatcaaaggacaagtccatgatggcagataaatcatctgataagaaaatgaccaatgatggtcctatggcgcctgatttcgaactcaaaggcatcgatggtaagacctatcgcttatcagagttcaaaggtaaaaaagtttatttgaaattttgggcctcttggtgttcaatctgtctatcaaccttggcagataccgaagacctggctaaaatgtcagataaagactatgtggtcctaacagttgtctcgccaggtcatcaaggggaaaaatcagaagcagactttaaaaaatggttccaaggaacagactataaggacttaccagtcttgttagatccggatggcaagctattggaagcttacggtgtcagatcttacccaacagaagttttcattggaagtgatggtgttcttgctaaaaaacacattggttatgccaaaaaatcagacatcaaaaagacccttaaaggtatacat

SEQ ID NO: 8112 - protein, 207 aa, Streptococcus pyogenes
MKKGLLVTTGLACLGLLTACSTQDNMAKKEITQDKMSMAAKKKDKMSTSKDKSMMADKSSDKKMTNDGPMAPDFELKGIDGKTYRLSEFKGKKVYLKFWASWCSICLSTLADTEDLAKMSDKDYVVLTVVSPGHQGEKSEADFKKWFQGTDYKDLPVLLDPDGKLLEAYGVRSYPTEVFIGSDGVLAKKHIGYAKKSDIKKTLKGIH

SEQ ID NO: 8113 - DNA, 708 bp, Streptococcus pyogenes
atgacactatcacttgtattaatggtatcggtttttggggcaggcttgttatcctttttctctccgtgtatctttccggtccttcctgtctatttaggcattttactggatgcagatgattcaaagacgattactatatttggtaaaaaactctattggtatggcattgtcaaaactttagcctttatttttggtctatctactatttttgtgattttaggttacggggctggttttttaggaaatatcctttatgcggtatggtttcggtacttactgggagccttggtcattatcttggggattcatcagatgggcctcattaccattaagagcttacaatttcaaaaatcactgactttccataataacaagaatcgcaacggtttgttcaatgcatttatccttggtttaacctttagctttggttggacgccttgtgtgggacctgttttgagttctgtcctagcattggtggcttcagggggaaatggtgcctggcaaggtggcgttttgatgattatttatactcttggattgggcattcctttcctactcatctcttttgcgtcaggcattgttttgaaacagtttaacaagctcaaaccccacatacttttactgaaaaaagtaggaggcgttctgattatagtcatgggaatcttgcttatgacaggaaccttaaataacttagcacaactttttgga

SEQ ID NO: 8114 - protein, 236 aa, Streptococcus pyogenes
MTLSLVLMVSVFGAGLLSFFSPCIFPVLPVYLGILLDADDSKTITIFGKKLYWYGIVKTLAFIFGLSTIFVILGYGAGFLGNILYAVWFRYLLGALVIILGIHQMGLITIKSLQFQKSLTFHNNKNRNGLFNAFILGLTFSFGWTPCVGPVLSSVLALVASGGNGAWQGGVLMIIYTLGLGIPFLLISFASGIVLKQFNKLKPHILLLKKVGGVLIIVMGILLMTGTLNNLAQLFG

SEQ ID NO: 8115 - DNA, 159 bp, Streptococcus pyogenes
gtgagacctgatgtaattggtgattttcgtgatatgctttttatttcaatccactcacccatgaagggtgagactgcgccaaatgacacagtttatagagaaacggatggcacacatagaggtgttttaagcctttttatctccatttcgcttcttttt

SEQ ID NO: 8116 - protein, 53 aa, Streptococcus pyogenes
VRPDVIGDFRDMLFISIHSPMKGETAPNDTVYRETDGTHRGVLSLFISISLLF

SEQ ID NO: 8117 - DNA, 291 bp, Streptococcus pyogenes
atgatggttttagtcacttatgatgtaaatacggaaacacctgctggtagaaaaagattgcgtcatgttgccaaactctgtgtggactatgggcaacgtgttcaaaattctgtttttgaatgttctgtgacacccgcagaatttgtggatataaagcaccgcttaacacaaatcattgatgagaaaactgatagtattcgcttttatttattggggaaaaattggcagaggcgtgtggaaacacttggtcgctcagacagctatgacccagataaaggtgtcttattattg

SEQ ID NO: 8118 - protein, 97 aa, Streptococcus pyogenes
MMVLVTYDVNTETPAGRKRLRHVAKLCVDYGQRVQNSVFECSVTPAEFVDIKHRLTQIIDEKTDSIRFYLLGKNWQRRVETLGRSDSYDPDKGVLLL

SEQ ID NO: 8119 - DNA, 1023 bp, Streptococcus pyogenes
atgaagaagttgctaaataccttgtatttgacgcaagaagatttttatgtcactaaagagggcgataacattgttatcaagcaagaaggtaaggttctcaaacggtttccgtttcggattattgacggtattgtctgtttttcttatttgggtgtgtcgtctgctttggtgaagttatgtacggagaatcagattaatttatcgtttcatacaccacaagggcgtttttgtggtcgctatattggttcaaccaatgggaatgtgttgttgcgtagagaacattatcgtttatctgatcgtgaggaatctttggaatacgcaaagcggtttattttggctaaaatttccaactcaaggaaatacttgctacgctttaaacgagatcatcgtcaacagattgataccaagctttttgaggctgttaatgacgaattgatatgggctttagagatggttcaggcagcagataataaagactctttaagagggattgaaggccaagctgctaatcagtattttcgcatatttaatgacctggtgttgacggacaaaaaaacgttttacttccaaggtcggagtaaacgaccacccttagattgtgttaatgccctcttgtcttttggttacagtttactgacctttgaatgtcaatctgccttggaagctgtcggattagacagttacgttggtttctttcacacggatcgtcctgggcgtgctagtttagcgcttgatttagttgaagagttccgctcatatattgtagatcgttttgtcttttcattaattaataaaggacaacttcagaaaaaacactttgaggttaaagaaaatggtagtattttattgacggaaaatggcagagctatttttattgatttgtggcagaagcgtaagcatactgaggtagaacatccttttacaaaagagaaagtaaaacttatgttattaccctatgtacaagcgcagcttttagctaaggctatacgaggagatttagaaagctatccaccttttatggtt

SEQ ID NO: 8120 - protein, 341 aa, Streptococcus pyogenes
MKKLLNTLYLTQEDFYVTKEGDNIVIKQEGKVLKRFPFRIIDGIVCFSYLGVSSALVKLCTENQINLSFHTPQGRFCGRYIGSTNGNVLLRREHYRLSDREESLEYAKRFILAKISNSRKYLLRFKRDHRQQIDTKLFEAVNDELIWALEMVQAADNKDSLRGIEGQAANQYFRIFNDLVLTDKKTFYFQGRSKRPPLDCVNALLSFGYSLLTFECQSALEAVGLDSYVGFFHTDRPGRASLALDLVEEFRSYIVDRFVFSLINKGQLQKKHFEVKENGSILLTENGRAIFIDLWQKRKHTEVEHPFTKEKVKLMLLPYVQAQLLAKAIRGDLESYPPFMV

SEQ ID NO: 8121 - DNA, 672 bp, Streptococcus pyogenes
atggtctatgccgaagatgattatttaatgctgtcaggtattcagcatttccaattttgtaaacgtcaatgggcgttgatccatattgagcaacaatggcttgataatgaagcgacagcgcatggacaggttttacatactaaagcagataacccttacattaaagaaaaacgaaaagagcttttggtctcacgtgctatgcccatttcttctgcagaacttggactttcaggaattatggatgttgtggaattttataaagatgatcaaggtgtgtctttgaggggaaaacgtgggaaatggttaccaaaagttgtggaatacaagcgcggaaaacctaaaaaagataccagagatattgtccagttggtggctcagaccatgtgtttagaagaaacgctagactgcgacattaacgaaggttgtctttattaccatagtgtcaatcaaagagtgattgttcctatgacatcagctttgcgtcaagaagtgaaggaattagccgcagagatgcatgaggtttatcagagtcaaatgctacctaaagcagcttattttaaaaactgtcagctttgttctttagtcgatatttgtaagcccaggttgagtaaaaaaacaaggagtgtgtcgcgttacatcaatgaggctatgaccagtgaggagatggaccta

SEQ ID NO: 8122 - protein, 224 aa, Streptococcus pyogenes
MVYAEDDYLMLSGIQHFQFCKRQWALIHIEQQWLDNEATAHGQVLHTKADNPYIKEKRKELLVSRAMPISSAELGLSGIMDVVEFYKDDQGVSLRGKRGKWLPKVVEYKRGKPKKDTRDIVQLVAQTMCLEETLDCDINEGCLYYHSVNQRVIVPMTSALRQEVKELAAEMHEVYQSQMLPKAAYFKNCQLCSLVDICKPRLSKKTRSVSRYINEAMTSEEMDL

SEQ ID NO: 8123 - DNA, 861 bp, Streptococcus pyogenes
gtgaggagtaaaaagatgttggaacacaaaattgattttatggtaactcttgaagtgaaagaagcaaatgcaaatggtgatcccttaaatggaaacatgcctcgtacagatgccaaaggatatggtgtgatgagtgatgtctccattaaacgtaagattcgtaatcgtttgcaagatatggggaagtctatttttgtgcaagctaatgagcgtattgaagatgattttcgttcactggaaaaacgcttttcgcaacattttacagctaagacacctgacaaagaaattgaagaaaaagcaaatgcattatggtttgatgttcgtgcttttggacaagtttttacttatctgaaaaaatcaattggggtgcgtggaccagtttccatcagtatggctaagtccttggagccaattgtcatttccagccttcaaattacgcgtagtaccaatggtatggaagctaagaataatagtggccgctcttctgatacgatggggacaaaacattttgtagattatggtgtgtatgtacttaaaggttctatcaatgcttattttgctgaaaagactggtttttctcaggaagatgctgaggctattaaagaagttttggttagcttgtttgaaaatgatgcgtcgtctgcacgtccggaaggctctatgcgagtttgtgaagtcttttggtttacgcattcaagcaaattgggaaatgtttcaagtgcgcgtgtctttgacttgttagagtatcatcaatcaatagaagaaaaaagcacttatgacgcttatcagattcatctaaatcaagaaaaattggctaaatatgaagcgaaagggttaacgcttgaaatcctagaaggactc

SEQ ID NO: 8124 - protein, 287 aa, Streptococcus pyogenes
VRSKKMLEHKIDFMVTLEVKEANANGDPLNGNMPRTDAKGYGVMSDVSIKRKIRNRLQDMGKSIFVQANERIEDDFRSLEKRFSQHFTAKTPDKEIEEKANALWFDVRAFGQVFTYLKKSIGVRGPVSISMAKSLEPIVISSLQITRSTNGMEAKNNSGRSSDTMGTKHFVDYGVYVLKGSINAYFAEKTGFSQEDAEAIKEVLVSLFENDASSARPEGSMRVCEVFWFTHSSKLGNVSSARVFDLLEYHQSIEEKSTYDAYQIHLNQEKLAKYEAKGLTLEILEGL

SEQ ID NO: 8125 - DNA, 1893 bp, Streptococcus pyogenes
atggatttttttacttctctcttgaagacttatgaaaaagcagagctagcagacttggttgatcatcaaaaaagaaataatgagccggttttactgccgatttatcatacgagtttaaagtcaaatggtaaaaatatcatttcagtgaaacttgacaaagatggccagtttcacaaggcagaatttatggcagataagcaaatgattatttttcctgtaacggctgattctgttgctaggtcaggtagtcatcctgcaccgcatcccctagtcgataaatttgcttattatagtgctgaaatggggcagattcagtatgattcttttcataagcaactgaataactggattgattattgtgaggagggtgatgtcaagaaatttttaacctttgttcagcagttcattttgaagccagaatttctaacattgattcttgattctttaattggtcctgattatcaacataatcaattaaaagtcacattttgtgatgccactggaaaagaaaaattaattgatttatcagcttgctttttagaattttcaattgatcagttccagggctttaaaaatgaatcggtttcgacatttaaagccttacaccaatcctatatttcttttgttgaagccaatcgtgaaaatctcggtatttgtaatattagtggacgagaggaacagcttaccgataagcatagaggtttgatggggaatgctaaaatcatctctgttagtaataaaagagaagcttataaaggacgttttagagaacgcgaagacgtttttagtgttggctatgaaacttccgaaaagattcatttaatgctcaagtaccttttagaaaataaaaataccagtacttggttagggtcttctcaatatttaatcaactggttcagcgatgatttaacaaatgatagtcggttggatattgtatcaccaatctttgatgatggacttgaagaagatgatgatgacgatacgcctcctgttataacattagcaactgaagacaataaaagaattggtaaatcattcatcaagggacaaaaattatttgctaatgatgccacttactacgttgctattttgaataaaaccagcaatgggcggattgctttaaaatattttcgtcagcttcaagcgtcccaattactcaccaatcttaacaagtggcaggaaacatacagttgggagtcgcgatctaagtttgggaaaagtcgcttaagaacccctacttttcatgacatccttaatgtgtcctacggggttgatagggatcgcttccttgaattagataatgataacttcaaaagtgatcaaattcaaaagttagtggcaagtttgattgatggtaaaccgatgccacagtccattgtcaaaaagttaggtaacaatgttaaagaacgacatcgttaccgtaagcactggtatcaagttgagcaggtctgcttagcaattttacacaaacaaaatggggaggaattttcaccgatgctagatcataccaatcaaaatcgttcctatctttttggacgattattagcaatttttgaattaatcgagaccttgcgttatggcttggatggaaacaataacgaccgtattaccaatgctgaacgttattggacagcctatactggacaaccaacaaaattgatgatgttattggaaaataaaattaagccttacgaagaaccattgaaattaaatcgtcgtggcagttggatgaaattagaaaaagaaaaagaagagattttagaactgttaaatcctctgttagaaacagaaacaatggaaaaacccttagattaccgctttatttttgggtattatgctgagaaaaactattactatacaaaacaaaacacggaagtaacagaaagtgaggag

SEQ ID NO: 8126 - protein, 631 aa, Streptococcus pyogenes
MDFFTSLLKTYEKAELADLVDHQKRNNEPVLLPIYHTSLKSNGKNIISVKLDKDGQFHKAEFMADKQMIIFPVTADSVARSGSHPAPHPLVDKFAYYSAEMGQIQYDSFHKQLNNWIDYCEEGDVKKFLTFVQQFILKPEFLTLILDSLIGPDYQHNQLKVTFCDATGKEKLIDLSACFLEFSIDQFQGFKNESVSTFKALHQSYISFVEANRENLGICNISGREEQLTDKHRGLMGNAKIISVSNKREAYKGRFREREDVFSVGYETSEKIHLMLKYLLENKNTSTWLGSSQYLINWFSDDLTNDSRLDIVSPIFDDGLEEDDDDDTPPVITLATEDNKRIGKSFIKGQKLFANDATYYVAILNKTSNGRIALKYFRQLQASQLLTNLNKWQETYSWESRSKFGKSRLRTPTFHDILNVSYGVDRDRFLELDNDNFKSDQIQKLVASLIDGKPMPQSIVKKLGNNVKERHRYRKHWYQVEQVCLAILHKQNGEEFSPMLDHTNQNRSYLFGRLLAIFELIETLRYGLDGNNNDRITNAERYWTAYTGQPTKLMMLLENKIKPYEEPLKLNRRGSWMKLEKEKEEILELLNPLLETETMEKPLDYRFIFGYYAEKNYYYTKQNTEVTESEE

SEQ ID NO: 8127 - DNA, 726 bp, Streptococcus pyogenes
ttgtacagatctagagacttctacgtgagagtaagtggtcagcgagctctttttacaaatccagccacaaaagggggatcggaacgctcatcctattcggttccgactagacaggcactgaatggtatcgttgatgccatctattataagccgacctttactaatatcgtcacagaggttaaggttattaaccagattcaaaccgaattacagggtgtcagggctctgttacatgattatagtgcagatttaagttatgtatcctatttgagtgatgttgtttatctgatcaagtttcattttgtttggaatgaagatagaaaagatttgaactcagatagacttccagctaaacatgaagccattatggagcgttctattcgtaaagggggacgtcgagatgtgtttttgggtacaagagaatgtttagggcttgtagatgatatcagccaagaagagtatgagactactgtgtcgtattataatggtgtcaatatcgacttgggaatcatgttccattcctttgcctatccgaaggacaaaaagacaccattaaaatcatactttacaaagactgtgatgaaaaatggagtcattacgtttaaagcacagtctgaatgcgatattgttaacacgctttctagttatgcttttaaagcaccagaggagataaaatcggttaacgatgaatgcatggagtatgatgccatggagaaaggagaaaac

SEQ ID NO: 8128 - protein, 242 aa, Streptococcus pyogenes
LYRSRDFYVRVSGQRALFTNPATKGGSERSSYSVPTRQALNGIVDAIYYKPTFTNIVTEVKVINQIQTELQGVRALLHDYSADLSYVSYLSDVVYLIKFHFVWNEDRKDLNSDRLPAKHEAIMERSIRKGGRRDVFLGTRECLGLVDDISQEEYETTVSYYNGVNIDLGIMFHSFAYPKDKKTPLKSYFTKTVMKNGVITFKAQSECDIVNTLSSYAFKAPEEIKSVNDECMEYDAMEKGEN

SEQ ID NO: 8129 - DNA, 2406 bp, Streptococcus pyogenes
atgagaatgattttagcacactatgactgtaaaaaagataaaaagcaatctttagatgagcatttatggcatgtggcctgttctagtcgacaggaagcatctataattggtcaaggagatgtgctttttttaattggtctttaccacgacctgggcaaagctgatcgaacctttcaagataaattattaaataatccaaatcggcatgttgatcactcttatgcaggggcaaaatacttatgttctattattgggcctcatctaaaaaaccgaggggttgataaaaatgagagaatgacattcaacgaaatggtggggtatgtcatctctgctcatcatgggatgtatgatttatgctactattttgacgatgctgaatattatggctttaataagtttaaaaatcgtatcaatagagacttagatggttatcactatcatgaagatattaaagggtacgctctaaaattagaaaaaaaattatgtgattatggctacaaagatttaagggagcttattgataaagcttttgataattaccaacaagccatgtcttccttaaactggcaagataagagtgagtgggattattatcagtcttgtatggtgagactttacttgtcactcttaaaaaacgctgatattttggacacagtaaatgcctatggccttaagataagtcctatggataaaacagagcgatcctttctaaaacactcctatttagcggccattgaacaaaaatatgctagctttggacagccaaacaatcagttgaacactattcggacagaaatcgctgagcgtgttaaagaaagaggtaaacgagattccaaggggatttatcgcttagatttaccgacaggagctggcaagactaatcttagtatgcgttatgcgtttcaccaattagttcatcacgacaaatcaaggtttttttacataactccctttctttcggttcttgagcaaaatgcttccgaaattagaaaagttacaggtgaccttggcgttctagaacaccattccaatgtggtgaaacaggctaatgaagatgatgatgataaggacagtttattgtcagcttatcttagtgatagctgggacagtcaagtagtcttgacttctatggttcaatttttccaaacacttttcaaaacaaaatcagctaatctgagacgtttttcaagtttgattaatagtgttgtgattctagatgaagttcaatccctgcctattgaagtcaccactttgtttaatttaacgatgaattttttaaataaagttatggatacaaccatcgttctttgcacagcgacacaacctgcttatgattcttcagagattgaccatcgtatctgttatggagggaacttgggagaattagctgaaatagttgagttaacgattgaagaaaaacagattttttcaaggacagagcttagaaaatttgatgatagtgatcagaaagttcacttgactgatgttattaaccttattctaggtgaggaaaactcagttcttgctatttttaatacgaaaaaaacggttcataactgctatactatgctaaaagacatgactgatagaccggtctatcagctttcgacaaatatgtgtgcgcagcatagacttgacttgattgctaagatcaaaacggagttacaaaataatatccctattatttgtattagcacgcaattaattgaagcaggtgtagatgttgattttcatcgcgtcattcgttcctactcagggattgattctattgttcaggctgctggacggtgtaaccgagaaggcaaacgagataaagggcaagtcactcttgtcaatctgaccaatgaagaggaaaatatttctaggctgacagaaataaaaactaaaaaagaagccacagaatctattcttcataagattgggtctccaattgatatctcaactttaaaccgtgacttttttgagtattattatgccaataatcagggactgatggattatcctttggaagacaacctatcaatctacgactatttaagccttaatatttatcagacggcaaataaaaagttcaaaggtaagttaaaacaagcttttaaaacagcaggagccaaaatgaacctcatcaataatgatatgataggaattctcgtaccttatggcgaagctgagaaaaaattggcttatttagaagaattaggtgtgtcacattttttatcagcaaaagattatcaaacgataaaatcattactaaaagagttacaaccttttacggttaatgtccgcgagaacgatcctctctttgagacaacaaaatcttatctaaatggtcagattctggttttgacgtcggagtattatgacacggaaagaggagttaaatacgattcagctagcttttacttc

SEQ ID NO: 8130 - protein, 802 aa, Streptococcus pyogenes
MRMILAHYDCKKDKKQSLDEHLWHVACSSRQEASIIGQGDVLFLIGLYHDLGKADRTFQDKLLNNPNRHVDHSYAGAKYLCSIIGPHLKNRGVDKNERMTFNEMVGYVISAHHGMYDLCYYFDDAEYYGFNKFKNRINRDLDGYHYHEDIKGYALKLEKKLCDYGYKDLRELIDKAFDNYQQAMSSLNWQDKSEWDYYQSCMVRLYLSLLKNADILDTVNAYGLKISPMDKTERSFLKHSYLAAIEQKYASFGQPNNQLNTIRTEIAERVKERGKRDSKGIYRLDLPTGAGKTNLSMRYAFHQLVHHDKSRFFYITPFLSVLEQNASEIRKVTGDLGVLEHHSNVVKQANEDDDDKDSLLSAYLSDSWDSQVVLTSMVQFFQTLFKTKSANLRRFSSLINSVVILDEVQSLPIEVTTLFNLTMNFLNKVMDTTIVLCTATQPAYDSSEIDHRICYGGNLGELAEIVELTIEEKQIFSRTELRKFDDSDQKVHLTDVINLILGEENSVLAIFNTKKTVHNCYTMLKDMTDRPVYQLSTNMCAQHRLDLIAKIKTELQNNIPIICISTQLIEAGVDVDFHRVIRSYSGIDSIVQAAGRCNREGKRDKGQVTLVNLTNEEENISRLTEIKTKKEATESILHKIGSPIDISTLNRDFFEYYYANNQGLMDYPLEDNLSIYDYLSLNIYQTANKKFKGKLKQAFKTAGAKMNLINNDMIGILVPYGEAEKKLAYLEELGVSHFLSAKDYQTIKSLLKELQPFTVNVRENDPLFETTKSYLNGQILVLTSEYYDTERGVKYDSASFYF

SEQ ID NO: 8131 - DNA, 120 bp, Streptococcus pyogenes
atgcttggcttcctctttctgaaattatctttaccattataccataaggcaggcctcttgtgccatgttattaataactggtaccctcattttgatgataaacaattaaggaaatatttt

SEQ ID NO: 8132 - protein, 40 aa, Streptococcus pyogenes
MLGFLFLKLSLPLYHKAGLLCHVINNWYPHFDDKQLRKYF

SEQ ID NO: 8133 - DNA, 90 bp, Streptococcus pyogenes
gtgaattctaaaataaaccaagctaaagggcttaatctggagatgagaaagccaagctttaaaattcgtattgtcatcgctttgaatacg

SEQ ID NO: 8134 - protein, 30 aa, Streptococcus pyogenes
VNSKINQAKGLNLEMRKPSFKIRIVIALNT

SEQ ID NO: 8135 - DNA, 156 bp, Streptococcus pyogenes
ttgtcaactgtattgggtggcctatggaaaagcaaaagagaaggtgacgctcatcttctctttttacgtattcaaagcgatgacaatacgaattttaaagcttggctttctcatctccagattaagccctttagcttggtttattttagaattcac

SEQ ID NO: 8136 - protein, 52 aa, Streptococcus pyogenes
LSTVLGGLWKSKREGDAHLLFLRIQSDDNTNFKAWLSHLQIKPFSLVYFRIH

SEQ ID NO: 8137 - DNA, 336 bp, Streptococcus pyogenes
atgtcttatatcaataatattgagcacgcgaaggttcttgatttgacgcaagaagtaatgattgagcaagatcaaatgttaagtagaacactagtccaaaggcaagacctaggaataacagttttttccttagataagggccaagaaattgggcgacactcatcaccaggagatgccatggttactatcttaagtggcttagcagaaatcaccattgatcaagagacctaccgggttgctgaaggtcaaaccattgtgatgccagctgggattcctcatgccttatatgcagtagaagcctttcaaatgcttttagtagtagtaaaaccggaggct

SEQ ID NO: 8138 - protein, 112 aa, Streptococcus pyogenes
MSYINNIEHAKVLDLTQEVMIEQDQMLSRTLVQRQDLGITVFSLDKGQEIGRHSSPGDAMVTILSGLAEITIDQETYRVAEGQTIVMPAGIPHALYAVEAFQMLLVVVKPEA

SEQ ID NO: 8139 - DNA, 108 bp, Streptococcus pyogenes
ttgaacttttccttttataagagcttcttttctaaaaaaacggtaggttatctggcagacctcaaaggaactatgacttgtatcacgttagggataaggctcttcaaa

SEQ ID NO: 8140 - protein, 36 aa, Streptococcus pyogenes
LNFSFYKSFFSKKTVGYLADLKGTMTCITLGIRLFK

SEQ ID NO: 8141 - DNA, 105 bp, Streptococcus pyogenes
ttgtatcacgttagggataaggctcttcaaataagctttttgctcttaaaaacagctctcgcaaaaagaattttagcagcccatgatgactgctccatctcttat

SEQ ID NO: 8142 - protein, 35 aa, Streptococcus pyogenes
LYHVRDKALQISFLLLKTALAKRILAAHDDCSISY

SEQ ID NO: 8143 - DNA, 99 bp, Streptococcus pyogenes
gtggaaaaaacggatcatcaaataagtggaagttataaagggagaaaaattaatgtcaataatgttactactcttagtaaagcggtttccaaaagccta

SEQ ID NO: 8144 - protein, 33 aa, Streptococcus pyogenes
VEKTDHQISGSYKGRKINVNNVTTLSKAVSKSL

SEQ ID NO: 8145 - DNA, 330 bp, Streptococcus pyogenes
atgcacatgggtgcttggaatactggtaacaataaaatcctttacactcaagaatctgttactgacgacatgattgctaaacgtgaccaatcaatcaaggatgctaaagaatctccaatccttggtttcactgttgacacaaaagttatcaaaacggaattgtcaaatatttcaaatgtcatgaaccgatataaagcaagtatcaatactggtacagtggatcctgacgaagcccttccaaaacttcttgcagacctcaaaggtgctggttgggacaaggtgcaaaaagaagttcaaaaacaattggacgactttgtagctaaagacaag

SEQ ID NO: 8146 - protein, 110 aa, Streptococcus pyogenes
MHMGAWNTGNNKILYTQESVTDDMIAKRDQSIKDAKESPILGFTVDTKVIKTELSNISNVMNRYKASINTGTVDPDEALPKLLADLKGAGWDKVQKEVQKQLDDFVAKDK

SEQ ID NO: 8147 - DNA, 1140 bp, Streptococcus pyogenes
atgaaaaaatggcaaaaaatcgtgtgtgtgactggaactgtgcttgcaacgtctaatttagcagcctgcgaaagcaagtcagcatcaaaagatagtgatgtcaaattattgatgtaccaagttggtgacaaacctgataacttcgatgaattgatgacaattgctaacaagcgcatcaaagaaaaaacaggtgcaacggttgaccttcaatacatcggttggggggactgggatgataaaatgagtaccatcattgcctctggtgaaaactacgacattgcttttgccaataattatgtggtcaatgcacaaaaaggtgcttttgctgatttgacaacgttaatgccaaaatacgctaagaaaacgtataaaaacttagacccagcctatattaaaggaaatactattgacggtaaactctatgccttcccagtagatgccaacgtttatgcccaacagatgctttctttcaataaagaactagtggacaaatatggccttgacatttcaaacattaagtcctatgcagatgctgaaaatgtcttgaaacaattccacgaaaaagaaccaaatacagcagcttttgctattggtcaagtctttagtatgtcaggtgactatgactacccattaaccaaaacccaaccctttgctgtgaaaattgatgaaggcaagccaaccatcattaatcagtatgaagatgagtcctttaaaaacaatctccgcttgatgcacaaatggtataaagaaggtttgattccaacagatgcagcgaccaatacagaaggttatccccttgaaggaaacacttggtttatgcgtgaagaaacccaaggtcctatggactatggcgatactatcttgaccaatgctgcaggaaaagacatcgtgtctcgtccattgactaaaccgctaaaaaccacatcacaagcacaaatggcaaactttgtggtatcaagcgtatctaaaaacaaagaaaaagcagttgaagtcctttctcttcttaatagcgatcccgaattgttaaatgggcttgtttatggtgtcgaaggcaaagcttgggaaaaaattggcgacaagaaaatcaaactgctcgatggctatcaacctaaaaatgcacatgggtgcttggaatactgg

SEQ ID NO: 8148 - protein, 380 aa, Streptococcus pyogenes
MKKWQKIVCVTGTVLATSNLAACESKSASKDSDVKLLMYQVGDKPDNFDELMTIANKRIKEKTGATVDLQYIGWGDWDDKMSTIIASGENYDIAFANNYVVNAQKGAFADLTTLMPKYAKKTYKNLDPAYIKGNTIDGKLYAFPVDANVYAQQMLSFNKELVDKYGLDISNIKSYADAENVLKQFHEKEPNTAAFAIGQVFSMSGDYDYPLTKTQPFAVKIDEGKPTIINQYEDESFKNNLRLMHKWYKEGLIPTDAATNTEGYPLEGNTWFMREETQGPMDYGDTILTNAAGKDIVSRPLTKPLKTTSQAQMANFVVSSVSKNKEKAVEVLSLLNSDPELLNGLVYGVEGKAWEKIGDKKIKLLDGYQPKNAHGCLEYW

SEQ ID NO: 8149 - DNA, 120 bp, Streptococcus pyogenes
atgcctggtccctttgttgatgtcattgttgctgacgcttctgttaaaggaattggtcatcagttaatgctcgagctattagaagctatgctagttatcgccaataagcaaagcctcact

SEQ ID NO: 8150 - protein, 40 aa, Streptococcus pyogenes
MPGPFVDVIVADASVKGIGHQLMLELLEAMLVIANKQSLT

SEQ ID NO: 8151 - DNA, 1653 bp, Streptococcus pyogenes
atgacaagaggagactatcttgtctttgacacgccattgacttgccgatttattggccgttttttccgctttgaaaatcaaaaagccctgctggcagaattggcaacgtcaaagtattttcagtggattgaagaaggccaagcagaggtgacgatgaaacacttttttaaccgtcagctggctaaggatgcctttaccctgaagatttcagaagataaggaaatcattattgaaagccaaaaccttagaggttttcgttacgcccaagaagctttgcttaaagtcatgaccttcaaaggggataaactttatttgcccattgtttctgtcaagcacagcccttcttttgctatgcgggggataattgaaggcttttacggaacaccgtggacacgagaagagcggttagattgcctgcgttttattggaaataaaaggatgaatacttacatgtatgctcctaaagatgatgattaccaacgaaaactgtggcgcgatctttatcctgaggattgggtgacttatttcaaagagctacttgcagtagccaaggaagaagggcttgatttttggtatatgattagtccggggcttgattttgattataccaaggaagctgactatcagttgctctatcaaaaattgcaacaacttctagcgttaggtgtttgtcattttgggcttttgctggatgatattgactaccaaattgtagatgctgttgagagacgattcaaaaagactgcctatgcccaggcccacttggcaactgaggttcatcactttttaaaccaacaacatgcggcgccagaattggtgatctgtccgacagaatacgacaaccaccatgattctatctatttgcaagagctgtcagaaaggattcctaaagaagtcgcctttttctggacaggcccaagcacgctagcgagtcaaatctcgcaagcagatattgaaactatggcagcagtatatcaacggcctatcattatttgggacaatattcctgttaatgattatcaaaaagatccagaacgtctctttttaaccccttttgccaatcgctcgccatttttatgccagccagactatcaggtcaaggggattgtttctaaccctatgattagttgggaattatctaagcttaccttgacagatatgagccattatctgtgggatgctaaccgttatcagcctagtcattcttggctagaaaccttaacagactatacagaagatactgaattagccttagctttacaggcatttgcttggcataatggcaatcgtcatctgcacagggaccttccttttgaagtggaagaagctctcctggctaaggatgtatcaacgttatcagcttgggtagctgaattggtcgaacgtgtcaatacgttgagaaagctagataagccagcgtttcaacaagctattgctccttggtttgaacgggtggccaaagaccaagatttttggcaggctatgttaaatcaggagcctcagttggaaacactctatgctgacttacaagaagataaacaccgtattggaagtgacattccaagtcgttactatcgcatctactatcaacagcaagataaactaacagctaatcaaggtcaagttacccaagcaagaccggaagactatgct

SEQ ID NO: 8152 - protein, 551 aa, Streptococcus pyogenes
MTRGDYLVFDTPLTCRFIGRFFRFENQKALLAELATSKYFQWIEEGQAEVTMKHFFNRQLAKDAFTLKISEDKEIIIESQNLRGFRYAQEALLKVMTFKGDKLYLPIVSVKHSPSFAMRGIIEGFYGTPWTREERLDCLRFIGNKRMNTYMYAPKDDDYQRKLWRDLYPEDWVTYFKELLAVAKEEGLDFWYMISPGLDFDYTKEADYQLLYQKLQQLLALGVCHFGLLLDDIDYQIVDAVERRFKKTAYAQAHLATEVHHFLNQQHAAPELVICPTEYDNHHDSIYLQELSERIPKEVAFFWTGPSTLASQISQADIETMAAVYQRPIIIWDNIPVNDYQKDPERLFLTPFANRSPFLCQPDYQVKGIVSNPMISWELSKLTLTDMSHYLWDANRYQPSHSWLETLTDYTEDTELALALQAFAWHNGNRHLHRDLPFEVEEALLAKDVSTLSAWVAELVERVNTLRKLDKPAFQQAIAPWFERVAKDQDFWQAMLNQEPQLETLYADLQEDKHRIGSDIPSRYYRIYYQQQDKLTANQGQVTQARPEDYA

SEQ ID NO: 8153 - DNA, 99 bp, Streptococcus pyogenes
atgagctggttagctcaggtaaaggagaccagaaatgaccatttatcacgccttaaaggattatcaagaagtcatgacaagaggagactatcttgtctt

SEQ ID NO: 8154 - protein, 33 aa, Streptococcus pyogenes
MSWLAQVKETRNDHLSRLKGLSRSHDKRRLSCL

SEQ ID NO: 8155 - DNA, 1311 bp, Streptococcus pyogenes
atgatatatcattttggaggatatgacatgacacgaccaatcccaactagcgtcagccaatttatggccaaggtggaaagcctttgtggagaccaacaccctgattgggctcttaatttcaaaaccagctttaccaataccttagagacaaccctaaaaacctacgaagatggcactagctttcttttaactggcgatattcctgccatgtggttacgtgattccactgcgcaaatgaaaccttacctcttcctcgccaaggaagatgaagaaattagaaagattattgccggtctggtcaaacgccaattccgctacatttgtatcgatccctatgccaatgccttcaacgaagaagctaacgaaaaaggacaccaaacagatcatacccaaatgaacccttggatttgggaacgcaaatatgagattgattgcctttgctaccctattcaactggcttatctgctctatcgtgaaacaggaagcaccgatcagtttaatgacgattttcatcgtggggtagaactcattcttgacctatggacagttgagcaagaccacgcccagtccccttacttgtttgaacgcgatacttggcgcaaagaagataccctaacacatgctggaaaaggaagtcctgtcgcaccaacagggatgacctggtcaggctttagaccaagtgatgatgcttgtcaatatggttacctcattccttcaaatatgtttgcagtggttgtgctttcctatctagaagatttatataacaacctttttcacaatgaaccagtagctactcgtgccaagcagctgaaagaagctattcaatcgggtattgcagaccatgcccttgttcaaaacagcaagggagaaaccatttacgcttatgaagtggatggtctgggacagttttccatcatggatgatgctaatattccaagcctccttgctgcaccttaccttggtttttgcactaaagatgaccctatctatctggcaacgcgccgcaccattctcagccaagaaaacccttattattatcagggaaatgcagcagcaggcatcggttcttcccatacaccagaaaattatatctggcatatcgcccttgccttacaaggattgaccgctcttgaccaagacagtaaaaaagagatgcttgatttgcttgtggcaacagatgctggtacccacttaatgcacgagggtttcgatgtcaatgatccttatcaatacactcgtgagtggttctcttgggctaacatgatgttctgtgaactacttcttgactatctgggctttagtattgctcct

SEQ ID NO: 8156 - protein, 437 aa, Streptococcus pyogenes
MIYHFGGYDMTRPIPTSVSQFMAKVESLCGDQHPDWALNFKTSFTNTLETTLKTYEDGTSFLLTGDIPAMWLRDSTAQMKPYLFLAKEDEEIRKIIAGLVKRQFRYICIDPYANAFNEEANEKGHQTDHTQMNPWIWERKYEIDCLCYPIQLAYLLYRETGSTDQFNDDFHRGVELILDLWTVEQDHAQSPYLFERDTWRKEDTLTHAGKGSPVAPTGMTWSGFRPSDDACQYGYLIPSNMFAVVVLSYLEDLYNNLFHNEPVATRAKQLKEAIQSGIADHALVQNSKGETIYAYEVDGLGQFSIMDDANIPSLLAAPYLGFCTKDDPIYLATRRTILSQENPYYYQGNAAAGIGSSHTPENYIWHIALALQGLTALDQDSKKEMLDLLVATDAGTHLMHEGFDVNDPYQYTREWFSWANMMFCELLLDYLGFSIAP

SEQ ID NO: 8157 - DNA, 2703 bp, Streptococcus pyogenes
atggcaactaaaaaagtacatattatttcacacagtcactgggatcgcgagtggtacatggcttacgaacaacaccacatgcgtctgattaacttaatagatgacctgttagaagtttttcaaacggatcctgattttcatagttttcatttggatgggcaaaccattatcctagatgattatttaaaagtacgccccgaacgagaacctgagattagacaagccattgcttcgggaaaactccgtatcggacctttctatatcttacaggacgattttttgaccagcagtgaatccaatgtgcgcaatatgctgattggtaaggaagattgtgacagatggggcgctagtgtgccacttggttattttcctgatacctttggaaatatgggacaaacaccacagctgatgttaaaagccggcctacaagctgctgcctttggtcgtggcattcgtccaactggatttaacaatcaggtggataccagtgaaaaatacagctcccaattctctgaaatcagttggcaaggcccagataacagtcgtattcttggactcctcttcgccaactggtacagcaatggcaatgagatcccgacaacagaagctgaggcgcgtcttttttgggataaaaaacttgctgatgccgaacgcttcgcctcaaccaagcaccttctgatgatgaacgggtgtgatcatcaacccgtacaacttgatgtcaccaaggcaatcgccttagccaaccaactctatcctgactacgaatttgtgcattcctgctttgaagattacttggctgatctcgcagatgatttaccagagaacctttcaaccgtccaaggagagattaccagtcaagaaaccgatggctggtataccctagctaacacggcttctgctcgtatttacctcaaacaggctaataccagagtctctcgccaactcgaaaacatcaccgaacccttagcagcaatggcttatgaggtaacaagtacctaccctcacgaccaactgcgttacgcttggaaaaccctcatgcaaaatcaccctcatgattctatctgtggttgtagtgttgatagcgttcatcgggaaatgatgacgcgctttgaaaaagcctatgaagtcggacactatttagcaaaagaagctgctaagcaaattgctgacgccattgataccagggattttccaatggatagccaacccttcgtcttatttaataccagcggccattccaaaacaagtgttgctgagctcagcctgacctggaaaaaatatcattttggccaacgctttcctaaagaggtttaccaagaagctcaagaatatttggcaagactctcccaatctttccaaattattgacactagtggacaagtgagacccgaagcagaaattttaggcacaagcatcgcttttgactacgatttgcccaagagatccttccgcgaaccttatttcgccatcaaagtgagattacggctaccaataactctcccagccatgtcttggaaaaccttagcattaaagctaggaaatgaaacaactccttcagaaaccgtttccctctacgatgacagtaatcagtgccttgaaaatgggtttctaaaagttatgatacaaaccgatggtcgtctaaccatcaccgataaacaatctggactaatctatcaagacctgttgcggtttgaagattgtggcgatattggaaatgaatatatttctcgccagccaaatcatgaccaacctttctatgcggatcaagggaccatcaagcttaacatcattagcaacaccgctcaagttgctgaacttgaaatccagcaaacctttgccattcctatctccgcagataagctcttacaggctgagatggaggctgtcattgacatcacagaacgccaagcaagacgttcacaagaaaaggctgagctaaccttaacaacccttatccgcatggagaaaaataatcctcgcctccaattcaccacacgttttgataaccaaatgactaatcatcgcttgcgcgtcctattcccaacgcaccttaaaacagaccatcatctagctgacagtatttttgaaactgtcaaacgtccaaatcatccagatgccaccttttggaagaatccaagtaacccacagcaccaagaatgctttgtgagtctctttgatggtgaaaatggagtcactattggtaactatggcctcaacgaatatgagatcttaccagataccaacaccattgccatcactctcttacgttctgttggcgaaatgggcgactggggttacttcccaacacctgaagcccagtgtcttggcaaacacagcctttcttatagttttgaaagcatcactaagcaaacacaatttgccagctactggcgagctcaagaaggccaagtccctgttattaccacacaaacaaaccaacacgagggaacattagccgcagaatatagctatttgacgggtacaaacgaccaagttgccctcacagctttcaaacgtcgcttagcagacaatgcccttatcacgcgcagctataatctctcaaacgataaaacttgtgactttagcctaagcctgccaaactacaatgccaaggtcactaatttgttagaaaaagacagcaagcaaagcacacccagccaacttggcaaagcggaaattttaactctagcttggaagaaacaa

SEQ ID NO: 8158 - protein, 901 aa, Streptococcus pyogenes
MATKKVHIISHSHWDREWYMAYEQHHMRLINLIDDLLEVFQTDPDFHSFHLDGQTIILDDYLKVRPEREPEIRQAIASGKLRIGPFYILQDDFLTSSESNVRNMLIGKEDCDRWGASVPLGYFPDTFGNMGQTPQLMLKAGLQAAAFGRGIRPTGFNNQVDTSEKYSSQFSEISWQGPDNSRILGLLFANWYSNGNEIPTTEAEARLFWDKKLADAERFASTKHLLMMNGCDHQPVQLDVTKAIALANQLYPDYEFVHSCFEDYLADLADDLPENLSTVQGEITSQETDGWYTLANTASARIYLKQANTRVSRQLENITEPLAAMAYEVTSTYPHDQLRYAWKTLMQNHPHDSICGCSVDSVHREMMTRFEKAYEVGHYLAKEAAKQIADAIDTRDFPMDSQPFVLFNTSGHSKTSVAELSLTWKKYHFGQRFPKEVYQEAQEYLARLSQSFQIIDTSGQVRPEAEILGTSIAFDYDLPKRSFREPYFAIKVRLRLPITLPAMSWKTLALKLGNETTPSETVSLYDDSNQCLENGFLKVMIQTDGRLTITDKQSGLIYQDLLRFEDCGDIGNEYISRQPNHDQPFYADQGTIKLNIISNTAQVAELEIQQTFAIPISADKLLQAEMEAVIDITERQARRSQEKAELTLTTLIRMEKNNPRLQFTTRFDNQMTNHRLRVLFPTHLKTDHHLADSIFETVKRPNHPDATFWKNPSNPQHQECFVSLFDGENGVTIGNYGLNEYEILPDTNTIAITLLRSVGEMGDWGYFPTPEAQCLGKHSLSYSFESITKQTQFASYWRAQEGQVPVITTQTNQHEGTLAAEYSYLTGTNDQVALTAFKRRLADNALITRSYNLSNDKTCDFSLSLPNYNAKVTNLLEKDSKQSTPSQLGKAEILTLAWKKQ

SEQ ID NO: 8159 - DNA, 1353 bp, Streptococcus pyogenes
atgttagaagattttcttcaatttttaggatttatatttttagatattattgaaattatgttaacgttaaagctttttagctttgtaagtgcaattccgcttcgcctgaaaaatattttttatttatcacttagtatggttttgtttcaagtagttttttgggctttctttccagaccatttcattcttgatgttgtgatgttggctcagtttcttttctttgcgcttatagccctatactatggtaaatcaataaaagctaagtttttaatgttttatgccttttttccactagtgtctattagtttggttaagcgatttattgtattttttgttatgccattgtttggtatgccttattcagttgttaaacataatacactactgatttacagcattacttgttttagtatttttttgatttatcgctgcattcaagtttttcatttcgatttttcaacctggcgccaatattttcaatcacatagagctagtaaactattagtgtttactaactcttcgatggctctatattacttgtgtgtccaagggatagatgtgatgtcgccttctttatcaggacttgctacaacgactgctcgttcaatcatagtgctcttttatttcattttgtttcttactttattaattcatttagagcgttatgtaaaacaaaactctattgaggcaattgtgcaacaaaaagaatatcgtgagctgattaattatagtcagcaccttggattgctgtatcaagatattcaagagcttaggcggctattaactaccgtgtctagtcgtcttaagattggaatcgaacaaaatgatatctctattgtgagacttacttatgaaggtatcttgaatgctgaaaagaataatgctaaagatgacagacttgatttaacttgtttagataaattacaagttgaagcaatcagacatattgttttagctaaattaattgaggcaaaaaataagaagcttaaggttgaggtatcgatccctaattgtattgcaacgttttttctagaagtagtagatttcactaagctattgtcatttttgttagataatgctatagaaatgagtttggagacaaagcaaccttgcttatcaatagcatttctggatcaaaaccataaacttgtcatagtcattcaaagcagtactaaacaaggacaagatgatagtcaaagcgtgtttgctataccggctttgaaaaaaagagatgactggcaatttgacttaaggaatgtcacgaccattttaaatcgttatgactatctcacaattagctcgcagattcatgatggcattttaacccagttaatagaaatagctaagcctgac

SEQ ID NO: 8160 - protein, 451 aa, Streptococcus pyogenes
MLEDFLQFLGFIFLDIIEIMLTLKLFSFVSAIPLRLKNIFYLSLSMVLFQVVFWAFFPDHFILDVVMLAQFLFFALIALYYGKSIKAKFLMFYAFFPLVSISLVKRFIVFFVMPLFGMPYSVVKHNTLLIYSITCFSIFLIYRCIQVFHFDFSTWRQYFQSHRASKLLVFTNSSMALYYLCVQGIDVMSPSLSGLATTTARSIIVLFYFILFLTLLIHLERYVKQNSIEAIVQQKEYRELINYSQHLGLLYQDIQELRRLLTTVSSRLKIGIEQNDISIVRLTYEGILNAEKNNAKDDRLDLTCLDKLQVEAIRHIVLAKLIEAKNKKLKVEVSIPNCIATFFLEVVDFTKLLSFLLDNAIEMSLETKQPCLSIAFLDQNHKLVIVIQSSTKQGQDDSQSVFAIPALKKRDDWQFDLRNVTTILNRYDYLTISSQIHDGILTQLIEIAKPD

SEQ ID NO: 8161 - DNA, 147 bp, Streptococcus pyogenes
gtgcttaaggcagcgactttctttggaattccatgccttatttttgagatcctaggctcaaaaatgccaagtggcgtcaacattaacattgacgccacttttaccacaacgaaaaacatctgttttggctcactccacacgcagaaa

SEQ ID NO: 8162 - protein, 49 aa, Streptococcus pyogenes
VLKAATFFGIPCLIFEILGSKMPSGVNINIDATFTTTKNICFGSLHTQK

SEQ ID NO: 8163 - DNA, 276 bp, Streptococcus pyogenes
ttggcacttgatgttgtaaccaaaactgacaagacacctcttttaggtagaattttatcaaagtatgtaggacgcttgacgtcgtgtattgaaaatgaaaccactaaaataaggaatcattcaagacaaaacgataccatcggcctcaatcatcttcttggaaacttgaaaaccgtccataaccctgagattatccttaaaacgattaatgtctattctcgtcgtcttcaggttttttcgcagataatggctacgcttatactcggtttaatcctt

SEQ ID NO: 8164 - protein, 92 aa, Streptococcus pyogenes
LALDVVTKTDKTPLLGRILSKYVGRLTSCIENETTKIRNHSRQNDTIGLNHLLGNLKTVHNPEIILKTINVYSRRLQVFSQIMATLILGLIL

SEQ ID NO: 8165 - DNA, 93 bp, Streptococcus pyogenes
ttgtatcctttgttttcccattttagacaatctcgacaagctattatatctgagtttgcacaacatgtcgcacaaacactttttcctatcttt

SEQ ID NO: 8166 - protein, 31 aa, Streptococcus pyogenes
LYPLFSHFRQSRQAIISEFAQHVAQTLFPIF

SEQ ID NO: 8167 - DNA, 96 bp, Streptococcus pyogenes
gtgttgctacctggtgcagtactatcatttattgaagaactgtttgaacttgacgttgaactcgatgagctactagaagagtgtgtttcttctgga

SEQ ID NO: 8168 - protein, 32 aa, Streptococcus pyogenes
VLLPGAVLSFIEELFELDVELDELLEECVSSG

SEQ ID NO: 8169 - DNA, 168 bp, Streptococcus pyogenes
atgacacaagtagatgttaaatgctattgccaactctatcaaaaaaatttatatgcttataaaaattctatatttttatttttagcgttttcttgttatcttagagacatggaaagcgcttttctaaaactgaaaggatgtttattttatgaaaaacatagttatcgt

SEQ ID NO: 8170 - protein, 56 aa, Streptococcus pyogenes
MTQVDVKCYCQLYQKNLYAYKNSIFLFLAFSCYLRDMESAFLKLKGCLFYEKHSYR

SEQ ID NO: 8171 - DNA, 660 bp, Streptococcus pyogenes
ttggtagaaaaaatgtgtaaagaaatcacaataaaagaagcggtagctcacgttaaagatggtgataccattatggttggtggcttcatgacaaatggcacaccagaaaaattaattgatgcacttgtggaaaaaggtgtcaaagacctcactttaatctgtaacgatgccggttttcctgacaaaggcgttggtaagatggttgccaataaacagttttcaactattattgcatcacatatcggtctcaaccgtgaagcaggccgacaaatgactgagggcgagactgtaattgatcttgtacctcagggaacattagctgagcgcatccgcagtggcggttttgggctaggcggtttcttaacacctactggaataggaaccgaagttgccaaaggaaaagaagtcattactattgacggcaaagactaccttcttgaaaaacctttgaaagctgatgtcgcacttatttttgctaacaaggcagataaaaatggcaatttgcaatacgcaggttctgaaaataactttaatcatgtgatggctgctaatgcgaaaaccaccattgttgaagcaagagaaattgttgacgtggggcaaatggatcctaattttgtccatactcctggcatttttgttaactacttagtgaaaggagcc

SEQ ID NO: 8172 - protein, 220 aa, Streptococcus pyogenes
LVEKMCKEITIKEAVAHVKDGDTIMVGGFMTNGTPEKLIDALVEKGVKDLTLICNDAGFPDKGVGKMVANKQFSTIIASHIGLNREAGRQMTEGETVIDLVPQGTLAERIRSGGFGLGGFLTPTGIGTEVAKGKEVITIDGKDYLLEKPLKADVALIFANKADKNGNLQYAGSENNFNHVMAANAKTTIVEAREIVDVGQMDPNFVHTPGIFVNYLVKGA

SEQ ID NO: 8173 - DNA, 657 bp, Streptococcus pyogenes
atgggaacatcaactactgttctttcaaaagaagagattcaaacacgtattgctaagcgcgttgcacaagaattagaacacaatacactggtcaacttaggcataggtttgccaacaaaagtagccaactatattcctgaaggtgtaaccattaccctgcagtccgaaaatggttttgtcggtctcactggattaacagatgatcactacgatcctactattgttaatgctggtgggcaacctgttagtattgctcctggaggggctttcttcgatagctcaacttcctttggtattattcgaggcggccatgtggccgcaaccgtcttaggtgccttacaagttgataaagaagctagcattgctaattacctgattcctggaaaaatggttcctgggatgggaggggccatggacttattggtaggtgctaaaaaagtcattgttgcaatggagcataccaataaaggcaaagcaaaaattttagacaaatgcacccttcctctgactgctcaaaatgttgttaacctaatcattactgaaatgggagtctttgaatatcaagatgaaggtctatgcgcccttgaaattaacccagattacacctttgaagacgtgcaaaacgttaccgaagttaccctaattgataaaacaaac

SEQ ID NO: 8174 - protein, 219 aa, Streptococcus pyogenes
MGTSTTVLSKEEIQTRIAKRVAQELEHNTLVNLGIGLPTKVANYIPEGVTITLQSENGFVGLTGLTDDHYDPTIVNAGGQPVSIAPGGAFFDSSTSFGIIRGGHVAATVLGALQVDKEASIANYLIPGKMVPGMGGAMDLLVGAKKVIVAMEHTNKGKAKILDKCTLPLTAQNVVNLIITEMGVFEYQDEGLCALEINPDYTFEDVQNVTEVTLIDKTN

SEQ ID NO: 8175 - DNA, 105 bp, Streptococcus pyogenes
atggaacgcggtaaacccctcaagctagcaacccaaactttggtaggggcatgggatagttggaaacgaacaagctatcctgactgtcaacagacggtagacaga

SEQ ID NO: 8176 - protein, 35 aa, Streptococcus pyogenes
MERGKPLKLATQTLVGAWDSWKRTSYPDCQQTVDR

SEQ ID NO: 8177 - DNA, 222 bp, Streptococcus pyogenes
atgttagtagaaatctttagcctttatgtaaaaggtctcattctctcaagccttactatgattttaatttgtttaatatggactttatggcgagcaaaaaccaaaagagataaaacattgattgaaagacaagcttttctttatgagatgctaatggttgctattttaaccatcccaattttatcgtttgcttttatgagtattttggttgtcataaaatcc

SEQ ID NO: 8178 - protein, 74 aa, Streptococcus pyogenes
MLVEIFSLYVKGLILSSLTMILICLIWTLWRAKTKRDKTLIERQAFLYEMLMVAILTIPILSFAFMSILVVIKS

SEQ ID NO: 8179 - DNA, 147 bp, Streptococcus pyogenes
atgttttacctcgttttcttccatattatatcattattgttagagacaagcaaaaggagtgggacaacactcgcaaaatcagcatttgtgggtcatctccactctcttattgatgatgttaatcaaaatgctattggtgactattct

SEQ ID NO: 8180 - protein, 49 aa, Streptococcus pyogenes
MFYLVFFHIISLLLETSKRSGTTLAKSAFVGHLHSLIDDVNQNAIGDYS

SEQ ID NO: 8181 - DNA, 111 bp, Streptococcus pyogenes
atgtttttaacccttattgcagcaatcatatcctttatggtatccgctttcacaatgcccttattttatcaaattctatcaattgaaaaaaattggtgggcaacaaatgca

SEQ ID NO: 8182 - protein, 37 aa, Streptococcus pyogenes
MFLTLIAAIISFMVSAFTMPLFYQILSIEKNWWATNA

SEQ ID NO: 8183 - DNA, 105 bp, Streptococcus pyogenes
gtgattaaggaagctaaaaatcttttacaagcagttgaaactctagaggcagtggctaagtcagtgcttgctaagttggctgatagcgaacaaaaagaacaagat

SEQ ID NO: 8184 - protein, 35 aa, Streptococcus pyogenes
VIKEAKNLLQAVETLEAVAKSVLAKLADSEQKEQD

SEQ ID NO: 8185 - DNA, 138 bp, Streptococcus pyogenes
ttgaccttgctcattatttcgacgtttgatccagctaaccagcataccatctccaaaaaaaaacaaaatagccccaatttcggacaattttcaattccaaatgaatcacctgaatctgatgtaaaagttcttctaaag

SEQ ID NO: 8186 - protein, 46 aa, Streptococcus pyogenes
LTLLIISTFDPANQHTISKKKQNSPNFGQFSIPNESPESDVKVLLK

SEQ ID NO: 8187 - DNA, 138 bp, Streptococcus pyogenes
atgactaatgaaagagaaaaagaagaagcaaaggttactttagaagaacttttacatcagattcaggtgattcatttggaattgaaaattgtccgaaattggggctattttgtttttttttggagatggtatgctggt

SEQ ID NO: 8188 - protein, 46 aa, Streptococcus pyogenes
MTNEREKEEAKVTLEELLHQIQVIHLELKIVRNWGYFVFFWRWYAG

SEQ ID NO: 8189 - DNA, 144 bp, Streptococcus pyogenes
ttgttgggtcttttgattttctttgataagaaagattacctcgttagaaatgaggagacgtggttgtcatcagtggatttttcaagttcatctagtgggataagctacctatcttatcagcttttttttagctttaaaaattct

SEQ ID NO: 8190 - protein, 48 aa, Streptococcus pyogenes
LLGLLIFFDKKDYLVRNEETWLSSVDFSSSSSGISYLSYQLFFSFKNS

SEQ ID NO: 8191 - DNA, 102 bp, Streptococcus pyogenes
ttgacaatcgtttttttgtcatcagtaaaatacctgacgatgttactagcatgtattacaggtctaggcaccaaaaaaccgcattttgatgctcctaaatca

SEQ ID NO: 8192 - protein, 34 aa, Streptococcus pyogenes
LTIVFLSSVKYLTMLLACITGLGTKKPHFDAPKS

SEQ ID NO: 8193 - DNA, 480 bp, Streptococcus pyogenes
ttgaagaaatcgataacaaatgaaaaagccatattagcccaaggaggacaggaatttggtgctcagaacacgaaatttttgacgttacttcacattatgatttatgtgtttgcggtgattgaagcgctgcttaaacaaattaagtttgatggcattagttttttaggtcttttgttgatgttattatcagtagctgttttatatgaagtgacacgtatcttaggtgacatttggactgtaaaattgatgttagcaaaagaccacaaatatgtggatcactggttgttcaaaacgattaaacatcctaactactttttaaatatcgcccctgagctggtgggcatagccttactttgccatgctaaaattacggctatgcttcttttcccatgctacattgtagtaatatatttacgtattcgagaagaaaacaagctattagcggaagtgattattccaaacggtactcgaacaaaacct

SEQ ID NO: 8194 - protein, 160 aa, Streptococcus pyogenes
LKKSITNEKAILAQGGQEFGAQNTKFLTLLHIMIYVFAVIEALLKQIKFDGISFLGLLLMLLSVAVLYEVTRILGDIWTVKLMLAKDHKYVDHWLFKTIKHPNYFLNIAPELVGIALLCHAKITAMLLFPCYIVVIYLRIREENKLLAEVIIPNGTRTKP

SEQ ID NO: 8195 - DNA, 108 bp, Streptococcus pyogenes
gtgaaagaaactattattgaaaataaggagccgtattgtgaccatctttttagtgatgttagctatgtttactattcgtttagtatttttgaagaaatcgataacaaa

SEQ ID NO: 8196 - protein, 36 aa, Streptococcus pyogenes
VKETIIENKEPYCDHLFSDVSYVYYSFSIFEEIDNK

SEQ ID NO: 8197 - DNA, 1647 bp, Streptococcus pyogenes
ttgagcgaggacaatattgtgtcagtaaattggcaagacattgcatttcatttctttggaggcttaggtctctttcttttcagtatcaagtatatgggagatggtctgcaacaagcagcaggagataaactaaggtattacattgataaatacaccagtaatcccttttttggtatcttagtcggaattgccatgtctgccttaattcagtccagttcaggcgtaactgtaattacggttggtttggtttctgcgggtttgctaaatttgcgacaagccattggaattgttatgggggctaatattggaacgactatcacttcgtttttaattggttttaaactaggagattacgccttgcccatgatttttattggtgcagcctgtcttttctttacctctaataaaaagctcaacaattttgggcgtatcatttttggtgtcggaggaattttcttctcgctgaacctaatgggagatgccatggatcctttgaaatctgtgtcagcctttcaaaattatttagcgacattaggtgataaacccttccaaggtgtctttatcggaacggctttgaccatgttgattcagtcatcggcagccattatcgggattttacagggactgttttcaggcggtcttttgaccttacagggggctattcctattttgttaggctcaaatataggaacctgcattacagctgtcttagcagctataggttcaaatattgctgctaaacgtgtggcagcagctcatgtgttatttaatttgatcggtacaattatttttatgattatcctagtcccattcacatcattgatgttatggctacaatcaaagttgagtttaacgcctgagatgactatcgctttttctcacggttcttttaatatcactaataccatcttattaattcctttcattagtctactagctatgattgtgactagactcattccaggagaagatgaagtggtcaaatacgaagccctttatttagatcgcttacttattacccaagccccttctatcgcactaggaaatgcccacaaggaattggttcatttagcctcttatgcgattcaagcttttgaagcttcttacagttatattatgacagctgacggtaaatttggggaaaaggtcaagcgttatgaaagagcagttgataccatcgatgaggagttaaccacttatttggttgatatttctaacgaagccctcagcccaagtgaaaatgaagtcttggctggtattcttgactcttcacgtgatttggaaagaattggagatcattctgagtctttaggcattctaattgaaggcatcatatctaaacaaattggtttttcaatatctgctcgtcaagaattgacagagatgtatcaattgacgcattgtttaacactggatgccattagagctatcgttgatagtgatacagacttggcgcaaactattgtgactcgccataaagaaattgaagaaaaagagcgacgattacgtaaaacccacattaagcgcttgaattgtggagaatgtacggcacaagcaggtattaattttattgatattatttcccactatacccgcatcacagatcatgccttgaatttagcagagaaagtactttcacaccagctt

SEQ ID NO: 8198 - protein, 549 aa, Streptococcus pyogenes
LSEDNIVSVNWQDIAFHFFGGLGLFLFSIKYMGDGLQQAAGDKLRYYIDKYTSNPFFGILVGIAMSALIQSSSGVTVITVGLVSAGLLNLRQAIGIVMGANIGTTITSFLIGFKLGDYALPMIFIGAACLFFTSNKKLNNFGRIIFGVGGIFFSLNLMGDAMDPLKSVSAFQNYLATLGDKPFQGVFIGTALTMLIQSSAAIIGILQGLFSGGLLTLQGAIPILLGSNIGTCITAVLAAIGSNIAAKRVAAAHVLFNLIGTIIFMIILVPFTSLMLWLQSKLSLTPEMTIAFSHGSFNITNTILLIPFISLLAMIVTRLIPGEDEVVKYEALYLDRLLITQAPSIALGNAHKELVHLASYAIQAFEASYSYIMTADGKFGEKVKRYERAVDTIDEELTTYLVDISNEALSPSENEVLAGILDSSRDLERIGDHSESLGILIEGIISKQIGFSISARQELTEMYQLTHCLTLDAIRAIVDSDTDLAQTIVTRHKEIEEKERRLRKTHIKRLNCGECTAQAGINFIDIISHYTRITDHALNLAEKVLSHQL

SEQ ID NO: 8199 - DNA, 165 bp, Streptococcus pyogenes
atgatattgtttcatcgtagccatattatacctctaattaaacgaaatgaaaagatttgtgcaaaaacaaatgatgtaaaatatcggaaaagcctaacaccttatcaaaccaataatatgcaaatgttgacatcggtatacacagaaacgcttaaaaaaaccttg

SEQ ID NO: 8200 - protein, 55 aa, Streptococcus pyogenes
MILFHRSHIIPLIKRNEKICAKTNDVKYRKSLTPYQTNNMQMLTSVYTETLKKTL

SEQ ID NO: 8201 - DNA, 117 bp, Streptococcus pyogenes
ttgtttgaatcttttgtagcaaggatgaaaatgggttttatccttgcttttttatccttacattttatctttttctacttattttttaaaggaaaacgtggtaaactaaaagaagac

SEQ ID NO: 8202 - protein, 39 aa, Streptococcus pyogenes
LFESFVARMKMGFILAFLSLHFIFFYLFFKGKRGKLKED

SEQ ID NO: 8203 - DNA, 96 bp, Streptococcus pyogenes
ttgtggtcactcataaagactctgacgttagcaggtgtgttccgagcaaaacaaaaacacctctctgggggcaaatcacttttgccagaaggtgtt

SEQ ID NO: 8204 - protein, 32 aa, Streptococcus pyogenes
LWSLIKTLTLAGVFRAKQKHLSGGKSLLPEGV

SEQ ID NO: 8205 - DNA, 153 bp, Streptococcus pyogenes
ttgactgttttttcaattgttagagcacaagaggcacaactcattccctccactaaaaatatctctttagccattaatacgtctcctttctctgacagtggcactgcccaggcagacaattacacggcacctcaagaactgcattttcttttt

SEQ ID NO: 8206 - protein, 51 aa, Streptococcus pyogenes
LTVFSIVRAQEAQLIPSTKNISLAINTSPFSDSGTAQADNYTAPQELHFLF

SEQ ID NO: 8207 - DNA, 159 bp, Streptococcus pyogenes
ttgatattagcaggaggaactaatgatccagaccctgatgagctagactcatcagctgctaaagcatctgatgaagaagacggcgtagctggcctatggcttgaagcagtagagtcctggtctgtactagcactctggccggtatctactccacttgaa

SEQ ID NO: 8208 - protein, 53 aa, Streptococcus pyogenes
LILAGGTNDPDPDELDSSAAKASDEEDGVAGLWLEAVESWSVLALWPVSTPLE

SEQ ID NO: 8209 - DNA, 96 bp, Streptococcus pyogenes
ttgacaatcaaattatatcaaaggtcaaagtattttgcaagcaatagctgtcttacttaccttgaaaatttggtcggcgcctttctccaaaagcta

SEQ ID NO: 8210 - protein, 32 aa, Streptococcus pyogenes
LTIKLYQRSKYFASNSCLTYLENLVGAFLQKL

SEQ ID NO: 8211 - DNA, 117 bp, Streptococcus pyogenes
ttgtttcagctatttttggaaaaaggtattaaaaaaaggctgcatggaagtttccaagcagcctttttgcaacataaaatgtcttatctttttattggttgcatcctcattataaga

SEQ ID NO: 8212 - protein, 39 aa, Streptococcus pyogenes
LFQLFLEKGIKKRLHGSFQAAFLQHKMSYLFIGCILIIR

SEQ ID NO: 8213 - DNA, 213 bp, Streptococcus pyogenes
ttgatagttgctgatagcaataagttaaagtattttgtctctgaaaaaaaggcggtcggtctttcacaggctgcctttttgtatgtcatgttagtgaccgcctataaaaagaccatcatctatgctaaaataagactgacaggtattgctttagaaccttcaggagtttctgacgggtatttaatgaactatcacgtttgtctacactattat

SEQ ID NO: 8214 - protein, 71 aa, Streptococcus pyogenes
LIVADSNKLKYFVSEKKAVGLSQAAFLYVMLVTAYKKTIIYAKIRLTGIALEPSGVSDGYLMNYHVCLHYY

SEQ ID NO: 8215 - DNA, 306 bp, Streptococcus pyogenes
atggttgttgtaatggcgacaccttcggtatcaacttcgttcagcaattcaaccatatcaacgattttggataaggtcgttgcaaaggttgttgtctcactttctgaaaatgataattttgatagcttcgcgacatggcgaacttcttcttcagaaattttcatgatttctcccatccaagatgatcagaagtattccaattccaaagaacagccctgctattctccaaaggtagcggaaaaactcctcacatcatttttacatagtctcaattattatatcacaattgctcccatttaccatagg

SEQ ID NO: 8216 - protein, 102 aa, Streptococcus pyogenes
MVVVMATPSVSTSFSNSTISTILDKVVAKVVVSLSENDNFDSFATWRTSSSEIFMISPIQDDQKYSNSKEQPCYSPKVAEKLLTSFLHSLNYYITIAPIYHR

SEQ ID NO: 8217 - DNA, 162 bp, Streptococcus pyogenes
ttgaattatttgcgctttcattataacaaagctaactcgcttttgcaaggaattatcagaaaattttctattcttactacaattccaactattgatgccttattatcacttcatttaaaggagataagcactagcttgttagagcatagggtcacattcttt

SEQ ID NO: 8218 - protein, 54 aa, Streptococcus pyogenes
LNYLRFHYNKANSLLQGIIRKFSILTTIPTIDALLSLHLKEISTSLLEHRVTFF

SEQ ID NO: 8219 - DNA, 702 bp, Streptococcus pyogenes
atgatttcctatcttaaagcagatttatttcggatacgccaagagcgtttagctctattttcttgtatgctacttgttgtcattgctgttggtgtagcctatagttttcgcaagacacctaaccaagtcatcatgatacaaatcattaatattattactgattttgtgacgcttttctttttaacaccagcccgtatcttttttagtgatgactataactaccgtacgattaataatgttgtggtcaaacaacaaaatcgtactttaattataatctataaactgctagttagttttggcttatctcttttatttattagtttaacttatcttcttagtgctttagcatttcatttatttactggtcaagcatactatggaatagtcatagatcggatgattaaacaactgcctttttatattgctattattgctttgtgtcaatttttgtttaatatacttcgtaaaacttatcagtcaatcacagcttatatactttatgtccttctttttgataaagtatctgctactttagcaaaccatttttttaagttagatattagcccagttttgatgtttaaacacctatccttgtctcttggtgataaacacctttctagtactagcatattagtggcctttggtttaactctttgttatcttttaggcaatgtctttcttttttccaaacgagaactaaaa

SEQ ID NO: 8220 - protein, 234 aa, Streptococcus pyogenes
MISYLKADLFRIRQERLALFSCMLLVVIAVGVAYSFRKTPNQVIMIQIINIITDFVTLFFLTPARIFFSDDYNYRTINNVVVKQQNRTLIIIYKLLVSFGLSLLFISLTYLLSALAFHLFTGQAYYGIVIDRMIKQLPFYIAIIALCQFLFNILRKTYQSITAYILYVLLFDKVSATLANHFFKLDISPVLMFKHLSLSLGDKHLSSTSILVAFGLTLCYLLGNVFLFSKRELK

SEQ ID NO: 8221 - DNA, 678 bp, Streptococcus pyogenes
atgaggcttgatgttcgcaccaaactgcttttgttggtacttgccaatgcctgcttcttttttcgtgttgatggctttttagaatttataattgttatttttctcttattacttttgtctgctttaaataagaaaaagctagcgttcaagttggcggttgtttatctgttaatgatcggtctatctgtaatcccgctatcgattttcccttcttatcttgaccacttattgagttttgtctcaatagcaggaaggttagttttcccttctttactagcaggtttaattactattaagacaactaccatctacgaattggttcatggattacgcaaatggcgtttcccagaagtctggctattgaccttggccgttatgtgccgtttcataccaatgattagacaagaatgttgtgttattcatcgctctttaaaaatcagggggattattttaacaaaatggtctattttgatcagacctaaacaatacttggagtatttaatggttccattgcttttatctttgataagaagtagccaagaactaactatcgctagtctaactaaagggctagcagtcaacaaaggcaccagtgaatgctttagctcacacttaacatggaaagattggggggtgcagatttggattactgttatcataatcatcacgatactgcaa

SEQ ID NO: 8222 - protein, 226 aa, Streptococcus pyogenes
MRLDVRTKLLLLVLANACFFFRVDGFLEFIIVIFLLLLLSALNKKKLAFKLAVVYLLMIGLSVIPLSIFPSYLDHLLSFVSIAGRLVFPSLLAGLITIKTTTIYELVHGLRKWRFPEVWLLTLAVMCRFIPMIRQECCVIHRSLKIRGIILTKWSILIRPKQYLEYLMVPLLLSLIRSSQELTIASLTKGLAVNKGTSECFSSHLTWKDWGVQIWITVIIIITILQ

SEQ ID NO: 8223 - DNA, 591 bp, Streptococcus pyogenes
atgaaacagttaacaataaaagatattatgataacaggcgcatttgccgcgctctactttatttgtgttggtctaggcacgtttattaacatcttttttgatcgctcaggaaatatgttatatgcccctgcctttgcagctttactggggggaacaatttattttcttttgattgctaaattgcaaacatttgggccaataacattattaggattgatgatgggaggttttttcttccttagtggtcacttttttgccgcgatgtttcccagcattattttcggtttaatagcggatattattgcgtctttaggaaaatacaagtcaaggttttttaatgacctatcttatatggtttttgcttttgtcaatagtggccctattttgctgatgtggttgttgaaagatgcctatgttgaaagtttgttagcccgcggtaaaagtatgacctatgtcaatcgcattatgtatgattttagtttagggcatgttatttggtttgtaggaattgttcttgcaggagccttattagggtcagtttttgcacattatttactaaagaaacattttatcaaatcaggattgttatca

SEQ ID NO: 8224 - protein, 197 aa, Streptococcus pyogenes
MKQLTIKDIMITGAFAALYFICVGLGTFINIFFDRSGNMLYAPAFAALLGGTIYFLLIAKLQTFGPITLLGLMMGGFFFLSGHFFAAMFPSIIFGLIADIIASLGKYKSRFFNDLSYMVFAFVNSGPILLMWLLKDAYVESLLARGKSMTYVNRIMYDFSLGHVIWFVGIVLAGALLGSVFAHYLLKKHFIKSGLLS

SEQ ID NO: 8225 - DNA, 873 bp, Streptococcus pyogenes
atgacaaaggtagtaataaagcaattgttgcaggtaatagtagtgttcatgataagtttatcgacaatgacaaatcttgtgtatgcagataaaggtcaaatttatggatgtattattcaaagaaattatcgtcatccgatatctgggcagatagaagatagcggaggggagcattcctttgatattggtcaaggtatggttgaaggaactgtctatagtgatgccatgctagaagtatctgatgctggaaagatcgttcttacttttcgtatgagcttagctgattattcgggcaattatcagttctggatacaacctggaggaactggaagctttcaggcagttgattacaatatcacccaaaaaggtactgataccaatgggacaacactagatattgctattagtttgcctactgtaaatagtatcattcgaggcagcatgtttgttgaacctatgggcagagaagtggtcttttacctgtcagcttcagagttaatacaaaagtattcaggtaatatgttggcccagcttgttactgaaacagacaattctcaaaatcaagaagtaaaagacagtcaaaagcctgttgatacaaaactaggagaaagtcaagatgagtctcacacaggtgctatgataactcagaataagcctaaagccaactcatcaaataacaagagtctatcagataaaaaaattcttccttctaagatgggcttaacgacttctttagagttaaaaaaagaagataagtttcggtctaaaaaagacttatcaatcatgatttactactttccaactttttttctgatgttaggagggtttgctgtatgggtttggaaaaagaggaaaaaaaatgataaaacgatg

SEQ ID NO: 8226 - protein, 291 aa, Streptococcus pyogenes
MTKVVIKQLLQVIVVFMISLSTMTNLVYADKGQIYGCIIQRNYRHPISGQIEDSGGEHSFDIGQGMVEGTVYSDAMLEVSDAGKIVLTFRMSLADYSGNYQFWIQPGGTGSFQAVDYNITQKGTDTNGTTLDIAISLPTVNSIIRGSMFVEPMGREVVFYLSASELIQKYSGNMLAQLVTETDNSQNQEVKDSQKPVDTKLGESQDESHTGAMITQNKPKANSSNNKSLSDKKILPSKMGLTTSLELKKEDKFRSKKDLSIMIYYFPTFFLMLGGFAVWVWKKRKKNDKTM

SEQ ID NO: 8227 - DNA, 3720 bp, Streptococcus pyogenes
gtgacaacagtagctttaactcaggataatcgacttttagttgaagagataggcccttacgctagtcaatcagctggaaaagagtattataaacatattgaaaagattattgttgataatgatgtctatgaaaaaagcctggagggcgagcgaacctttgatattaactaccaagggattaagatcaatgctgaccttattaaagacggtaagcatgaattgactattgttaataaaaaagatggtgatatcctaattacctttattaaaaagggcgataaagtgacctttatttcagctcaaaaattaggaacaacagatcatcaggattcattaaaaaaagatgtgctcagtgataaaacagtgccacaaaaccaaggcacacaaaaagttgttaaatctgggaaaaatactgctaacttgtcattaataacaaaattgagtcaagaagatggtgcaattttatttccagaaattgatcgttattctgataacaaacagataaaagcattgactcagcaaatcacaaaggttacagtcaatggtacagtttataaagatcttatttcagattctgtaaaagatactaatggctgggtctcgaatatgacagggcttcatcttggaacaaaagctttcaaagatggagaaaatacaatcgtgatatcctcaaaaggatttgaagacgttactattaccgttaccaagaaagatggtcaaatccattttgtatctgccaaacaaaaacaacatgtgactgctgaagacagacaatcaacaaagttggatgtcaccactttggaaaaagctatcaaagaagcggatgcgattattgctaaagaaagcaacaaagacgcggtcaaagatctggctgagaaacttcaagtcatcaaggattcttacaaagaaatcaaagatagtaagctactcgccgatactcatcgactgttaaaagataccatcgagtcttatcaagcaggtgaggtttctattaacaatctcacagaaggaacctatacgctaaactttaaagctaataaagaaaactcagaagagtcctccatgcttcaaggtgcttttgataaaagagccaaattagtggttaaagcagatggtacaatggaaatttccatgcttaatactgctttgggacaatttttgattgacttttctattgaaagcaaagggacctacccagcagcagtgcgtaaacaagttggccaaaaagatatcaatggtagctatattcgaagcgaatttaccatgcctattgatgatttggataaattacacaaaggtgctgttttggtatcagccatgggaggtcaagaaagtgatttaaaccactatgacaaatacaccaaacttgacatgacctttagtaagaccgttaccaaaggctggagtggttatcaggtagaaactgatgataaagaaaaaggggttgggactgaacgtcttgaaaaagttttagttaaacttggcaaagatttagacggcgatggtaaattatcaaaaacggaattagaacagattcgaggcgagttgcgtctagaccattacgagttaactgatatttctttattgaaacatgctaaaaatattacagaactacatctggatggaaaccaaattacggaaattccaaaagagttatttagtcaaatgaagcaacttcgatttcttaacttaagaagtaatcatttaacttatctagacaaagatacatttaaaagcaatgctcaattaagagaactctacttatcaagtaactttattcactctcttgaaggaggactattccagtcgcttcatcacctggagcaacttgatctttccaagaatcgtattggccgactttgtgataacccatttgaaggattgtctcgtctgacttcattaggtttcgcagaaaatagtcttgaggagatacctgaaaaagcgctagagcctctaacatcacttaattttatcgacttatctcaaaataatttagcactactgccaaaaacaatagaaaaattgcgcgccttaagcactattgtggcaagtagaaatcatattactcgtattgataatatttcatttaaaaatcttcctaaattatctgtactcgatttatcaactaatgaaatttcaaatcttccaaatggtatatttaaacagaataaccaattaacaaaacttgattttttcaataacttgcttactcaggttgaagaatcagtatttccagatgttgaaacgcttaatttagatgtgaagttcaatcagataaaaagtgtgagtccaaaagtaagagctcttatcggacaacacaaactgactccacaaaaacatattgcaaaacttgaagcttccttagatggcgaaaaaataaaatatcatcaagctttcagtcttttagatttgtattattgggagcaaaaaacaaattctgccattgataaagaactagtgtctgttgaagaatatcaacaattgttacaagaaaaaggttcagatacggtttctttacttaatgatatgcaagtcgattggagtattgtgattcagttgcaaaaaaaagcttccaatggacagtatgtgacggttgacgaaaagcttctctcaaatgatccgaaagatgacttaacgggagagttttctttaaaagatccaggtacatatcggattcgcaaagctttaataacaaagaaatttgctactcaaaaagaacatatctatttgacatctaatgatatccttgtggcgaaaggaccacattcacatcagaaagatttagttgagaacggccttagagcattaaatcaaaaacaattgcgtgatggtatttactatttaaatgccagcatgttaaaaactgacttagcatctgagtccatgtcaaacaaggctattaatcatcgagtgactttggtagttaaaaaaggtgtttcctatttagaagttgagtttagaggtataaaggttggtaaaatgttaggctaccttggtgaattgagctatttcgtagatggttaccaaagagatttagctggtaaaccagttggtcgaacaaaaaaggcagaggttgtgtcttatttcacggatgtaactggcctaccattggcagatcgttatggaaaaaactatccaaaagtgctgcgtatgaaattgattgaacaagcgaagaaagacggacttgtgccattacaggtctttgtgcctatcatggatgccatttcaaaagggtctggccttcaaaccgtttttatgcgtttagactgggcaagccttacaacagagaaggcaaaggttgtcaaagaaactaataatccacaagaaaatagccatctaacttcaacagatcagttgaaaggacctcaaaatcgtcaacaagaaaaaacacctacaagtcctccttcagcagctactggtattgctaacttaactgatctcctggctaaaaaagcaaccggccaatcaactcaagaaacttctaagacagatgatactgataaggcagagaaattgaagcagttagtgcgtgaccatcaaacatcaattgaaggtaaaacagcaaaagatactaagactaaaaaatctgataagaaacatcgttccaatcaacaatcaaatggtgaagaaagtagctctcgttatcacttaattgcaggtctatctagctttatgatcgtagctctgggattcattattggtcgaaagacattatttaaa

SEQ ID NO: 8228 - protein, 1240 aa, Streptococcus pyogenes
VTTVALTQDNRLLVEEIGPYASQSAGKEYYKHIEKIIVDNDVYEKSLEGERTFDINYQGIKINADLIKDGKHELTIVNKKDGDILITFIKKGDKVTFISAQKLGTTDHQDSLKKDVLSDKTVPQNQGTQKVVKSGKNTANLSLITKLSQEDGAILFPEIDRYSDNKQIKALTQQITKVTVNGTVYKDLISDSVKDTNGWVSNMTGLHLGTKAFKDGENTIVISSKGFEDVTITVTKKDGQIHFVSAKQKQHVTAEDRQSTKLDVTTLEKAIKEADAIIAKESNKDAVKDLAEKLQVIKDSYKEIKDSKLLADTHRLLKDTIESYQAGEVSINNLTEGTYTLNFKANKENSEESSMLQGAFDKRAKLVVKADGTMEISMLNTALGQFLIDFSIESKGTYPAAVRKQVGQKDINGSYIRSEFTMPIDDLDKLHKGAVLVSAMGGQESDLNHYDKYTKLDMTFSKTVTKGWSGYQVETDDKEKGVGTERLEKVLVKLGKDLDGDGKLSKTELEQIRGELRLDHYELTDISLLKHAKNITELHLDGNQITEIPKELFSQMKQLRFLNLRSNHLTYLDKDTFKSNAQLRELYLSSNFIHSLEGGLFQSLHHLEQLDLSKNRIGRLCDNPFEGLSRLTSLGFAENSLEEIPEKALEPLTSLNFIDLSQNNLALLPKTIEKLRALSTIVASRNHITRIDNISFKNLPKLSVLDLSTNEISNLPNGIFKQNNQLTKLDFFNNLLTQVEESVFPDVETLNLDVKFNQIKSVSPKVRALIGQHKLTPQKHIAKLEASLDGEKIKYHQAFSLLDLYYWEQKTNSAIDKELVSVEEYQQLLQEKGSDTVSLLNDMQVDWSIVIQLQKKASNGQYVTVDEKLLSNDPKDDLTGEFSLKDPGTYRIRKALITKKFATQKEHIYLTSNDILVAKGPHSHQKDLVENGLRALNQKQLRDGIYYLNASMLKTDLASESMSNKAINHRVTLVVKKGVSYLEVEFRGIKVGKMLGYLGELSYFVDGYQRDLAGKPVGRTKKAEVVSYFTDVTGLPLADRYGKNYPKVLRMKLIEQAKKDGLVPLQVFVPIMDAISKGSGLQTVFMRLDWASLTTEKAKVVKETNNPQENSHLTSTDQLKGPQNRQQEKTPTSPPSAATGIANLTDLLAKKATGQSTQETSKTDDTDKAEKLKQLVRDHQTSIEGKTAKDTKTKKSDKKHRSNQQSNGEESSSRYHLIAGLSSFMIVALGFIIGRKTLFK

SEQ ID NO: 8229 - DNA, 141 bp, Streptococcus pyogenes
ttgattgaaaatgaaaaaaatcagcaaatgtgcgtttgtggcaatatctgcccttgttctcattcaggctactcaaactgtaaaatcacaagagcctttagttcagtcacaactcgtgacaacagtagctttaactcagga

SEQ ID NO: 8230 - protein, 47 aa, Streptococcus pyogenes
LIENEKNQQMCVCGNICPCSHSGYSNCKITRAFSSVTTRDNSSFNSG

SEQ ID NO: 8231 - DNA, 129 bp, Streptococcus pyogenes
gtgttaggagacaacatgagatgtcactactgcatattcatcacaataaaaaaagacaatagccctaatcgtgctattgtctcaaaatcatttattgacttgaaactttatcgtgttacaccaacagtt

SEQ ID NO: 8232 - protein, 43 aa, Streptococcus pyogenes
VLGDNMRCHYCIFITIKKDNSPNRAIVSKSFIDLKLYRVTPTV

SEQ ID NO: 8233 - DNA, 90 bp, Streptococcus pyogenes
atgagaaaaaaggataaaattatgactctctgtttctctgataactttacccacgccaaacgcatgaagaaacttttgttttcagaaaac

SEQ ID NO: 8234 - protein, 30 aa, Streptococcus pyogenes
MRKKDKIMTLCFSDNFTHAKRMKKLLFSEN

SEQ ID NO: 8235 - DNA, 93 bp, Streptococcus pyogenes
ttgttcttttttatctttatgatgacacaggctcttatcaagacagccatgtctcacggacaagcgccactttctggtagtctaacgattatt

SEQ ID NO: 8236 - protein, 31 aa, Streptococcus pyogenes
LFFFIFMMTQALIKTAMSHGQAPLSGSLTII

SEQ ID NO: 8237 - DNA, 3039 bp, Streptococcus pyogenes
atggtatatcaactgggaagccatgacttagtaccaaaaataaggagtgtccaaatggataaacatttgttggtaaaaagaacactagggtgtgtttgtgctgcaacgttgatgggagctgccttagcgacccaccatgattcactcaatactgtaaaagcggaggagaagactgttcaggttcagaaaggattaccttctatcgatagcttgcattatctgtcagagaatagcaaaaaagaatttaaagaagaactctcaaaagcggggcaagaatctcaaaaggtcaaagagatattagcaaaagctcagcaggcagataaacaagctcaagaacttgccaaaatgaaaattcctgagaaaataccgatgaaaccgttacatggttctctctacggtggttactttagaacttggcatgacaaaacatcagatccaacagaaaaagacaaagttaactcgatgggagagcttcctaaagaagtagatctagcctttattttccacgattggacaaaagattatagccttttttggaaagaattggccaccaaacatgtgccaaagttaaacaagcaagggacacgtgtcattcgtaccattccatggcgtttcctagctgggggtgataacagtggtattgcagaagataccagtaaatacccaaatacaccagagggaaataaagctttagccaaagctattgttgatgaatatgtttataaatacaaccttgatggcttagatgtggatgttgaacatgatagtattccaaaagttgacaaaaaagaagatacagcaggcgtagaacgctctattcaagtgtttgaagaaattgggaaattaattggaccaaaaggtgttgataaatcgcggttatttattatggatagcacctacatggctgataaaaacccattgattgagcgaggagctccttatattaatttattactggtacaggtctatggttcacaaggagagaaaggtggttgggagcctgtttctaatcgacctgaaaaaacaatggaagaacgatggcaaggttatagcaagtatattcgtcctgaacaatacatgattggtttttctttctatgaggaaaatgctcaagaagggaatctttggtatgatattaattctcgcaaggacgaggacaaagcaaatggaattaacactgacataactggaacgcgtgccgaacggtatgcaaggtggcaacctaagacaggtggggttaagggaggtatcttctcctacgctattgaccgagatggtgtagctcatcaacctaaaaaatatgctaaacagaaagagtttaaggacgcaactgataacatcttccactcagattatagtgtctccaaggcattaaagacagttatgctaaaagataagtcgtatgatctgattgatgagaaagatttcccagataaggctttgcgagaagctgtgatggcgcaggttggaaccagaaaaggtgatttggaacgtttcaatggcacattacgattggataatccagcgattcaaagtttagaaggtctaaataaatttaaaaaattagctcaattagacttgattggcttatctcgcattacaaagctcgaccgttctgttttacccgctaatatgaagccaggcaaagataccttggaaacagttcttgaaacctataaaaaggataacaaagaagaacctgctactatcccaccagtatctttgaaggtttctggtttaactggtctgaaagaattagatttgtcaggttttgaccgtgaaaccttggctggtcttgatgccgctactctaacgtctttagaaaaagttgatatttctggcaacaaacttgatttggctccaggaacagaaaatcgacaaatttttgatactatgctatcaactatcagcaatcatgttggaagcaatgaacaaacagtgaaatttgacaagcaaaaaccaactgggcattacccagatacctatgggaaaactagtctgcgcttaccagtggcaaatgaaaaagttgatttgcaaagccagcttttgtttgggactgtgacaaatcaaggaaccctaatcaatagcgaagcagactataaggcttaccaaaatcataaaattgctggacgtagctttgttgattcaaactatcattacaataactttaaagtttcttatgagaactataccgttaaagtaactgattccacattgggaaccactactgacaaaacgctagcaactgataaagaagagacctataaggttgacttctttagcccagcagataagacaaaagctgttcatactgctaaagtgattgttggtgacgaaaaaaccatgatggttaatttggcagaaggcgcaacagttattggaggaagtgctgatcctgtaaatgcaagaaaggtatttgatgggcaactgggcagtgagactgataatatctctttaggatgggattctaagcaaagtattatatttaaattgaaagaagatggattaataaagcattggcgtttcttcaatgattcagcccgaaatcctgagacaaccaataaacctattcaggaagcaagtctacaaatttttaatatcaaagattataatctagataatttgttggaaaatcccaataaatttgatgatgaaaaatattggattactgtagatacttacagtgcacaaggagagagagctactgcattcagtaatacattaaataatattactagtaaatattggcgagttgtctttgatactaaaggagatagatatagttcgccagtagtccctgaactccaaattttaggttatccgttacctaacgccgacactatcatgaaaacagtaactactgctaaagagttatctcaacaaaaagataagttttctcaaaagatgcttgatgagttaaaaataaaagagatggctttagaaacttctttgaacagtaagatttttgatgtaactgctattaatgctaatgctggagttttgaaagattgtattgagaaaaggcagctgctaaaaaaa

SEQ ID NO: 8238 - protein, 1013 aa, Streptococcus pyogenes
MVYQLGSHDLVPKIRSVQMDKHLLVKRTLGCVCAATLMGAALATHHDSLNTVKAEEKTVQVQKGLPSIDSLHYLSENSKKEFKEELSKAGQESQKVKEILAKAQQADKQAQELAKMKIPEKIPMKPLHGSLYGGYFRTWHDKTSDPTEKDKVNSMGELPKEVDLAFIFHDWTKDYSLFWKELATKHVPKLNKQGTRVIRTIPWRFLAGGDNSGIAEDTSKYPNTPEGNKALAKAIVDEYVYKYNLDGLDVDVEHDSIPKVDKKEDTAGVERSIQVFEEIGKLIGPKGVDKSRLFIMDSTYMADKNPLIERGAPYINLLLVQVYGSQGEKGGWEPVSNRPEKTMEERWQGYSKYIRPEQYMIGFSFYEENAQEGNLWYDINSRKDEDKANGINTDITGTRAERYARWQPKTGGVKGGIFSYAIDRDGVAHQPKKYAKQKEFKDATDNIFHSDYSVSKALKTVMLKDKSYDLIDEKDFPDKALREAVMAQVGTRKGDLERFNGTLRLDNPAIQSLEGLNKFKKLAQLDLIGLSRITKLDRSVLPANMKPGKDTLETVLETYKKDNKEEPATIPPVSLKVSGLTGLKELDLSGFDRETLAGLDAATLTSLEKVDISGNKLDLAPGTENRQIFDTMLSTISNHVGSNEQTVKFDKQKPTGHYPDTYGKTSLRLPVANEKVDLQSQLLFGTVTNQGTLINSEADYKAYQNHKIAGRSFVDSNYHYNNFKVSYENYTVKVTDSTLGTTTDKTLATDKEETYKVDFFSPADKTKAVHTAKVIVGDEKTMMVNLAEGATVIGGSADPVNARKVFDGQLGSETDNISLGWDSKQSIIFKLKEDGLIKHWRFFNDSARNPETTNKPIQEASLQIFNIKDYNLDNLLENPNKFDDEKYWITVDTYSAQGERATAFSNTLNNITSKYWRVVFDTKGDRYSSPVVPELQILGYPLPNADTIMKTVTTAKELSQQKDKFSQKMLDELKIKEMALETSLNSKIFDVTAINANAGVLKDCIEKRQLLKK

SEQ ID NO: 8239 - DNA, 93 bp, Streptococcus pyogenes
ttgagaatttttcagaaaatccttgagaagactttattatcaaggtttgatgtcaatctctaccagttaatcatcaaaaaggagggcttgtca

SEQ ID NO: 8240 - protein, 31 aa, Streptococcus pyogenes
LRIFQKILEKTLLSRFDVNLYQLIIKKEGLS

SEQ ID NO: 8241 - DNA, 237 bp, Streptococcus pyogenes
atggctcaacaacgtcgtggcggattcaaacgccgtaaaaaagttgacttcatcgcagctaacaaaattgaatatgttgattacaaagatactgagcttcttagccgtttcgtttcagaacgtggaaaaattcttcctcgtcgtgtaacaggaacttcagctaaaaaccaacgtaaagtaacaacagcaatcaaacgtgctcgcgttatggctcttatgccttacgtaaacgaagac

SEQ ID NO: 8242 - protein, 79 aa, Streptococcus pyogenes
MAQQRRGGFKRRKKVDFIAANKIEYVDYKDTELLSRFVSERGKILPRRVTGTSAKNQRKVTTAIKRARVMALMPYVNED

SEQ ID NO: 8243 - DNA, 291 bp, Streptococcus pyogenes
atgttccagaaattaaagaatcttattgatcggtattcgtggttcgtttttataatgatgattcttgtgttatttcttaactatatttatccatttgatccttctttgagcggactacagttggaatggctgatcatgacgcaagtttttcctggattaggtatcgtatgtgccatggttgctattatttttaaaaagtttaacctttttgttttggccctaattttatattttgcactttggttaaaacttttccttgctttttcttttttcacctattttttaggagtc

SEQ ID NO: 8244 - protein, 97 aa, Streptococcus pyogenes
MFQKLKNLIDRYSWFVFIMMILVLFLNYIYPFDPSLSGLQLEWLIMTQVFPGLGIVCAMVAIIFKKFNLFVLALILYFALWLKLFLAFSFFTYFLGV

SEQ ID NO: 8245 - DNA, 501 bp, Streptococcus pyogenes
atgatggaatcatatgaacacttttatgccaaactatctcaaccttttagaaaaaccccacagttaataattcttttaaatgttttactaaaaataatcacaggagtgatgtacatactttatccatcttttctgatatttacgctttggcaagggatgacatttcaattatggttaaggttattaattattcctgctgttggctttatagctttgtcttacattaggaaacgctttgattttccacgaccgtatgaaaaatggaatattaaacctttaattgataaggatacaaagggaaggtcaatgcctagcagacatgttttttcagctacgatgattagtatgtgtttgttacgatattatgtttactttggaatagtttgtttaatattatcggctttattggcaatttgccgtgtgatagcaggtattcactatcctaaggatgttattgtaggttaccttattggcttgatgttagggctttgtttattgatt

SEQ ID NO: 8246 - protein, 167 aa, Streptococcus pyogenes
MMESYEHFYAKLSQPFRKTPQLIILLNVLLKIITGVMYILYPSFLIFTLWQGMTFQLWLRLLIIPAVGFIALSYIRKRFDFPRPYEKWNIKPLIDKDTKGRSMPSRHVFSATMISMCLLRYYVYFGIVCLILSALLAICRVIAGIHYPKDVIVGYLIGLMLGLCLLI

SEQ ID NO: 8247 - DNA, 117 bp, Streptococcus pyogenes
gtggacaaaatgtttgagtggcggactagcgtttctagtatcgcttctttttttgaacatgttactgtctatttttgcaacggtccctatgccttttttacagcactatttgcactc

SEQ ID NO: 8248 - protein, 39 aa, Streptococcus pyogenes
VDKMFEWRTSVSSIASFFEHVTVYFCNGPYAFFTALFAL

SEQ ID NO: 8249 - DNA, 105 bp, Streptococcus pyogenes
ttgttgaaacagtcacaaactgtattagaatgtatttttttggctttagatagcctaaaaggtataatagagaaaggagggacttatgcttatttttccactgat

SEQ ID NO: 8250 - protein, 35 aa, Streptococcus pyogenes
LLKQSQTVLECIFLALDSLKGIIEKGGTYAYFSTD

SEQ ID NO: 8251 - DNA, 90 bp, Streptococcus pyogenes
atgtatctaaacgtgcttaatccaattgtacctactaaaaataaggccacattttctctttcacgaatggcttttgcgagtcatttttat

SEQ ID NO: 8252 - protein, 30 aa, Streptococcus pyogenes
MYLNVLNPIVPTKNKATFSLSRMAFASHFY

SEQ ID NO: 8253 - DNA, 96 bp, Streptococcus pyogenes
gtgaccaaatcaactttaaaagagttaagaacaacaaagaaaatgacacagcaggaattgttctcacttaacaggtatttctgtcagaacgattgc

SEQ ID NO: 8254 - protein, 32 aa, Streptococcus pyogenes
VTKSTLKELRTTKKMTQQELFSLNRYFCQNDC

SEQ ID NO: 8255 - DNA, 186 bp, Streptococcus pyogenes
atggctaaagtatgttattttacaggacgtaaaaccgtttctggaaacaaccgttcacacgcgatgaaccaaacaaaacgtacagttaaaccaaaccttcaaaaagttactatccttgttgatggtaaacctaaaaaagtttgggcttctgctcgtgcgcttaaatctggtaaagtagaacgcatc

SEQ ID NO: 8256 - protein, 62 aa, Streptococcus pyogenes
MAKVCYFTGRKTVSGNNRSHAMNQTKRTVKPNLQKVTILVDGKPKKVWASARALKSGKVERI

SEQ ID NO: 8257 - DNA, 117 bp, Streptococcus pyogenes
atgactgaaaaagaaagtgctaacctaaaaatatcacgtttttctttttctaatgctatttttatagaaaagatccctttaatagctagtaatctttatcagtatctgccagccaag

SEQ ID NO: 8258 - protein, 39 aa, Streptococcus pyogenes
MTEKESANLKISRFSFSNAIFIEKIPLIASNLYQYLPAK

SEQ ID NO: 8259 - DNA, 2976 bp, Streptococcus pyogenes
atgggaaatcaaactaaaacggaacttgaacttgaaaaagagttgatccatctcttagaaacaggtgaaagtcaatggacatatcgtaaagaattaaaaactgaagatgctttatgggataatttctttaagatcttagcgcaaaataacacgcaatatctgaacgaggagcctttaacagctagtgaaaaagagcagattaagaatcaacttaactttgtcaattactatgaagcggctaaatggttagctggtgaaaacggcattgctaaagtacaagtgcaacgcgaagatgcaaaactaggaacgattcgtttagaagtcgttaaagcagacaatgtggctggtggaacttctgtttatgagattgccaatcaagttgctttctctggttctcgtgatagacgaggtgatgtgacacttctcatcaatggcttacctatgatccaaattgaattaaaatctcagaatcatcaatgcattgaagcttttaaccaagtcaaaaagtatgataaagaaggccagtttagaggtatcttttcaaccttacaaatgtttgtggtctcaaataaaacagatacaaggtatatcgctgcagctaaagaaaataaattaaaccctaacttcttgacccaatgggtagatcaaaacaacaaaccacaaaaagatctctttgcctttgccaaagaagtcctatctatccctcgtgctcaccaaatggtcatgacttactctgtcattgatgatgataaaaaagcactaattctccttcgtccttatcagattcatgcaatcgaagccgtcgctgaagcgagtcgtcaccgcaagtctggctatatctggcacacaacaggttctggaaaaaccttaacttcctataaagtggctcgcaatatccttcaaataccggccgttgaaaaatccatctttgtcattgaccgaaaggatttagataatcagaccgcttctgcttttcaatcctatgcgcaaaatgatatctttgatgtcgatgagacagaagatacgagacaactcatcaaaaatttagaatccagcgatcgtcgtgttgtggtcaccaccattcaaaaactcaatgccatgatcagtcagatggaaagttatgacactccaaaattcaagaaactaaaagagcgtcttgcacacttaaatgttgtctttgttgtggacgaatgccaccgtgctgtcacgccagaacgtcaacgttatctcacgaatacttttcgtaacagtcgctggtatggctttaccggcactcctatctttgtggaaaataagcgtgctcaattaggtgatttagcccaaacaacggaacagcaatacggcaaatgtctccatcaatacaccgttaaagaagccattcatgataaagcggttctaggctttcaagttgagtataagacaaccattcctgatatgcctgaagacagtattccggaagaagcttatgatcatgaagaacatatgttagctgtcttagatagtatcattaatcaatcacgcaagaaacttggttttaataatggaattggtcagacattcgaaggtttactaaccgttaagagtattgctcgtgcccaagcctattatgatctgatgaagaaagttaaggctggtgaaacggatttagtcatttctaagaaggtcaaagaaaaactaccagactttccaaaggtagctattacttattctatcactgaaaatgacaatgcgtctatcagccgacaagataaaatgaccaaaaatctagaagactataatcacctctttggcactaactttaccatcgataacttacaaggctataacagagatttaaatgatcgcttagcccgtaaaaaagataaattcaaagaccgtcatgaacaattagacctcgtgattgtggttgaccgtctcttaacaggttttgatgcgccttgtttatcaacgatctttattgatcgccagcctatgaaacctcagcacattattcaagctttctcacgaaccaaccgtatctttgaaagtagaaaacattacggtcaggttgtgactttccaaacaccacttcgttttaaagaagctgtcgacaaagcgcttagcctctactctaatgggggtgaaaacgacgttttggccccttcttgggaagaagaaaaagcaagattctttgaaaaagtaacagtattaaaaaatatagttcctgatccagacgctttcccaactattgagagcgcacagacagcttttctcaaacaatacgccaaagcctttcaagcgtttgataaactctttgcatctgtacaggtctatagtgattttaatgaaacactgttgagtgaggttgggttatcagatgaagtgattgatacttataaaggcacttaccaaaatgtcattgcagaaatacgaaagcgaagagaagatgacgaagccatcccagagatcaatatcgactatgagctagaaagtgttcagatggatgatatcaactatcactatatcttgaccttaattcaagcctttgtcgatcaagaacaagaagctcttcaagaaaggctcaatgacaatcctatggatcaatacatccaagatttggcaaaatcaaaccctgctatggctgactcactagctgagttatggcaagatatccaaaaagaacccaaagcctatgaagggaaaagcattgtttatgagttagataacctcattggtgataagatccaaagggccatcaaacactttgcggaccaatggaaggcagatcctgacaaattagcctttgtggcgactaattatcatagtgctaactctaccaaacaagtgggcatgtcaaccttaaaagaatccctagactaccaagcctataaagaaaaacaaggtgattctgccatgaataaactcaaatacaagagccaatttgaacgggagttagttcaattcattagagatcaaatccaacccttaaaagggcac

SEQ ID NO: 8260 - protein, 992 aa, Streptococcus pyogenes
MGNQTKTELELEKELIHLLETGESQWTYRKELKTEDALWDNFFKILAQNNTQYLNEEPLTASEKEQIKNQLNFVNYYEAAKWLAGENGIAKVQVQREDAKLGTIRLEVVKADNVAGGTSVYEIANQVAFSGSRDRRGDVTLLINGLPMIQIELKSQNHQCIEAFNQVKKYDKEGQFRGIFSTLQMFVVSNKTDTRYIAAAKENKLNPNFLTQWVDQNNKPQKDLFAFAKEVLSIPRAHQMVMTYSVIDDDKKALILLRPYQIHAIEAVAEASRHRKSGYIWHTTGSGKTLTSYKVARNILQIPAVEKSIFVIDRKDLDNQTASAFQSYAQNDIFDVDETEDTRQLIKNLESSDRRVVVTTIQKLNAMISQMESYDTPKFKKLKERLAHLNVVFVVDECHRAVTPERQRYLTNTFRNSRWYGFTGTPIFVENKRAQLGDLAQTTEQQYGKCLHQYTVKEAIHDKAVLGFQVEYKTTIPDMPEDSIPEEAYDHEEHMLAVLDSIINQSRKKLGFNNGIGQTFEGLLTVKSIARAQAYYDLMKKVKAGETDLVISKKVKEKLPDFPKVAITYSITENDNASISRQDKMTKNLEDYNHLFGTNFTIDNLQGYNRDLNDRLARKKDKFKDRHEQLDLVIVVDRLLTGFDAPCLSTIFIDRQPMKPQHIIQAFSRTNRIFESRKHYGQVVTFQTPLRFKEAVDKALSLYSNGGENDVLAPSWEEEKARFFEKVTVLKNIVPDPDAFPTIESAQTAFLKQYAKAFQAFDKLFASVQVYSDFNETLLSEVGLSDEVIDTYKGTYQNVIAEIRKRREDDEAIPEINIDYELESVQMDDINYHYILTLIQAFVDQEQEALQERLNDNPMDQYIQDLAKSNPAMADSLAELWQDIQKEPKAYEGKSIVYELDNLIGDKIQRAIKHFADQWKADPDKLAFVATNYHSANSTKQVGMSTLKESLDYQAYKEKQGDSAMNKLKYKSQFERELVQFIRDQIQPLKGH

SEQ ID NO: 8261 - DNA, 1197 bp, Streptococcus pyogenes
atgacaaaatctaaacagcctcaatatcgctttgacggttttgaaggggagtgggaagaaaaagaactaggggatattgttcaaattacaatgggccaatctccatcaagtcaaaattatactacaaacccttctgattatattctagtacaaggaaatgccgatataaaaaatggatatgtttttccgcgtgtctggacaacacaaattacaaaacaagctgacaaaggtgatattattcttagtgttagggctccagttggtgatgttggaaagacaaattatcatgttattattgggcgtggagttgctgctataaaaggtaatgaatttatctttcaaatattaaaatacttgaaagaaattggttattggaaaagaattagtacaggttcaacttttgatagcattagctctagtgatatcaaatatgctaaaattcaaattccctccctccctgaacaagaagccattggcgaacttttccaaatggttgatcaattgattcagttgcaggatcaaaagctagcaacccttaaagaacaaaagcaaaccttcctcaggaaaatgttcccagctcaaggacaaaaagtccctgaaatccgtttacaaggttttaaaggagagtgggaagagaagaaattgagggaagtatctactcatagaagtggaacggcaattgaaaaatattttgattcggaaggtgaatttaaagtcatttcaataggtagttatggaactaataacctctatgtagaccaaaatattagagcagtctcaaatgaacttactaattctaaattagttgcctccggtgaattaacaatggtactcaatgataagacagcgaatggggcaataatcggaagatgtctacttattacagaaaataataaatacgttgttaatcaaagaacagaaattattagaccagatattaatatttcctcttactatcttttccattatttaaatggcgaatttcgtaatggtatcattaaaattgctcaaggtggcactcaaatctatgtaaattattcatctgttgaacaattaaagataaatatacctacattaaaagaacaagaagccattggtaatttcttccaaactttagaccaacaaattgctcaatctgaagaaaaactaacagaactcaaagcactcaaacaaacattactcaatcgtttattcgta

SEQ ID NO: 8262 - protein, 399 aa, Streptococcus pyogenes
MTKSKQPQYRFDGFEGEWEEKELGDIVQITMGQSPSSQNYTTNPSDYILVQGNADIKNGYVFPRVWTTQITKQADKGDIILSVRAPVGDVGKTNYHVIIGRGVAAIKGNEFIFQILKYLKEIGYWKRISTGSTFDSISSSDIKYAKIQIPSLPEQEAIGELFQMVDQLIQLQDQKLATLKEQKQTFLRKMFPAQGQKVPEIRLQGFKGEWEEKKLREVSTHRSGTAIEKYFDSEGEFKVISIGSYGTNNLYVDQNIRAVSNELTNSKLVASGELTMVLNDKTANGAIIGRCLLITENNKYVVNQRTEIIRPDINISSYYLFHYLNGEFRNGIIKIAQGGTQIYVNYSSVEQLKINIPTLKEQEAIGNFFQTLDQQIAQSEEKLTELKALKQTLLNRLFV

SEQ ID NO: 8263 - DNA, 1578 bp, Streptococcus pyogenes
atggcagagaaaacaacttcactccgtcaagcactatggcattcggccgaccaattacgtggccaaatggatgccaatgactataaaaactatcttcttggacttattttttacaaacacttatctgataaattactcttggctgtttgtgataatctagaaaaacacttcaatacctttacagaggctcaaaaaatctttgaagatgcttatcaagatgaaggcctaaaagatgacctcatttctgttgttactggtgatttaggttactttatcgaaccgacactgacctttgaaaaactcatccaagatgtttatcacaatactttccaattagaatcattagctcaaggttttcgcgatattgaacaaagtggtgaagactttgaaaacttatttgaagatattgacctctactctaaaaaattaggctctactcctcaaaaacaaaatcaaaccatttctaatgtcatgaaaacattaaatgaaattgactttgaggcagtagatggggatactttaggtgatgcttatgagtacttgattggtgaatttgccagtgaatcaggaaaaaaagcaggtgagttctataccccacaagctgtctctcacttaatgactcagattgtctttttaggtcgtgaagatcaaaaaggaatgaccctctatgaccctgctatgggatctggatcactccttttaaatgctaagaaatatagtaaccaatccgataccgtttcttactatggtcaagaaatcaatacttctacttataacttggctcgtatgaacatgatgcttcatggcgttgccatcgagaaccaacacttaagtaacgctgataccttggatgcagactggccaacagatgaaccaatcaactttgatggggtgttgatgaacccaccttattctttgaaatggtcagcgactgctggtttcttaacggatccacggttttcaagttatggtgtattagcaccaaaatcaaaagccgattttgcctttttacttcatggtttctatcatttaaaaaatacaggaactatggcgattgtcttaccacacggtgtccttttccgtggagctgcagaaggcaagattcgccaaaaactactcgaacaaggggctatcgataccattatcggactcccatcaaatatcttttataatacaagcatccctacgactattatcatattaaagaagaacagaaccaacaaagatgtcttctttatcgatgcttcaaaagagtttgataagggtaaaaatcaaaacacaatgacagataaccatatcaaaaagatccttgatgcttataagagtcgtgataattctgataagttttcatatttagcctcatttgatgaaatcattgaaaatgactataacttaaatatcccacgctatgttgatacctttgaggaagtcccagttaaaccactgccagaattagctaaacagctcagtgacattgatcaagaaattgccaaaacaaatgccaaactagatcaactcatgaaacaactagtcggaacaaccaaagaagcacaagacgaattggatacttttagaaac

SEQ ID NO: 8264 - protein, 526 aa, Streptococcus pyogenes
MAEKTTSLRQALWHSADQLRGQMDANDYKNYLLGLIFYKHLSDKLLLAVCDNLEKHFNTFTEAQKIFEDAYQDEGLKDDLISVVTGDLGYFIEPTLTFEKLIQDVYHNTFQLESLAQGFRDIEQSGEDFENLFEDIDLYSKKLGSTPQKQNQTISNVMKTLNEIDFEAVDGDTLGDAYEYLIGEFASESGKKAGEFYTPQAVSHLMTQIVFLGREDQKGMTLYDPAMGSGSLLLNAKKYSNQSDTVSYYGQEINTSTYNLARMNMMLHGVAIENQHLSNADTLDADWPTDEPINFDGVLMNPPYSLKWSATAGFLTDPRFSSYGVLAPKSKADFAFLLHGFYHLKNTGTMAIVLPHGVLFRGAAEGKIRQKLLEQGAIDTIIGLPSNIFYNTSIPTTIIILKKNRTNKDVFFIDASKEFDKGKNQNTMTDNHIKKILDAYKSRDNSDKFSYLASFDEIIENDYNLNIPRYVDTFEEVPVKPLPELAKQLSDIDQEIAKTNAKLDQLMKQLVGTTKEAQDELDTFRN

SEQ ID NO: 8265 - DNA, 669 bp, Streptococcus pyogenes
atgataagaataaaaaacataacaaagagtaagttctttgggactgcaataatcttgttgcaacaattaatagccttgttaattttggtctataatcgagagaacctgtctcttcttttctctgaaaaagtagctcttgtaatgacccttattgatacagcttttatttggctggcaacaatattacgccaaaaacaaggtgatatttttaaaaggattatttctatcatctccttaacaatttggcaatacttagtatctgtgctgacaagaggaactcctctctttttaagcagtggactacagattatattgctctattgttataccgttgagattactaatttaatattatatgggcacaaacaatttaaagataagttagataagggcttgttaataattatttttgtttctataactagcctttttgttaatagaattttatttaattttttattcctgatggtttttactattttacacctgtatccgttactagttatagtgctatattataggtcctttaggcaacaaatatcagttgttagacgttcattgatactattttctttacttttgctggtaatacttggtagtgaactttatggagaaatgctagatgttaatcaagcctttaataatttgggatggtatctgtttccctta

SEQ ID NO: 8266 - protein, 223 aa, Streptococcus pyogenes
MIRIKNITKSKFFGTAIILLQQLIALLILVYNRENLSLLFSEKVALVMTLIDTAFIWLATILRQKQGDIFKRIISIISLTIWQYLVSVLTRGTPLFLSSGLQIILLYCYTVEITNLILYGHKQFKDKLDKGLLIIIFVSITSLFVNRILFNFLFLMVFTILHLYPLLVIVLYYRSFRQQISVVRRSLILFSLLLLVILGSELYGEMLDVNQAFNNLGWYLFPL

SEQ ID NO: 8267 - DNA, 1623 bp, Streptococcus pyogenes
atgataaaaagaaatgaattaaagttagagtatcagcaacatcagttttacgaatactttaactcaatttttgactatgacatattagatacttctattagagaaaccagtgaagtgttaaggaaaaagacacataagttattttatagtgagtttgaaaatcagttatttgaaacgatcatgttcctttcgatgaaaacactagttttagatataaatcatttttccaaggaaattgaaaataagtcagaggcatatgagcagtatatacagcagataagagaagaaaacggaataaatcatttttttgacaggtatccgtatttgctaaaacaaattaataaagaagtaggactgatagaggaatcatattctttattatttgatagatttttagaagacttatctgagataaagtcgtgctttaacattagtgagcccctaagcaatgttgccttttcacttggtgacagtcactctaaaaagcaaacagtcgttaaaattgcgtttaaagagaaatctgtttactacaagcctaaaagttatcattcacacagtatcttgttagaacttactagtttattgaaatctagtaatataccctcattcagtcttcctaaaagcttagttaaagcagattattgttggcaacttggtgtagcttatacaagttccaataaagatgaagtagcgaaaatttactttaagtatggtgttttagcagcattttctgaaatattttctattacggacttacatatggaaaatgtgattgtttcaggcggagatttatatttaattgacgttgaaacattttttcaaagaaagttgaatgtacaaaatcagaattttgaagggattactgtagacacctatcagagaatttatgagacatcactttcaaacggtttatttcctgtacaatttgagaaaaacagcgctcctaacgtttctggaataagtcgaaaaggtggaaaaagacaaaaaggaaaatatgaactgatcaataaaaatcgtggagatctgaagttagtaaaagttgactattttcaagaagatcggttcaatattcccacattaaatgggaaagtggtagagcctcttgactatgctaatgagatcatttcaggatttagagagtgctacatatttcttctatcacaacgttcaaagattaaagaaatagtagaaggttttccagaattgaaaagcagagtcccatttcgaaatacttccgactatggaaaatttttgcaagcttctacgaatccaaaatatcttttctcagaaaaaaagaggaagaatttattttcgatactatatgagacaaaacatattgaacattttattgttgataatgaaattaaagatttgatgaatggtgatattccttacttttcaatggataccagaggaaacgtctataattctgtagggacattaattggaaatctaggagatacaacctcgttatttgatagtataactattttgaacgatgaaagattgaagttcacttgtgaattgcttgaaatagtcttgaaaaaaccgattaagcattgggagagggaaaagggcaaatcttatcagtttttatcaatctcctcagaacattaccttctc

SEQ ID NO: 8268 - protein, 541 aa, Streptococcus pyogenes
MIKRNELKLEYQQHQFYEYFNSIFDYDILDTSIRETSEVLRKKTHKLFYSEFENQLFETIMFLSMKTLVLDINHFSKEIENKSEAYEQYIQQIREENGINHFFDRYPYLLKQINKEVGLIEESYSLLFDRFLEDLSEIKSCFNISEPLSNVAFSLGDSHSKKQTVVKIAFKEKSVYYKPKSYHSHSILLELTSLLKSSNIPSFSLPKSLVKADYCWQLGVAYTSSNKDEVAKIYFKYGVLAAFSEIFSITDLHMENVIVSGGDLYLIDVETFFQRKLNVQNQNFEGITVDTYQRIYETSLSNGLFPVQFEKNSAPNVSGISRKGGKRQKGKYELINKNRGDLKLVKVDYFQEDRFNIPTLNGKVVEPLDYANEIISGFRECYIFLLSQRSKIKEIVEGFPELKSRVPFRNTSDYGKFLQASTNPKYLFSEKKRKNLFSILYETKHIEHFIVDNEIKDLMNGDIPYFSMDTRGNVYNSVGTLIGNLGDTTSLFDSITILNDERLKFTCELLEIVLKKPIKHWEREKGKSYQFLSISSEHYLL

SEQ ID NO: 8269 - DNA, 153 bp, Streptococcus pyogenes
atgagttttatgaaaaattcaaaggatattttgactaatgctatcgaagaagtttctgaaaaagaacttatggaagtagctggtggtaaaaaaggttccggttggtttgcaactattactgatgactgtccgaactcagtatttgtttgttgt

SEQ ID NO: 8270 - protein, 51 aa, Streptococcus pyogenes
MSFMKNSKDILTNAIEEVSEKELMEVAGGKKGSGWFATITDDCPNSVFVCC

SEQ ID NO: 8271 - DNA, 93 bp, Streptococcus pyogenes
ttgatgacagtaatggcaaccattctagaggtgaaatatatagctgtctgcctatttccacgttattcatcagaaaaaggaacagtacaagac

SEQ ID NO: 8272 - protein, 31 aa, Streptococcus pyogenes
LMTVMATILEVKYIAVCLFPRYSSEKGTVQD

SEQ ID NO: 8273 - DNA, 183 bp, Streptococcus pyogenes
ttgaaccgtccaatagttttctattcgtgtctttttccgctttggcataatgatttcagccatagggttatgcttgagcagtttcatcttgatggcaaaatcaaagaccttttcagtgtaggacttgatttgcttgatattcttaaaggtctttgctttatcggtgatgaagttctagcagtc

SEQ ID NO: 8274 - protein, 61 aa, Streptococcus pyogenes
LNRPIVFYSCLFPLWHNDFSHRVMLEQFHLDGKIKDLFSVGLDLLDILKGLCFIGDEVLAV

SEQ ID NO: 8275 - DNA, 537 bp, Streptococcus pyogenes
atgtcatataaagatttaaaggagaaacgaatcatgtttgatagcaaacaaaatctcgctaagtcacaatggggtttcattgtcataacagcagtgatggatctagttgtgatagtagcaacattactggctaagaccagttttcaacgttacttagttggaggcgtagcttttgtattgactagctttctcatattgttggtatgggggctaaagacagcgaaaaagctccaaacgagactagacagcaaggaagtactagattctaaggtaagggacgatcagaagttgcccaaatatgatgaacgccaaaaacagattcttctcaaaggatacactattgggttttggtttatgattgtggttatctggctgtcactctttattagccgattcacagagggactggtatctgcaagcttcctctttacattggctctttggggagggttggcagttcaaacgacatattgtaaccttagtatgggagctagtattttctatcgtcattatctggatgctaaagaggcagatgaa

SEQ ID NO: 8276 - protein, 179 aa, Streptococcus pyogenes
MSYKDLKEKRIMFDSKQNLAKSQWGFIVITAVMDLVVIVATLLAKTSFQRYLVGGVAFVLTSFLILLVWGLKTAKKLQTRLDSKEVLDSKVRDDQKLPKYDERQKQILLKGYTIGFWFMIVVIWLSLFISRFTEGLVSASFLFTLALWGGLAVQTTYCNLSMGASIFYRHYLDAKEADE

SEQ ID NO: 8277 - DNA, 795 bp, Streptococcus pyogenes
atgacaactatgcaaaaaacaattagcttattatcactagctttacttattggtttgctggggacttctggcaaagccatatctgtgtatgcacaagatcagcacactgataatgttatagctgaatcaactattagtcaggtcagtgttgaagccagtatgcgtggaacagaaccttatattgatgctacagtcaccacagatcaacctgtcagacaaccaactcaggcaacgataacacttaaagacgctagtgataatactattaatagttgggtatatactatggcagcgcaacagcgtcgttttacagcttggtttgatttaactggacaaaagagtggtgactatcatgtaactgtcaccgttcatactcaagaaaaggcagtaactggtcaatcaggaactgttcattttgatcaaaacaaagctagaaaaacaccaactaatatgcaacaaaaggatacttctaaagcaatgacgaattcagtcgatgtagacacaaaagctcaaacaaatcaatcagctaaccaagaaatagattctacttcaaatcctttcagatcagctactaatcatcgatcaacttccttaaagcgatctactaaaaatgagaaacttacaccaactgctagtaatagccaaaaaaacggtagcaacaagacaaaaatgctagtggacaaagaggaagtaaaacctacttcaaaaagaggattcccttgggtcttattaggtctagtagtcagtttagctgcaggtttatttatagctattcaaaaagtatctagacgaaaa

SEQ ID NO: 8278 - protein, 265 aa, Streptococcus pyogenes
MTTMQKTISLLSLALLIGLLGTSGKAISVYAQDQHTDNVIAESTISQVSVEASMRGTEPYIDATVTTDQPVRQPTQATITLKDASDNTINSWVYTMAAQQRRFTAWFDLTGQKSGDYHVTVTVHTQEKAVTGQSGTVHFDQNKARKTPTNMQQKDTSKAMTNSVDVDTKAQTNQSANQEIDSTSNPFRSATNHRSTSLKRSTKNEKLTPTASNSQKNGSNKTKMLVDKEEVKPTSKRGFPWVLLGLVVSLAAGLFIAIQKVSRRK

SEQ ID NO: 8279 - DNA, 228 bp, Streptococcus pyogenes
atgaataaaataagagttgggctgtatgtcattatgagtttgtctattcttgtttctagtattacactggtggctagtctaatctttttactgagacaagacatggttaaagcgattatatacttcattttgaccctattttggttaataggtttggttattaatattaaattgttgaaaaggtggaacagcatttcagaaaaagacttaggatatcaagatgacaac

SEQ ID NO: 8280 - protein, 76 aa, Streptococcus pyogenes
MNKIRVGLYVIMSLSILVSSITLVASLIFLLRQDMVKAIIYFILTLFWLIGLVINIKLLKRWNSISEKDLGYQDDN

SEQ ID NO: 8281 - DNA, 159 bp, Streptococcus pyogenes
gtggatttcggtgttttagggattttactgggccgcttaggaacgtcgattggtcaaatcggtatttacttggtggttgctgtgcttgctattgtattggtgcttccaaactttctgtcaaaatctcaagaagccatcaataatgtttcagtagaaatc

SEQ ID NO: 8282 - protein, 53 aa, Streptococcus pyogenes
VDFGVLGILLGRLGTSIGQIGIYLVVAVLAIVLVLPNFLSKSQEAINNVSVEI

SEQ ID NO: 8283 - DNA, 96 bp, Streptococcus pyogenes
ttgaccaataactggtccaccatcgtttcaacagctggcgaagctaaaggaaaagtatccactgcttcagcccttacgttccgtgaaaatggtcga

SEQ ID NO: 8284 - protein, 32 aa, Streptococcus pyogenes
LTNNWSTIVSTAGEAKGKVSTASALTFRENGR

SEQ ID NO: 8285 - DNA, 93 bp, Streptococcus pyogenes
gtgatgaggtatcttttgttgtatcatgaagaaaaagggaatcaattcccagatttgcctatttttgaccaccttttgaggaacttgttacaa

SEQ ID NO: 8286 - protein, 31 aa, Streptococcus pyogenes
VMRYLLLYHEEKGNQFPDLPIFDHLLRNLLQ

SEQ ID NO: 8287 - DNA, 141 bp, Streptococcus pyogenes
ttggacttcgtcgttaatttcaagtttaaaaagtcctctgcttatgcagtgggctttttcatttttgacatgttgtttgttaacttacacatttggctagaatggtctaagactgtttttttagcagttgatgattttatt

SEQ ID NO: 8288 - protein, 47 aa, Streptococcus pyogenes
LDFVVNFKFKKSSAYAVGFFIFDMLFVNLHIWLEWSKTVFLAVDDFI

SEQ ID NO: 8289 - DNA, 153 bp, Streptococcus pyogenes
atgactatgctaggttaccgcttatcagctgaagtgcggggatcagccatcttacctcttttagctggttatcttattaggcaagcaatcgcacaggtttattctgatttaaaaacagcctcttggctatttggccttgctagttctgttgct

SEQ ID NO: 8290 - protein, 51 aa, Streptococcus pyogenes
MTMLGYRLSAEVRGSAILPLLAGYLIRQAIAQVYSDLKTASWLFGLASSVA

SEQ ID NO: 8291 - DNA, 105 bp, Streptococcus pyogenes
gtgccattgaaagccattaaggcggggaaagtttggatgaaatatgccaaacttttttgttttgatccctggattgaaacagttattctgatgctaacaggttca

SEQ ID NO: 8292 - protein, 35 aa, Streptococcus pyogenes
VPLKAIKAGKVWMKYAKLFCFDPWIETVILMLTGS

SEQ ID NO: 8293 - DNA, 102 bp, Streptococcus pyogenes
atgccaccagtggttgttcattattcttctcctattaatcattcattcatcttttattttaacgttttttctctttttgtgcaatcgtttgcgcaaataaca

SEQ ID NO: 8294 - protein, 34 aa, Streptococcus pyogenes
MPPVVVHYSSPINHSFIFYFNVFSLFVQSFAQIT

SEQ ID NO: 8295 - DNA, 141 bp, Streptococcus pyogenes
atgatagatcgttcagcttgttttggctcctgtgaccggcctgtgtttacatggttttcttgttttatgggtctttacgacttgactagccctgctattgtgcaagttgcccaaagaagtttggtcgctttgtctctgttt

SEQ ID NO: 8296 - protein, 47 aa, Streptococcus pyogenes
MIDRSACFGSCDRPVFTWFSCFMGLYDLTSPAIVQVAQRSLVALSLF

SEQ ID NO: 8297 - DNA, 1320 bp, Streptococcus pyogenes
atgaaaaattacttatctattggagtgattgcactgctgtttgcattaacatttggaacagtcaagtcggtccaagctattgctgggtatggatggctaccagaccgtccacctatcaataacagccagttagttgttagtatggccggtatcgttgaaggtaccgataaaaaagtttttataaatttttttgaaatcgatctaacatcacaacctgctcacggaggaaagacagagcagggcttaagtccaaaatcaaaaccatttgctacagataatggcgcaatgccacataaacttgaaaaagctgacttattaaaagctattcaaaaacagctgatcgctaacgttcacagtaacgacggctactttgaggtcattgattttgcaagcgatgcaaccattactgatcgaaacggcaaggtctactttgctgacaaagatggttcggtaaccttgccgacccaacctgtccaagaatttttgttaaagggacatgtgcgcgttagaccatataaagaaaaaccagtacaaaatcaagcaaaatctgttgatgtagaatatactgtacagtttactcctttaaaccctgatgacgatttcagaccagggctcaaagatactaagctattgaaaacactagctatcggtgacaccatcacatctcaagaattactagctcaagcacaaagcattttaaacaaaacccacccaggctatacgatttatgaacgtgactcctcaatcgtcactcatgacaatgacattttccgtacgattttaccaatggatcaagagtttacttaccatgtcaaaaatcgggaacaagcttatgagatcaatcctaaaacaggtattaaagaaaaaacgaacaacactgatctggtctctgagaaatattacgtccttaaacaaggggaaaagccgtatgatccctttgatcgcagtcacttgaaactgttcaccatcaaatacgttgatgtcaacaccaacgaattgctaaaaagcgagcagctcttaacagctagcgaacgtaacttagacttcagagatttatacgatcctcgtgataaggctaaactactctacaacaatctcgatgcttttgatatcatggactataccttaactggaaaagtagaggataatcacgataagaataatcgtgtcgttacagtttatatgggcaagcgccctaaaggggcaaagggtagctatcatttagcttatgataaagatctctataccgaagaagaacgaaaagcttacagctacctgcgtgatacagggacacctatacctgataaccctaaagacaaa

SEQ ID NO: 8298 - protein, 440 aa, Streptococcus pyogenes
MKNYLSIGVIALLFALTFGTVKSVQAIAGYGWLPDRPPINNSQLVVSMAGIVEGTDKKVFINFFEIDLTSQPAHGGKTEQGLSPKSKPFATDNGAMPHKLEKADLLKAIQKQLIANVHSNDGYFEVIDFASDATITDRNGKVYFADKDGSVTLPTQPVQEFLLKGHVRVRPYKEKPVQNQAKSVDVEYTVQFTPLNPDDDFRPGLKDTKLLKTLAIGDTITSQELLAQAQSILNKTHPGYTIYERDSSIVTHDNDIFRTILPMDQEFTYHVKNREQAYEINPKTGIKEKTNNTDLVSEKYYVLKQGEKPYDPFDRSHLKLFTIKYVDVNTNELLKSEQLLTASERNLDFRDLYDPRDKAKLLYNNLDAFDIMDYTLTGKVEDNHDKNNRVVTVYMGKRPKGAKGSYHLAYDKDLYTEEERKAYSYLRDTGTPIPDNPKDK

SEQ ID NO: 8299 - DNA, 96 bp, Streptococcus pyogenes
ttgggatctctcaggcgtgagcatgataccaaaggcctgctcccgaccaaaaatagagagaaccaaggggctctctctattatgtttgcttatcag

SEQ ID NO: 8300 - protein, 32 aa, Streptococcus pyogenes
LGSLRREHDTKGLLPTKNRENQGALSIMFAYQ

SEQ ID NO: 8301 - DNA, 537 bp, Streptococcus pyogenes
ttgcttgtcagaagaggatttgttccatcatttatccccgcagtaattttttatggtatgataccaattaaagcgcttaagattaaggtggagactgttatgaaaataattgagtacaaaggaaattacagagatgacctcatttttatggtcttggaagcaaaaaatgccttaaggagaattcccagcattaacccggatcttttgacaattgaaacaagttatttggaaaaagaggattgtttttggctagcggtcaatgaagaaagtcgtgttattggctcaatcgcttattcttctattcccaaaacaaatgaggtcttcttgcaccgtctcttcatcaaaccaagcttaaaacatcaaggcattggcagtcaacttctggcgtttgcagaagattatctaaggaaaatcggcaagagtcatgttcgtatccacttaggtcaacctaaagaacaatggtttgaatcttatcggttttatcctaaacatggttatcaattctatgatgacacgcatctcatcaagaaactaatc

SEQ ID NO: 8302 - protein, 179 aa, Streptococcus pyogenes
LLVRRGFVPSFIPAVIFYGMIPIKALKIKVETVMKIIEYKGNYRDDLIFMVLEAKNALRRIPSINPDLLTIETSYLEKEDCFWLAVNEESRVIGSIAYSSIPKTNEVFLHRLFIKPSLKHQGIGSQLLAFAEDYLRKIGKSHVRIHLGQPKEQWFESYRFYPKHGYQFYDDTHLIKKLI

SEQ ID NO: 8303 - DNA, 93 bp, Streptococcus pyogenes
ttgagacatgatactaaaagtggattgacgcttttaattaagccgattagttatgaaacaagcaaaaaagcctttaaacaaaggctttcagtc

SEQ ID NO: 8304 - protein, 31 aa, Streptococcus pyogenes
LRHDTKSGLTLLIKPISYETSKKAFKQRLSV

SEQ ID NO: 8305 - DNA, 774 bp, Streptococcus pyogenes
ttgttaatgattatttcttttgaaagtgttatattaaaacataataaaataataactcctgaaaagaggctatttatgaaaaaaacaaaacttattttttcttttacttcaatattcattgcaataatttctcgtcctgtgtttggattagaagtagataataattcccttctaaggaatatctatagtacgattgtatatgaatattcagatacagtaattgattttaaaaccagtcataacttagtgactaagaaacttgatgttagagatgctagagatttttttattaactccgaaatggatgaatatgcagccaatgattttaaagatggagataaaatagctatgttctccgtcccatttgattggaactacttgtcagaaggaaaagtcatagcatatacctatggtggaatgacgccttatcaagaagaaccaatgtctaaaaatatccctgttaatttatggattaatagaaagcagattcctgtcccctataatcaaatatcaactaacaaaacaacagttacagctcaagaaattgatctaaaggttagaaaatttttaatatcacaacatcaattatattcttctggttctagctacaaaagtggtaaattagtttttcatacaaatgataattcagataaatattctctcgatcttttctatgtaggatatagagataaagaaagtatttttaaagtatacaaagacaataaatctttcaatatagataaaattgggcatttagatatagaaattgactcc

SEQ ID NO: 8306 - protein, 258 aa, Streptococcus pyogenes
LLMIISFESVILKHNKIITPEKRLFMKKTKLIFSFTSIFIAIISRPVFGLEVDNNSLLRNIYSTIVYEYSDTVIDFKTSHNLVTKKLDVRDARDFFINSEMDEYAANDFKDGDKIAMFSVPFDWNYLSEGKVIAYTYGGMTPYQEEPMSKNIPVNLWINRKQIPVPYNQISTNKTTVTAQEIDLKVRKFLISQHQLYSSGSSYKSGKLVFHTNDNSDKYSLDLFYVGYRDKESIFKVYKDNKSFNIDKIGHLDIEIDS

SEQ ID NO: 8307 - DNA, 264 bp, Streptococcus pyogenes
atgacttattttagattaaaaaaagaattaaactggtcactaagaaataaaggaattgtagtttacgaagggaatcaaaaacttcagatagccattaatacaggtgaaaataacagtgaaaaagtcttttttgatactttttttgaggtggttcgggcggcagcgactttctccacagcaaaaaacatctgttttggtcttggcttacttcgttcgcagaaacaggaaatcgggtatcacattagcagagtagttcatgttttt

SEQ ID NO: 8308 - protein, 88 aa, Streptococcus pyogenes
MTYFRLKKELNWSLRNKGIVVYEGNQKLQIAINTGENNSEKVFFDTFFEVVRAAATFSTAKNICFGLGLLRSQKQEIGYHISRVVHVF

SEQ ID NO: 8309 - DNA, 111 bp, Streptococcus pyogenes
atgctttgtcaatggcaactaccatcttttatcacagcaactgaagagataagcaaaagacaattgttgacagctatttgtcctaacttctttttgatgaggcagcacatc

SEQ ID NO: 8310 - protein, 37 aa, Streptococcus pyogenes
MLCQWQLPSFITATEEISKRQLLTAICPNFFLMRQHI

SEQ ID NO: 8311 - DNA, 1203 bp, Streptococcus pyogenes
atgttacacaaagaaaaacctgattataaccgcaatcagtacggtttctatacccttgaccagttagtgcctgatgaacatttcctgcgccaagtggaagctgtgattgacttcgacttcatctatgacctagtagaagacacctattcgtctgataatggtcgccctagccttgatcctgtcatgttggttaaaatccctctgattcagtgcttttatggcattcgttccatgcgtcagaccatcaaggatattgaagtgaatactgcctatcgctggtttttaggtttgactttggatgacaaggtgccacatttcacaacctatggcaaaaattattcccgtcgctttcaagaaaaaggcttgattgagtccatttttacgcatattgttgggctatgtatcaatacaggcctgattgacccgacggagattttcatagatgggactcatattaaggctgcggctaataatcgcaagttcatcaaccgagaggtggaaaaacaagccaagttcatgagtgaacagctagaaatcgaaatcaatcgggatagggagaagcatggaaaaaagccgctagggcccgccaaagagctagagcccgtcgctaagaaaatctccacaaccgatccagaaagtggctggtttcacaaaggtgatcataaggaagtcttcgcttattctgctcaggtggcttgtgacaagtatggatgggcgcttgcttatagtgttgaggctggcaatatccatgatagtcaggcttttcctgcactttttgccaagcttgaacccttgaaaccacagtttattattgcggattccggctataacgttcccagcattgccaagtttctgattgataaggagatcactcctgtccttccttacacacgaccaagaggaaagaaagaccttctacgtccgaaagaattgatttatgatgagcactttgattgtgtcatctgccctgaacatcaagccttgacctaccgcactacgaccagagaaggctaccgagaatacaaaagtgaccctgtaatttgtgccaattgtcccctgttatctgtatgtacgaccagtaagaactaccaaaaagttgtcacacggcatatttggaaagactatttggcacagccaaggaataccacaatctctgctatacgagagagaaaggcaagtccaaaatggaagatacggttggac

SEQ ID NO: 8312 - protein, 401 aa, Streptococcus pyogenes
MLHKEKPDYNRNQYGFYTLDQLVPDEHFLRQVEAVIDFDFIYDLVEDTYSSDNGRPSLDPVMLVKIPLIQCFYGIRSMRQTIKDIEVNTAYRWFLGLTLDDKVPHFTTYGKNYSRRFQEKGLIESIFTHIVGLCINTGLIDPTEIFIDGTHIKAAANNRKFINREVEKQAKFMSEQLEIEINRDREKHGKKPLGPAKELEPVAKKISTTDPESGWFHKGDHKEVFAYSAQVACDKYGWALAYSVEAGNIHDSQAFPALFAKLEPLKPQFIIADSGYNVPSIAKFLIDKEITPVLPYTRPRGKKDLLRPKELIYDEHFDCVICPEHQALTYRTTTREGYREYKSDPVICANCPLLSVCTTSKNYQKVVTRHIWKDYLAQPRNTTISAIRERKASPKWKIRLD

SEQ ID NO: 8313 - DNA, 252 bp, Streptococcus pyogenes
ttggaaagactatttggcacagccaaggaataccacaatctctgctatacgagagagaaaggcaagtccaaaatggaagatacggttggactgactttggcatgcttaaatctcaaaaaactggtcaaaaggatggcgggagagcctttttattttgttcagatgaggtggtttaagcacggaaacagccatttttatctaaaaacactaaaaaagacaaacaccaaatcgatgtttgtcttcaatctgttc

SEQ ID NO: 8314 - protein, 84 aa, Streptococcus pyogenes
LERLFGTAKEYHNLCYTREKGKSKMEDTVGLTLACLNLKKLVKRMAGEPFYFVQMRWFKHGNSHFYLKTLKKTNTKSMFVFNLF

SEQ ID NO: 8315 - DNA, 924 bp, Streptococcus pyogenes
atgaatattagaaataagattgaaaatagtaaaacactactatttacatcccttgtagccgtggctctactaggagctacacaaccagtttcagccgaaacgtatacatcacgcaattttgactggtctggagatgactggtctggagatgactggcctgaagatgactggtctggagatggtttgtctaaatatgaccggtctggagttggtttgtctcaatatggctggtctaaatatggctggtctagcgataaagaagaatggcctgaagattggcctgaagatgactggtctagcgataaaaaagatgagacagaagataaaacgagaccaccatatggagaagcattaggtacagggtatgaaaaacgtgatgattggggaggacctggtacggtggcaactgacccttacactccaccatatggaggagcattaggtacagggtatgaaaaacgtgatgattggggaggacctggtacggtggcaactgacccttacactccaccatatggaggagcattaggtacagggtatgaaaaacgtgatgattggagaggacctggacatattcctaaacctgagaacgaacaatcaccaaacccacttcatattcctgaacctcctcagattgagtggcctcagtggaatggctttgatggattatcatttggcccctctgattggggccaatctgaggacacccctccaagtgaacctcgtgtgccagaaaaaccgcaacatactcctcaaaaaaatccacaagaatcagattttgatagagggttttcagctggcttgaaagcaaaaaactcaggtagaggtattgattttgaaggtttccagtatggtggctggtcagacgaatataaaaaaggttacatgcaagccttcggtacaccatatacaccatcagcaacg

SEQ ID NO: 8316 - protein, 308 aa, Streptococcus pyogenes
MNIRNKIENSKTLLFTSLVAVALLGATQPVSAETYTSRNFDWSGDDWSGDDWPEDDWSGDGLSKYDRSGVGLSQYGWSKYGWSSDKEEWPEDWPEDDWSSDKKDETEDKTRPPYGEALGTGYEKRDDWGGPGTVATDPYTPPYGGALGTGYEKRDDWGGPGTVATDPYTPPYGGALGTGYEKRDDWRGPGHIPKPENEQSPNPLHIPEPPQIEWPQWNGFDGLSFGPSDWGQSEDTPPSEPRVPEKPQHTPQKNPQESDFDRGFSAGLKAKNSGRGIDFEGFQYGGWSDEYKKGYMQAFGTPYTPSAT

SEQ ID NO: 8317 - DNA, 246 bp, Streptococcus pyogenes
gtgttatttttagccatttttatgctccttatgctatcattttttaggaagaaaccctcattttcagggtttaactctaataattctattgtaaataataaaagccaaaaggtaaagaccagcttttttagcttttgccacctttttgacctaaatgctattaatgatgaatctgtttttgagttgctacagttaggctgtctaagttgtggaggggggggcatgcaacttgttggggggagtggg

SEQ ID NO: 8318 - protein, 82 aa, Streptococcus pyogenes
VLFLAIFMLLMLSFFRKKPSFSGFNSNNSIVNNKSQKVKTSFFSFCHLFDLNAINDESVFELLQLGCLSCGGGGMQLVGGSG

SEQ ID NO: 8319 - DNA, 192 bp, Streptococcus pyogenes
ttgactgttatggtacaaccattaaaaattctatcatacttcagtcaatttacaccaacattagctcttgaaaacgtttctacgatgttttttatgaactggttaacttgtcttttttcgttggctattttgagaaaacagggctttgggttctattttgcttttaattttagccatgtgactctcacatca

SEQ ID NO: 8320 - protein, 64 aa, Streptococcus pyogenes
LTVMVQPLKILSYFSQFTPTLALENVSTMFFMNWLTCLFSLAILRKQGFGFYFAFNFSHVTLTS

SEQ ID NO: 8321 - DNA, 90 bp, Streptococcus pyogenes
gtgtttggctttttgatgacatcatggctctcaaaagaccaaaaaacttccaataacttagctcgtgctctaaattattggaagattatt

SEQ ID NO: 8322 - protein, 30 aa, Streptococcus pyogenes
VFGFLMTSWLSKDQKTSNNLARALNYWKII

SEQ ID NO: 8323 - DNA, 249 bp, Streptococcus pyogenes
atgataaagaaagtgaccaccccgagtcaaaaaacaaaaaaacgtgttcgtaatggctacctcctaaaactaggtacagcctgtttactcttaagtatactcagttatggcattggtcttttgggccagcctagcatggaaaatacgtttatgggaatagcgagtgttgccatgttaggaagtgtctgtttctttattatctttgctctaaaccgtatctttgacgcattagaggacaatttgcgagat

SEQ ID NO: 8324 - protein, 83 aa, Streptococcus pyogenes
MIKKVTTPSQKTKKRVRNGYLLKLGTACLLLSILSYGIGLLGQPSMENTFMGIASVAMLGSVCFFIIFALNRIFDALEDNLRD

SEQ ID NO: 8325 - DNA, 402 bp, Streptococcus pyogenes
atgacaggacaaaaaaagctagccaatctcaaaaaaacagataaaaaacagataatcgttagaaaaacagtagatgcgtctgttaaactaaaggtatcaaaacaaaaggagcatttcatcatgaaattcaaaaaagtattagtcattcctgcattagcattagcagcaacatgctttttaacagcttgtggcacaaaaaaagattctaaaaaagaagaagttaaagaaatcaaaatgtctgacatcaaagacgacgcagttagcaaaaaaacaaaagtggttgatggcgaagaagttacagaatacaccacaaaagatggaaacgtgattcagattcctgcaggaaacgaagaaggcatggaatcaaaagatgctggtggatcaggcgctcctgctaaaaac

SEQ ID NO: 8326 - protein, 134 aa, Streptococcus pyogenes
MTGQKKLANLKKTDKKQIIVRKTVDASVKLKVSKQKEHFIMKFKKVLVIPALALAATCFLTACGTKKDSKKEEVKEIKMSDIKDDAVSKKTKVVDGEEVTEYTTKDGNVIQIPAGNEEGMESKDAGGSGAPAKN

SEQ ID NO: 8327 - DNA, 234 bp, Streptococcus pyogenes
atgacccatcgtttttttctcacccctctttcaaccctctggcgccgtctgagaccaaagcgttactccaaaaaagttttggctgatgagcctactagctatcagccaccggcagctcatggcccgtgcgacgatattcatcagttgcttgaggacaagagcttatcagacgattatctgattgctacttctgcgatgagacacctctggtactgggggtatagtcagattggg

SEQ ID NO: 8328 - protein, 78 aa, Streptococcus pyogenes
MTHRFFLTPLSTLWRRLRPKRYSKKVLADEPTSYQPPAAHGPCDDIHQLLEDKSLSDDYLIATSAMRHLWYWGYSQIG

SEQ ID NO: 8329 - DNA, 93 bp, Streptococcus pyogenes
ttgaaaaggggagtgatggctagggctgtctttttaagcaaccttagggaaataaactggcaaccctctatttttgggcaggttgtttttggt

SEQ ID NO: 8330 - protein, 31 aa, Streptococcus pyogenes
LKRGVMARAVFLSNLREINWQPSIFGQVVFG

SEQ ID NO: 8331 - DNA, 303 bp, Streptococcus pyogenes
atggaaatgcatttcgttagaacagaacctgaggcacgccgcatagctgaaaccttttgtgccgaaaacacacaaacaaaaacccctatgcgcgtgcagcagttaagctatccatcagacacagatcactcaggtggtgagctatacatctatgctttgtctcctgctggatttatcatcgtatcaggagacaccagagcgcacaccattttaggctattcttttgataataacctagacctcaaccatgataatgtcaggagtatgatagaagcttaccaaaaacaaatcaactctttggat

SEQ ID NO: 8332 - protein, 101 aa, Streptococcus pyogenes
MEMHFVRTEPEARRIAETFCAENTQTKTPMRVQQLSYPSDTDHSGGELYIYALSPAGFIIVSGDTRAHTILGYSFDNNLDLNHDNVRSMIEAYQKQINSLD

SEQ ID NO: 8333 - DNA, 1194 bp, Streptococcus pyogenes
atgaataaaaagaaattaggtgtcagattattaagtcttttagcattaggtggatttgttcttgctaacccagtatttgccgatcaaaactttgctcgtaacgaaaaagaagcaaaagatagcgctatcacatttatccaaaaatcagcagctatcaaagcaggtgcacgaagcgcagaagatattaagcttgacaaagttaacttaggtggagaactttctggctctaatatgtatgtttacaatatttctactggaggatttgttatcgtttcaggagataaacgttctccagaaattctaggatactctaccagcggatcatttgacgctaacggtaaagaaaacattgcttccttcatggaaagttatgtcgaacaaatcaaagaaaacaaaaaattagacactacttatgctggtaccgctgagattaaacaaccagttgttaaatctctccttgattcaaaaggcattcattacaatcaaggtaacccttacaacctattgacacctgttattgaaaaagtaaaaccaggtgaacaatcttttgtaggtcaacatgcagctacaggatgtgttgctactgcaactgctcaaattatgaaatatcataattaccctaacaaagggttgaaagactacacttacacactaagctcaaataacccatatttcaaccatcctaagaacttgtttgcagctatctctactagacaatacaactggaacaacatcttacctacttatagcggaagagaatctaacgttcaaaaaatggcgatttcagaattgatggctgatgttggtatttcagtagacatggattatggtccatctagtggttctgcaggtagctctcgtgttcaaagagccttgaaagaaaactttggctacaaccaatctgttcaccaaatcaaccgtggcgactttagcaaacaagattgggaagcacaaattgacaaagaattatctcaaaaccaaccagtatactaccaaggtgtcggtaaagtaggcggacatgcctttgttatcgatggtgctgacggacgtaacttctaccatgttaactggggttggggtggagtctctgacggcttcttccgtcttgacgcactaaacccttcagctcttggtactggtggcggcgcaggcggcttcaacggttaccaaagtgctgttgtaggcatcaaacct

SEQ ID NO: 8334 - protein, 398 aa, Streptococcus pyogenes
MNKKKLGVRLLSLLALGGFVLANPVFADQNFARNEKEAKDSAITFIQKSAAIKAGARSAEDIKLDKVNLGGELSGSNMYVYNISTGGFVIVSGDKRSPEILGYSTSGSFDANGKENIASFMESYVEQIKENKKLDTTYAGTAEIKQPVVKSLLDSKGIHYNQGNPYNLLTPVIEKVKPGEQSFVGQHAATGCVATATAQIMKYHNYPNKGLKDYTYTLSSNNPYFNHPKNLFAAISTRQYNWNNILPTYSGRESNVQKMAISELMADVGISVDMDYGPSSGSAGSSRVQRALKENFGYNQSVHQINRGDFSKQDWEAQIDKELSQNQPVYYQGVGKVGGHAFVIDGADGRNFYHVNWGWGGVSDGFFRLDALNPSALGTGGGAGGFNGYQSAVVGIKP

SEQ ID NO: 8335 - DNA, 168 bp, Streptococcus pyogenes
atggacaacccaaaaaaagacaaaggactttcacttggtgttgtggaccctatcacgatccttatcacagaatcagttattaacaaaatgagaacggtcccatatcatctaaaaaaactgtcaagcacaacctattgtttgctagctgatcttgcctatcagtctgcc

SEQ ID NO: 8336 - protein, 56 aa, Streptococcus pyogenes
MDNPKKDKGLSLGVVDPITILITESVINKMRTVPYHLKKLSSTTYCLLADLAYQSA

SEQ ID NO: 8337 - DNA, 129 bp, Streptococcus pyogenes
atgctcatttcagttgacaagaaacttaaaaatactgataatataaacaaaatgattcttttgtttgtcaatgcttttattgacttctcatttttatctactaccattttgcaaaaggaactacaaaaa

SEQ ID NO: 8338 - protein, 43 aa, Streptococcus pyogenes
MLISVDKKLKNTDNINKMILLFVNAFIDFSFLSTTILQKELQK

SEQ ID NO: 8339 - DNA, 126 bp, Streptococcus pyogenes
atgaaaattaaaggagatagtaaggagaaaaaagaaggcgttgtctttttgttttgccatactaatatcatttttgaaataggtgctgtgtgtcacctagaggtggtgattgtatttaggcctagg

SEQ ID NO: 8340 - protein, 42 aa, Streptococcus pyogenes
MKIKGDSKEKKEGVVFLFCHTNIIFEIGAVCHLEVVIVFRPR

SEQ ID NO: 8341 - DNA, 507 bp, Streptococcus pyogenes
atgtcaactgaccatcaattacgagaagtttcttatcaattactggctgagcgaggggtttctttagaagctattgcagagctggtgctttttttgcagaatgattatattcccaatttgaccatggcagaatgtttagagagcgttgaggcggtgcttgcaaaacgagaagtgcaaaatgctattatcactggggtagaattggataaattggctgaagccaaccagctgtctgagccactccttagtatcttgaaaaccgaccaagggctgtatgggattgatgaaatcctggccttatccattgttaacctctatgggtctatcggttttaccaattatgggtatctggacaagacaaaaccgggaatagttgacaaactcaaccacaaagatggctactcctgccatacctttttagatgatattgttagcgccattgcggcagcagctgccagtcgtattgcccacaatgaccccgctaaaagtgctattaccaaccaacaa

SEQ ID NO: 8342 - protein, 169 aa, Streptococcus pyogenes
MSTDHQLREVSYQLLAERGVSLEAIAELVLFLQNDYIPNLTMAECLESVEAVLAKREVQNAIITGVELDKLAEANQLSEPLLSILKTDQGLYGIDEILALSIVNLYGSIGFTNYGYLDKTKPGIVDKLNHKDGYSCHTFLDDIVSAIAAAAASRIAHNDPAKSAITNQQ

SEQ ID NO: 8343 - DNA, 90 bp, Streptococcus pyogenes
ttggagatcgttgctacattgcctttacctttatgcttttttaaagctcaaaccagtatgggctttaaaaaagcttaccaatcagattat

SEQ ID NO: 8344 - protein, 30 aa, Streptococcus pyogenes
LEIVATLPLPLCFFKAQTSMGFKKAYQSDY

SEQ ID NO: 8345 - DNA, 198 bp, Streptococcus pyogenes
ttgactctgttacaagctaatttagtgcacttggtttggagatcgttgctacattgcctttacctttatgcttttttaaagctcaaaccagtatgggctttaaaaaagcttaccaatcagattattgatactacaaaaaaggctgggaatactcccagcctaggcttttccaagcaagcttatcatttctaccaatct

SEQ ID NO: 8346 - protein, 66 aa, Streptococcus pyogenes
LTLLQANLVHLVWRSLLHCLYLYAFLKLKPVWALKKLTNQIIDTTKKAGNTPSLGFSKQAYHFYQS

SEQ ID NO: 8347 - DNA, 174 bp, Streptococcus pyogenes
atgggattcattagcgggacttttaaagtcttaaaagacacaacatggccaaatcgtaaacaacgttggaaagattttatctcagttcttgagtacacagctttctttacggtgattatctacatctttgatcagctcttagcaaagagtgtattagcactgattaatttattc

SEQ ID NO: 8348 - protein, 58 aa, Streptococcus pyogenes
MGFISGTFKVLKDTTWPNRKQRWKDFISVLEYTAFFTVIIYIFDQLLAKSVLALINLF

SEQ ID NO: 8349 - DNA, 378 bp, Streptococcus pyogenes
atgaaaacaattagacgttatgatgttaacgaagatagagggcatacaggccttgtagaagcaggagatttctattatttaaactattgtgtcggcaatgttggacaagacattgaaagtcagattaatggagcctttgacgagatggagcgccgattagcattggtggggctcacattagatgcagttgttcaaatggattgtctatttcgagacgtttggaacatacctgtgatggaaaaaatgattaaagagcgctttaatggcagataccctgctcgaaaatcgattcaaacggaatttgcacatcacggtggaccacaaggactactctttcaagtggatggtgtggcttattcaaagcatatttcgatgacc

SEQ ID NO: 8350 - protein, 126 aa, Streptococcus pyogenes
MKTIRRYDVNEDRGHTGLVEAGDFYYLNYCVGNVGQDIESQINGAFDEMERRLALVGLTLDAVVQMDCLFRDVWNIPVMEKMIKERFNGRYPARKSIQTEFAHHGGPQGLLFQVDGVAYSKHISMT

SEQ ID NO: 8351 - DNA, 189 bp, Streptococcus pyogenes
atgaataaattccaagcttttaaagaaaccttatccgcagaaagtctaaaagccatttacgatgagactcgcttggaggtagctaatgacgagcgtgaaggtactgaagctttctctgctgctcttgccacccaaatggctatcaaccttgttgaaaaataccataactggctcaatgaagacaacaaa

SEQ ID NO: 8352 - protein, 63 aa, Streptococcus pyogenes
MNKFQAFKETLSAESLKAIYDETRLEVANDEREGTEAFSAALATQMAINLVEKYHNWLNEDNK

SEQ ID NO: 8353 - DNA, 180 bp, Streptococcus pyogenes
atgctgattttggatgaaagtaacatgcccattgatgagtttatgtatgctgtccatgattttcatcgtgacaacacaattcaagatagtgatggcttgaagcagttacttcatgctcaactagcatcaactgataagaaggagatgttcacggatatcttttggcatatccagcatgtc

SEQ ID NO: 8354 - protein, 60 aa, Streptococcus pyogenes
MLILDESNMPIDEFMYAVHDFHRDNTIQDSDGLKQLLHAQLASTDKKEMFTDIFWHIQHV

SEQ ID NO: 8355 - DNA, 132 bp, Streptococcus pyogenes
atgacaaagaaaaacaatgtattttccaatacattaaaagtctgtaaccacaaagattggcattttatatcacaactaaaaaaacaaagatgggatatcatgagtcgaaatccaatctttgttcttttttca

SEQ ID NO: 8356 - protein, 44 aa, Streptococcus pyogenes
MTKKNNVFSNTLKVCNHKDWHFISQLKKQRWDIMSRNPIFVLFS

SEQ ID NO: 8357 - DNA, 108 bp, Streptococcus pyogenes
ttgcttgcgggctactctaaaaacttagtagcaccacgtcaatacattttgactaaaactgactattattataacaaatacaagaccttaaacgcaactcttaatcat

SEQ ID NO: 8358 - protein, 36 aa, Streptococcus pyogenes
LLAGYSKNLVAPRQYILTKTDYYYNKYKTLNATLNH

SEQ ID NO: 8359 - DNA, 153 bp, Streptococcus pyogenes
ttggccatagtatttttcatacctaataatcaggctctaaaagacatcttcgggaaatttgaccgacttttgaccgactttatttctttttttctctttttttatcctgccgcaaaaaataaaaaccttgatttaacaacgttttcacgaagt

SEQ ID NO: 8360 - protein, 51 aa, Streptococcus pyogenes
LAIVFFIPNNQALKDIFGKFDRLLTDFISFFLFFYPAAKNKNLDLTTFSRS

SEQ ID NO: 8361 - DNA, 1284 bp, Streptococcus pyogenes
atgttaaaaaaggaggtttttatggttgctgatgtcttattaacacattttaatcaactattttgtctaaatgatccaggtcatcctttaactggtcaagaaatgaaaaaagccactatcgttgaagatggctatatagccatcaaagacggcctcattgtggctcttggttctggtgaaccagatgctgagcttgtcggtacacagactattatgcgttcttataaaggtaaaattgcaacgcctggtattattgactgtcatacccatttggtctatggtggcagtcgtgaacatgaatttgccaagaaattagcaggggtgtcttacttggatattttagctcaaggtggtggtattttaagcacggtgagggccactcggtcagccagctttgacaacctttatcaaaaatccaagagattgctagactacatgttgcttcatggagtgactactgtcgaagcgaaaagtggctacggccttgattgggaaacagaaaaacgccaactggatgttgttgctgctttagaaaaagaccatcccattgatttggtgtctacgtttatggcagcccatgcgattcctgaagaatacaaagggaatcctaaggcttatctcgatgtgattatcaaggatatgcttcctgttgttaaagaggaaaatctggcagaattttgtgatattttctgtgaaaaaaatgtttttacagctgatgagtctcgctatctgttaagcaaagccaaagaaatgggcttcaagcttcgtattcacgcagatgaaattgcgtctataggcggagttgatgtcgcagcagagctcagcgcagttagtgcagagcatttgatgatgataacagatgatggtatcgctaagttgattggtgctggtgttattggtaatttgcttccagccaccacctttagtttgatggaagacacttatgcccctgctcgcaaaatgatcgatgctggcatggccatcaccctctcaacagatagtaatccaggcagttgcccgactgctaacatgcagtttgtgatgcaattaggttgttttatgttacgtttaacaccgattgaagtcttaaatgctgttaccattaacgcggcctactctgtcaatcgtcaggagagagttggtagtttgacagttggtaaagaagcagatattgccatttttgatgccccaaatattgattacccattttatttctttgccaccaacttgattcaccaagtctataaaaaaggacaactcacagttgaccgaggtcgtattctt

SEQ ID NO: 8362 - protein, 428 aa, Streptococcus pyogenes
MLKKEVFMVADVLLTHFNQLFCLNDPGHPLTGQEMKKATIVEDGYIAIKDGLIVALGSGEPDAELVGTQTIMRSYKGKIATPGIIDCHTHLVYGGSREHEFAKKLAGVSYLDILAQGGGILSTVRATRSASFDNLYQKSKRLLDYMLLHGVTTVEAKSGYGLDWETEKRQLDVVAALEKDHPIDLVSTFMAAHAIPEEYKGNPKAYLDVIIKDMLPVVKEENLAEFCDIFCEKNVFTADESRYLLSKAKEMGFKLRIHADEIASIGGVDVAAELSAVSAEHLMMITDDGIAKLIGAGVIGNLLPATTFSLMEDTYAPARKMIDAGMAITLSTDSNPGSCPTANMQFVMQLGCFMLRLTPIEVLNAVTINAAYSVNRQERVGSLTVGKEADIAIFDAPNIDYPFYFFATNLIHQVYKKGQLTVDRGRIL

SEQ ID NO: 8363 - DNA, 2028 bp, Streptococcus pyogenes
atgtcattttacagtgaaactgacatagctgccgctatgactgttaagttagacgatgttttaccggaaaagactgtgtttgaagaaggtatccgaagagcaccagacagaggttttcgattgacccaggctcagaccgaaatcgccttgaaaaatgccctacgctatgtacctacgaagttccacgaagaagtcattccagaatttttggaagaactcaaaacccgtggccgtatttatggctaccgctttagaccaaaagaccgcatttacggcaaacccattgacgagtacaagggaaattgtacagctgccaaggccatgcaggtcatgattgacaataacttgagttttgaaattgccttgtacccttacgaactagtcacatatggagaaactggttctgtttgtgccaactggatgcaatattgtttgattaaaaaatacctagaagtcatgactgatgaacaaaccttggtggttgagtctggtcatccagttggtcttttcaaatccaaacctgaagcgcctcgtgtgattattactaatggccttttggtgggtgaatacgacaacatgaaagactgggaaatcgctgaagagatgggtgtcaccaactatggtcaaatgaccgcaggtggttggatgtatattggcccacaaggaatcgttcatggaacgtttaataccctcttaaatgctggtcgtctcaaacttggagtggctgatgacggtgatttgaccggtaaactcttcatctcatctggtctaggaggcatgagtggggcacaaggtaaggctgctgaaattgctaaagcagttgccattattgctgaagttgaccaatctcggattaaaacccgtcattctcaaggctggatcagtcaaattgccgaaagccctgaagaagctctgcaattagcccaaaaagccatagatgctaaggagtccacttcgattgcttaccatggtaatatcgttgatcttttagagtacgtcaatgacaagcagattcatgttgatcttttgtctgaccaaacctcttgtcacaacgtttatgacggtggctactgcccagtaggtattagctttgacgaaagaacccggctcttggcagaagataaagataccttccaccaaatggttgatgataccttggcacggcattttgaagctattaagacgttaactgaaaatggcacctatttctttgactacggcaatgcctttatgaagtctgtttacgactctggtattacagaaatttctaagaatggtcgtaacgacaaagacggatttatctggccatcctatgtggaagatatcatgggacctatgctttttgactatggctatggacctttccgttgggtctgcttgagtggtaatcacgatgacttggtggccactgacaaagctgccatggaagctatcgatcctgaccgccgctatcaagaccgtgataactacaactggattcgtgatgctgagaaaaatcaactcgtagttggtacccaagcccggatcctttaccaagactgtatcggtcgtgtgactatcgcccttaaatttaatgaattggtccgcaaaggcaagattggtcctgtcatgattggtcgtgaccaccatgacgtgtctggtaccgactcaccatttcgtgaaacctcaaacattaaagacggttccaatgtgacctgtgatatggcggtgcaatgttacgctggtaacgctgcgcgtggtatgagtttagtggctcttcataacggtggcggaactggtattggtaaagccatcaatggtggtttcggacttgttttagatggcagcgaacgcattgatgagattattaaatctgctattgcttgggacaccatgggtggtgttgctcgtcgcaattgggctcgcaatgagcacgctattgaaaccgctattgagtataatcgtctccatgcaggtactgatcacatcactatcccatacttggctgatgatgaccttgtgacttcagcagtagatcaattatttcac

SEQ ID NO: 8364 - protein, 676 aa, Streptococcus pyogenes
MSFYSETDIAAAMTVKLDDVLPEKTVFEEGIRRAPDRGFRLTQAQTEIALKNALRYVPTKFHEEVIPEFLEELKTRGRIYGYRFRPKDRIYGKPIDEYKGNCTAAKAMQVMIDNNLSFEIALYPYELVTYGETGSVCANWMQYCLIKKYLEVMTDEQTLVVESGHPVGLFKSKPEAPRVIITNGLLVGEYDNMKDWEIAEEMGVTNYGQMTAGGWMYIGPQGIVHGTFNTLLNAGRLKLGVADDGDLTGKLFISSGLGGMSGAQGKAAEIAKAVAIIAEVDQSRIKTRHSQGWISQIAESPEEALQLAQKAIDAKESTSIAYHGNIVDLLEYVNDKQIHVDLLSDQTSCHNVYDGGYCPVGISFDERTRLLAEDKDTFHQMVDDTLARHFEAIKTLTENGTYFFDYGNAFMKSVYDSGITEISKNGRNDKDGFIWPSYVEDIMGPMLFDYGYGPFRWVCLSGNHDDLVATDKAAMEAIDPDRRYQDRDNYNWIRDAEKNQLVVGTQARILYQDCIGRVTIALKFNELVRKGKIGPVMIGRDHHDVSGTDSPFRETSNIKDGSNVTCDMAVQCYAGNAARGMSLVALHNGGGTGIGKAINGGFGLVLDGSERIDEIIKSAIAWDTMGGVARRNWARNEHAIETAIEYNRLHAGTDHITIPYLADDDLVTSAVDQLFH

SEQ ID NO: 8365 - DNA, 897 bp, Streptococcus pyogenes
atggcgaaaattgttgaatgtattcccaacttctcagaaggccaaaatcaggctgttatcgatggtttggtagcgacggccaaaagtattcctggagtgacccttctcgactactcttctgatgcgagccacaaccggagcgtgtttaccttggttggagatgaccagtctattcaagaagcagctttccaactggtgaaatacgcttctgaaaacattgatatgaccaaacatcatggcgaacaccctcgtatgggagcaaccgatgtctgcccattcgttccgatcaaagacatcactacacaagaatgtgttgagatttccaaacaagtcgcagaacggattaaccgtgaacttggaatcccaatcttcctttatgaagattctgccacacgcccagaacgtcaaaacctggccaaagtccgtaaaggacaattcgaaggcatgccagaaaaactgttggaagaggattgggcacctgactacggagatcgtaagattcacccaactgctggggtaactgccgttggtgctcgcatgccattggttgctttcaatgttaatttggatactgacaatatcgacattgctcataaaattgcgaaaattatccgcggttcaggtggtggctacaaatattgtaaggctatcggtgtcatgttagaagaccgtcatattgcccaagtttccatgaacatggttaactttgaaaaatgttctctttaccgtacttttgaaaccatcaaatttgaagcgcgtcgctacggtgtgaatgttattggttctgaagtcatcggcttagcgccagccaaggccttaatcgatgtggctgaatactacttacaagttgaggactttgactaccataaacagattcttgaaaaccatttgctaggt

SEQ ID NO: 8366 - protein, 299 aa, Streptococcus pyogenes
MAKIVECIPNFSEGQNQAVIDGLVATAKSIPGVTLLDYSSDASHNRSVFTLVGDDQSIQEAAFQLVKYASENIDMTKHHGEHPRMGATDVCPFVPIKDITTQECVEISKQVAERINRELGIPIFLYEDSATRPERQNLAKVRKGQFEGMPEKLLEEDWAPDYGDRKIHPTAGVTAVGARMPLVAFNVNLDTDNIDIAHKIAKIIRGSGGGYKYCKAIGVMLEDRHIAQVSMNMVNFEKCSLYRTFETIKFEARRYGVNVIGSEVIGLAPAKALIDVAEYYLQVEDFDYHKQILENHLLG

SEQ ID NO: 8367 - DNA, 624 bp, Streptococcus pyogenes
atgggtttagttgatttaagcttaacagatttcgctaaagtccttggctcagatgcccctgctccaggtggtggttctgctgctgctctctctggcgctaatggcatttccttaaccaagatggtctgtgaattgactcttggtaagaaaaaatacgctgactaccaagatattattacagagatccatgctaaaagcaccgctctacaagctagcttgcttgcagccattgacaaagataccgaagccttcaacctggtttctgccgtttttgatatgccaaaagagactgacgaagacaaggctgctagacgaactgccatgcaaaaggccttgaaaacagctgcacaatcaccttttgagatgatgaccctcatggtcgaagcacttgagatcactgcaacagctgtcggtaagtctaatacaaatgctgctagcgacttaggagttgctgctttaaacttaaaagcaggtttacaaggcgcttggttgaatgttttgattaatctgtctggcatcaaagatgaagactttgttaccgactatcgccaaaaaggacaagccttactagacaagggctgtcatttggcagatgacatctacacgaaaattctcgatattgtt

SEQ ID NO: 8368 - protein, 208 aa, Streptococcus pyogenes
MGLVDLSLTDFAKVLGSDAPAPGGGSAAALSGANGISLTKMVCELTLGKKKYADYQDIITEIHAKSTALQASLLAAIDKDTEAFNLVSAVFDMPKETDEDKAARRTAMQKALKTAAQSPFEMMTLMVEALEITATAVGKSNTNAASDLGVAALNLKAGLQGAWLNVLINLSGIKDEDFVTDYRQKGQALLDKGCHLADDIYTKILDIV

SEQ ID NO: 8369 - DNA, 615 bp, Streptococcus pyogenes
ttggaaataaggagagaacaaatgacaaaggtaaccatcaaagcgccctctgattacctccaaactgactggtctggcggtgaaaccaaccaattgttcctttatcccgaagatggagattacaaaaagagagaattctcttatcgtctctcaactgcaactgtagccctacgacagacaacctttacccgacttgatggctatcacaggattctaatgagcctagacaagcccatcacattaagtgatttgagtcatgctaaagagatttccctagctccttttcaaccctatgcgtttgaaggcgataccagaatcgtcagtcgtggaacctgccaagacatcaatttaatgtatgatgaccaataccaagggcaattattacccgtctggtctgacacaccatttgaggcacctaaagcggactgtcaactactttatgccctaagcaaactgacttattctgtgaccaatcaggcgaatcaagagcttgaagccaatcacttgttggtaaccgagcaggaggccagcctttcagatctaaaagtttgcctcaatcaaacaagccccgcccaaactccagtagctgtttgggcaggcttatggtataagact

SEQ ID NO: 8370 - protein, 205 aa, Streptococcus pyogenes
LEIRREQMTKVTIKAPSDYLQTDWSGGETNQLFLYPEDGDYKKREFSYRLSTATVALRQTTFTRLDGYHRILMSLDKPITLSDLSHAKEISLAPFQPYAFEGDTRIVSRGTCQDINLMYDDQYQGQLLPVWSDTPFEAPKADCQLLYALSKLTYSVTNQANQELEANHLLVTEQEASLSDLKVCLNQTSPAQTPVAVWAGLWYKT

SEQ ID NO: 8371 - DNA, 1653 bp, Streptococcus pyogenes
ttgtttatggtgcagttggtgtcatcattgcaagtagtgtgtactaccttatgcacggacgtaaccaccaaatggaccaaatgccccctaaggaacaaatctaggagaaaaactatgacaagagtgattaatttagatggcgaaagccttactatcgaagacgtgattgcgattgctcgccaaggcgtagcctgtcacattgatgatagtgctattgaagctgtgaatgcctctcgtaaaattgttgatgacattgtcagtgaaaaacgggtggtttacggggtgaccaccggttttggatccctttgtaacgtgagcatctcaccagaagatacagttcaactccaagaaaatttgattcgtacccatgctagtggatttggtgacccattgccagaagatgccgtgagagctatcatgctgatccgtatcaattcactagtcaaagggtattctggtattcgtctatccaccattgaaaaactgttggaactgctcaataaaggggttcatccttacattcctgaaaaagggtctctaggggcttcaggagatttggcgccgcttgctcacatggtgcttcctatgcttggtctagggaaagcttactacaaaggagagcttctttctggtcaagaagctcttgataaagctggtattgacaagatttctttagccgctaaagaaggactcgcccttatcaacggaacaactgttctcactgcagtcggtgcccttgcaacctatgacgccattcaattattgaaactgtcagacctagctggtgccctatcccttgaagtgcataacgggattactagtccatttgaagaaaaccttcacaccattcgcccacaaagcggccagttggcaacagcccgcaatatccgaaacctccttgaaggcagccaaaacacaaccgtagctactcaatctcgtgtgcaagacccttacaccttgcgctgcatgcctcaaattcatggggctagcaaagacagtatcgcctatgtcaaatccaaagttgacattgaaatcaattctgtcacagataatccaattatctgtaaagatggccacgttatttcaggaggtaacttccacggagaaccaatggcacagccatttgacttcttaggcatcgccatttctgaaattggaaatgtttctgaacgccgcgtggaacgtttggtcaatagccagctcagcaaattgccatccttccttgtcaaatacccaggtctcaattcaggctttatgattacccagtacgcctgtgcctctcttgcttctgaaaacaaggttttggcacatccagccagtgtggattctatcccatcttgtgagaaccaagaagactttgtcagcatgggcaccaccgctgctcgcaaggcctttgaaatccttaaaaattctcgccgcatcgtggctactgaaatcatggcagcctgccaagcccttgatctcaaacctgaaaatcatgaactaggtaaagggactaaggttgcctacgatctcttccgcaaggaagtcaactttatcgaacacgataaacacatcgaaatctacgatgaactaaacaaggcatcagcagtcattgaagacccaagcttcctcgaagcggttgagcaggcagttgagttgagtatccaattt

SEQ ID NO: 8372 - protein, 551 aa, Streptococcus pyogenes
LFMVQLVSSLQVVCTTLCTDVTTKWTKCPLRNKSRRKTMTRVINLDGESLTIEDVIAIARQGVACHIDDSAIEAVNASRKIVDDIVSEKRVVYGVTTGFGSLCNVSISPEDTVQLQENLIRTHASGFGDPLPEDAVRAIMLIRINSLVKGYSGIRLSTIEKLLELLNKGVHPYIPEKGSLGASGDLAPLAHMVLPMLGLGKAYYKGELLSGQEALDKAGIDKISLAAKEGLALINGTTVLTAVGALATYDAIQLLKLSDLAGALSLEVHNGITSPFEENLHTIRPQSGQLATARNIRNLLEGSQNTTVATQSRVQDPYTLRCMPQIHGASKDSIAYVKSKVDIEINSVTDNPIICKDGHVISGGNFHGEPMAQPFDFLGIAISEIGNVSERRVERLVNSQLSKLPSFLVKYPGLNSGFMITQYACASLASENKVLAHPASVDSIPSCENQEDFVSMGTTAARKAFEILKNSRRIVATEIMAACQALDLKPENHELGKGTKVAYDLFRKEVNFIEHDKHIEIYDELNKASAVIEDPSFLEAVEQAVELSIQF

SEQ ID NO: 8373 - DNA, 993 bp, Streptococcus pyogenes
atgacgcgcatgctagaagattactacccatccaccactagctattatcatggtgggatcgacgatgacttatatactgccaaatggggcatggtcatgactttccttgaccttaacgacagctcactaaccccatttgaagggacacattttgccttgattggctttaaaagtgataagggggtttatatcaataatggtcgtgtcggagcggtcgaaagtccagctgccatacgaacccagctcgccaaattcccttggcatttaggaaaccaagttatggtttacgatgtgggtaacattgacggccccaatcgctctttggaacaactgcaaaacagtttaagcaaagccatcaaacggatgtgtgacctcaatctcaaacccatcgtcttaggaggtggccatgaaaccgcctacggccactacttaggcctacgccaaagcctatccccaagtgatgacctagctgtcatcaatatggacgcccactttgatttaaggccttacgaccaaacaggccctaattcagggacaggctttcgacagatgtttgacgatgcggttgctgacaaacgcctctttaaatacttcgttttaggcattcaagaacataataacaaccttttcctatttgactttgtggcaaaatccaagggcattcaatttttaacaggtcaagacatctaccaaatgggccatcaaaaggtctgccgagccattgaccgtttcttagaagggcaagaaagggtctacctgaccattgacatggattgtttctcagttggtgctgcgcctggggttagtgctatccagtccctcggtgttgacccaaatcttgccgtcttagttttgcaacacattgcagctagcggaaaattagttggctttgatgtggttgaggtttcaccaccacacgatattgataaccacaccgccaatttagcagccacctttatcttttacctcgtacagattatggcacaacatagc

SEQ ID NO: 8374 - protein, 331 aa, Streptococcus pyogenes
MTRMLEDYYPSTTSYYHGGIDDDLYTAKWGMVMTFLDLNDSSLTPFEGTHFALIGFKSDKGVYINNGRVGAVESPAAIRTQLAKFPWHLGNQVMVYDVGNIDGPNRSLEQLQNSLSKAIKRMCDLNLKPIVLGGGHETAYGHYLGLRQSLSPSDDLAVINMDAHFDLRPYDQTGPNSGTGFRQMFDDAVADKRLFKYFVLGIQEHNNNLFLFDFVAKSKGIQFLTGQDIYQMGHQKVCRAIDRFLEGQERVYLTIDMDCFSVGAAPGVSAIQSLGVDPNLAVLVLQHIAASGKLVGFDVVEVSPPHDIDNHTANLAATFIFYLVQIMAQHS

SEQ ID NO: 8375 - DNA, 3072 bp, Streptococcus pyogenes
atgacgaagggtattcgatttcaattgcttggcagtccccacatttttcttgatgacaaagaacaattttttgcctttgccaaagcaaatgctctcctttattacttagtggttaatggatctgttagccgcgaggtggcggcgagtctactttgggaaaataagaacacgcaaacagcgaaaaagaatttacgaaacgctatctaccaggtcaataaagtcttgcaagctgatgtgattatttgtcccaatcgcaacctgctggttttgaataaaacacttgatatcaaaacagatattaacctttttctggctgatccgctagctcacttagaactctaccaaggggagtttttgcagggcttttaccttaaaagtggtgaggaatttgatctttgggtttcaaaaatgcgtatgcagtatgaacaggtatacctaaaagcgtgttaccaaaaaattgaagaaaagctctctttagatgccattgaagatgtcgaggaacatttaaaacagcttattgaacgtgatgaatttgaagagaaaaattatcagctcttgatgaggctttatcagcaggggaattgtcctggtaaggtcatcgaaacttattatcagttggctaatgtgttggataaggagctagggattcagccaagtttgcaaagccaacagatttatcaggaagtggtcgctaaagatcgtaatgaacgcaaaatcaagcattttttgcgcaacagtaatcattttttggggcggattgatgagattaagcagctggaaaattattttgccaactgtttggcctgccaagaggtaggagctctgctcttaattggtgatacagggattgggaaacgaaccctagccagacaggtcttagccaatcaaacccaaacgtttcaaattgtcacagctaaatgttttcgtgaagaggctatggattccttattgccttggcgtaatatcttagatggcctgggagatttggtgattcaaaaccgcttattgaccaccaaagcttggaaggctgctcttaaacgctgttttcctgtggcaaccatttttcaagaagataacaaccaaccctttatcaaggaccacaccagcttgttggtttcctttattgttgatattttacaacatttggcagaaatcaaggcgctggtaatccttattgaggattgtcactggatggatgaggatagtttgaccttgttgcaacgggtcatgaatcaattggtccactatccgattgcttttgtcttgaccaagcatctaggaacgactcctgagctcggtctttgtttgaatgctttgatgagtcaagggcgtttagaaagcatttgtttggagccttttaatcggcaagaaagtttggtttatattaacagtcaactgggtagtcagccagtgacggcagaagaaatggagcacctctatcaagccagccaaggcaaccctttctttttgtcagaatacactcaggccctactgcgtcacgaaaaatttgtgcctttaacgcctgccattaaggctaagttgggtcttaaactagctaatctaagtagtcgtgatgacgcattgttaaactatttgtcttgttgtcggaggcctatccctctaaataccctcgctcaattgatgttactgcctttagaagaagtgatcgagatggtggataatctggggcactactatattttggtagaagaaagcgtaggagaggaagtgttgatttcatttcgtcagcggattattcaactctatagttatgaccgtttatctttgtcaaaaaggcgtttattgcacggacaaattgccaaacggttagaagatttactgcctattttgacaccaagccctcacttattagatgacattgcttaccattatcaggaatcacggcaggtgattaaggctttggaatacaaccttaactatctagatgctaccttgccatttcagcatgagctgtttcccatttattcaaagagtattggctccttggaaaagtcagatcgtgaccatcaacgcttaatggaagagcagtttgataagattcgtcaaagcattgcggatttggaactgacctatgataataaccgtgatttccagcagttgcttattcgtttttcttaccttgaaggccgttatgatattcgaacagggaggtatcaagaagggattaaacacattcaaaaggtcatcgctttggcaaccgagctaaaacagccctccttcttgctagaaggctatcgccagttaattcattactgtatccaagtggaaaacaagccagaaatgcgttattacactagtctttcattggaggcagcggttgctgctaatcattttgaggccattgcgattagtttgcggttaaacggtctctatcatttgattattggggagttaaatgaggcagagcgtctgcttcaacagtcgattgacttcttcaaggtgacgccaggcttgcaagctaactatgcgattcagattgctgctgccttagattatttgggggagattgcccagattcgctatcagtttgaaaaggccgttgcttatcaaaaacaagccattgccttgaccgaaaacaagccagctgagttatcggcgagtattttttatattggattagggatttcctacttttatttagctgattttgaacaagctgagcaaatcttgagtttggctaaggaagctttggtcaatcatagttatccttggaaagaaacgcaacttgaaatttacctggctatgattcaatggaaaaagggcaattatcagccagccttgaccctacttgattacagagaaaccttgatgtctaggtatcgcaatccgcgtgataagggcttggttttctatttgatggctgtggtcaagtaccaattgatatttcaaggagctaccctaagtcagcaggaaaaagaaatggcagaccacctgttgtcagaatcctttgagtattattatgagattgctagtactaacctcaacccttaccgagattgtcatttggtgagtgagttgaacgatttgcgtcaacaattatctgctaaaagc

SEQ ID NO: 8376 - protein, 1024 aa, Streptococcus pyogenes
MTKGIRFQLLGSPHIFLDDKEQFFAFAKANALLYYLVVNGSVSREVAASLLWENKNTQTAKKNLRNAIYQVNKVLQADVIICPNRNLLVLNKTLDIKTDINLFLADPLAHLELYQGEFLQGFYLKSGEEFDLWVSKMRMQYEQVYLKACYQKIEEKLSLDAIEDVEEHLKQLIERDEFEEKNYQLLMRLYQQGNCPGKVIETYYQLANVLDKELGIQPSLQSQQIYQEVVAKDRNERKIKHFLRNSNHFLGRIDEIKQLENYFANCLACQEVGALLLIGDTGIGKRTLARQVLANQTQTFQIVTAKCFREEAMDSLLPWRNILDGLGDLVIQNRLLTTKAWKAALKRCFPVATIFQEDNNQPFIKDHTSLLVSFIVDILQHLAEIKALVILIEDCHWMDEDSLTLLQRVMNQLVHYPIAFVLTKHLGTTPELGLCLNALMSQGRLESICLEPFNRQESLVYINSQLGSQPVTAEEMEHLYQASQGNPFFLSEYTQALLRHEKFVPLTPAIKAKLGLKLANLSSRDDALLNYLSCCRRPIPLNTLAQLMLLPLEEVIEMVDNLGHYYILVEESVGEEVLISFRQRIIQLYSYDRLSLSKRRLLHGQIAKRLEDLLPILTPSPHLLDDIAYHYQESRQVIKALEYNLNYLDATLPFQHELFPIYSKSIGSLEKSDRDHQRLMEEQFDKIRQSIADLELTYDNNRDFQQLLIRFSYLEGRYDIRTGRYQEGIKHIQKVIALATELKQPSFLLEGYRQLIHYCIQVENKPEMRYYTSLSLEAAVAANHFEAIAISLRLNGLYHLIIGELNEAERLLQQSIDFFKVTPGLQANYAIQIAAALDYLGEIAQIRYQFEKAVAYQKQAIALTENKPAELSASIFYIGLGISYFYLADFEQAEQILSLAKEALVNHSYPWKETQLEIYLAMIQWKKGNYQPALTLLDYRETLMSRYRNPRDKGLVFYLMAVVKYQLIFQGATLSQQEKEMADHLLSESFEYYYEIASTNLNPYRDCHLVSELNDLRQQLSAKS

SEQ ID NO: 8377 - DNA, 108 bp, Streptococcus pyogenes
ttgtctacaagttgtttgtgccaaaaaagccattattttggtaaaataaaaggtgttgtctgtaaaaaaatagacaaatggaaaggtaatttaccctatgacaaagta

SEQ ID NO: 8378 - protein, 36 aa, Streptococcus pyogenes
LSTSCLCQKSHYFGKIKGVVCKKIDKWKGNLPYDKV

SEQ ID NO: 8379 - DNA, 129 bp, Streptococcus pyogenes
gtgcacacttacaataacacagttgataatggggaaactcagagtcaagaaaaagaaaagcaagccttgcattttgcaaggcttttttctgtctttattttggtctgcgccgagcaaaatctaaaaatt

SEQ ID NO: 8380 - protein, 43 aa, Streptococcus pyogenes
VHTYNNTVDNGETQSQEKEKQALHFARLFSVFILVCAEQNLKI

SEQ ID NO: 8381 - DNA, 126 bp, Streptococcus pyogenes
atgatattatcacattctttacagtttgataaaattactttttttctacaaaaagacttgcgctcatctcacgaatatgataatataatatcaagtctgtttgagaaaacagaagctcaggtcaag

SEQ ID NO: 8382 - protein, 42 aa, Streptococcus pyogenes
MILSHSLQFDKITFFLQKDLRSSHEYDNIISSLFEKTEAQVK

SEQ ID NO: 8383 - DNA, 252 bp, Streptococcus pyogenes
ttgctaaaggggaccttgcgttttgggcagttgaagtcctcaataggttcggtcagtcaaaaggtacttactgcccaattaagggctatggaagcagacggattggttcatcgggaagtgtatgcagaagtgccacctcgggtggagtattccttaacagaaactgggttgagcttagctcctgttattgaagcgatgtcggattggggccaaacttaccaagaaaaacatgccgatttatttgaagaaggc

SEQ ID NO: 8384 - protein, 84 aa, Streptococcus pyogenes
LLKGTLRFGQLKSSIGSVSQKVLTAQLRAMEADGLVHREVYAEVPPRVEYSLTETGLSLAPVIEAMSDWGQTYQEKHADLFEEG

SEQ ID NO: 8385 - DNA, 141 bp, Streptococcus pyogenes
atgtctggaggtggtgcttatgtatgtaagtcacagaaaccaaaagaaaggagacgacaaggtttgtcagtttatgaaacgcttactttgatgattgcctttggtactctgatagtagctatcatgaataacaagaacaaa

SEQ ID NO: 8386 - protein, 47 aa, Streptococcus pyogenes
MSGGGAYVCKSQKPKERRRQGLSVYETLTLMIAFGTLIVAIMNNKNK

SEQ ID NO: 8387 - DNA, 159 bp, Streptococcus pyogenes
atgaataaaaataattttatgcaagaatttataatgctttatgcaaccactgaccacgcgcagacagtttttttaattaccgccgacaaaaagttcagaaaagttcagattatacctcaatttttgtcaagttttgagggtcttgtaattaaagaaaat

SEQ ID NO: 8388 - protein, 53 aa, Streptococcus pyogenes
MNKNNFMQEFIMLYATTDHAQTVFLITADKKFRKVQIIPQFLSSFEGLVIKEN

SEQ ID NO: 8389 - DNA, 204 bp, Streptococcus pyogenes
atgacgcaaattacactaaaagctgcccgaatcaacgctggttacactttaaaacaagtagctggagcggttgggaaaaatccccaaactatttcaaagtacgaaaaagatagctccgatatttctttaggactattgcaaaaattatcatctttgtacggtgtcactattgataacctttttttaggtaaaaaagtacgaaaa

SEQ ID NO: 8390 - protein, 68 aa, Streptococcus pyogenes
MTQITLKAARINAGYTLKQVAGAVGKNPQTISKYEKDSSDISLGLLQKLSSLYGVTIDNLFLGKKVRK

SEQ ID NO: 8391 - DNA, 270 bp, Streptococcus pyogenes
gtgatgcgcgtggataaaggagaaatgattatgaaagcaacaacttacaaagagttgaagaaatggattgatgaaggtgttgatttagctgagctagcacagggttacgctggcaaagtaccaaatgcagatcgcgaacagtttgaagcaatcacacaggaaattttcaacgtattggaaggcgtatcgctcatgcttgatgacaaagtgctaatctataatcgcaaagcagagcaaaagcgtttgaatgacattgaacaaggcaattat

SEQ ID NO: 8392 - protein, 90 aa, Streptococcus pyogenes
VMRVDKGEMIMKATTYKELKKWIDEGVDLAELAQGYAGKVPNADREQFEAITQEIFNVLEGVSLMLDDKVLIYNRKAEQKRLNDIEQGNY

SEQ ID NO: 8393 - DNA, 339 bp, Streptococcus pyogenes
atgaaatatagagtagaaacaaatcctttttcaaaagatagatacaatcctgaacagctagaaatgttcaaaaatcgccaactcagcaaagataaagctgaagtctttttcactcgactatataaccaacatattgcttgggtaattattgctaacgttatgacagagtacgtcattaaattcagaaaaagtgccaccagctttgaagaagcatgggacgctttagactatcaacgaaccacagagattgtctttagagccgttaacggtttaccttgttcagagaaagactcaggggaactagaaacttatttaagtgaggaacagcatgaaaagcat

SEQ ID NO: 8394 - protein, 113 aa, Streptococcus pyogenes
MKYRVETNPFSKDRYNPEQLEMFKNRQLSKDKAEVFFTRLYNQHIAWVIIANVMTEYVIKFRKSATSFEEAWDALDYQRTTEIVFRAVNGLPCSEKDSGELETYLSEEQHEKH

SEQ ID NO: 8395 - DNA, 231 bp, Streptococcus pyogenes
gtgaggaacagcatgaaaagcattaaagaattaaatgaaatcgctaacgacattttggtagattatgaaggtctttgcggtcaacttatggatattctagatgtcctagatttggctgctcaagaatatagtaaggaaacaactagtgcaattataaacacgagttgtagcgctttgaagtgccttatttctgaccatgataagacgacacgtaaatacagaaaggagttg

SEQ ID NO: 8396 - protein, 77 aa, Streptococcus pyogenes
VRNSMKSIKELNEIANDILVDYEGLCGQLMDILDVLDLAAQEYSKETTSAIINTSCSALKCLISDHDKTTRKYRKEL

SEQ ID NO: 8397 - DNA, 189 bp, Streptococcus pyogenes
atgcaagaacttaacctcacaccaacacagacgcttattctattctttgttttaggtctcttagggcttcttcttagccgttctaagtcattaatagacattgatttaccagaagatacccaagtccctaaaccacgtcagaacgcaaactatggggcttatattcaatcacagaaccattattacaat

SEQ ID NO: 8398 - protein, 63 aa, Streptococcus pyogenes
MQELNLTPTQTLILFFVLGLLGLLLSRSKSLIDIDLPEDTQVPKPRQNANYGAYIQSQNHYYN

SEQ ID NO: 8399 - DNA, 327 bp, Streptococcus pyogenes
atgacactaccagagaattatagacgtgtccttaatctgatcaaggttggagcagacaaccccattacaggggcagagattagcttaatactgaaacttgaagaacgctccgtccaaagtatcatcagtagcttaatcacgcgctataacgtccctattatcggcattagacacggattcaatcgtgggtactttatcccagctaacaaagaagaattactaggtggtgctaaagccttttataatcaagtacaaaaggaacaggaacgcctaagtgtgttattgaatgccgatttaaccagttataaggaattactcaaaggaggt

SEQ ID NO: 8400 - protein, 109 aa, Streptococcus pyogenes
MTLPENYRRVLNLIKVGADNPITGAEISLILKLEERSVQSIISSLITRYNVPIIGIRHGFNRGYFIPANKEELLGGAKAFYNQVQKEQERLSVLLNADLTSYKELLKGG

SEQ ID NO: 8401 - DNA, 270 bp, Streptococcus pyogenes
atgaacgtatttagtcaagattatgaagccaaactcttagaacaaaacctgaccgcttttaatcactttttggaagcctaccagaaacctaaaccaagagttttagggttgatcacggccgaacaagtcaaagaggaattaaatatcaaaggtaaaaccctaaaacggtgggaaaatgctgggttaagacgataccaaccaccactagaagacaccaggaaacattattacaaggtcagtgatattcttatctttttgggggtaaatgtg

SEQ ID NO: 8402 - protein, 90 aa, Streptococcus pyogenes
MNVFSQDYEAKLLEQNLTAFNHFLEAYQKPKPRVLGLITAEQVKEELNIKGKTLKRWENAGLRRYQPPLEDTRKHYYKVSDILIFLGVNV

SEQ ID NO: 8403 - DNA, 855 bp, Streptococcus pyogenes
atggctatttatgaagcaagaggctttagctcttatttgtacccctacaaaggacctttagaaccatttgactatattgctcagtttagacctttgaaaccgcctgaggatattgatattgaagaatacaagcgaacacaagccccctactgcctaagtggcaaggtcacagcagagaaaaacggtagctataagcgcaataatgctagtttagtttatcgcgatttgatttttcttgactatgacgagatagaaacaggcgtcaacctacctaaaatcgtttctcagacgctttgggagtatagttatattatttatccaacgattaaacacacccccgagaagccccgttatcgccttgtcatgaagcctagtgacgtgatgactgaagcaacttataaacaagtggtcaaggagatagccgataagattggactgccttttgatttagctagtcttacctggtcgcaattacaaggcttacccgttacaacaggcgacccagaggactatcagcgctatgtgaaccatggtcttgattatcctgttcctaaaaatggtagcacgccaaacagacaagttgttactacttacacgccacgccctagaagtcagcgttctattaccatgagggtcatagataccttgtttaatggttttggaaacgaaggcgggcgcaacgtggccttaactaaatttgttggcttgctatttaataaatgggtggattgtgatttagagacggcttatgagctggtacaaatagctaacagcgtgacaactaagccactacccattgatgagatagataggacgtttaccagcattgctaaagcagaatacagaaagagaggg

SEQ ID NO: 8404 - protein, 285 aa, Streptococcus pyogenes
MAIYEARGFSSYLYPYKGPLEPFDYIAQFRPLKPPEDIDIEEYKRTQAPYCLSGKVTAEKNGSYKRNNASLVYRDLIFLDYDEIETGVNLPKIVSQTLWEYSYIIYPTIKHTPEKPRYRLVMKPSDVMTEATYKQVVKEIADKIGLPFDLASLTWSQLQGLPVTTGDPEDYQRYVNHGLDYPVPKNGSTPNRQVVTTYTPRPRSQRSITMRVIDTLFNGFGNEGGRNVALTKFVGLLFNKWVDCDLETAYELVQIANSVTTKPLPIDEIDRTFTSIAKAEYRKRG

SEQ ID NO: 8405 - DNA, 1686 bp, Streptococcus pyogenes
ttgctaaagcagaatacagaaagagagggtagaaccatagagcaagaagatttgaaaaacttagaaaatgaaatcactgaagcgcgtgagaatgaagataaatatttcagcactttcaaaggtgttagaggtcagcttatcaaggaatgtcaagagatgaaagatgaagctttcaagattgcctatgatggcgttatggctgatagcaaacaccttgagaacgtaaaagcgggtagattgaccgaggtacaacatgaagaattagctaaagaaaaaggacaagaagccagtgaaaaagctttacctaaaacacctttgggcgtggctattatgctcaaacactatctccgctttattcgagttaaacctgaagctcaaggacaaaaagccccactttacttttttcatcctgatcacggggtttggctagaagataatgagtttttacaagatctcatttcagttattttcccaaacgcgactgaaaaacaagcttttgacacactttacaaaattgctaggcaaagtcaactgaaggagattcaaagagaatatacagttatcggaaatcagctctacaattataaaactggtcaatttgaagaattaactccagatataaccgtcactcgtaaaattaagacgggttacaataagaaagctaaagaacccacaataaagggctggaaacctactgcttggctcttagaattgtttgacggtgacgccgaactttataaccttgctattcagattattaaagctagcatcacaggtcaatccttacagaaaatcttctggttattcggtgaaggtgggacaggaaaagggacttttcagcaattactcattaatttagtgggtatggataacgtggcaagccttaaaataacagagctagcaaaaagtcgctttactacttcgatacttctagggaaatccattgtaattggtgatgatattcaaaaagacgcggttatcaaagatacgtctgatatatttagtttagccaccggtgacattatgacgattgaggacaaggggaaacgcccatatagtatccgtttaaacatgactgtggtacaatcttccaacggtttaccacggatgaacggtgataagtccgccattgatagacgctttaggattttaccttttaccaaagtatttaaaggaaagcccaacaaagctatcagaaatgattatattaatcgcaaagaagttcttgagtacttacttaagctagcgattgaaacaccaatcactgacattaatccaaaagcatctattgagatactggaagaacaccataaagagatgaacccagttattgacttcgtttctaagttcttcacggatgagctcaccagcgaatttattcctaatagctttgtctatcatgtttggaaaggctttttagaatactatgacatcaaacaaataaaatcagaaagagggttacataaagaaatcaaaagcaatcttcctgaagggtttgaagcaggccagaaggtcataccagtaggccgacagctccatacaggtttttatcctaaagaagatctacctctgtttgctagcgcatcttacgctaacggtagagcatcacccgaaaaaaggaaaaagccaaagaatgaacgtggatattacaatcattggccgacgcacaaaaaacaaaagaaaact

SEQ ID NO: 8406 - protein, 562 aa, Streptococcus pyogenes
LLKQNTEREGRTIEQEDLKNLENEITEARENEDKYFSTFKGVRGQLIKECQEMKDEAFKIAYDGVMADSKHLENVKAGRLTEVQHEELAKEKGQEASEKALPKTPLGVAIMLKHYLRFIRVKPEAQGQKAPLYFFHPDHGVWLEDNEFLQDLISVIFPNATEKQAFDTLYKIARQSQLKEIQREYTVIGNQLYNYKTGQFEELTPDITVTRKIKTGYNKKAKEPTIKGWKPTAWLLELFDGDAELYNLAIQIIKASITGQSLQKIFWLFGEGGTGKGTFQQLLINLVGMDNVASLKITELAKSRFTTSILLGKSIVIGDDIQKDAVIKDTSDIFSLATGDIMTIEDKGKRPYSIRLNMTVVQSSNGLPRMNGDKSAIDRRFRILPFTKVFKGKPNKAIRNDYINRKEVLEYLLKLAIETPITDINPKASIEILEEHHKEMNPVIDFVSKFFTDELTSEFIPNSFVYHVWKGFLEYYDIKQIKSERGLHKEIKSNLPEGFEAGQKVIPVGRQLHTGFYPKEDLPLFASASYANGRASPEKRKKPKNERGYYNHWPTHKKQKKT

SEQ ID NO: 8407 - DNA, 171 bp, Streptococcus pyogenes
atgaaaatcaaactattttatcaaaaacacaatgaatcactagatgattttgaatatcgggtcaatctctttaccctatcggtatctgtgatagacatcaagttttcagaagccacttatggcaactatgaagacatgagtaccacaacttctttattggtcttgtacagg

SEQ ID NO: 8408 - protein, 57 aa, Streptococcus pyogenes
MKIKLFYQKHNESLDDFEYRVNLFTLSVSVIDIKFSEATYGNYEDMSTTTSLLVLYR

SEQ ID NO: 8409 - DNA, 171 bp, Streptococcus pyogenes
atgaaactaaaattacacacacgaggtggtaacaccatcaccatacaaggagaccgcaccctttataatgagttgatcaaatatcttttatctggccaacagccaaactgggtagcatctccttctgccatcatcaatttatcagacattatagcaatcacaaaagagaaa

SEQ ID NO: 8410 - protein, 57 aa, Streptococcus pyogenes
MKLKLHTRGGNTITIQGDRTLYNELIKYLLSGQQPNWVASPSAIINLSDIIAITKEK

SEQ ID NO: 8411 - DNA, 507 bp, Streptococcus pyogenes
atgagaacattttcagacacaccaaagacattcacattccactacacgtttaaagactttgacaccgcacaagtggcttgtcatgctattttaggctatatgactggtacttatgagcaaccagtgattgacgcaacttatcacaatgatgaccaaggtggtcatgctaatcagttagtcttaaaatatgttgaagacagaaagttaagcaaggtcttcaagcgtatctgtgacagtttcaaggactattacaaccaacctgaggatatgacggatgaagaacttgattatcagcgcgtggtttctttatctaaaagtactcaagggaaagttaataatcgagacacacttatagccttcatctccgatcacaaccaactggctgaacacctctctatgaattataaagagatgacgccagaagacttaggggccatccttgagtctatcagtcaagcctttaaccatttgtatgatatggttgttgaaggtcagttactcgttaaa

SEQ ID NO: 8412 - protein, 169 aa, Streptococcus pyogenes
MRTFSDTPKTFTFHYTFKDFDTAQVACHAILGYMTGTYEQPVIDATYHNDDQGGHANQLVLKYVEDRKLSKVFKRICDSFKDYYNQPEDMTDEELDYQRVVSLSKSTQGKVNNRDTLIAFISDHNQLAEHLSMNYKEMTPEDLGAILESISQAFNHLYDMVVEGQLLVK

SEQ ID NO: 8413 - DNA, 96 bp, Streptococcus pyogenes
ttgccagtagtagcaacagtctgtcttgcttcgattgagcgtggcttgatgaaccttctgacaagaaccacaagcaaaggcatgagaagccttaaa

SEQ ID NO: 8414 - protein, 32 aa, Streptococcus pyogenes
LPVVATVCLASIERGLMNLLTRTTSKGMRSLK

SEQ ID NO: 8415 - DNA, 486 bp, Streptococcus pyogenes
atgttagaactatctattgagaatatcattaaaccaatgaagacacaggggaagacaagagttacaggatcaataggtgaccaagctatccgcataaacctagatgggctagtgattcactacaatggtcaaggcctattgcttgaaacgattccaggaacttatggtggtaaacgttactttttcgtgtgtcctgactgtgagagacgttgtcggaaattatttaaggcttctcatgcctttgcttgtggttcttgtcagaaggttcatcaagccacgctcaatcgaagcaagacagactgttgctactactggcaattagcctttaaagagtgtttgaaagtaaatccagaagcaagacacattcatggatattatagtcgtgatgactttcctaaacgtccaaagtacatgagattaaccaaatacctttatcactggagaagatttcattactatatggataagggtgacaggtactggcta

SEQ ID NO: 8416 - protein, 162 aa, Streptococcus pyogenes
MLELSIENIIKPMKTQGKTRVTGSIGDQAIRINLDGLVIHYNGQGLLLETIPGTYGGKRYFFVCPDCERRCRKLFKASHAFACGSCQKVHQATLNRSKTDCCYYWQLAFKECLKVNPEARHIHGYYSRDDFPKRPKYMRLTKYLYHWRRFHYYMDKGDRYWL

SEQ ID NO: 8417 - DNA, 150 bp, Streptococcus pyogenes
ttgatgatttatactataaactctaaaaagtgcttagaaacgattttagaagcgaaaagcgaagtactacaaaaaatatctagtttacaaaacgaacaaaacaaaaagacgtccacacggaacgcccccttggttaaatttaagcttaac

SEQ ID NO: 8418 - protein, 50 aa, Streptococcus pyogenes
LMIYTINSKKCLETILEAKSEVLQKISSLQNEQNKKTSTRNAPLVKFKLN

SEQ ID NO: 8419 - DNA, 360 bp, Streptococcus pyogenes
atgagcgctaaagaacaacttaaagaattgaaaccacttttcgctttaataaccttatttgaggaacaacgagataaagacatcaagctgataaatgcttttcataatcctgaagcaataagacatatcgaaaaaggtacagctaaacaactcttatatttagctaaagaacgtgacaagagactggccatgatcgccacactccaagatgagagacagatagccgttattaaggctagatacgtggatgacttatcatgggacgagatactcgataaactaggttactcaataaacactgtgttcaaactacatagaaaagctttagaggtattagatgaacaagaagaacgctattcg

SEQ ID NO: 8420 - protein, 120 aa, Streptococcus pyogenes
MSAKEQLKELKPLFALITLFEEQRDKDIKLINAFHNPEAIRHIEKGTAKQLLYLAKERDKRLAMIATLQDERQIAVIKARYVDDLSWDEILDKLGYSINTVFKLHRKALEVLDEQEERYS

SEQ ID NO: 8421 - DNA, 381 bp, Streptococcus pyogenes
atgaacaagaagaacgctattcgtaagctgaaagaattccatagatggcaacgtatcgctaatagccttgatttaacttataccgagctttaccagtttgatatagagtaccatcccacgcgcagaaaacaccttgaaataagccgagaatgcgccctagaggaactagatgctattaggtatgccattaatcaactgtctaaagtagaatatagacaaatactgattgagtgttacttgatcagtgaggaaaaaactcaacaggacattatggaagaacttaatggaagtcaaagctggtattatgaatctaagaaaagagccttgcttgagtttgtggaattttacagagacggggcgctaaaaaataatgttcactta

SEQ ID NO: 8422 - protein, 127 aa, Streptococcus pyogenes
MNKKNAIRKLKEFHRWQRIANSLDLTYTELYQFDIEYHPTRRKHLEISRECALEELDAIRYAINQLSKVEYRQILIECYLISEEKTQQDIMEELNGSQSWYYESKKRALLEFVEFYRDGALKNNVHL

SEQ ID NO: 8423 - DNA, 99 bp, Streptococcus pyogenes
atgattagaagaaaatcacttggtatcgtttgcaaatctgacttggcgggtcaaattagacataaaatgtcaaaaattagagtggattttttgactgac

SEQ ID NO: 8424 - protein, 33 aa, Streptococcus pyogenes
MIRRKSLGIVCKSDLAGQIRHKMSKIRVDFLTD

SEQ ID NO: 8425 - DNA, 573 bp, Streptococcus pyogenes
ttgatatttaattttaaggagaatatagtgaaaaagaaattagttttagctaccttatgtctatcaatgggtgctgtgagtgttagagcggaaagtgattttgggaatgctaatgaaatcgggctaggtttttatggtagtgatgactatactaaccaacctgctttaacaggagaccaagcgaaaataggcttcagaaacgattggaaagatgctagagattttggagtaaaaccaataaatctgggagatagtaaaatcgaagtaaaaacaaatccgggagctcttgtaagagtttccttgacaacgggtgaaacaaccaatagtatatgggagttaacaagtgtatcttcctcaatgagtaacggtatctacactaacacttataaaataaagccaactattgcaaattcttcaggaattgcaacgttcgatttagcgaactcaggaaaatacgacaaggaaaaaagtgaaattataaagagtactgagagtaatgcaaagaaaggtgatacttactcagttactacaagtatagatggatggacaataggttatggagaatggactgtg

SEQ ID NO: 8426 - protein, 191 aa, Streptococcus pyogenes
LIFNFKENIVKKKLVLATLCLSMGAVSVRAESDFGNANEIGLGFYGSDDYTNQPALTGDQAKIGFRNDWKDARDFGVKPINLGDSKIEVKTNPGALVRVSLTTGETTNSIWELTSVSSSMSNGIYTNTYKIKPTIANSSGIATFDLANSGKYDKEKSEIIKSTESNAKKGDTYSVTTSIDGWTIGYGEWTV

SEQ ID NO: 8427 - DNA, 204 bp, Streptococcus pyogenes
atgccctgcttttcaaaaaaaatagataaagaaaaggctgcgacagtatctgcaagcagggcaaaagaactagaagataggctcagtcatcagccattaattgatgattatcgagaaaagatgcaagatgcaagtgatgtgattcagtatatcaccaaacgtatagaagatcagttaaacaaggagttaacaaatggcaaaaac

SEQ ID NO: 8428 - protein, 68 aa, Streptococcus pyogenes
MPCFSKKIDKEKAATVSASRAKELEDRLSHQPLIDDYREKMQDASDVIQYITKRIEDQLNKELTNGKN

SEQ ID NO: 8429 - DNA, 99 bp, Streptococcus pyogenes
ttgaagtttcataagtttacctctttgattagttttctctttaaacattctaccattttttcttatattttaaacaagcatatatcatttgctttagtt

SEQ ID NO: 8430 - protein, 33 aa, Streptococcus pyogenes
LKFHKFTSLISFLFKHSTIFSYILNKHISFALV

SEQ ID NO: 8431 - DNA, 366 bp, Streptococcus pyogenes
atgggctgtgttaggctaggagaaaaaattatgaaaaaagatagtatctgtcaagtgggtgttataaatcaacaaaatgttacaaccgcaacgaactaccttgaaaaggaaaaagtccaaaaatcacttcgtattttatcaaaatttaccgataataaacagataaatatcatcttttatctccttgccgtcgaagaactctgtgtctgcgatatagcctgtttattaaatctcagtatggcatctgcctcccaccatcttcgtaaactagccaatcaaaacatcttggacactagaagagaggggaaaattatatattattttataaaagatgaggaaatcagagatttttttaatcaactagga

SEQ ID NO: 8432 - protein, 122 aa, Streptococcus pyogenes
MGCVRLGEKIMKKDSICQVGVINQQNVTTATNYLEKEKVQKSLRILSKFTDNKQINIIFYLLAVEELCVCDIACLLNLSMASASHHLRKLANQNILDTRREGKIIYYFIKDEEIRDFFNQLG

SEQ ID NO: 8433 - DNA, 942 bp, Streptococcus pyogenes
atgattatagggggattatatatgaaattttttgaagaaaattattcacaagaaatacctactcgtatcaaaaatttaagaaaaaaacacaatattacacaaagcgaactaggcaatgcaggtcaagttagtcaagttgaaagtggtaagcgaccaattacgagttcgatgttagtttatttaaatgctctaaccgcttcgaactatacgtatatcgtttttggagagttagatgagtttattgagaatctgtttcattattttttcagttctattttatatagagatttagaggctgtagatgaaaacctatattctttcatgagtgatgatttaatttcaatccaatcaagttgtctaagtattgccaagacatttgcaaatttcaatattcaaagaaaaagatttatgatttctactgaaactgaaatggatacttttcacaagaaagatgacattgacgtatgggttggtggaaaaagttataaccccgctaggagttttaggaataatccaataaatgaattaactgttattgattttgaagaaatggctgatattcttttgttgatgttgagagataatctaattaggtcgtttgaaattaatgtctgcaacacactgttcgaattagataaaaatggtgaaccgacaacatttaatctagataaaattgactcaataatcaataagtggtggtctgagaatgtctcaacagagataatacccaacctcataaaaaaacttagagaaaatcccttgtttaatatcggatttatggtaaatgatatattagaacgaatgtataaagaggacataccaaagtcttaccttacttctgttccattagttatttccaaaaaagcaaggtcaactttatcgattaagtcaaacggaagtcaaaaaatagataaatcaaaatttgcacagattttgtccctt

SEQ ID NO: 8434 - protein, 314 aa, Streptococcus pyogenes
MIIGGLYMKFFEENYSQEIPTRIKNLRKKHNITQSELGNAGQVSQVESGKRPITSSMLVYLNALTASNYTYIVFGELDEFIENLFHYFFSSILYRDLEAVDENLYSFMSDDLISIQSSCLSIAKTFANFNIQRKRFMISTETEMDTFHKKDDIDVWVGGKSYNPARSFRNNPINELTVIDFEEMADILLLMLRDNLIRSFEINVCNTLFELDKNGEPTTFNLDKIDSIINKWWSENVSTEIIPNLIKKLRENPLFNIGFMVNDILERMYKEDIPKSYLTSVPLVISKKARSTLSIKSNGSQKIDKSKFAQILSL

SEQ ID NO: 8435 - DNA, 600 bp, Streptococcus pyogenes
atgaccactaaaacctacttcatgagaagcttcaatctcatattatacttactgcttattgctccaatctgctatgtgttcggttggctgttcaatcttgtttcagttcaattatctaccgtcacatttgtcaatctggatacggttaaaaacgttactgataccattagttctgtatgttatggattcgctcttatttctttacttctagccttattatctggattaaagatgatacaacgcttgaatacagatagccttgggaactactgccaatctatttatcgcacctttctattaagacacttccttttccagcgtgaacgagtacagaaggtaagcaactttgaacaccagaccgttaccactatcaatccaatccataacgggtttaaccgagctgtacgtaagtgtatcgtagatatacgaaaagatgccattactgtatttctaaaagttcctagagaccaacaggggcaaaaaatcctaaaggatacgggagtacaactgaaagaagagattgtcatccaacacacagactattatttctcttctcctgttcgagttcgtaaccaattgtggtttattggtcaaaagcgt

SEQ ID NO: 8436 - protein, 200 aa, Streptococcus pyogenes
MTTKTYFMRSFNLILYLLLIAPICYVFGWLFNLVSVQLSTVTFVNLDTVKNVTDTISSVCYGFALISLLLALLSGLKMIQRLNTDSLGNYCQSIYRTFLLRHFLFQRERVQKVSNFEHQTVTTINPIHNGFNRAVRKCIVDIRKDAITVFLKVPRDQQGQKILKDTGVQLKEEIVIQHTDYYFSSPVRVRNQLWFIGQKR

SEQ ID NO: 8437 - DNA, 96 bp, Streptococcus pyogenes
atgtcacaagaagagcttgctgaaatgatgtatgtttcaagaagactatctcaaactgggaaaacggtaaaagctatccagacctgcaaaatcttt

SEQ ID NO: 8438 - protein, 32 aa, Streptococcus pyogenes
MSQEELAEMMYVSRRLSQTGKTVKAIQTCKIF

SEQ ID NO: 8439 - DNA, 840 bp, Streptococcus pyogenes
atggtttcatttatttcaagagtttttaaaggcatgattattgcactaggttttattttacctggtgtatccggtggtgttctcgcagccattttaggaatctatgagcgaatgatttcctttttagctcatatgagggataactttattgaaaatgtcttatttttcttaccagtaggaattggtggtattttaggtattgctctcttttctttccccgttgagtttttgcttaagcactatcaagttagcgtcttatggggatttgctggcgctattgtcggcactattcctagtctgattaaggagtcaaccaagcagtctcaaagagacaaagctgactggctatggctagtccttacctttgttatttcaggactaggtctttacttcttaaatgacttaatcggtaccttaccagctaactttttaacctttattttagcaggtgccttaattgctttaggagtactggtccctggactaagcccgtcaaatctcttacttatcttaggactctatggtcctatgttaatagggttcaaatctttggatttattagggactttcttacctattgctatcggaggagtcctagccatcttggctttttctaaaagtatggattatgctttacagcaccatcattcaaaagtttaccactttatcattggtattgtattatccagcacgctattaattcttattccaaatagtagtagtcccgaatccatttcctacagtcatgcaggtatcttaacctggcttatggcctttgtgttatttgctcttggtatttggctcggactttggatgagtcaattagaagaaaaatacaaa

SEQ ID NO: 8440 - protein, 280 aa, Streptococcus pyogenes
MVSFISRVFKGMIIALGFILPGVSGGVLAAILGIYERMISFLAHMRDNFIENVLFFLPVGIGGILGIALFSFPVEFLLKHYQVSVLWGFAGAIVGTIPSLIKESTKQSQRDKADWLWLVLTFVISGLGLYFLNDLIGTLPANFLTFILAGALIALGVLVPGLSPSNLLLILGLYGPMLIGFKSLDLLGTFLPIAIGGVLAILAFSKSMDYALQHHHSKVYHFIIGIVLSSTLLILIPNSSSPESISYSHAGILTWLMAFVLFALGIWLGLWMSQLEEKYK

SEQ ID NO: 8441 - DNA, 420 bp, Streptococcus pyogenes
ttgactgttgatgcgtcccagatccagctatggggtgaaattgattatttagtacagtcttctagaactattcattgtttcgttggtcaattagtcgttgatgactggaaaagcatacagcctaacgaagaagttgacaaggtctttatagtacctttacgtcagctacttttcactgatcctgtctattatcgtttagaagtcactcctattgagacaacggattttccttttgaccgtattcgtaatgggaaatactaccaatttagtcaagagtaccgtagtattccgttttatgaaaatctagaagaaaccatatggggaatgactgcccagtttactaagtgtttaaccgatattctaaatgatgaatcaattgcaaagaaaaacccctcagatattgaaaaatctaaggggaga

SEQ ID NO: 8442 - protein, 140 aa, Streptococcus pyogenes
LTVDASQIQLWGEIDYLVQSSRTIHCFVGQLVVDDWKSIQPNEEVDKVFIVPLRQLLFTDPVYYRLEVTPIETTDFPFDRIRNGKYYQFSQEYRSIPFYENLEETIWGMTAQFTKCLTDILNDESIAKKNPSDIEKSKGR

SEQ ID NO: 8443 - DNA, 153 bp, Streptococcus pyogenes
ttgaccaaaaagctaggattggttatgatgaagataagattaacggaaagagaaattagggaagactatgaaggacttattaaaacagtatcaggcaaaaccactaggagaggagaagcggtacgccgtatttttacctcttattcttgtcaa

SEQ ID NO: 8444 - protein, 51 aa, Streptococcus pyogenes
LTKKLGLVMMKIRLTEREIREDYEGLIKTVSGKTTRRGEAVRRIFTSYSCQ

SEQ ID NO: 8445 - DNA, 324 bp, Streptococcus pyogenes
atgtattttccagtatcggctaccttgattgaatttctgattttagccattgtcgaaaaaaatgattcttacggttacgatattagtcaaaccattaaactagtggctaatatcaaagaatccactctctatcctattcttaaaaaattggagaaagcaggttttttgacaacttatagtcaagaacatcagggacgaaagcgtaaatattatgctgtcacttcttcggggagagcacagctgatttttctaaaaaaagaatggcagagctataaatttgccttagacgggattattgaagggagcttaagacatgacaaggac

SEQ ID NO: 8446 - protein, 108 aa, Streptococcus pyogenes
MYFPVSATLIEFLILAIVEKNDSYGYDISQTIKLVANIKESTLYPILKKLEKAGFLTTYSQEHQGRKRKYYAVTSSGRAQLIFLKKEWQSYKFALDGIIEGSLRHDKD

SEQ ID NO: 8447 - DNA, 585 bp, Streptococcus pyogenes
atgacaaggactgagtatctagcagaactagataaatacttgcgcaaactacctagagaagactaccatgaagcgatggaatattatattgaatattttgatgaagctggtcctgacaaagaaagccaggttatcgacgatttaggaaatcctaaggaagctgccagtgaaatcatttcaaatgttctaggaaaacacttggcaactcccgagaaaactcccaaaaatcgggcaacaattattggattaaccattttgtccctctttgctgctccgattgctttacccgtattgctggcgttgattctctttattattgcctgcctaatgctcgggctcacagctatctttgccgcctacatttttgggcttgcaggtattcttgtcgcaggagtgaccctgtttgaaagcttgaccttgattggctcatctattcctgcacaagctatgggcatcggcagcgccttgttgtgttttggtggtggtcttcttatttggattattgccacagcattccttcgtttttcaggacgggcttttgttgcctttattaagtggatcagtaataagaaaggagctcaagca

SEQ ID NO: 8448 - protein, 195 aa, Streptococcus pyogenes
MTRTEYLAELDKYLRKLPREDYHEAMEYYIEYFDEAGPDKESQVIDDLGNPKEAASEIISNVLGKHLATPEKTPKNRATIIGLTILSLFAAPIALPVLLALILFIIACLMLGLTAIFAAYIFGLAGILVAGVTLFESLTLIGSSIPAQAMGIGSALLCFGGGLLIWIIATAFLRFSGRAFVAFIKWISNKKGAQA

SEQ ID NO: 8449 - DNA, 1077 bp, Streptococcus pyogenes
atgaaaaatatctcacgcaaatgctttatgaccagtgtggtatgtattattctaggaggcattcttctagggactggctatgcaactggaggacttcaggacattaaacaccaaacagctcccaaaaaggtcatcaaaacatttgaccaaataactgctcttgatattgacagttctgcctcaactattacagtagagacaggacccgttcaaagaccaacagtgacctattacacacatcctaaacttattgatcctatcgtcacaacagtaacaggtaagaccctatctctttcgcaaacacctaaagacgttgtcatcactggtggaattgaaattttaggttttactctcaataatagtcgtcaagagaagaactaccgttctattaccattactgttcctgaaaaaactagcctcaatgaagttaaggcaagtaatgtcccacataccactttgtcaaatctaactgtccaagatatgcaattcgatggcaatcttactcttttacataccaaagtcaagaaagctactatcactggtatgttggaagccactaaaagtcagttaacaaatctcgagttaaaagctgactattctttttcaaacctgactgattctagtgtggaaaatgggaccatcagcttaggaaatggacaactaactactaaagataccactctaaaagctgtcaatattcaatcattacaccctggtggtatagaagccgagagaacaacccttgaaaatgtgaccttcactgtttctaaaagcaaagaagaagaggagaacgactactatgacaatgatgctatcttcaccgctcatgcccttacccttaaagggactaatactattactggtggtgatattgatgttgacataaccttgacaaaagcaaaggccatcgcctacagagcaaggaccgaaaatggtaaagtctcccttggctcacagctgacaccagctaagattggtaaggaatcaacttcagatgttatttcttatgtggctgagaataaagcagctactggaaatttaacggttaatctcaataagggagacattactatcaaa

SEQ ID NO: 8450 - protein, 359 aa, Streptococcus pyogenes
MKNISRKCFMTSVVCIILGGILLGTGYATGGLQDIKHQTAPKKVIKTFDQITALDIDSSASTITVETGPVQRPTVTYYTHPKLIDPIVTTVTGKTLSLSQTPKDVVITGGIEILGFTLNNSRQEKNYRSITITVPEKTSLNEVKASNVPHTTLSNLTVQDMQFDGNLTLLHTKVKKATITGMLEATKSQLTNLELKADYSFSNLTDSSVENGTISLGNGQLTTKDTTLKAVNIQSLHPGGIEAERTTLENVTFTVSKSKEEEENDYYDNDAIFTAHALTLKGTNTITGGDIDVDITLTKAKAIAYRARTENGKVSLGSQLTPAKIGKESTSDVISYVAENKAATGNLTVNLNKGDITIK

SEQ ID NO: 8451 - DNA, 99 bp, Streptococcus pyogenes
ttgtcttattttgacaataacttgacaatttctgtcaagttttttattgtcttgttaagattatttgatagtaatgtctcccttattgagattaaccgt

SEQ ID NO: 8452 - protein, 33 aa, Streptococcus pyogenes
LSYFDNNLTISVKFFIVLLRLFDSNVSLIEINR

SEQ ID NO: 8453 - DNA, 117 bp, Streptococcus pyogenes
gtgattgtcaatattgatttcatcacagacctttacagtaatgtcaatgtttttacaactctgtcaatctattgtaatgtttttaaaatgattacaaaagtatcactatgtctaatc

SEQ ID NO: 8454 - protein, 39 aa, Streptococcus pyogenes
VIVNIDFITDLYSNVNVFTTLSIYCNVFKMITKVSLCLI

SEQ ID NO: 8455 - DNA, 1023 bp, Streptococcus pyogenes
atgagtgaaaaaagtcttggtgaagtgttaagagaatcgcgtgttggaaaaaatatcacactagatgatatagaattgaagacagggatttcttcccattacttgctggcaatggaattggatcagtttaaaattattccggaagaaaaatttgatcaatttttaaaagaatatgctgacattgttgagttagatttcaatactttaaaaagacgataccgttatcaagttaattccaaaaaagacagtgatataaaatctgtaactgagattgttgaagagaagttaagtaagaaacgattacaagagaagttgttatcacatcagagcatggggtatggtcaaccgttagaagtttctaaaaacaaagaaaccttagttatccctgtaaagactgttggtttagatagcaaatcgccactaaaaacgatatcgcctgttagccaatttaaatcagataacaggttaattcctaaaaaaaatgtgtcacgtatgaggcgaaatagcactgacagtcgttctaaaacgtcactatttcccatagttatattaggaacgattgcttttgcaattatcagtgttatcattttaggtgtttggcaacaattcgaaaagagtcaaagagctaaagaagctgaagttgctttgcttaaagcctctgagcagtctactaacggtttaaaaaataattcaaatgatcgcaaaactcaagtcacaactgaggggtcgggtaattatttaatagcgactgttactaaatctaaagagaccgttgatatcagtgtgtctttaaccgaggcacaaagtagttggatttctctaacaaattcagaaattggtgaaggtggtataacattgactcaagactcgccaacttatacagcgactttacctgcagaaataacagaatcattgttgacacttggtgtgacaaaaggtgtatctgtaacaattgatggacaacctgttgatctatcacctttaacaagtactgacttaagttatatcacgtttaagatccaa

SEQ ID NO: 8456 - protein, 341 aa, Streptococcus pyogenes
MSEKSLGEVLRESRVGKNITLDDIELKTGISSHYLLAMELDQFKIIPEEKFDQFLKEYADIVELDFNTLKRRYRYQVNSKKDSDIKSVTEIVEEKLSKKRLQEKLLSHQSMGYGQPLEVSKNKETLVIPVKTVGLDSKSPLKTISPVSQFKSDNRLIPKKNVSRMRRNSTDSRSKTSLFPIVILGTIAFAIISVIILGVWQQFEKSQRAKEAEVALLKASEQSTNGLKNNSNDRKTQVTTEGSGNYLIATVTKSKETVDISVSLTEAQSSWISLTNSEIGEGGITLTQDSPTYTATLPAEITESLLTLGVTKGVSVTIDGQPVDLSPLTSTDLSYITFKIQ

SEQ ID NO: 8457 - DNA, 1206 bp, Streptococcus pyogenes
atgaaaatagcagttgctggatcaggatatgttggattatcactaggagttcttttatcacttcaaaacgaagtcactattgttgatattcttccctctaaagttgataagattaataatggcttatcaccaattcaagatgaatatattgaatattacttaaaaagtaagcaattatctattaaagcaactttagatagcaaagcagcttataaagaagcggaactggtcattattgccacacctacaaattacaacagtagaattaattattttgatacacagcatgttgaaacagttatcaaagaggtactaagcgttaatagccatgcaactcttatcatcaaatcaacaattccaataggtttcattactgaaatgagacagaaattccaaactgatcgtattatcttcagccctgaatttttaagagaatctaaagctttatatgacaacttatatccaagccgaattattgtttcttgtgaagaaaacgattctccaaaagtaaaggcagacgcagaaaaatttgcacttttattaaagtctgcagctaaaaaaaataatgtaccagtacttattatgggagcttcagaagctgaagcagtaaaactatttgccaatacttatttagcgttaagggtagcttattttaatgagttagacacttacgcagaatcgagaaaattaaatagtcacatgattattcaaggaatttcttatgatgatcgaataggaatgcattataataacccatcatttggttatggaggttattgtctacctaaagatacgaagcaattattggcaaattacaataatattcctcaaacgctaattgaagctatcgtttcatcaaataatgtgcgcaagtcctatattgctaagcaaattatcaacgtcttagaagagcgggagtccccagtaaaagtagtcggggtttaccgtttaattatgaaaagtaactcagataattttagagaaagtgctatcaaagatgttattgacattcttaaaagtaaagacattaagataattatttatgagccaatgttaaacaaacttgaatctgaagatcaatctgtacttgtaaatgatttagagaatttcaagaaacaagcaaatattatcgtaactaatcgctatgataatgaattacaagatgttaaaaataaagtttacagtagagatatttttaatagagac

SEQ ID NO: 8458 - protein, 402 aa, Streptococcus pyogenes
MKIAVAGSGYVGLSLGVLLSLQNEVTIVDILPSKVDKINNGLSPIQDEYIEYYLKSKQLSIKATLDSKAAYKEAELVIIATPTNYNSRINYFDTQHVETVIKEVLSVNSHATLIIKSTIPIGFITEMRQKFQTDRIIFSPEFLRESKALYDNLYPSRIIVSCEENDSPKVKADAEKFALLLKSAAKKNNVPVLIMGASEAEAVKLFANTYLALRVAYFNELDTYAESRKLNSHMIIQGISYDDRIGMHYNNPSFGYGGYCLPKDTKQLLANYNNIPQTLIEAIVSSNNVRKSYIAKQIINVLEERESPVKVVGVYRLIMKSNSDNFRESAIKDVIDILKSKDIKIIIYEPMLNKLESEDQSVLVNDLENFKKQANIIVTNRYDNELQDVKNKVYSRDIFNRD

SEQ ID NO: 8459 - DNA, 123 bp, Streptococcus pyogenes
gtgaaatggactaatgattatttgaaaggaaaccataactttcaggttggcaccccttaccgtgcagcttctttcattgagaagattgagatagtatctcgttttgataaagcagatgctaat

SEQ ID NO: 8460 - protein, 41 aa, Streptococcus pyogenes
VKWTNDYLKGNHNFQVGTPYRAASFIEKIEIVSRFDKADAN

SEQ ID NO: 8461 - DNA, 111 bp, Streptococcus pyogenes
ttgaaagcatgtctcccattcaatactgatgaatataagattattgtaaggagtcaaaagattgaaatcgtatcagcgatgattattgtcatttcaatctttgaaagagag

SEQ ID NO: 8462 - protein, 37 aa, Streptococcus pyogenes
LKACLPFNTDEYKIIVRSQKIEIVSAMIIVISIFERE

SEQ ID NO: 8463 - DNA, 231 bp, Streptococcus pyogenes
gtgtctatgaaaccaatagatttgtctaagatggttagtatcagaaaacgttctaagaaagtcatgaagacgaataagaagactttaggtaaatctatcgaagaacgtccagaatatattaatgatcgttctgaatttgggcattgggagattgatttggctctcggcaagaaaaccaaaagtgaagctgttatgttgactttggtagagcgccagacacgctatgcacta

SEQ ID NO: 8464 - protein, 77 aa, Streptococcus pyogenes
VSMKPIDLSKMVSIRKRSKKVMKTNKKTLGKSIEERPEYINDRSEFGHWEIDLALGKKTKSEAVMLTLVERQTRYAL

SEQ ID NO: 8465 - DNA, 267 bp, Streptococcus pyogenes
atgaacatgtctaatattaattctaccagaaaatcatcctattctcatctttcagccacagaacggggtgaaattgctgcttatcttaaaatgggaaagaaacccgttgagattgctcgacttctgggtagtcaccgttctacaatctgccgagaaataaaacgtggttcagtagatcaggtaaaggataagaatggaaaacaaaccttcttcaacgcctatttcgctgatagtagacaacgtgtctatgaaaccaatagatttgtc

SEQ ID NO: 8466 - protein, 89 aa, Streptococcus pyogenes
MNMSNINSTRKSSYSHLSATERGEIAAYLKMGKKPVEIARLLGSHRSTICREIKRGSVDQVKDKNGKQTFFNAYFADSRQRVYETNRFV

SEQ ID NO: 8467 - DNA, 171 bp, Streptococcus agalactiae
atgtttgtcaaagggatttttcaagtattgcgtgacactacttggccaaatcgaaaacaacgttggaaagattttatttccatcttggaatacactgtatttttcacaatcgttatctacatctttgacaaactgttagccgcaggagtcatggacttgattaatcgattt

SEQ ID NO: 8468 - protein, 57 aa, Streptococcus agalactiae
MFVKGIFQVLRDTTWPNRKQRWKDFISILEYTVFFTIVIYIFDKLLAAGVMDLINRF

SEQ ID NO: 8469 - DNA, 1614 bp, Streptococcus agalactiae
atgagacgtaacatattattgagcattacttgtttattgatggtgactctgactgcatgccattcacaggatagcaaaagtcataaactaaacagtgataaactcacgcttgcttggggagaagactttggtgatgttaatccgcatcgctataaccctgatcagtttgttatccaggatatggtttatgaggggttggtacgatatggtgacaatgggaaaattgaaccagctttagcgaaaagctggagcattagtcaagatggaaaaacctacacttttaaattgagaaatgctaaatattctgatggcagtaactttaatgctgcgaatgtcaaacgtaattttgatagtattttttcgaagtctaatagaggtaatcataattggtttaatttaacgaatcaattggaaaattatcgtgccttgaatcaaagtacttttgaaattaaactgaaacaagcttatagtgctactttatatgatctctctatgattcgaccaattcgctttttatctgatagcgctttccctaaaggtgatgatacaactaagaagaatgtaaaaaaaccaattggaacgggtcaatgggttgtgaaaagtaaaaagcaaaatgaatatattaccttcaaacgtaatgagaattactggggaaagaaaccaaaattaaaagaagtaaccgtaaaagttatacccgatgctcagacgcgtgctttagcattcgaatcaggtgacgttgatttgatctatgggaatggcattattggtttagacacttttgcccaatatacgaaggacaagaaatatgtcacagctatttctcaacctatgtcaacaagacttttgttgctaaatgctaaggaaagtattttccaagataaaaaagttcgtcaggcaatgaatcatgctattgacaaggtttctattgctaagaacacctttagaggaacagaaaagccagcagacactattttttcaaaatcaacatctcactcagatgctaagttaaatccttatagctataatgttgataaagcaaatcagctattggatcaagctggttggaagatgggaaaagataaggttcgtgaaaaagatggtaaaactctaaccttacgtcttccttatatcgccactaaggcaactgataaagacctggtaacttatttccaaggagaatggcgtaaaatcggtattaatgtttctcttattgctatggaagaagatgattattgggctaatgctaaaaagggtaattttgatatgatgttaacctattcttggggagcaccatgggaccctcatgcttggatgtcggcattaactgccaaggcagatcatggacatccagaaaatatagctttagaaaatctagcaactaaaactgaaatggatagacttattaagtcagctctagtagatcctaaggaagaaaatgttgatagagactataagaaggttcttgaattattgcatgatgaggctgtatatatcccattaacttatcaatcggtgatttctgtttataggaaaggtgattttaaaaccatgcgttttgcgccagaagaaaattcattcccattacgctatatagaaaaaaacaatgtatctaag

SEQ ID NO: 8470 - protein, 538 aa, Streptococcus agalactiae
MRRNILLSITCLLMVTLTACHSQDSKSHKLNSDKLTLAWGEDFGDVNPHRYNPDQFVIQDMVYEGLVRYGDNGKIEPALAKSWSISQDGKTYTFKLRNAKYSDGSNFNAANVKRNFDSIFSKSNRGNHNWFNLTNQLENYRALNQSTFEIKLKQAYSATLYDLSMIRPIRFLSDSAFPKGDDTTKKNVKKPIGTGQWVVKSKKQNEYITFKRNENYWGKKPKLKEVTVKVIPDAQTRALAFESGDVDLIYGNGIIGLDTFAQYTKDKKYVTAISQPMSTRLLLLNAKESIFQDKKVRQAMNHAIDKVSIAKNTFRGTEKPADTIFSKSTSHSDAKLNPYSYNVDKANQLLDQAGWKMGKDKVREKDGKTLTLRLPYIATKATDKDLVTYFQGEWRKIGINVSLIAMEEDDYWANAKKGNFDMMLTYSWGAPWDPHAWMSALTAKADHGHPENIALENLATKTEMDRLIKSALVDPKEENVDRDYKKVLELLHDEAVYIPLTYQSVISVYRKGDFKTMRFAPEENSFPLRYIEKNNVSK

SEQ ID NO: 8471 - DNA, 975 bp, Streptococcus agalactiae
gtgaaacatattaccactgtagttatctggaagatacttaggtgtttgtcactcgtttttggagtatcaattttgacctttattttactaaaacaatcaccggttgatccagtcatggcaagtgtcaattatgacacgtcactaacccctgttcagtacaaagcgattgctcaccactatggtttggataagccagctccggtccagtattttatttggttaaaaaattttatacagggacatttagggacttcactagtttatcggcaacctgttattgatattattagatcacgggcaggtgcctctttcatacttatgggactctcctgggtcttatcgggtcttattggatttatcttaggaactttatcagctttccatcaagggaaattgcttgatcgaattgtaaggtggttttcttaccttcagatatcagtaccaactttttggattgggctcatttttttattaatcttttctgtccagctggggtggttcccgattggtatttcttccccgataggtactttgagtcaagatattacgttagctgatcgtattaagcaccttattttacctgttttcacgctaagtattctaggcattgccaatgtaactcttcatactagaactaaaatgatgtcggtactttctagtgaatatgtcttatttgccagagcgcgtggggaaacggaatggcaaatttttaaaaatcattgtcttagaaatgctatcgtaccagctattacactgcatttttcctattttggagaattgtttggaggatccgttcttgctgagcaagttttctcatatccaggactagggtctaccctaactgaagcaggacttaaaagtgatacaccgctacttctagctattgtgatgatagggacattatttgtttttgcgggcaatcttattgcggatattttaaacagcataatcaatccacagttaaggagaaaagta

SEQ ID NO: 8472 - protein, 325 aa, Streptococcus agalactiae
VKHITTVVIWKILRCLSLVFGVSILTFILLKQSPVDPVMASVNYDTSLTPVQYKAIAHHYGLDKPAPVQYFIWLKNFIQGHLGTSLVYRQPVIDIIRSRAGASFILMGLSWVLSGLIGFILGTLSAFHQGKLLDRIVRWFSYLQISVPTFWIGLIFLLIFSVQLGWFPIGISSPIGTLSQDITLADRIKHLILPVFTLSILGIANVTLHTRTKMMSVLSSEYVLFARARGETEWQIFKNHCLRNAIVPAITLHFSYFGELFGGSVLAEQVFSYPGLGSTLTEAGLKSDTPLLLAIVMIGTLFVFAGNLIADILNSIINPQLRRKV

SEQ ID NO: 8473 - DNA, 765 bp, Streptococcus agalactiae; identical to SEQ ID NO: 65

SEQ ID NO: 8474 - protein, 255 aa, Streptococcus agalactiae
LLVISAIFAPILSSFDPQYVDLSQKLLAPNNVHLLGTDQLGRDVLSRLLYGARYSLFLAIIISLLELTIGMFVGLIVGWYQGKLENLFLWIANIILAFPSFLLSLATVGILGHGLGNLIFAIVFVEWVYYAKLMTNLVKSAKKEPYVINAQIMGLSVWHILRKHIFPFVYQPILVMVLMNIGNIILMISGFSFLGIGVQPNVTEWGMMLHDARGYFRTATWMMLSPGIAIFLTVFSFNTLGDAIDKKDWKRQWNS

SEQ ID NO: 8475 - DNA, 1770 bp, Streptococcus agalactiae
atgagatatacaaatggaaattttgaagcctttgcaagacctcgaaaacctgaaggtgtggataaaaaatccgcttatattgttggttctggtttagcaggattagctgccgctgtctttttaatacgtgacggtcaaatggatggtcaacgtattcatatttttgaagaactacctctttctggaggatcacttgacggtgtcaaacgacctgatatcggttttgtaacgcgtggtggtcgtgaaatggaaaatcacttcgaatgtatgtgggatatgtaccgttccatcccctctctcgaagttccagatgcttcttatctagatgaattttattggcttgacaaggatgatcccaattcatctaactgtcgcctcattcataaacaggggaatcgcttagaatctgatggtgattttacactcggaacacattccaaagagttagttaagctagtcatggagactgaagagtctttaggtgctaagacgattgaagaagttttttcaaaagaattttttgaaagtaatttttggacttattggggtactatgtttgcctttgagaaatggcattcagcgattgaaatgcgtcgatatgctatgcgctttatccatcatattggtggtctgcctgatttcacttcattaaaatttaataaatataatcaatatgattctatggtgaaaccaatcatcagttatttagagtctcataatgtagatgttcaatttgatagcaaggtaactaatatctccgtagactttaagaacggtcagaagcttgcaaaagctattcatctcacagttggtggtgaagcaaaaacaattgatcttactccaaatgattttgtttttgtaacgaatggttctatcactgaaagtacgaactatggtagtcatgatactgtagctaaacctaataccgatttgggaggttcttggaatctttgggaaaacttagctgctcaatctgatgaatttggacatcctaaagtcttctacaaagatattccaaaagagtcatggtttgtttctgctactgcaacaataaaagatccagctattgaaccttatatagagcgtttaacacatcgtgacctccatgatggtaaagtaaataccggaggcattgttacagttacagattctaattggatgatgagttttgctatccatcgccaaccgcatttcaaagagcaaaaggaaaatgaaacaattgtttggatttatggactctattcaaatgtggaaggtaattatattaaaaaaccaattgaagaatgtactggtcgagaaatcacagaagagtggttatatcacttaggtgttcctgaaatgaagattcatgatttatctgataaacaatatgtaagtacagttcctgtttatatgccttacattactagttatttcatgcctcgagttaaaggtgaccgaccagatgttatcccacaaggatctgttaacctagccttcattggtaattttgcagaatctccatccagagatacagtatttacaacggaatattctattagaactgctatggaagctgtttatactttcttaaatattgaacgtggtgttccagaagtctttaattcagcatttgatattcgtgtcttgttgcaatctttatactatctcaatgataagaaatctgttgaagatatggatttaccaatacctgccttaatgcgtaaagtaggcatgaaaaaaattagaggaacttatttagaagaattacttcgagaagctcatctttta

SEQ ID NO: 8476 - protein, 590 aa, Streptococcus agalactiae
MRYTNGNFEAFARPRKPEGVDKKSAYIVGSGLAGLAAAVFLIRDGQMDGQRIHIFEELPLSGGSLDGVKRPDIGFVTRGGREMENHFECMWDMYRSIPSLEVPDASYLDEFYWLDKDDPNSSNCRLIHKQGNRLESDGDFTLGTHSKELVKLVMETEESLGAKTIEEVFSKEFFESNFWTYWGTMFAFEKWHSAIEMRRYAMRFIHHIGGLPDFTSLKFNKYNQYDSMVKPIISYLESHNVDVQFDSKVTNISVDFKNGQKLAKAIHLTVGGEAKTIDLTPNDFVFVTNGSITESTNYGSHDTVAKPNTDLGGSWNLWENLAAQSDEFGHPKVFYKDIPKESWFVSATATIKDPAIEPYIERLTHRDLHDGKVNTGGIVTVTDSNWMMSFAIHRQPHFKEQKENETIVWIYGLYSNVEGNYIKKPIEECTGREITEEWLYHLGVPEMKIHDLSDKQYVSTVPVYMPYITSYFMPRVKGDRPDVIPQGSVNLAFIGNFAESPSRDTVFTTEYSIRTAMEAVYTFLNIERGVPEVFNSAFDIRVLLQSLYYLNDKKSVEDMDLPIPALMRKVGMKKIRGTYLEELLREAHLL

SEQ ID NO: 8477 - DNA, 804 bp, Streptococcus agalactiae
atgaagataacattacacggcgttgctgaaacgttattaatcaccttatatattagggctaaagatgcgatggctaaacatccgatacttaatgatcaaaaatccttagcaattgttgaacagatagaatatgattttgataaattcgataattcagaagcttctttttatgcaacattagctagawttcgcgttatggatagagaaatcaaaaaatttattagagaaaatccaaatagtcaaatcctttcaattggttgtggacttgatacaaggtttgaaagagtcgataatggacaaattaggtggtataaccttgatttgccagaggttatggagataagaaaattattttttgaagagcatgaaagagttactaatatagcaaaatcagccctagatgaaacttggacacgggaggtaaatccccaaaatgccccttttctaatcgtgtcagaaggtgttttaatgtttctaaaagaagatgacgtagagacttttcttcatatcctgacaaattcatttagccaatttatggcacaatttgatttgtgtcataaggaaatgattaataaaggaaagcaacatgatacagtaaagtatatggatacagaatttcagtttggtatcacagatggtcatgagattgtggatttagaccctaaattaaagcaaataaatctgattaactttacagatgagatgagcaaatttgagttaggcacacttcgctctttacttccaacaattcgtaaatttaataattgtttaggtgtgtacgaatataaagcatctgagaaaaag

SEQ ID NO: 8478 - protein, 268 aa, Streptococcus agalactiae
  MISC_FEATURE (1)..(268): Xaa = Any Amino Acid
MKITLHGVAETLLITLYIRAKDAMAKHPILNDQKSLAIVEQIEYDFDKFDNSEASFYATLARXRVMDREIKKFIRENPNSQILSIGCGLDTRFERVDNGQIRWYNLDLPEVMEIRKLFFEEHERVTNIAKSALDETWTREVNPQNAPFLIVSEGVLMFLKEDDVETFLHILTNSFSQFMAQFDLCHKEMINKGKQHDTVKYMDTEFQFGITDGHEIVDLDPKLKQINLINFTDEMSKFELGTLRSLLPTIRKFNNCLGVYEYKASEKK

SEQ ID NO: 8479 - DNA, 1074 bp, Streptococcus agalactiae
gtgaagaatagagatccaaaaagaaaacataaaagtttactaggtctgcttaaatggtggattataggttttgcttttttattgttagtattagcaagccttgtagtgagactaccttattatttggaaatgccaggtggagcttatgatatccgttcggtattgaaagtgaataaaaaggctgataaagctaagggttcgtacaattttgtagcggtatctgtcagtcaagcaacgccagctcaggttctttatgcttggttaactccttttacagaattatctagtaaagaggagacaacaggtggctttagtaatgacgattatctcagaattaatcaattctacatggagacttctcaaaatgagtccatctatcaagctttaaagttagctaataagcaagtatctcttacttataaaggagtttatgtgcttaacttagctaaaaattcgacatttaaagatagattacatttagctgatacagtcacaggagttaatggcaaaagtttcaaaaattcttctcaacttatcaaatatgttgcagctcttcatctaggtgataaagtaaaggtacaatacacaagtcaaggtaaaaagaaagaatcagttggtaaagttattaaactatcaaacggtaaaaatggtattggtatcggtttgacagaccatacagaagtattatctgatgttcctgtggactttaatactgaaggtgttggaggaccaagtgcaggtttaatgtttactttagcgatttacgaccaattggttaaagaagatttacgtaaaggacgtaagattgcaggtactggtactattgagcaaaatgggcatgttggcgatattggtggagcaggtttgaaagttgtttcagcggctaaaaaaggaatggatattttctttgttcctaataatccgatcgataaaaatgctaaaaaaggcaaaacaaaggttcagacgaattatcaagaggcaaaagcagcagctaagcgattaggtacgaagatgaaaattgtaccagttcaaaatgttcagcaagctattgattatttgaaaaaaacaaaataa

SEQ ID NO: 8480 - protein, 357 aa, Streptococcus agalactiae
VKNRDPKRKHKSLLGLLKWWIIGFAFLLLVLASLVVRLPYYLEMPGGAYDIRSVLKVNKKADKAKGSYNFVAVSVSQATPAQVLYAWLTPFTELSSKEETTGGFSNDDYLRINQFYMETSQNESIYQALKLANKQVSLTYKGVYVLNLAKNSTFKDRLHLADTVTGVNGKSFKNSSQLIKYVAALHLGDKVKVQYTSQGKKKESVGKVIKLSNGKNGIGIGLTDHTEVLSDVPVDFNTEGVGGPSAGLMFTLAIYDQLVKEDLRKGRKIAGTGTIEQNGHVGDIGGAGLKVVSAAKKGMDIFFVPNNPIDKNAKKGKTKVQTNYQEAKAAAKRLGTKMKIVPVQNVQQAIDYLKKTK

SEQ ID NO: 8481 - DNA, 1740 bp, Streptococcus agalactiae; identical to SEQ ID NO: 161

SEQ ID NO: 8482 - protein, 580 aa, Streptococcus agalactiae
LMKSNQWQVFKRLISYLRPYKWFTVLALSLLLLTTVVKNIIPLIASHFIDHYLTNVNQTAVLILVGYYSMYVLQTLIQYFGNLFFARVSYSIVRDIRRDAFANMERLGMSYFDRTPAGSIVSRITNDTEAISDMFSGILSSFISAIFIFTVTLYTMLMLDIKLTGLVALLLPVIFILVNVYRKKSVTVIAKTRSLLSDINSKLSESIEGIRIVQAFGQEERLKTEFEEINKEHVVYANRSMALDSLFLRPAMSLLKLLAYAVLMAYFGFTGVKGGLTAGLMYAFIQYVNRLFDPLIEVTQNFSTLQTSMVSAGRVFDLIDETGFEPSQKNTEAFVREGNIEFKNVSFSYDGKKQILDNVSFSVKKGETIAFVGATGSGKSSIINVFMRFYEFQSGQVLLDGKDIRDYSQEQLRKNIGLVLQDPFLYHGTIKSNIKMYQDITDQEVQDAAEFVDADQFIQKLPDKYDAAVSERGSSFSTGQRQLLAFARTVASKPKILILDEATANIDSETEQIVQDSLAKMRQGRTTIAIAHRLSTIQDANCIYVLDRGKIIESGNHESLLDLKGTYYRMYQLQAGMMEV

SEQ ID NO: 8483 - DNA, 375 bp, Streptococcus agalactiae
atgtctgttattttaattattgttattcttctggcttttgttgcttgggcatcttggaattattggagggttcgtagggcagctaaatttttagataacgagtcttttcaaaaagaaatgtcacgaggacagttaattgatatccgagaagctggtgcttttcatagaaagcatattctcggagcacgtaacattccagcaagtcaatttaaagttgccttatcggctttgcgcaaagataaacctgtcctcttatatgacgcaagccgtggtcaatctattccaaggattgttttgttactcagaaaagaaggttttaatcaactttacgtgttaaaggacggtttcaattactggacgggtagagttaagtaa

SEQ ID NO: 8484 - protein, 124 aa, Streptococcus agalactiae
MSVILIIVILLAFVAWASWNYWRVRRAAKFLDNESFQKEMSRGQLIDIREAGAFHRKHILGARNIPASQFKVALSALRKDKPVLLYDASRGQSIPRIVLLLRKEGFNQLYVLKDGFNYWTGRVK

SEQ ID NO: 8485 - DNA, 714 bp, Streptococcus agalactiae
atgattattagtaaacacttaagcgtaagttatgataataatttagtgctagaagatattaatttacgcttagaaggctccggaatcattggtattttagggcctaatggggcggggaaatctacgcttatgaaagctcttcttggtttggttgattctactggagaatcagggattgggggagatttgctacctttaatggggagagtagcatatgttgaacaaaaaactaatattgattaccaattccctataactgttggagaatgcgtttctttaggattatataaggaacgaggcctcttcaagcgactatcaaaaactgactgggaaaaagtatcccgagtgattgatcaagttggtttgagagggtttgaaaatagaccaattaatgccttatcaggtggacaatttcaacgtatgcttatggcaagatgtctcgttcaagaagcggattacatttttttagatgagccgtttgtagggattgattccattagtgaacaaatcatagttaatttactaaaaaaattaagtaaggccggaaaattaattttagtcgtccatcacgatttgagtaaagttgatcattattttgatcaagtaattattttgaaccgtcatctaattgcttgtggaccaatagatcaggcatttacccgtgagaatttaagtgctgcttacggtgatgctattttgttaggacaaggagac

SEQ ID NO: 8486 - protein, 238 aa, Streptococcus agalactiae
MIISKHLSVSYDNNLVLEDINLRLEGSGIIGILGPNGAGKSTLMKALLGLVDSTGESGIGGDLLPLMGRVAYVEQKTNIDYQFPITVGECVSLGLYKERGLFKRLSKTDWEKVSRVIDQVGLRGFENRPINALSGGQFQRMLMARCLVQEADYIFLDEPFVGIDSISEQIIVNLLKKLSKAGKLILVVHHDLSKVDHYFDQVIILNRHLIACGPIDQAFTRENLSAAYGDAILLGQGD

SEQ ID NO: 8487 - DNA, 603 bp, Streptococcus agalactiae
atgaaacaagaaaaaactggccgtaatttaaatttctggaaatgggcatttctcttattgttggcaattaacctttccttcacagcagtgattgcaagtcgcttaattcaagtacgtgagcctaatacaggaaaaatttcgactggggtacaagataaagtaaaagtaggtacttttacgaccaataagtcgcaactgaataagacaattgcactttatttaaaacaatatcaaactaagaagatgaattataagatttatgctgcttcatcttctatactatttgaaggctcttatcaattattaggttatgaagtgcctttatacatctattttgaaccttatcgtttaacaaatggcgctgttcaacttaaagtgacctcattttcagtaggaactcttccgcttccagaaaaagatgtgttacaatatataaaatcatcttataaattgccaaactttgtagatataaaacctaaaaaatcggttattaatattaatttgcaagatttaaaaaataaagaaggtatttatttgaaagcgactgcaattgatttagtaaacgataattttagtttcgatatttttaagaaaaagccctaa

SEQ ID NO: 8488 - protein, 200 aa, Streptococcus agalactiae; identical to SEQ ID NO: 308

SEQ ID NO: 8489 - DNA, 1639 bp, Streptococcus agalactiae
aaaaaactggcgccgtgttggagttggtgtccttacacttgcttcagttgcgactcttgctgcatgtggaagtaaatcagcttcccaggattctaatggagcgattaattgggctattccaacagaaatcaatacactagatttatctaaagtcacagacacttactcaaatctagctattggtaactctagtagtaatttccttcgcttagataaagatggaaagacaagaccagatttggctactaaagtagatgtttcaaaagatggcttaacttatacagctacattacgtaaaggcttgaagtggtcagatggcagtaaacttactgcaaaggattttgtttattcatggcaacgtttagttgatcctaaaacagcttcacaatatgcttaccttgctgttgaagggcatgtgcttaatgccgataaaatcaacgaaggacaagagaaagacttgaataagctaggtgttaaggcggaaggcgatgacaaagttgttattactttatctagtccgtctccacaatttatctactaccttgcattcactaacttcatgccacaaaaacaagaagttgttgaaaaatatggaaaagattacgcaactacttcaaaaaatacagtttactcaggaccatatactgttgaaggttggaatggttcgaatggtactttcacgctgaagaaaaacaaaaattattgggacgctaaaaatgtaaaaacaaaagaagttcgcatccagactgttaaaaaaccagataccgccgttcaaatgtataaacgtggtgagttagatgcagctaatatctcaaatacttctgctatttatcaagctaataagaataataaagatgtcacagatgttctagaagcgaccactgcctatatggaatataatactactggttctgtgaaagggcttgataatgttaagattcgtcgcgccttaaacttagcaactaaccgtaaaggagttgttcaagcagccgttgatacaggctcaaaaccggcaattgcttttgcacctactggtttagccaaaacaccagatggaactgatttggcaaaatatgttgccccaggttatgaatataataaaactgaagcagcaaaactctttaaagaaggtttggctgaatcaggcttgactaagctaaaattaacaattacagcagatgctgatgctcctgctgccaaaaactctgttgactatatcaagtctacttgggaagctgctcttccaggacttactgttgaagaaaaatttgtaacctttaaacaacgcttagaagacagtagaaaacaaaactttgacatcgtagtttctctttggggtggggattatccagaaggatcaactttctacggcctctttaagtcagattcacaaaataacgatggaaaatttgctaacaaggactatgatgctgcttataacaaggcaatttctgaagatgcgatgaaaccagcagaatcagcgaaggactataaagaagcagagaaaattttatttgagcaaggtgcttataacccactctacttccgtagtggtaaaggtttacaaaatccaaaattaaaaggtgttattcgtaatactacaggtttgtcaatagactttacacatgcttataaaaaa

SEQ ID NO: 8490 - protein, 546 aa, Streptococcus agalactiae
KNWRRVGVGVLTLASVATLAACGSKSASQDSNGAINWAIPTEINTLDLSKVTDTYSNLAIGNSSSNFLRLDKDGKTRPDLATKVDVSKDGLTYTATLRKGLKWSDGSKLTAKDFVYSWQRLVDPKTASQYAYLAVEGHVLNADKINEGQEKDLNKLGVKAEGDDKVVITLSSPSPQFIYYLAFTNFMPQKQEVVEKYGKDYATTSKNTVYSGPYTVEGWNGSNGTFTLKKNKNYWDAKNVKTKEVRIQTVKKPDTAVQMYKRGELDAANISNTSAIYQANKNNKDVTDVLEATTAYMEYNTTGSVKGLDNVKIRRALNLATNRKGVVQAAVDTGSKPAIAFAPTGLAKTPDGTDLAKYVAPGYEYNKTEAAKLFKEGLAESGLTKLKLTITADADAPAAKNSVDYIKSTWEAALPGLTVEEKFVTFKQRLEDSRKQNFDIVVSLWGGDYPEGSTFYGLFKSDSQNNDGKFANKDYDAAYNKAISEDAMKPAESAKDYKEAEKILFEQGAYNPLYFRSGKGLQNPKLKGVIRNTTGLSIDFTHAYKK

SEQ ID NO: 8491 - DNA, 912 bp, Streptococcus agalactiae
atgattaaatatattttaaagcgtgttgctattttgttagtaacgctatgggttgtcataaccctatcgttctttctgatgcagatccttccaggaacaccctacaataatccaaaactcactgaagaaatgatcgcattgcttaataaacagtatggtttagacaagcctgtatggcaacaatatttgacttacctttggaatgtacttcatggtgactttggaacgagttatcaatcagtgaatcagccagtatcacgtatgattagcttgagattaggagtttcagtacatctaggtgttcaggctctcgtatttggtgttttaggcggtattttggtaggagctatttcggcacgtcataagaatgataaagtcgatggtatcttaagtgttattgcaacgctagggatttctatgccttcatttatcattggtatcttattattagactattttggatttaagtggaacttgttgcctttatcaggttgggggactttctctcaaaccattttaccttctttagctctaggactccctacattagcatctgtttcacgcttcttccgtagtgaaatgattgaaactttaaattctgattatgtgcaactagctcgttcaaaaggtatgacaattcgtcaagtaactcgaaaacatgcttaccgtaattctatgattccaattttaactctaattggccctttggcggcgggtctgttaactggttctgcactaattgagcagattttctcgattccaggaattgggcagcagtttgttacttcgattccaacaaaagactatcctgttattatggggacaaccattgtttatgcagtaatgttgatggttgctatcttgataacagacgttgttattagtatcgtagacccacgtgttcgcttgcag

SEQ ID NO: 8492 - protein, 304 aa, Streptococcus agalactiae
MIKYILKRVAILLVTLWVVITLSFFLMQILPGTPYNNPKLTEEMIALLNKQYGLDKPVWQQYLTYLWNVLHGDFGTSYQSVNQPVSRMISLRLGVSVHLGVQALVFGVLGGILVGAISARHKNDKVDGILSVIATLGISMPSFIIGILLLDYFGFKWNLLPLSGWGTFSQTILPSLALGLPTLASVSRFFRSEMIETLNSDYVQLARSKGMTIRQVTRKHAYRNSMIPILTLIGPLAAGLLTGSALIEQIFSIPGIGQQFVTSIPTKDYPVIMGTTIVYAVMLMVAILITDVVISIVDPRVRLQ

SEQ ID NO: 8493 - DNA, 849 bp, Streptococcus agalactiae
atgaataaggcattattagagggaaaagatttatcaaaaatgttaggagagttaggtttttctgacactgttatcacacaggttgcattagctgatttgcatggtaacatttcaaggagcctactaaagattgagtcttatttagctaatcttttgttagttagaaaaaaagtaatagaagtagctacttacccattgatattattgtcttttctggtgctaattatgattggccttaggaattatttaatgccccaattaggagaaaataattttgcaactagactgattacaaatgtgccgaatattttcttattacttttagcagttgtacttatttttagtttaatattttatattattcaaaagcgattgtcgcgcattaaagtagcttgttttttaacaacaattcccttagttggatcatatgttaagctttatttaactgcttactatgcccgtgagtggggaaatttattaagtcaaggtattgaattggaccaaattgttaaagtaatgcaaaatcagaaatccaaactttttagggaaataggatatgacatggaagaaggttttctatcaggtaaagcatttcaccaaaaagtattagactatccgtttttcttaactgagcttagtttaatgattgaatatggccaagttaaggcgaaattaggaacagagttagatatatatgctgatgagaagtgggaggatttttttacaaaattagctagagcgacccagttaatccaacccgttatttttatttttgtagctcttatcattgttatgatttatgcagcaatgctgttaccaatgtatcaaaatatggagatattatcatga

SEQ ID NO: 8494 - protein, 282 aa, Streptococcus agalactiae
MNKALLEGKDLSKMLGELGFSDTVITQVALADLHGNISRSLLKIESYLANLLLVRKKVIEVATYPLILLSFLVLIMIGLRNYLMPQLGENNFATRLITNVPNIFLLLLAVVLIFSLIFYIIQKRLSRIKVACFLTTIPLVGSYVKLYLTAYYAREWGNLLSQGIELDQIVKVMQNQKSKLFREIGYDMEEGFLSGKAFHQKVLDYPFFLTELSLMIEYGQVKAKLGTELDIYADEKWEDFFTKLARATQLIQPVIFIFVALIIVMIYAAMLLPMYQNMEILS

SEQ ID NO: 8495 - DNA, 456 bp, Streptococcus agalactiae
atgaaaaatttattgttaaaatgtaaggataagaaggttaaagcatttacacttttagaatgtttggtagcattggttacaatcacaggagctttactagtttatcaaggactgacaaaattgttggctcaacagatagtagtgatgtcttcttccagtcagtctgaatgggtgttattaactcagcaactaaatgcagaatttgaaggcgctcatctggaatatttaagacagaacaaactttatttacgtaagcaagataagattgtaacctttggcaaatctaataaagatgatttccgtaagacaggttatgatggtcgaggttatcaaccaatggtttatgggttagacaattgtcaaatgagtcagaccaaaagtatggtaaaacttgttttttattttaaggacgggttaaaaaggacattttactatgattttaaagaagaaacttaa

SEQ ID NO: 8496 - protein, 151 aa, Streptococcus agalactiae; identical to SEQ ID NO: 398

SEQ ID NO: 8497 - DNA, 282 bp, Streptococcus agalactiae
atgaaaaataaaaaaatcttatttgggactggccttgctggtgtgggtttactggcagctgctggttataccctaactaaaaaagtaacagattataaacgtcagcaaatcactcagaccttaagagaattttttagtcagatgggtgatattcaggtattttattttaatgaatttgaatctgatattaaaatgaccagtggtggtcttgtcttggaagatggcagaattttcgaattcatttatcgtcaaggtgttcttgattatgtggaggtgagcaaa

SEQ ID NO: 8498 - protein, 94 aa, Streptococcus agalactiae
MKNKKILFGTGLAGVGLLAAAGYTLTKKVTDYKRQQITQTLREFFSQMGDIQVFYFNEFESDIKMTSGGLVLEDGRIFEFIYRQGVLDYVEVSK

SEQ ID NO: 8499 - DNA, 453 bp, Streptococcus agalactiae
atgaaacacaccagtaaagaaaccaaaacaaaagaagctccaatgtttattcaaatgtcaatatatgcagctattctattagtttcacaaatgatttcaatgttattaccgaaatcactaccaatcccaacgacggttattggtttggtgctaatgtatgtattgctaactgctaaaattatcaaggtagagtgggttgactcttttggggctttgatgataagcatgattggttttatgtttgtcccctcaggaatatcagtagcagcgaatcttgatatcctaaaagctgaaggcttgcaactagttgctgttattacaatctcaactgttgttatgttggtagtggtagcatatgttgcacgattaatacttgctatcagagaactcagtgtcacagatttatttaaaaagatattacctaaccactatagtaagaaagtagaggaaaaa

SEQ ID NO: 8500 - protein, 151 aa, Streptococcus agalactiae
MKHTSKETKTKEAPMFIQMSIYAAILLVSQMISMLLPKSLPIPTTVIGLVLMYVLLTAKIIKVEWVDSFGALMISMIGFMFVPSGISVAANLDILKAEGLQLVAVITISTVVMLVVVAYVARLILAIRELSVTDLFKKILPNHYSKKVEEK

SEQ ID NO: 8501 - DNA, 1626 bp, Streptococcus agalactiae; identical to SEQ ID NO: 467

SEQ ID NO: 8502 - protein, 542 aa, Streptococcus agalactiae
VTKYLKYISFVALFLASIFLVACQNQNSQTKERTRKQRPKDELVVSMGAKLPHEFDPKDRYGIHNEGNITHSTLLKRSPELDIKGELAKKYKISKDGLTWSFDLNDDFKFSNGEPVTADDVKFTYDMLKADGKAWDLTFIKNVEVVGKNQVNIHLTEAHSTFTAQLTEIPIVPKKHYNDKYKSNPIGSGPYMVKEYKAGEQAIFVRNPYWHGKKPYFKKWTWVLLDENTALAALESGDVDMIYATPELASKKVKGTRLLDIASNDVRGLSLPYVKKGVVKNSPDGYPVGNDVTSDPAIRKALTIGLNRQKVLDTVLNGYGKPAYSIIDRTPFWNPKTAIKDNKVAKAKQLLTKAGWKEQADGSRKKGNLKSEFDLYYPTNDQLRANLAVEVAEQAKALGITIKLKASNWDEMATKSHDSALLYAGGRHHAQQFYESHYPSLAGKGWTNITFYNNPTVTKYLDKAMTSPDLDKANKYWKLAQWDGKTGASTLGDLPNVWLVSLNHTYIGDKRINVGKQGVHSHGHDWSLLTNIAEWTWDESAK

SEQ ID NO: 8503 - DNA, 1257 bp, Streptococcus agalactiae
atgcgagcttggaaaggtattgttttaattttatctagcatagtggtgacactagtagcatggcaaaatgcaggattaagtgaatttgttgtaccaggattagctttgacaagtttatcgctaacattcctcttatcaaccaaatttaggatacttgaaagttactttcaaggtattgaaaatatgtatttttaccacaaggtaatggctgtattttcaatgattttgcttctattgcacaaaattggtcttggacaaggcggacatggaagtgagtttgcaaagactattggcagtgcgggattatatctttttctaagtattgtttttgtagcttatttcggaaattttttaaagtatgaaatttggcgttttattcatcgctttgtttatttagcttatattttgggattggtacatacttttatgattttaggagataggatactaggaaatactttactcagtttaatcgtattaggttatgctgtcattggggttatatctggattttatattattttcctatattctagaatgcgttttcgtcgtgtagggtacgttcaaaaggttactcatcttaaccatgatacaactgagattgaaatagcaatgaagcgtccttatcgatatgactatggacaatttactttttttaaaatttatcaagctggctttgaatcagcagctcatcctttctcgatatcaggtggtcatgatagagtgatatttttaactgttaaagcttcaggagattatacgaaatccatttacaaacagctaaaagttgggacaaaaatagccttagatagagcttatggtcatatgttatttgataaagacaagaaagaacaggtttggattgcaggaggtatcggcatcactcccttcatttcatttattagagaaaatagtattttgactaagagagttgacttcttttataccttttcaaatcaagacaatttgatttatcaagatatgttagaatcctatgctaaagccaatcctaattttaaacttcacttaaataatagtagcctcaaaggaagacttgattttagtcagtctgtttttgaaggacaaccaacaatatttatgtgtgggccaactagtatgacatctacttatgctaaggtctttcggcaaaaagatgcaaagtctcgtttagtctatgaaggattttcctttagagacagttggttatccatatttctattaaaaacttttgacaaagtttattctaatttgataaaa

SEQ ID NO: 8504 - protein, 419 aa, Streptococcus agalactiae
MRAWKGIVLILSSIVVTLVAWQNAGLSEFVVPGLALTSLSLTFLLSTKFRILESYFQGIENMYFYHKVMAVFSMILLLLHKIGLGQGGHGSEFAKTIGSAGLYLFLSIVFVAYFGNFLKYEIWRFIHRFVYLAYILGLVHTFMILGDRILGNTLLSLIVLGYAVIGVISGFYIIFLYSRMRFRRVGYVQKVTHLNHDTTEIEIAMKRPYRYDYGQFTFFKIYQAGFESAAHPFSISGGHDRVIFLTVKASGDYTKSIYKQLKVGTKIALDRAYGHMLFDKDKKEQVWIAGGIGITPFISFIRENSILTKRVDFFYTFSNQDNLIYQDMLESYAKANPNFKLHLNNSSLKGRLDFSQSVFEGQPTIFMCGPTSMTSTYAKVFRQKDAKSRLVYEGFSFRDSWLSIFLLKTFDKVYSNLIK

SEQ ID NO: 8505 - DNA, 228 bp, Streptococcus agalactiae
atggataaaaataatttagaagacttgacaggaaaaaagatacttagaaatggttttggtggtcttcgtttggaatatgggacaatctttcttgatgttggattgttcacttatattgtgctgatactatcaatatttttctttttagttgaacgttggtttttgggagctttaacttttgtgttgcatgttcccttgcttctacttgggatatggtgtggagagaga

SEQ ID NO: 8506 - protein, 76 aa, Streptococcus agalactiae
MDKNNLEDLTGKKILRNGFGGLRLEYGTIFLDVGLFTYIVLILSIFFFLVERWFLGALTFVLHVPLLLLGIWCGER

SEQ ID NO: 8507 - DNA, 474 bp, Streptococcus agalactiae; identical to SEQ ID NO: 593

SEQ ID NO: 8508 - protein, 158 aa, Streptococcus agalactiae
LLKIQYYQGVTRSKMRIKDYADSLGVSSQSIYKRIRSPKYKERLKGHLYRDNQKVENLDLIGIKILEDYHFENDVIELEKTLGDIQEEFEQEKKGMQYRIDRLADKLTPLLEDNQNLVQKNYELLNYVRSLERQKLLLIIALAVMVITLLVAIWLAIF

SEQ ID NO: 8509 - DNA, 648 bp, Streptococcus agalactiae
atgaaacaaatgaatactttccaacaatttatctactacttccaacataatggtagttatatcttagaacaatttatccaccactttttaatttcagtttacggcgttattttagctgcaattgttggtatccctctaggtatcttcatcgctagacgtggtaaaattaaaacctttgttatgggaatcgcaaatgtcatccaaaccattccttctttagctatgatctctatcattatgttaggtctagggctaggtattaaaacagtagttgcaactgtctttctttattctcttctgccaatcatcacaaatacttacactggtattagaaatgttgactccgacttactagatgctgctaaaggaatgggcatgactaagcgtcaacgtttatttatggttgagttaccactatctatttccgttatcatggctggacttagaaatgcccttgttgtagcaattggtattacagccattggtgctttcgtcgggggaggcggacttggagatatcatcataagaggaactaatgcaacaaatggtggtgctattatcttagcaggatctcttccaacagcccttatggcaattttctctgatttaatcctaggcggtatccaacgcatgcttgaaccaagaaaa

SEQ ID NO: 8510 - protein, 216 aa, Streptococcus agalactiae
MKQMNTFQQFIYYFQHNGSYILEQFIHHFLISVYGVILAAIVGIPLGIFIARRGKIKTFVMGIANVIQTIPSLAMISIIMLGLGLGIKTVVATVFLYSLLPIITNTYTGIRNVDSDLLDAAKGMGMTKRQRLFMVELPLSISVIMAGLRNALVVAIGITAIGAFVGGGGLGDIIIRGTNATNGGAIILAGSLPTALMAIFSDLILGGIQRMLEPRK

SEQ ID NO: 8511 - DNA, 927 bp, Streptococcus agalactiae
atgcttaaaaaatcgcactttttacagatatttacactttgcttagccctcttaacgatttctggttgtcaattaaccgatactaaaaagtctggtcataccacaattaaggttgctgcccaaagttctacagagtctagtattatggcaaatattatcaccgaattaattcatcacgaattaggatacaacacaactttaataagcaatcttggttcctctacggttactcaccaagctttgctccgtggtgatgctgacattgctgccacacgttatacaggaacagacatcacagggactcttggtttaaaagctgttaaagaccctaaagaagcttctaagattgtaaaaactgaawtccaaaaacgctacaatcaaacttggtatcctacttatggtttttctgatacttatgcattcatggttactaaagagtttgccagacagaataaaatcactaagatctctgatcttaaaaaattatcaacaactatgaaggcaggggttgatagttcatggatgaatcgcgagggagatggatacactgatttcgctaaaacatacggttttgaattttcacatatttaccctatgcaaattggcttagtctatgatgcggttgaaagtaacaaaatgcaatctgtattaggctactccactgacggtcgtatttcgagctatgatttagaaattttaagggatgataaaaaattctttcctccttatgaagcctctatggttgtcaacaattctatcatcaaaaaagatcctaaactaaaaaaattactccatcgactcgatggtaaaatcaatttaaaaacgatgcaaaaccttaattatatggtagatgataaacttttagaaccttcagttgttgccaaacaatttttagaaaaaaaccattattttagaggagataaataa

SEQ ID NO: 8512 - protein, 308 aa, Streptococcus agalactiae
  MISC_FEATURE (1)..(308): Xaa = Any Amino Acid
MLKKSHFLQIFTLCLALLTISGCQLTDTKKSGHTTIKVAAQSSTESSIMANIITELIHHELGYNTTLISNLGSSTVTHQALLRGDADIAATRYTGTDITGTLGLKAVKDPKEASKIVKTEXQKRYNQTWYPTYGFSDTYAFMVTKEFARQNKITKISDLKKLSTTMKAGVDSSWMNREGDGYTDFAKTYGFEFSHIYPMQIGLVYDAVESNKMQSVLGYSTDGRISSYDLEILRDDKKFFPPYEASMVVNNSIIKKDPKLKKLLHRLDGKINLKTMQNLNYMVDDKLLEPSVVAKQFLEKNHYFRGDK

SEQ ID NO: 8513 - DNA, 633 bp, Streptococcus agalactiae
atggtcaatttcttatcacagtatggcatgcaaatattagtaaaaacatgggaacaagtctatatctcattctttgctatagcacttgggattgcaattgctgttccatkgggtgtggtcttaacacgttttcccaaagtagccaaaattatcattgctatagctagcatgttacaaactataccaagtttagccttattagctttaatgattccattgtttggaattggaaaaatcccagctatcgttgctttatttatttattccttgcttcctatactaaggaatacttatataggtatgaataatgtcaatccaacacttaaagattgtgctaaagggatgggaatgaaacctattcaatctatatttcaagttgagttacctttagctactccaattattatggctggtattcgcttgtctactatttatgttattgcttgggctacattggcttcttatataggtgcaggtggacttggtgatctcatttttagcgggttaaatctttttcagtccaaattaattctagggggcacaattcctgttattatcctgtcacttattatagattatcttttaggattactggaaacagctctaacgcccagaacaacaagaagggaggct

SEQ ID NO: 8514 - protein, 211 aa, Streptococcus agalactiae
  MISC_FEATURE (1)..(211): Xaa = Any Amino Acid
MVNFLSQYGMQILVKTWEQVYISFFAIALGIAIAVPXGVVLTRFPKVAKIIIAIASMLQTIPSLALLALMIPLFGIGKIPAIVALFIYSLLPILRNTYIGMNNVNPTLKDCAKGMGMKPIQSIFQVELPLATPIIMAGIRLSTIYVIAWATLASYIGAGGLGDLIFSGLNLFQSKLILGGTIPVIILSLIIDYLLGLLETALTPRTTRREA

SEQ ID NO: 8515 - DNA, 456 bp, Streptococcus agalactiae
atgagaaaatatataaaatggttaattcccatatcaatttttgggatgatacttggaggctgtcaaatgaatagtgaacataaaattcagtcaaacgaagtaaaaaatagcaagcaatcagaagtgaagaaagataaaaaaatgacaaaaaaagaacaattagcctatctcaaagagcatgagcaagaaatcatagattatgtaaaattacataacaaccaaattgagtccgttcaattcgattggtcaagtgtaaaagtagaacaaagcgggaatggaactccacaagggggtgattataatctttcactgagaggaaagtttaatcatctacaaaattcaaaattaatagttgatttttatttagctcataaaaatgatatcccaaatatcaaatcaatgggaatgctaaataagccgtatatacataaaaatggtatttggcacatttatgaa

SEQ ID NO: 8516 - protein, 152 aa, Streptococcus agalactiae
MRKYIKWLIPISIFGMILGGCQMNSEHKIQSNEVKNSKQSEVKKDKKMTKKEQLAYLKEHEQEIIDYVKLHNNQIESVQFDWSSVKVEQSGNGTPQGGDYNLSLRGKFNHLQNSKLIVDFYLAHKNDIPNIKSMGMLNKPYIHKNGIWHIYE

SEQ ID NO: 8517 - DNA, 579 bp, Streptococcus agalactiae
atgaacaataaaaacaaatggactataattttacttatttttactatcatcgtaattgatgttagcttactatttggcgggaatcgtttaagtttaccaatcaaattattaattttattagtaaccagtatagcagaattttgttcgatttttataatgataaaagttccgactcctcaaaaatataagaaagaaccatttggattaaaagcaaaattttattctattgtactctttctctcgactattctttatacaattgggatatggaatgtgacgccagcttccccatacaatgttaaagaatcaattcttggagttggcattttaatacaagtagttttcttcatttattttctattaaaaaaaattaacgaaagtcccgatgaacgcttttatagtaatttagcattgtcagcttctttgatgtttttgatatcaataatgttattaattcttatagctatttaccttaatatatatggaacgttagagttaaaatcaggctacctttatattatggtaggtttattattactaatgtttgctgttacatattactttcttgagggacggaga

SEQ ID NO: 8518 - protein, 193 aa, Streptococcus agalactiae
MNNKNKWTIILLIFTIIVIDVSLLFGGNRLSLPIKLLILLVTSIAEFCSIFIMIKVPTPQKYKKEPFGLKAKFYSIVLFLSTILYTIGIWNVTPASPYNVKESILGVGILIQVVFFIYFLLKKINESPDERFYSNLALSASLMFLISIMLLILIAIYLNIYGTLELKSGYLYIMVGLLLLMFAVTYYFLEGRR

SEQ ID NO: 8519 - DNA, 948 bp, Streptococcus agalactiae
atgataaaaacaaagtttagtgatccactggaacaattagccaaaaaaaggaaaaggaaaacattattcaagaccgtagtattggcattaataactgtactattagtagttggaatagcttttaaagggtttacatatttaacttcaaaaaatggtcaaaaaacatatcataactttgaactactttctgaaatagcatatccaaatatttcctatgatagtctctattaccagccaagcggtcagtttactggtaaagtacatgctgatagatttaaagatatcgatggggttcaaattccatattctagttttgaagaaaattatagtatctcaggtacttttggcacaaatgctgatgaaaaatcagaaaagaatggcttgtatgatcgaggtactagacaaaaagttccacaatttttcaataaaaatgttaagtataaaaaaggagaagccaaaacaactccaacaaatgatttaaaatatgtaaataaattgaataatgatcttattgaaattgcaataacttttgataagtcctatagttacaaagaaataaaaacaatgataccaaataatataaaacaaaattggttatggataggtacaagcacagaattagatacatcatattggccaacaaagtatcaattcggtacagatcctgaaactttgaatacaccacaaatattcatagataaaataaaagaaaacttaaaaggtaactcaaaagtatactttaataatataaatatctactcagatttagaaaagtatgccaaaaaatacgacaaggtaaataatagcgacaaattaaaattttcgggaataatattaacaggtaaagccgaaaactttaaacaacttaaagaaaaagaatgggtacatgcttcaagtataggggcaaacatagaatataagccctattataaattagataaagaataa

SEQ ID NO: 8520 - protein, 315 aa, Streptococcus agalactiae; identical to SEQ ID NO: 672

SEQ ID NO: 8521 - DNA, 714 bp, Streptococcus agalactiae
atgaaaaaagtcatcgatttaaaaaaactacaaaaagcatatgcctcagaaaccgttttaaataatattaatttggaggtgtttaaaggcgaaataattggattaataggaccctctggagcagggaaatctaccttgattaaaactatgcttggcatggaaaaagcagataagggaacagctcttgttcttgatactcaaatgccagatcgtaatattttaaatcaaattggctatatggctcaatctgatgccttatacgagtctttaactggcttagaaaatttattattctttggaaaaatgaaaggtattcaaaaaactgaattaaaacagcagataactcatatttctaaagtagtagatctagaaaaccaacttgataaatttgtctcaggttactcaggaggtatgaaaagacggctttctctagccatcgccctacttggaaaccccacagttttaatcctagatgaacctaccgttggaattgatccatccttgaggagaaaaatctggcaagagctaattaatattaaggatgaaggacattctatctttattacaacccacgttatggatgaagcagaattaacaagtaaggttgcactactattacgtggaaacattattgcctttgatactccattacatttaaaaaaacaatttaatgtgagtactattgaggaagttttcttaaaagctgaaggagaa

SEQ ID NO: 8522 - protein, 238 aa, Streptococcus agalactiae
MKKVIDLKKLQKAYASETVLNNINLEVFKGEIIGLIGPSGAGKSTLIKTMLGMEKADKGTALVLDTQMPDRNILNQIGYMAQSDALYESLTGLENLLFFGKMKGIQKTELKQQITHISKVVDLENQLDKFVSGYSGGMKRRLSLAIALLGNPTVLILDEPTVGIDPSLRRKIWQELINIKDEGHSIFITTHVMDEAELTSKVALLLRGNIIAFDTPLHLKKQFNVSTIEEVFLKAEGE

SEQ ID NO: 8523 - DNA, 705 bp, Streptococcus agalactiae
atgaaaatagataaaaaagaacttttagcacttattgctagtattattttattaatttttgcttctgttacgtttttcttatttaaagatcatggcactactcaaatggatactgtagaaagcagtgttaaccatgtcagtgattctcaattaactgaggcacaagatatgttagataaatttgagaagaaaccttcagaaaaattattgaaggatgtcgaacttgctttaaataaattgtccaattcttctaaaaaagaagctttgcaaaaacgttttaagaaagcaaaagataagtatcttaaagacgaagcagataagaaagctaccaaagatgctacagatttagtagaaattctagaacaagccccttcagaagaaaatgtgttaaaagctgaagcagcagtcaataagttaactgtcaaagaatctaaagaagctttacaaaaacgtattgatactgttaagacacaatatggtttgattgggaatcaaactccctctagttcagtagctgaaactacagaacaagggacagctaatcctgctagtcaggatacttctagttacgttaatcagaatgtagcaccaacttatgagcaaccgcaagcgaataatacaccagttactccaggggttaacaatactgttccgactccaggaactggtactgtacctgctactaatgggacaggtgttgctcag

SEQ ID NO: 8524 - protein, 235 aa, Streptococcus agalactiae
MKIDKKELLALIASIILLIFASVTFFLFKDHGTTQMDTVESSVNHVSDSQLTEAQDMLDKFEKKPSEKLLKDVELALNKLSNSSKKEALQKRFKKAKDKYLKDEADKKATKDATDLVEILEQAPSEENVLKAEAAVNKLTVKESKEALQKRIDTVKTQYGLIGNQTPSSSVAETTEQGTANPASQDTSSYVNQNVAPTYEQPQANNTPVTPGVNNTVPTPGTGTVPATNGTGVAQ

SEQ ID NO: 8525 - DNA, 3699 bp, Streptococcus agalactiae
gtggataaacatcactcaaaaaaggctattttaaagttaacacttataacaactagtattttattaatgcatagcaatcaagtgaatgcagaggagcaagaattaaaaaaccaagagcaatcacctgtaattgctaatgttgctcaacagccatcgccatcggtaactactaatactgttgaaaaaacatctgtaacagctgcttctgctagtaatacagcgaaagaaatgggtgatacatctgtaaaaaatgacaaaacagaagatgaattattagaagagttatctaaaaaccttgatacgtctaatttgggggctgatcttgaagaagaatatccctctaaaccagagacaaccaacaataaagaaagcaatgtagtaacaaatgcttcaactgcaatagcacagaaagttccctcagcatatgaagaggtgaagccagaaagcaagtcatcgcttgctgttcttgatacatctaaaataacaaaattacaagccataacccaaagaggaaagggaaatgtagtagctattattgatactggctttgatattaaccatgatatttttcgtttagatagcccaaaagatgataagcacagctttaaaactaagacagaatttgaggaattaaaagcaaaacataatatcacttatgggaaatgggttaacgataagattgtttttgcacataactacgccaacaatacagaaacggtggctgatattgcagcagctatgaaagatggttatggttcagaagcaaagaatatttcgcatggtacacacgttgctggtatttttgtaggtaatagtaaacgtccagcaatcaatggtcttcttttagaaggtgcagcgccaaatgctcaagtcttattaatgcgtattccagataaaattgattcggacaaatttggtgaagcatatgctaaagcaatcacagacgctgttaatctaggagcaaaaacgattaatatgagtattggaaaaacagctgattctttaattgctctcaatgataaagttaaattagcacttaaattagcttctgagaagggcgttgcagttgttgtggctgccggaaatgaaggcgcatttggtatggattatagcaaaccattatcaactaatcctgactacggtacggttaatagtccagctatttctgaagatactttgagtgttgctagctatgaatcacttaaaactatcagtgaggtcgttgaaacaactattgaaggtaagttagttaagttgccgattgtgacttctaaaccttttgacaaaggtaaggcctacgatgtggtttatgccaattatggtgcaaaaaaagactttgaaggtaaggactttaaaggtaagattgcattaattgagcgtggtggtggacttgattttatgactaaaatcactcatgctacaaatgcaggtgttgttggtatcgttatttttaacgatcaagaaaaacgtggaaattttctaattccttaccgtgaattacctgtggggattattagtaaagtagatggcgagcgtataaaaaatacttcaagtcagttaacatttaaccagagttttgaagtagttgatagccaaggtggtaatcgtatgctggaacaatcaagttggggcgtgacagctgaaggagcaatcaagcctgatgtaacagcttctggctttgaaatttattcttcaacctataataatcaataccaaacaatgtctggtacaagtatggcttcaccacatgttgcaggattaatgacaatgcttcaaagtcatttggctgagaaatataaagggatgaatttagattctaaaaaattgctagaattgtctaaaaacatcctcatgagctcagcaacagcattatatagtgaagaggataaggcgttttattcaccacgtcagcaaggtgcaggtgtagttgatgctgaaaaagctatccaagctcaatattatattactggaaacgatggcaaagctaaaattaatctcaaacgaatgggagataaatttgatatcacagttacaattcataaacttgtagaaggtgtcaaagaattgtattatcaagctaatgtagcaacagaacaagtaaataaaggtaaatttgcccttaaaccacaagccttgctagatactaattggcagaaagtaattcttcgtgataaagaaacacaagttcgatttactattgatgctagtcaatttagtcagaaattaaaagaacagatggcaaatggttatttcttagaaggttttgtacgttttaaagaagccaaggatagtaatcaggagttaatgagtattccttttgtaggatttaatggtgattttgcgaacttacaagcacttgaaacaccgatttataagacgctttctaaaggtagtttctactataaaccaaatgatacaactcataaagaccaattggagtacaatgaatcagctccttttgaaagcaacaactatactgccttgttaacacaatcagcgtcttggggctatgttgattatgtcaaaaatggtggggagttagaattagcaccggagagtccaaaaagaattattttaggaacttttgagaataaggttgaggataaaacaattcatcttttggaaagagatgcagcgaataatccatattttgccatttctccaaataaagatggaaatagggacgaaatcactccccaggcaactttcttaagaaatgttaaggatatttctgctcaagttctagatcaaaatggaaatgttatttggcaaagtaaggttttaccatcttatcgtaaaaatttccataataatccaaagcaaagtgatggtcattatcgtatggatgctcttcagtggagtggtttagataaggatggcaaagttgtagcagatggtttttatacttatcgcttacgttacacaccagtagcagaaggagcaaatagtcaggagtcagactttaaagtacaagtaagtactaagtcaccaaatcttccttcacgagctcagtttgatgaaactaatcgaacattaagcttagccatgcctaaggaaagtagttatgttcctacatatcgtttacaattagttttatctcatgttgtaaaagatgaagaatatggggatgagacttcttaccattatttccatatagatcaagaaggtaaagtgacacttcctaaaacggttaagataggagagagtgaggttgcggtagaccctaaggccttgacacttgttgtggaagataaagctggtaatttcgcaacggtaaaattgtctgatctcttgaataaggcagtagtatcagagaaagaaaacgctatagtaatttctaacagtttcaaatattttgataacttgaaaaaagaacctatgtttatttctaaaaaagaaaaagtagtaaacaagaatctagaagaaataatattagttaagccgcaaactacagttactactcaatcattgtctaaagaaataactaaatcaggaaatgagaaagtcctcacttctacaaacaataatagtagcagagtagctaagatcatatcacctaaacataacggggattctgttaaccataccttacctagtacatcagatagagcaacgaatggtctatttgttggtactttggcattgttatctagtttacttctttatttgaaacccaaaaagactaaaaataatagtaaa

SEQ ID NO: 8526 - protein, 1233 aa, Streptococcus agalactiae
VDKHHSKKAILKLTLITTSILLMHSNQVNAEEQELKNQEQSPVIANVAQQPSPSVTTNTVEKTSVTAASASNTAKEMGDTSVKNDKTEDELLEELSKNLDTSNLGADLEEEYPSKPETTNNKESNVVTNASTAIAQKVPSAYEEVKPESKSSLAVLDTSKITKLQAITQRGKGNVVAIIDTGFDINHDIFRLDSPKDDKHSFKTKTEFEELKAKHNITYGKWVNDKIVFAHNYANNTETVADIAAAMKDGYGSEAKNISHGTHVAGIFVGNSKRPAINGLLLEGAAPNAQVLLMRIPDKIDSDKFGEAYAKAITDAVNLGAKTINMSIGKTADSLIALNDKVKLALKLASEKGVAVVVAAGNEGAFGMDYSKPLSTNPDYGTVNSPAISEDTLSVASYESLKTISEVVETTIEGKLVKLPIVTSKPFDKGKAYDVVYANYGAKKDFEGKDFKGKIALIERGGGLDFMTKITHATNAGVVGIVIFNDQEKRGNFLIPYRELPVGIISKVDGERIKNTSSQLTFNQSFEVVDSQGGNRMLEQSSWGVTAEGAIKPDVTASGFEIYSSTYNNQYQTMSGTSMASPHVAGLMTMLQSHLAEKYKGMNLDSKKLLELSKNILMSSATALYSEEDKAFYSPRQQGAGVVDAEKAIQAQYYITGNDGKAKINLKRMGDKFDITVTIHKLVEGVKELYYQANVATEQVNKGKFALKPQALLDTNWQKVILRDKETQVRFTIDASQFSQKLKEQMANGYFLEGFVRFKEAKDSNQELMSIPFVGFNGDFANLQALETPIYKTLSKGSFYYKPNDTTHKDQLEYNESAPFESNNYTALLTQSASWGYVDYVKNGGELELAPESPKRIILGTFENKVEDKTIHLLERDAANNPYFAISPNKDGNRDEITPQATFLRNVKDISAQVLDQNGNVIWQSKVLPSYRKNFHNNPKQSDGHYRMDALQWSGLDKDGKVVADGFYTYRLRYTPVAEGANSQESDFKVQVSTKSPNLPSRAQFDETNRTLSLAMPKESSYVPTYRLQLVLSHVVKDEEYGDETSYHYFHIDQEGKVTLPKTVKIGESEVAVDPKALTLVVEDKAGNFATVKLSDLLNKAVVSEKENAIVISNSFKYFDNLKKEPMFISKKEKVVNKNLEEIILVKPQTTVTTQSLSKEITKSGNEKVLTSTNNNSSRVAKIISPKHNGDSVNHTLPSTSDRATNGLFVGTLALLSSLLLYLKPKKTKNNSK

SEQ ID NO: 8527 - DNA, 60 bp, Streptococcus agalactiae
ttgaagaaaaaacttaaaacatttagcttaatattgctgacaggctctttattggttgct

SEQ ID NO: 8528 - protein, 60 aa, Streptococcus agalactiae
LKKKLKTFSLILLTGSLLVACGRGEVSSHSATLWEQIVYAFAKSIQWLSFNHSIGLGIIL

SEQ ID NO: 8529 - DNA, 1014 bp, Streptococcus agalactiae
atgacaaaacaaaaaattgccgttcttggacctggttcatgggggactgctcttgcacaagtattaaatgacaatggacatgaggtacgcttatggggaaacgtggttgaacaaatagaagagattaatactaaccatactaatcaacgttacttcaaagatattaccttagattccaaaataaaagcctacactaatcttgaggaagcgattaataatgttgacagcattttattcgtcgtcccaactaaagttacaagacttgttgctaaacaagtggctaatcttttaaagcataaagttgttcttatgcatgcttctaagggactagaacctggtactcatgaacgactttctacaattttagaagaagaaatctctgaacaatatcgtagtgatatcgttgttgtttcaggtcccagtcatgctgaagaagccatcgttcgtgatattactttgattactgctgcttcaaaagatattgaagcagctaagtatgtccaaaaattgtttagtaatcattattttagactttatactaacactgatgtcgtaggagtagaaacagctggtgctctaaaaaatattattgctgttggtgctggagcactacacggtcttggttatggtgataatgctaaagcagctattattacgcgtggtttagctgagataacacgtcttggtgtacaattaggggccgaccctctcactttcagtggtttatccggagttggagatttaattgtgactggtacatctgttcattctcgcaactggagagcgggagatgctttaggacgtggtgagaaacttgaagatattgaaaaaaatatggggatggttattgaaggtatctcaacaactaaagttgcttacgaaatcgcccaaaacttaaatgtttacatgcccattacagaagctatttataaatcaatatatgaaggggctaatatcaaagatagcattttagatatgatgtccaatgaatttcgttcagagaatgaatggcac

SEQ ID NO: 8530 - protein, 338 aa, Streptococcus agalactiae
MTKQKIAVLGPGSWGTALAQVLNDNGHEVRLWGNVVEQIEEINTNHTNQRYFKDITLDSKIKAYTNLEEAINNVDSILFVVPTKVTRLVAKQVANLLKHKVVLMHASKGLEPGTHERLSTILEEEISEQYRSDIVVVSGPSHAEEAIVRDITLITAASKDIEAAKYVQKLFSNHYFRLYTNTDVVGVETAGALKNIIAVGAGALHGLGYGDNAKAAIITRGLAEITRLGVQLGADPLTFSGLSGVGDLIVTGTSVHSRNWRAGDALGRGEKLEDIEKNMGMVIEGISTTKVAYEIAQNLNVYMPITEAIYKSIYEGANIKDSILDMMSNEFRSENEWH

SEQ ID NO: 8531 - DNA, 1041 bp, Streptococcus agalactiae
gtgaacagaaaaattattggcttaactctactatctttatctgtactaacattaacagcatgtggtaatcgttcagataagtctgcaaataaatcagatatcaaagttgcgatggtaactaatcaaggtggagtagacgataaatcgtttaatcaatcagcttgggaagggctacaaaagtggggaaaaaagaaggggttgacaaaaggtaatggctttgattatttccagtcatctaatgaatcagatcatgctaataaccttgatacggcagcctctagtggttataatttaatttttggtattggatttggtcttcatgatactattgaaaaagtatcagaaaataataaagatgttaaatacgttattgtagatgatatcattaaaggtaaagaaaatgtagctagtgttacttttgcagacaatgaagctgcttacttagctggagttgctgcagctaagacaactaagacaaaaacagttggttttatcggagggatggaaggcgtcgttgttaagcgatttgaagcaggatttaaggctggagtaaaatcaattgatccggctattaaagttgcggtatcttatgcaggctcatttacagatgcagctaaaggtaaaacgattgctgccacacagtatgcaacaggtgttgatgttatttaccaggctgctggtggtacaggagcaggaatttttagtgaggctaaaactgaaaatgagacccgcaaggaatctaacaaagtctgggtaattggtgttgacagagatcaaagtcaagaaggcaattatgtttcaaaagatggtaagaaagcaaactttgttctggcatctactataaaagaggtggggaaatctctccaatctgtagcagaattaacagagaaaaaacaatatccaggagggaaagtaacagtttttggtctaaaggatagtggtgtagatattaaagagcatcaattgtctagtgagggatctgttgctgtcaaaaaagctaaagaggatattgtttcagggaaaatacaagttcctatgaaa

SEQ ID NO: 8532 - protein, 347 aa, Streptococcus agalactiae
VNRKIIGLTLLSLSVLTLTACGNRSDKSANKSDIKVAMVTNQGGVDDKSFNQSAWEGLQKWGKKKGLTKGNGFDYFQSSNESDHANNLDTAASSGYNLIFGIGFGLHDTIEKVSENNKDVKYVIVDDIIKGKENVASVTFADNEAAYLAGVAAAKTTKTKTVGFIGGMEGVVVKRFEAGFKAGVKSIDPAIKVAVSYAGSFTDAAKGKTIAATQYATGVDVIYQAAGGTGAGIFSEAKTENETRKESNKVWVIGVDRDQSQEGNYVSKDGKKANFVLASTIKEVGKSLQSVAELTEKKQYPGGKVTVFGLKDSGVDIKEHQLSSEGSVAVKKAKEDIVSGKIQVPMK

SEQ ID NO: 8533 - DNA, 1011 bp, Streptococcus agalactiae
atgcgtaccttcaaaccagacactattatgcatttaggtggtggttctcctatggatgctgcgaaagttatgtggctcttctatgaacaaccagaagttgatttccatgacctcgttcaaaaattcatggatatccgtaaacgtgcgttcaaattcccagaacttggtaagaaaacaaaatttgttgctattccaacaacttctggaacaggttctgaagtgacaccatttgccgttatctctgacaaagcaaataatcgtaaatatccaatcgctgattattcattaacaccaactgtagctatcgttgatccggcccttgttatgactgttcctggttttattgcggctgatacgggtatggatgtattgacacatgcamcagaggsttatgtttcacagatggcaaatgattatacagacggacttgctcttcaagcaattaaaattgtgtttgactacttagaacgctcagtaaaagatgctgattttgaagcacgtgaaaagatgcacaatgcgtcaactatggcaggtatggctttcgccaatgcattcttaggtatttctcactcaatggcgcataaaattggcgcacaattccataccgtacacggacgtacaaatgcaattcttttgccgtatgttatccgctataatggaactcgtccagctaaaacagcaacatggcctaagtacaattactatcgtgctgacgaaaagtatcaagatatcgctaaattactcggcttaccagcagcaacaccagaagaagctgtcgaatcatatgcaaaagctgtgtatgaccttggaacacgtttaggtattaagatgaatttccgcgaccaaggcattgatgaaaaagaatggaaagaaaaatctcgtgaactagctttcttagcatatgaagatcaatgttcaccagcaaatccacgccttccgatggtagatcacatgcaagaaatcatcgaagatgcttattatggttatgaggaacgtccaggacgtcgtaag

SEQ ID NO: 8534 - protein, 337 aa, Streptococcus agalactiae
  MISC_FEATURE (1)..(337): Xaa = Any Amino Acid
MRTFKPDTIMHLGGGSPMDAAKVMWLFYEQPEVDFHDLVQKFMDIRKRAFKFPELGKKTKFVAIPTTSGTGSEVTPFAVISDKANNRKYPIADYSLTPTVAIVDPALVMTVPGFIAADTGMDVLTHAXEXYVSQMANDYTDGLALQAIKIVFDYLERSVKDADFEAREKMHNASTMAGMAFANAFLGISHSMAHKIGAQFHTVHGRTNAILLPYVIRYNGTRPAKTATWPKYNYYRADEKYQDIAKLLGLPAATPEEAVESYAKAVYDLGTRLGIKMNFRDQGIDEKEWKEKSRELAFLAYEDQCSPANPRLPMVDHMQEIIEDAYYGYEERPGRRK

SEQ ID NO: 8535 - DNA, 660 bp, Streptococcus agalactiae; identical to SEQ ID NO: 929

SEQ ID NO: 8536 - protein, 220 aa, Streptococcus agalactiae
VKKANQLIAAIFDVNNPFMQGCNVVFDLALLNLLFMITCLPLVTIGAAKISLYRTLWQKLEGDQTNLLILYIKHLKKEWFQGMLLGLVELSILVVIIFDLTILHYQIGFIVSFLKITCYAFLLLTVMTSIYLFPMAARYEMSLLDTVKKSFIMACLNLKWTGVLMFLLIMTWFIMVQSSLLFMLTVSAIFIFAYTAFAYFKIIILQKQFAYFSKQQGDYQ

SEQ ID NO: 8537 - DNA, 1317 bp, Streptococcus agalactiae
atgagtatcaaaaaaagtgtgattggtttttgcctcggagctgcagcattatcaatgtttgcttgtgtagacagtagtcaatctgttatggctgccgagaaggataaagtcgaaattacgtggtgggcttttccaacctttactcaagaaaaggctaaggatggagtaggtacttatgagaaaaaagtcatcaaggcttttgaaaagaaaaatcctaatataaaagtaaaactagagacaattgatttcacatctggacctgaaaaaatcactacagcgattgaagcagggacagcacctgatgtgctttttgatgcaccagggcgaattattcaatatggtaaaaatggtaaattagcagatttgaatgatttatttacagaccaatttattaaggatgtcaataataagaatatcattcaagcttctaagtctggcgataaagcctacatgtatccaataagttctgccccattttatatggcgttcaataaaaaaatgcttaaagatgcaggagttttgaaactcgtaaaagaaggttggactactagtgattttgaaaaagtactaaaagcactaaaaaataaaggctatacaccaggttcattctttgcaaacgggcaaggaggagatcaaggaccacgtgcattttttgctaatctttatagtgctccaataacagataaagaagtaacaaaatataccactgacactaaaaattctgtaaaatcaatgaaaaaaatagttgaatggattaagaaaggctacttgatgaatgggtctcagtatgatggctcagctgacattcaaaactttgccaatggacaaactgctttcactatcctatgggctccagctcaacccaaaactcaagcaaaattattagagtcaagtaaagtggattaccttgaagtgccattcccatcagaagatggaaaaccagatttagaataccttgttaatggttttgcggtctttaataataaagatgaaaacaaagtaaaagcctctaagaaatttatcacttttattgctgacgataaaaaatggggaccaaaagatgttatacgtacaggtgctttcccagttagaacatcatttggagatctttataaaggtgataaacgtatgatgaagatttcaaaatggactcaatattattcaccatattacaacactatcgatggattttctgaaatgagaaccttatggttcccaatggttcaatctgtatccaatggtgacgaaaaaccagcagatgctttgaaagactttactcaaaaagcaaatgataccattaaaaaagcagctaaataa

SEQ ID NO: 8538 - protein, 438 aa, Streptococcus agalactiae; identical to SEQ ID NO: 944

SEQ ID NO: 8539 - DNA, 1376 bp, Streptococcus agalactiae
atgaataaaaaggtactattgacatcgacaatggcagcttcgctattatcagtcgcaagtgttcaagcacaagaaacagatacgacgtggacagcacgtactgtttcagaggtaaaggctgatttggtaaagcaagacaataaatcatcatatactgtgaaatatggtgatacactaagcgttatttcagaagcaatgtcaattgatatgaatgtcttagcaaaaataaataacattgcagatatcaatcttatttatcctgagacaacactgacagtaacttacgatcagaagagtcatactgccacttcaatgaaaatagaaacaccagcaacaaatgctgctggtcaaacaacagctactgtggatttgaaaaccaatcaagtttctgttgcagaccaaaaagtttctctcaatacaatttcggaaggtatgacaccagaagcagcaacaacgattgtttcgccaatgaagacatattcttctgcgccagctttgaaatcaaaagaagtattagcacaagagcaagctgttagtcaagcagcagctaatgaacaggtatcaccagctcctgtgaagtcgattacttcagaagttccagcagctaaagaggaagttaaaccaactcagacgtcagtcagtcagtcaacaacagtatcaccagcttctgttgccgctgaaacaccagctccagtagctaaagtagcaccggtaagaactgtagcagcccctagagtggcaagtgttaaagtagtcactcctaaagtagaaactggtgcatcaccagagcatgtatcagctccagcagttcctgtgactacgacttcaccagctacagacagtaagttacaagcgactgaagttaagagcgttccggtagcacaaaaagctccaacagcaacaccggtagcacaaccagcttcaacaacaaatgcagtagctgcacatcctgaaaatgcagggctccaacctcatgttgcagcttataaagaaaaagtagcgtcaacttatggagttaatgaattcagtacataccgtgcgggagatccaggtgatcatggtaaaggtttagcagttgactttattgtaggtactaatcaagcacttggtaataaagttgcacagtactctacacaaaatatggcagcaaataacatttcatatgttatctggcaacaaaagttttactcaaatacaaacagtatttatggacctgctaatacttggaatgcaatgccagatcgtggtggcgttactgccaaccactatgaccacgttcacgtatcatttaacaaataatataaaaaaggaagctatttggcttcttttttatatgccttgaatagactttcaaggttcttatataatttttatta

SEQ ID NO: 8540 - protein, 432 aa, Streptococcus agalactiae
MNKKVLLTSTMAASLLSVASVQAQETDTTWTARTVSEVKADLVKQDNKSSYTVKYGDTLSVISEAMSIDMNVLAKINNIADINLIYPETTLTVTYDQKSHTATSMKIETPATNAAGQTTATVDLKTNQVSVADQKVSLNTISEGMTPEAATTIVSPMKTYSSAPALKSKEVLAQEQAVSQAAANEQVSPAPVKSITSEVPAAKEEVKPTQTSVSQSTTVSPASVAAETPAPVAKVAPVRTVAAPRVASVKVVTPKVETGASPEHVSAPAVPVTTTSPATDSKLQATEVKSVPVAQKAPTATPVAQPASTTNAVAAHPENAGLQPHVAAYKEKVASTYGVNEFSTYRAGDPGDHGKGLAVDFIVGTNQALGNKVAQYSTQNMAANNISYVIWQQKFYSNTNSIYGPANTWNAMPDRGGVTANHYDHVHVSFNK

SEQ ID NO: 8541 - DNA, 900 bp, Streptococcus agalactiae
ttgaataaatggttagttaaggcaagttccttagttgttttaggtggtatggttttatctgcgggttcccgagttttagcggatacttatgtccgtccaattgataatggtagaattacaacaggtttcaatggttatcctggacattgtggggtggattatgctgttccgactggaacgattattagggcagtggcagatggtactgtgaaatttgcaggagctggagccaacttttcttggatgacagacttagcaggaaattgtgtcatgattcaacatgcggatggaatgcatagtggttacgctcatatgtcacgtgtggtggctaggactggggaaaaagtcaaacaaggagatatcatcggttacgtaggagcaactggtatggcgacgggacctcaccttcattttgaatttttaccagctaaccctaattttcaaaatggtttccatggacgtatcaatccaacgtcactaattgctaatgttgcgacctttagtggaaaaacgcaagcatcagctccaagcattaagccattacaatcagctcctgtacagaatcaatctagtaaattaaaagtgtatcgagtagatgaattacaaaaggttaatggtgtttggttagtcaaaaataacaccctaacgccgactgggtttgattggaacgataatggtataccagcatcagaaattgatgaggttgatgctaatggtaatttgacagctgaccaggttcttcaaaaaggtggttactttatctttaatcctaaaactcttaagactgtagaaaaacccatccaaggaacagctggtttaacttgggctaagacacgctttgctaatggtagttcagtttggcttcgcgttgacaacagtcaagaactgctttacaaatag

SEQ ID NO: 8542 - protein, 299 aa, Streptococcus agalactiae
LNKWLVKASSLVVLGGMVLSAGSRVLADTYVRPIDNGRITTGFNGYPGHCGVDYAVPTGTIIRAVADGTVKFAGAGANFSWMTDLAGNCVMIQHADGMHSGYAHMSRVVARTGEKVKQGDIIGYVGATGMATGPHLHFEFLPANPNFQNGFHGRINPTSLIANVATFSGKTQASAPSIKPLQSAPVQNQSSKLKVYRVDELQKVNGVWLVKNNTLTPTGFDWNDNGIPASEIDEVDANGNLTADQVLQKGGYFIFNPKTLKTVEKPIQGTAGLTWAKTRFANGSSVWLRVDNSQELLYK

SEQ ID NO: 8543 - DNA, 1341 bp, Streptococcus agalactiae
atgaaaaaaagaatattatcagcagtccttgtgagtggagtaactcttggaactgctgccgtaacagtaaacgctgatgactttgactcgaaaattgctgctactgattcagtaatcaatactttatcagggcaacaagcagcagcacaaaaccaggtgactgctattaaaggacaagttggtgctttagagtctcaacaatcagaattagaagcgcaaaatgctcaacttgaggctgtatctcagcagttaggtcaagagattcaaactctttctaataaaattgttgcacgtaacgaatctttgaaaaagcaagttcgtagtgctcaaaagggtaacttgactaactatattaatactattttaaattcgaaatcagtatctgatgctgttaatcgtgttgttgctattcgtgaggttgtttcagctaatgaaaagatgttagcacaacaagaggctgacaaagcggccttagaagctaaacaaattgaaaatcaaaatgctataaatactgtagcagctaacaagcaagctatcgaaaataataaagcagccttagcaacacaaagagcacaattagaagcagctcaattagagttatctgctcaattgactacagtccaaaatgaaaaagcatctttaattcaggcaaaagcacaagctgaggaagctgcgcgtaaggcagctgaagcacaagcagcagctgaagcgaaagcacaagctgaagcgaaagcacaagctgagtctgtagcaaaagcacaggcagcagcacaagttgagtctgccacagctcctactgaaacagttcaaacacaaccgagaactgaaataaagccttctaatcttacggctacttcttcggcaactactgttgctacaactacagctacagctactaatgagccaaaagttactcaaccttctgtagtaactaaagcagttgaagcacctaaagcagttgtttcttcaacacctagagcggtatcaaaacctgttgtcagaagttatgattcaagtaacacatacccaatgggacaatgtacttggggagctaagtcaatggcttcttgggttggtaactattggggaaatgctaatcagtggggtgctagtgcacgtgcagctggttattctgtaggaactacccctcgtgttggtgcagtagctgtttggccatatgatggtggtggttacgggcacgttgcagtagtaacgtcagtggctaacaattcatctatccaagttatggaatcaaactatgctggaaatatgagtattggcaattaccgtggttcatttaaccctagtgcttctggctctgtttactatatttacccaaat

SEQ ID NO: 8544 - protein, 447 aa, Streptococcus agalactiae
MKKRILSAVLVSGVTLGTAAVTVNADDFDSKIAATDSVINTLSGQQAAAQNQVTAIKGQVGALESQQSELEAQNAQLEAVSQQLGQEIQTLSNKIVARNESLKKQVRSAQKGNLTNYINTILNSKSVSDAVNRVVAIREVVSANEKMLAQQEADKAALEAKQIENQNAINTVAANKQAIENNKAALATQRAQLEAAQLELSAQLTTVQNEKASLIQAKAQAEEAARKAAEAQAAAEAKAQAEAKAQAESVAKAQAAAQVESATAPTETVQTQPRTEIKPSNLTATSSATTVATTTATATNEPKVTQPSVVTKAVEAPKAVVSSTPRAVSKPVVRSYDSSNTYPMGQCTWGAKSMASWVGNYWGNANQWGASARAAGYSVGTTPRVGAVAVWPYDGGGYGHVAVVTSVANNSSIQVMESNYAGNMSIGNYRGSFNPSASGSVYYIYPN

SEQ ID NO: 8545 - DNA, 777 bp, Streptococcus agalactiae
atgaaaattgataaaaggcatcttctgaattattccatcctcattccctatttgatattgtctattctaggcttaattgtaatttattcgacaactagtgcaactctaattcagcttggagctaacccttttcgttcagtaatcaaccagggtgtcttttgggcagtcagtttggttgcaattatctttatctataaactgaaactaaattttttgaaaaattctaaagtgttgactatggcagtattggtagaagtatttttactactaatagcgcgcttttttacacaagaagttaatggagcacatggttggattgttattggtcctattagttttcaacctgctgaatatttaaaagttatcattgtatggtatttagcgtttacttttgctcgaaggcaaaaaaagatagaaatatatgattatcaagctttgacaaaagggagatggcttccgagatcactaagcgacctaaaagattggcgattttattctttatttatgattggtttggtaattgcacaacctgatttaggaaatggttcgataattgttctaacggtcattattatgtactgtattagtggtattggttatcgatggttttcagctttacttggtctaatcgtcgtggggtcaactttatttatcggaactattgcagttgttggagttgagacaatggctaaagtccctgtctttggttatgtagctaagcgatttaatgctttttttgacccatttaagatttacagattcaggacaccagttggc

SEQ ID NO: 8546 - protein, 259 aa, Streptococcus agalactiae
MKIDKRHLLNYSILIPYLILSILGLIVIYSTTSATLIQLGANPFRSVINQGVFWAVSLVAIIFIYKLKLNFLKNSKVLTMAVLVEVFLLLIARFFTQEVNGAHGWIVIGPISFQPAEYLKVIIVWYLAFTFARRQKKIEIYDYQALTKGRWLPRSLSDLKDWRFYSLFMIGLVIAQPDLGNGSIIVLTVIIMYCISGIGYRWFSALLGLIVVGSTLFIGTIAVVGVETMAKVPVFGYVAKRFNAFFDPFKIYRFRTPVG

SEQ ID NO: 8547 - DNA, 1131 bp, Streptococcus agalactiae
atgattgattttattatttctattgatgattgcgcagttgaattggatagtcgtcaatcttggaaaattcgctaccccttatcaaccattctatttcttgtctttgtttgtcagttagctggcattgaaacctggaaggagatggaagattttattgaaatgaatgaaccattgtttgcgacctacgttgatttgagtgaaggttgtccgtctcatgataccttagagcgtgtgattagtcttgttaattcagaccgtttaaaagagcttaaagttcaatttgagcaatcattgacaagcttagatgccgttcatcaactgatttcagtggacggtaaaacgattcgaggcaatcgaggtaaaaatcagaagcctgttcatattgtaacggcttatgatgggggtcatcatcttagtttgggacaggtagcggttgaggagaaaagtaatgaaattgttgccattcctcagttattgcggacaattgatatccgtaaaagcattgtaacgatagacgcaatgggcacgcagacggctatcgttgatacgattataaaaggtaaagcagactattgcttagccgtcaaaggaaatcaagaaacactttatgatgatattgctctttattttagtgatgtcaacttattggaagaactccaagaaaatgcgcagtattatcagactgttgaaaaatctaggggacagattgaagttagagaatactgggtgtcttccgatatcaaatggttgtgtcaaaaccatcccaaatggcataagttacgtggtattgggatgactcgtaacacgattgataaggatggtcagctgagtcaagagaatcgttattttatctttagctttaagccggatgtcctcacatttgccaattgtgtacgaggtcattggcagatagagagtatgcactggttattggacgttgtttatcatgaagatcatcatcagacattggataaaagagccgcatttaacctaaatcttatccgaaaaatgtgcttatattttctcaaagtgatggtatttcctaaaaaagacctcagttatcgtcgcaaacaacggtatatttctgtccatttggaagattatttagtccaattatttggagaaagaggc

SEQ ID NO: 8548 - protein, 377 aa, Streptococcus agalactiae
MIDFIISIDDCAVELDSRQSWKIRYPLSTILFLVFVCQLAGIETWKEMEDFIEMNEPLFATYVDLSEGCPSHDTLERVISLVNSDRLKELKVQFEQSLTSLDAVHQLISVDGKTIRGNRGKNQKPVHIVTAYDGGHHLSLGQVAVEEKSNEIVAIPQLLRTIDIRKSIVTIDAMGTQTAIVDTIIKGKADYCLAVKGNQETLYDDIALYFSDVNLLEELQENAQYYQTVEKSRGQIEVREYWVSSDIKWLCQNHPKWHKLRGIGMTRNTIDKDGQLSQENRYFIFSFKPDVLTFANCVRGHWQIESMHWLLDVVYHEDHHQTLDKRAAFNLNLIRKMCLYFLKVMVFPKKDLSYRRKQRYISVHLEDYLVQLFGERG

SEQ ID NO: 8549 - DNA, 402 bp, Streptococcus agalactiae
ttgattacagttgtcttattcgatttaaaagaaggtgtagctactgtaactataacaatgctagtttcttcttttttaatgggctttgggccatgggtctttttgcaaatcatttccttcactttaattttatgcttgtggaaatttctgatatatccgctgacaaaagctgtatgttttggtaaaataacggaggtagtacttcaaactttctttgcaggagggttaggggttgtttatggcgtcattattgatacctgttttgcttggttatatcatatgccttggtggacttatgtattagcaggacttagttttaatatggcacacgctttatcaacttgtttattttatcctcttttgttaccgattttaaggagatttaggaatgaaaaaatacat

SEQ ID NO: 8550 - protein, 134 aa, Streptococcus agalactiae
LITVVLFDLKEGVATVTITMLVSSFLMGFGPWVFLQIISFTLILCLWKFLIYPLTKAVCFGKITEVVLQTFFAGGLGVVYGVIIDTCFAWLYHMPWWTYVLAGLSFNMAHALSTCLFYPLLLPILRRFRNEKIH

SEQ ID NO: 8551 - DNA, 846 bp, Streptococcus agalactiae
atgagaagaagaattaaacctattgttgttgcggtttttttcagtttatttggacttttattaattattggtcatttacattcgacaaatactttgaaaaaagaattagttgaagctaaaaagacaattccatccgtaaaagcttcaaaagtaccgcaaaaatcaacatcatcgaaagataaagagtttgttcttaaaccgattatcgatgtctctggttggcaacttcctaaggagattgattacgatacgctttcaaaaaatatttcaggtgttgttattcgtgtctttggtggatcaaagatatctaagactaataacgctgcttatacaactggaatcgataaatcgtttaagacccatatcaaagaatttcaaaagcgaaatatcccagtagctgtctacagttatgcacttggttcaagtgttaaagaaatgaaagaagaggctcagatattttataagaatgcagctccttacaaaccaactttttattggattgacgtagaagaggagacaatgtctaacatgaataaaggtgtccaagcattccgaaaagaattaaaaagacttggtgctaaaaatgttggtatctacattggtacttactttatgactgagcaaggcatctctgtaaaaggatttgacgctgtttggattccaacttatggtagcgattctggatactatgaagcggctccgcaaactgaacttaaatacgatttacaccaatacacctctcaaggttatctaccaggawtcaatcaaccgcttgatttaaatcaaattgcagttaataaagacaagaagaaaacttatgagaaactttttggaaaagtaaaagag

SEQ ID NO: 8552 - protein, 282 aa, Streptococcus agalactiae
  MISC_FEATURE (1)..(282): Xaa = Any Amino Acid
MRRRIKPIVVAVFFSLFGLLLIIGHLHSTNTLKKELVEAKKTIPSVKASKVPQKSTSSKDKEFVLKPIIDVSGWQLPKEIDYDTLSKNISGVVIRVFGGSKISKTNNAAYTTGIDKSFKTHIKEFQKRNIPVAVYSYALGSSVKEMKEEAQIFYKNAAPYKPTFYWIDVEEETMSNMNKGVQAFRKELKRLGAKNVGIYIGTYFMTEQGISVKGFDAVWIPTYGSDSGYYEAAPQTELKYDLHQYTSQGYLPGXNQPLDLNQIAVNKDKKKTYEKLFGKVKE

SEQ ID NO: 8553 - DNA, 672 bp, Streptococcus agalactiae; identical to SEQ ID NO: 1057

SEQ ID NO: 8554 - protein, 224 aa, Streptococcus agalactiae
LTRHIKISILNLQNEGEGTMEILIAGGSGFLGKQIIKAALTKGHKVAYLSRHEGKGDIFKDPRLTYIRGDITEADKIHLEDRTFDILIDCIGAIKPNQLDELNVKATQKAVALCHKNQIPKLVYISANSGYSAYIKSKRKAEQIIKASGLDYLFVRPGLMYGEERPLSIFQAKCIKLFSHLPFLGIVVQKVFPTKVVIVAEAIVTTLRKKPTQKILSIEELNNK

SEQ ID NO: 8555 - DNA, 639 bp, Streptococcus agalactiae
atgaaattttatcttgttagacacggaaaaacacaatggaatttagaggggcgtttccaaggtgctaacggagactcacctctccttgaagaagctattgaagaattagaagaacttggacaatacctatcatctattcattttgatgctgtttattctagcgacttaggtcgtgctagagatactgttaatatcctcaatgatgctaattcatgcccaaaagaaatccactatactcctcaacttcgtgaatgggcattgggaactttagaaggttgtaaaattgcaactatgcaagctatctatcctcgtcaaatgaccgcattttatcaaaatcccttacaatttaaacatgacatgttcggtgcagaatctctttatcagacaacgcatcgtgtagagagtttcttacgttctctagcttcaaaaaattacgacaaggtccttattgtaggacatggagcaaacctaactgcgtctattcgttccttactgggttatcaatatggtagtttacactacaaagataaacttgataatgccagcctcacaatcatagaaactcatgattttaaagacttcaactgtctgacttggaacgataaatcttatttaaggcaagaggtcaaaatgacacac

SEQ ID NO: 8556 - protein, 213 aa, Streptococcus agalactiae
MKFYLVRHGKTQWNLEGRFQGANGDSPLLEEAIEELEELGQYLSSIHFDAVYSSDLGRARDTVNILNDANSCPKEIHYTPQLREWALGTLEGCKIATMQAIYPRQMTAFYQNPLQFKHDMFGAESLYQTTHRVESFLRSLASKNYDKVLIVGHGANLTASIRSLLGYQYGSLHYKDKLDNASLTIIETHDFKDFNCLTWNDKSYLRQEVKMTH

SEQ ID NO: 8557 - DNA, 708 bp, Streptococcus agalactiae
gtgtctggtatgttgttagcagtttacttagcaatgaaagaggcccctcgtaagaacattaagtcggatgatattctagatttcattctcatggcttttccactatccattgttggagctcgtatttattatgttatcttcgaatgggcttattactctaagcacccagtagagattatcgccatctggaatggcggtattgctatttacggagggttaattaccggggccattctccttgtgattttttcatatcgtcgcttgattaatcccattgattttctggatattgctgctccaggagtgatgattgcccaagccataggtaggtgggggaattttattaatcaagaagcatacggtagggcagtaaaaaatctgaattacgtaccaaactttataaaaaatcaaatgtatattgatggagcttaccgagtacctacatttttatatgagtctctttggaacttcctaggttttgtcatcatcatgtctattcgtcatcgaccgcgcactttaaaacaaggtgaagtggcatgtttttatttagtttggtatggatgtggacggttcattattgaagggatgaggacagatagcctttatttggcgggtttgcgcgtgtcacaatggttatcagttattttagttattatcggaattgtcatgattatttatcgtcgtcgtgaacaacatatttcatattat

SEQ ID NO: 8558 - protein, 236 aa, Streptococcus agalactiae
VSGMLLAVYLAMKEAPRKNIKSDDILDFILMAFPLSIVGARIYYVIFEWAYYSKHPVEIIAIWNGGIAIYGGLITGAILLVIFSYRRLINPIDFLDIAAPGVMIAQAIGRWGNFINQEAYGRAVKNLNYVPNFIKNQMYIDGAYRVPTFLYESLWNFLGFVIIMSIRHRPRTLKQGEVACFYLVWYGCGRFIIEGMRTDSLYLAGLRVSQWLSVILVIIGIVMIIYRRREQHISYY

SEQ ID NO: 8559 - DNA, 810 bp, Streptococcus agalactiae
atgattcgatttcttattcttgctggttattttgaattaagcatgtatttaaagttatcaggtaaactaaatcagtatattaatactcattatacctatttggcctatatttcaatggtcctatcttttattttagcaattgtacagctaattatttgggttaaaaatatgaaaatgcatagtcacctacatggtaaaatagctaaatcaacaagcccaatgattttagtatttcccgttttagtaggtttgttagtacctacagttagtttagactcaaccacagtctctgccaagggatataatttccctctagcagccggctctactggtactgtaagtcaagatgggacacgcgttcaatatttgaaaccagataccagcacttattttacttcttcagcctatgaaaaagaaatgcaaaaagagcttaaaaaatataaaggctctggtacattaaccatcacaactgaaaattacatggaagttatggaactaatttatctctatcccgagcaattcatggatcgccaaatacaatatactgggtttgtttataacgaacccaaacacgaaggatatcaatttattttccgctttggaatcattcattgtattgccgattcaggagtttatggtctactaacgactggaaatcaaaaaagttatccggacaatacttgggtaactgttagaggtacaattaaatccgagtataatcaattgttacaacaaaacttaccagtcttacacattgaagagtctcgtcaagtttctaaagctaataatccttatgtttatcgtgtcttt

SEQ ID NO: 8560 - protein, 270 aa, Streptococcus agalactiae
MIRFLILAGYFELSMYLKLSGKLNQYINTHYTYLAYISMVLSFILAIVQLIIWVKNMKMHSHLHGKIAKSTSPMILVFPVLVGLLVPTVSLDSTTVSAKGYNFPLAAGSTGTVSQDGTRVQYLKPDTSTYFTSSAYEKEMQKELKKYKGSGTLTITTENYMEVMELIYLYPEQFMDRQIQYTGFVYNEPKHEGYQFIFRFGIIHCIADSGVYGLLTTGNQKSYPDNTWVTVRGTIKSEYNQLLQQNLPVLHIEESRQVSKANNPYVYRVF

SEQ ID NO: 8561 - DNA, 1350 bp, Streptococcus agalactiae
atgaataatagtgctgcaaatattaggtcgtttgagctagccttactttttttactagtttttgttgctgtttattttgtttatctagcggttagagattttaaaatgtctaaaaatatccggcttttgaattggaaagtcagagatttgatagcaggaaattattcagatagtattctaattcaaggtgatgcagatttggtagaattaggtgaaagtctaaatgatttatctgatgtcttccgaatggcacatgataacttagaacaagaaaagaatcgcttagcaagtatcttaacttatatgactgacggtgtgctggctacagatcgttcaggaaaaatcgttatgattaatgagacagcccaacagcagttcaatctagcatatgatgaagctttatcaatgaatattgttgatatgttagggtcgggaagtccatattcgttccaagatttagtctctaaaacgccagaggtagttcttaatagacgtgatgaaaacggtgaatttgttaccttacggattcgatttgctttgaaccgtcgtgaaagtggttttatttccggtttagttgcagtgtcacacgatgctactgagcaagagaaagaagagcgtgaaagaagactttttgtatctaatgtttctcatgaacttcgtacacctttgacatctgtaaaatcttatttagaagctttagatgagggagcgcttaatgaagaagttgctccaagcttcattaaggtatctctagatgaaacaaatcgtatgatgcgtatgatatcagatttattaagtttatcgcgcattgataatgaagtaacgcatttagatgttgaaatgacgaattttacagctttcatgacctcaattttgaatcgatttgatcagattagaaatcaaaaaacagtcacaggaaaagtttatgaaattgtcagagattatcctcttaagtcaatttgggtggaaattgatacagataagatgactcaagtgattgataacattttaaataatgcagtcaagtattcaccagatggtggtaagatcacagttaatctacgcacaactaaaacgcagatgattttatcaatatcagaccaaggcttaggtattcccaaaaaagatttacctctcatctttgatcgtttttatcgtgttgataaggcgagaagtcgtaaacagggtgggactggacttggtttgtcaattgcaaaagaaattgttaagcagcataagggatttatttgggctaagagtgagtatggtaaagggtctacttttacaatagtcttgccttatgataaagatgctgtaacttatgaagaatgggaggacgttgaagattaa

SEQ ID NO: 8562 - protein, 449 aa, Streptococcus agalactiae; identical to SEQ ID NO: 1176

SEQ ID NO: 8563 - DNA, 567 bp, Streptococcus agalactiae
atgattaagaaaaataaagtttttttagaagttcttttagtccttgttgttatccttgaaggtggtgtattattttaccaatcacaattccaaaagacaactaatcaagcgttagctattgcttataaagatgctaaagtggctaagaaggatgtcatacatcaaaaaattgacaaagaatttgaaaactttagagggagctacgaaattgaattcaataccaaaagcgcagaatacagctatcatgtagatgttaagactggacaaatccttgagcgggacatggataataatggcttttcaaaatcgacttctcagtcaagttcatcgtcaagtcaaaaatctcataaaataagtcaagaagaagccaaaaagattgcatttaaagatgctaatatagaggaatcagaagtcagtaatcttaagatcaaagaagaaattgaaaatggaaaatcagtttatgatattgactttgtggacctgaaaaataaaaatgaagttgattatcaaattgatgcagaaactggaaaaatcattgaacgttctagagatcatatgaatgattaa

SEQ ID NO: 8564 - protein, 188 aa, Streptococcus agalactiae
MIKKNKVFLEVLLVLVVILEGGVLFYQSQFQKTTNQALAIAYKDAKVAKKDVIHQKIDKEFENFRGSYEIEFNTKSAEYSYHVDVKTGQILERDMDNNGFSKSTSQSSSSSSQKSHKISQEEAKKIAFKDANIEESEVSNLKIKEEIENGKSVYDIDFVDLKNKNEVDYQIDAETGKIIERSRDHMND

SEQ ID NO: 8565 - DNA, 1791 bp, Streptococcus agalactiae
atgacacatttagttgacttaacaaagaaacccttcaatctaaatcaagaagcaattgagtggattgaaaaaacaattaatgagatgacattggatgagaaaattgggcaactttttttcaatatgggagctagtcgttcagaagaatatttaacagatgttttggatcggtatcatattgctgctgttcgctataatagaggtagttcaagtgaaatctatgatcagaatttaattttacagacaaagtcgaaattgccgatgttgattgctgcaaatacagaagctggtggagacggtgctgtcacggatggaactaaagttggcgatgaaataaaagtggctgctacaaatgatccgaaatatgcttatgaaatgggaagaatcgcagggatggaggcatctgctgtgggttgtaatgcttcattttctccaattgtagatttgacacgtaattggcgtaatcctatcatagctagtcgaaattggggtgctaacgttgatcaaattatttcactttcaaaagagtatatgaaaggaatcatgcaatataatattgtacctttcgctaaacattttccaggggatggcattgatgagcgtgatcatcatttgtcatttgcttccaatcctatgagtaaagaggagtggatgtcgacatttggccgcatttatggtgaattggctgacgcaggtttaccaggagtcatggcaggtcacatacatttaccaaacgttgaaaaagaaatgcatccagagcgagaccttgatgatatgttaccagcttcattgaataaaacacttttagatgagttattgagaggagagttaggttataatggagctattgtaacggacgcttctcatatggttggaatgactgcttcaatggcaaggagagatttgttgccaacggcgattgaagcaggttgtgatttattcttattctttaatgaccctgatgaagacattcaatggatgaaagaaggttacgaaaaaggtattctaacagaggaacgtctccatgacgctttacgtcgtactctcggtctaaaagcgaaattaggcttgcataactatgagggacgtcgccaagaactctttatgcctaaagataaggctatggctttaatcaacacattagagtcgcaaaaaatagctgatgaagttgctgataaagcagtaactctggtaaaagataaacaaaaagatatctttccagtaaatccagaacgttatcgtcatatcttacttgttaacgttgaaggatataagggaggttttggtgcgatgattgctggaaacaagcaacgtgcatcggattacatgaaagagttacttgaggcacgtggccatgaagtaactgtctgggagtctaccgaagagcgtattatgaaattgccacaagaggagcgggcagcagctatcgctaatgtttacgcacaaaaacagccaatcgcaaatctaacagaacactatgacttgattattaacttggtagatgtcaatgctggaggaacaacacaacgtattatttggccagcagctaaaggcacccctgatcagcctttttacgttcatgaaataccatctattgtgatttcagtacaacatgcatttgctttagcagatatgccacaggtagggacttatattaatgcttatgatgggcttcctagcacgataagtgcagtagttgcgaaattggctggagaatcagaatttacaggagtttcaccagtagatgcttactgtggtttaattgatacacatttatggcgccaatgctaa

SEQ ID NO: 8566 - protein, 596 aa, Streptococcus agalactiae; identical to SEQ ID NO: 1236

SEQ ID NO: 8567 - DNA, 618 bp, Streptococcus agalactiae; identical to SEQ ID NO: 1277

SEQ ID NO: 8568 - protein, 206 aa, Streptococcus agalactiae
VKSQTIIISRRHLMSDVVEKQTTKSFIMNVLNGLALGTVIVLIPGAILGELMKALLPMWSGFATLIAATAVATSMMGLVIGIMVGLNFKFNPIQSASLGLAVMFAGGAATFLKGAIMLKGTGDIINMGITAALGVLLIQFLSDKTKSFTLIVIPTVTLLLVGGVGHVLLPYVKMITTMIGQGTRRTHENFLFILLCPDINFEKIPF

SEQ ID NO: 8569 - DNA, 816 bp, Streptococcus agalactiae
atgattttaaaaatttgtcgtgcagcatatagtttacaatggggaggtgtttaccaattagctttgctggattatcctcgaattaaggcgtttgaattggaaaggataggagctttcatagcttacgagaaacaatataaaagaaaaactgagatacaatgtgacgataaacatctcctcgcaaaaattgttcattttttaaaatacaatagttttacttttccctatattcccaaatatagagaagcggcagctacttttaatgaggatggtattagtttaacttctgattttttaagccatacatgtacgattgaaactgcaaaactaatttttaaagaaggtaaaatcttatcagcagttaaagcctttaataagcctgctgaagtactggtaaaagataagaggaatgctgctggagaccctaaagattactttgactatgtgatgttgaactggtcaaataccaattctggttatcgtttagtaatggaaagattgttaggcaaagcaccatctgaacaggagttaacagtaggttttaagccaggggtcagttttcattttacttatcaagatatcatcaatcatcctgattctatttttgatggttatcatcctgctaaaattaaaaatcagctttctttagcagaacatttagttgcatgtgttatcccaaaacattatcaagaagattatcaaagccttgtgcccaatgacttgaaacacagggtttattatttagattactgtaacgaaacactttatgagtggaatcaaaaagtttatgattttctttgtcatttggaaaataaa

SEQ ID NO: 8570 - protein, 272 aa, Streptococcus agalactiae
MILKICRAAYSLQWGGVYQLALLDYPRIKAFELERIGAFIAYEKQYKRKTEIQCDDKHLLAKIVHFLKYNSFTFPYIPKYREAAATFNEDGISLTSDFLSHTCTIETAKLIFKEGKILSAVKAFNKPAEVLVKDKRNAAGDPKDYFDYVMLNWSNTNSGYRLVMERLLGKAPSEQELTVGFKPGVSFHFTYQDIINHPDSIFDGYHPAKIKNQLSLAEHLVACVIPKHYQEDYQSLVPNDLKHRVYYLDYCNETLYEWNQKVYDFLCHLENK

SEQ ID NO: 8571 - DNA, 1275 bp, Streptococcus agalactiae; identical to SEQ ID NO: 1357

SEQ ID NO: 8572 - protein, 425 aa, Streptococcus agalactiae
VIKNAIAYITRKKNRTLIIFAILTIVLSCLYSCLTIMKSSNEIEKALYESSNSSISITKKDGKYFNINQFKNIEKIKEVEEKIFQYDGLAKLKDLKVVSGEQSINREDLSDEFKNVVSLEATSNTKRNLLFSSGVFSFKEGKNIEENDKNSILVHEEFAKQNKLKLGDEIDLELLDTEKSGKIKSHKFKIIGIFSGKKQETYTGLSSDFSENMVFVDYSTSQEILNKSENNRIANKILMYSGSLESTELALNKLKDFKIDKSKYSIKKDNKAFEESLESVSGIKHIIKIMTYSIMLGGIVVLSLILILWLRERIYEIGIFLSIGTTKIQIIRQFIFELIFISIPSIISSLFLGNLLLKVIVEGFINSENSMIFGGSLINKSSFMLNITTLAESYLILISIIVLSVVMASSLILFKKPKEILSKIS

SEQ ID NO: 8573 - DNA, 1086 bp, Streptococcus agalactiae; identical to SEQ ID NO: 1383

SEQ ID NO: 8574 - protein, 362 aa, Streptococcus agalactiae
LWLDIIFKKSIIILTRQTPHSFIGRYVLIWGFFYIVRRVMKQPLALTWEDQIRLLEKRGLIVKADDVEKIKHISYYRIKEFAKPLEIKQQDGEEQDILYDNIEFAEVLARYYQDKNLRIYLLHAIEKIEVSIKTKISFVLGDRYGAFGYLNFSSWANRNKFTKYDIEKRQFRIKKNLLNTVRKSQLTELQKSINLDLDGFPTVWLAIDLLMFGDIVSILTIMSEKNIKQICQYYSCTPEELVSWLKCLNFIRNVCAHNSNVLDIQITTKPKLRSEWRNYIDTVIIKHNVTKPSNKLSVIIAIVVYLVNTINSKYQWRNIQSSLKALCKEDDSRAKLLGFKDYDSVKAMINGIKCTTFTNSKK

SEQ ID NO: 8575 - DNA, 717 bp, Streptococcus agalactiae
atggtaattaatattgagcaagctatcgcatggatggcatctagaaaaggtaaagttacttactcgatggactatcgaaatggtccttcatcttacgattgctctagctctgtctattttgctctacgctcagcaggcgcatcagataatggctgggcagtaaatacagaatatgagcacgattggttgataaaaaacggttatgttcttattgcagaaaatactaattggaatgcgcaaagaggtgatatttttatttggggtaaacgtggggcttcggctggagcttttggacatactggtatgtttgttgatccagacaatattattcactgtaattatggttataactcaattacagtgaataaccatgatgaaatctggggatataatggtcaaccttatgtttacgcttatcgttacgctaggaaacagtcaaatgctaaggttgataatcaatcagttgtatctaaatttgaaaaagagttagacgttaacacaccgctaagtaattcaaatatgccatattacgaagcaacaatttcagaagattattacgttgagtccaagcctgacgtcaatagcactgataaggagttgcttgttgctggtactagagttcgagtttacgaaaaagtaaaaggctgggcaaggataggcgctccacagtctaatcagtgggtagaagatgcttacttaattgatgcaacagatatg

SEQ ID NO: 8576 - protein, 239 aa, Streptococcus agalactiae
MVINIEQAIAWMASRKGKVTYSMDYRNGPSSYDCSSSVYFALRSAGASDNGWAVNTEYEHDWLIKNGYVLIAENTNWNAQRGDIFIWGKRGASAGAFGHTGMFVDPDNIIHCNYGYNSITVNNHDEIWGYNGQPYVYAYRYARKQSNAKVDNQSVVSKFEKELDVNTPLSNSNMPYYEATISEDYYVESKPDVNSTDKELLVAGTRVRVYEKVKGWARIGAPQSNQWVEDAYLIDATDM

SEQ ID NO: 8577 - DNA, 1194 bp, Streptococcus agalactiae
gtgattaaacgatttgataattatgctcagtacgtacttgttttaggttttagcttactaattggtggtgtggttggggctattacagcagtctttggacgtgttctattattcctgacagcctttagaagtgattatatagcttacctactcccttttcttagcattgttggtttatttatagtttttgtctatcaaaaatttgggggtaagagtgttaaagggatgggattggtatttgaagtaggtcatggtaatgaggagactattccgaaacgtcttgttcctctcgtgatattaacaacttggttaacccacttatttggtggtagtgcaggtcgtgagggggttgctgtacagattggggctaccgtttcacactactttcaaaaatattgccgtttacaaaacgcttctcaacttttcctagtaatgggaatggcagcaggttttgctggtttatttcagactcctttagctgctactttttttgcgattgaagttttggtagtaggtcgtttaatggtttcgtatgtattaccaagtttaattgctgccctgacagcaaatttcgtctcacattctttaggtttagaaaaattttctcatagtatagcaacatcaatggcgttaacaccagatattattctaaaattattggttttaggactatgttttggtctgtgtggtaatttatttgcttatttattggctaaagctaaattaattgcttctagtaggttgctaaacccatataaacggattttcacacttggattgttagctacttttttattgtttatcttccattttggacgatattcaggactgggaacaaatctaattgaggctagcttcactaataagaacctttatgattatgattggttgttaaaattgtgtttgacagttattactttggctgcaggttatcagggaggagaagtaactcccttatttgcaatcggagcaagtttaggagtgattattgcgcccattttaggtttgccagttattttagttgctgctttaggctatactagcgtttttgggagtgcaacgaatactctgttaggtcctatcttaataggaggcgaagtctttggctttgccaacactccttattttgttattgtatgtcttgttgcttactccatatcacatgctcatacgatttatggtgctcaatctaga

SEQ ID NO: 8578 - protein, 398 aa, Streptococcus agalactiae
VIKRFDNYAQYVLVLGFSLLIGGVVGAITAVFGRVLLFLTAFRSDYIAYLLPFLSIVGLFIVFVYQKFGGKSVKGMGLVFEVGHGNEETIPKRLVPLVILTTWLTHLFGGSAGREGVAVQIGATVSHYFQKYCRLQNASQLFLVMGMAAGFAGLFQTPLAATFFAIEVLVVGRLMVSYVLPSLIAALTANFVSHSLGLEKFSHSIATSMALTPDIILKLLVLGLCFGLCGNLFAYLLAKAKLIASSRLLNPYKRIFTLGLLATFLLFIFHFGRYSGLGTNLIEASFTNKNLYDYDWLLKLCLTVITLAAGYQGGEVTPLFAIGASLGVIIAPILGLPVILVAALGYTSVFGSATNTLLGPILIGGEVFGFANTPYFVIVCLVAYSISHAHTIYGAQSR

SEQ ID NO: 8579 - DNA, 855 bp, Streptococcus agalactiae
atgcaggtatttttaaatattgtcaataaattctttgatccaattatccatatgggttcgggagttgtgatgctaattgtcatgacaggtttagccatgatatttggagtgaagttttctaaagcacttgaaggtggtattaagttagctattgctcttacgggtattggtgctattattggtattttaactggtgctttttctgaatcacttcaagcttttgttaaaaatacaggaatcaatctaagcattattgacgttggttgggctccattagcaactattacatggggatcaccatatacgctttacttcttattaatcatgcttattgtcaatattgttatgattgttatgaaaaaaacggataccttagatgttgatatttttgatatttggcatttatctatcacaggtcttttaattatgtggtatgctaaaaaaaataatctaccaacacttttatctgtcattattgcaactgtagctattatcttcgttggtgttctaaaaattatcaattctgatttgatgaaacctacctttgatgatttattggggacaggtccaacttctcccatgacttcaacgcatatgaattatatgatgaaccccattattatggttttggataagctttttgataaagtttttccagggctagataaatatgactttgacgcggctaaattaaataaagccattggattctggggctctaagttctttattggtatgattttaggacttgtcatarggattatgggcaaccccgtgttctcatttgcaagcattaggtggctggttttcttcttcgttttacagcagggtgcttgtttagaagttggtctcttt

SEQ ID NO: 8580 - protein, 285 aa, Streptococcus agalactiae
  MISC_FEATURE (1)..(285): Xaa = Any Amino Acid
MQVFLNIVNKFFDPIIHMGSGVVMLIVMTGLAMIFGVKFSKALEGGIKLAIALTGIGAIIGILTGAFSESLQAFVKNTGINLSIIDVGWAPLATITWGSPYTLYFLLIMLIVNIVMIVMKKTDTLDVDIFDIWHLSITGLLIMWYAKKNNLPTLLSVIIATVAIIFVGVLKIINSDLMKPTFDDLLGTGPTSPMTSTHMNYMMNPIIMVLDKLFDKVFPGLDKYDFDAAKLNKAIGFWGSKFFIGMILGLVIXIMGNPVFSFASIRWLVFFFVLQQGACLEVGLF

SEQ ID NO: 8581 - DNA, 2466 bp, Streptococcus agalactiae; identical to SEQ ID NO: 6983

SEQ ID NO: 8582 - protein, 822 aa, Streptococcus agalactiae
VKKTYGYIGSVAAILLATHIGSYQLGKHHMGLATKDNQIAYIDDSKGKVKAPKTNKTMDQISAEEGISAEQIVVKITDQGYVTSHGDHYHFYNGKVPYDAIISEELLMTDPNYHFKQSDVINEILDGYVIKVNGNYYVYLKPGSKRKNIRTKQQIAEQVAKGTKEAKEKGLAQVAHLSKEEVAAVNEAKRQGRYTTDDGYIFSPTDIIDDLGDAYLVPHGNHYHYIPKKDLSPSELAAAQAYWSQKQGRGARPSDYRPTPAPGRRKAPIPDVTPNPGQGHQPDNGGYHPAPPRPNDASQNKHQRDEFKGKTFKELLDQLHRLDLKYRHVEEDGLIFEPTQVIKSNAFGYVVPHGDHYHIIPRSQLSPLEMELADRYLAGQTDDNDSGSDHSKPSDKEVTHTFLGHRIKAYGKGLDGKPYDTSDAYVFSKESIHSVDKSGVTAKHGDHFHYIGFGELEQYELDEVANWVKAKGQADELVAALDQEQGKEKPLFDTKKVSRKVTKDGKVGYIMPKDGKDYFYARYQLDLTQIAFAEQELMLKDKKHYRYDIVDTGIEPRLAVDLSSLPMHAGNATYDTGSSFVIPHIDHIHVVPYSWLTRNQIATIKYVMQHPEVRPDVWSKPGHEESGSVIPNVTPLDKRAGMPNWQIIHSAEEVQKALAEGRFAAPDGYIFDPRDVLAKETFVWKDGSFSIPRADGSSLRTINKSDLSQAEWQQAQELLAKKNAGDATDTDKPEEKQQADKSNENQQPSEASKEEKESDDFIDSLPDYGLDRATLEDHINQLAQKANIDPKYLIFQPEGVQFYNKNGELVTYDIKTLQQINP

SEQ ID NO: 8583 - DNA, 924 bp, Streptococcus agalactiae
atgaaaaggatacggaaaagccttatttttgttctcggagtagttaccctaatttgcttatgtgcttgtactaaacaaagccagcaaaaaaatggcttgtcagtagtgactagcttttatccagtatattccattacaaaagcagtttctggtgatttgaatgatattaaaatgattcgatcacagtcaggtattcatggttttgaaccctcatcaagtgatgttgctgccatttatgatgctgatctatttctttatcattcgcacacactagaagcttgggcgagacgtttggaacctagtttgcatcactctaaagtatctgtaattgaagcttcaaaaggtatgactttggataaagttcatggcttagaagatgtagaggcagaaaaaggagtagatgagtcaaccttgtatgaccctcacacttggaatgaccctgtaaaagtatctgaggaagcacaactcatcgctacacaattagctaaaaaggatcctaaaaacgctaaggtttatcaaaaaaatgctgatcaatttagtgacaaggcaatggctattgcagagaagtataagccaaaatttaaagctgcaaagtctaaatactttgtgacttcacatacagcattctcatacttagctaagcgatacggattgactcagttaggtattgcaggtgtctcaaccgagcaagaacctagtgctaaaaaattagccgaaattcaggagtttgtgaaaacatataaggttaagactatttttgttgaagaaggagtctcacctaaattagctcaagcagtagcttcagctactcgagttaaaattgcaagtttaagtcctttaraagcagttcccaaaaacaataaagattacttagaaaatttggaaactaatcttaaggtacttgtcaaatcgttaaatcaatag

SEQ ID NO: 8584 - protein, 307 aa, Streptococcus agalactiae
  MISC_FEATURE (1)..(307): Xaa = Any Amino Acid
MKRIRKSLIFVLGVVTLICLCACTKQSQQKNGLSVVTSFYPVYSITKAVSGDLNDIKMIRSQSGIHGFEPSSSDVAAIYDADLFLYHSHTLEAWARRLEPSLHHSKVSVIEASKGMTLDKVHGLEDVEAEKGVDESTLYDPHTWNDPVKVSEEAQLIATQLAKKDPKNAKVYQKNADQFSDKAMAIAEKYKPKFKAAKSKYFVTSHTAFSYLAKRYGLTQLGIAGVSTEQEPSAKKLAEIQEFVKTYKVKTIFVEEGVSPKLAQAVASATRVKIASLSPLXAVPKNNKDYLENLETNLKVLVKSLNQ

SEQ ID NO: 8585 - DNA, 2400 bp, Streptococcus agalactiae
atgtcaaaacattatttttcaaaaagcgtattcgctttaactgtcttaacagctacagcaacaagtggtttagctgttcaagcagaagacattgttacaacaccaagttcaacctctacaaaggttgaatcaactacccccactagcacaattgcagaggaaaagtcaaacgttacttctactccaactgcaataactgatgcttcaacagccacaagcacaaataccactaccaataaccaaaatccacagcctgttgccacagaagccacaactagtgatctcaaacctattgaaggtgaaaaagttgaccttcgcatcatgtcaaccacagacctacacaccaatttagttaactatgattattatcaagataaagaatctcaaaaaatagggttagcaaaaactgctgtccttattgaagaagcaaaaaaagaaaatcctaataccgtcttagttgataacggagatgtcattcaagggacacctttaggaacttataaagcaatcgttaaacctgtcgcagaaaatgaagaacatcctatgtaccaagccatgaatgctcttggttatgatgcatcaacactaggtaatcatgagtttaattacggtttagattacctcaaaaaaatcattgctacagccaaccttycaatcctcaacgcaaatgttttggatttcaaaacacatcaaccagtttttaaaacttatgacatcattactaaaaccttcaaagattcaacaggaagagctgttgcactaaatattgggattacaggaattgtacctcctcaaatcttaaactgggacaaggctaacctagagggaaaggttattgtcaaagattcagttaaagcaatcgaagaaatcgttcctactatgcgtgctaaaggagcagatgtcattctcgttttatcacactctggcattggagatgatcgatatgaagaaggtgaagaaaacgttggctatcaaattgccagcatcaagggagtggatgccgttgttacgggacactcacacgctgaatttccatcaggtaacggtactggcttctatgaaaaatacactggagttgatggtatcaatggaaaaataaatggaacacctgttacaatggcaggcaagtacggggatcatcttggtattattgatttaggacttagttatactaatggaaaatggcaagtctccgaaagtagtgctaaaatccgtaaaattgatatgaactcaacaactgctgacgagcgtatcattgcattggctaaggaagcacacgatggcactatcaactatgttcgccaacaagtaggtacaacaactgcgccaattacaagttactttgcactagttaaagatgacccttcagttcaaattgttamcaacgctcaacgttggtacgttgcaaatgaattgaaaggaacacctgaggcaaatttaccacttctatctgctgcagcaccatttaaagctggaacacgcggcgatgctaccgcatatactgatattccagctggacctgttgcaattaaaaacgtagctgatctttacctttatgataatgttactgcacttttaaaagtgaccggagcagacttacgtgaatggttagaaatgtccgctggtcaatttaaccaaattgaccctaacaataaagcaccacaaaatattatcaataccgaatatcgtacctataattttgacgttattgacggcttgacttataaatttgatattacacaacctaataaatacaataaagatggaaaagttgttaatagtcaagctagtcgagtacgcgatttaatgtacaatggtaagcctgttgcagacaaacaagagtttatgattgtgaccaataactaccgtgctagtggtaccttccctggggctaaaaatgccacaatgaaccgtttgctgaacttagaaaatcgccaaactattatcaactatattatttcagagaaaaccatcaatcctacagctgataataactggggcttcacagagtctattaaagaccttgatttacgattccaaacagccgataaagctaaaaatcttgttactaatagcaaggatattcagtatatcgctagttctaccaaagatgaaggatttggtgattatcgatttgtctatactgaacaagaaaaagtagaccttactgagccatcacatcaagaaaagttaagccaaatagaaaaacaaaaaattcaccacatggttgcaactgcttatacaaaagcaaaagcttctccaaatattacaggcactgtctatacacaacagaaagaaaaaacattacctaaaactggacaagaaaaacaatcttatctggctttctttggtgtcgcaatacttggactcgtgggaagtttacttaaaaagaaacaaata

SEQ ID NO: 8586 - protein, 800 aa, Streptococcus agalactiae
  MISC_FEATURE (1)..(800): Xaa = Any Amino Acid
MSKHYFSKSVFALTVLTATATSGLAVQAEDIVTTPSSTSTKVESTTPTSTIAEEKSNVTSTPTAITDASTATSTNTTTNNQNPQPVATEATTSDLKPIEGEKVDLRIMSTTDLHTNLVNYDYYQDKESQKIGLAKTAVLIEEAKKENPNTVLVDNGDVIQGTPLGTYKAIVKPVAENEEHPMYQAMNALGYDASTLGNHEFNYGLDYLKKIIATANLXILNANVLDFKTHQPVFKTYDIITKTFKDSTGRAVALNIGITGIVPPQILNWDKANLEGKVIVKDSVKAIEEIVPTMRAKGADVILVLSHSGIGDDRYEEGEENVGYQIASIKGVDAVVTGHSHAEFPSGNGTGFYEKYTGVDGINGKINGTPVTMAGKYGDHLGIIDLGLSYTNGKWQVSESSAKIRKIDMNSTTADERIIALAKEAHDGTINYVRQQVGTTTAPITSYFALVKDDPSVQIVXNAQRWYVANELKGTPEANLPLLSAAAPFKAGTRGDATAYTDIPAGPVAIKNVADLYLYDNVTALLKVTGADLREWLEMSAGQFNQIDPNNKAPQNIINTEYRTYNFDVIDGLTYKFDITQPNKYNKDGKVVNSQASRVRDLMYNGKPVADKQEFMIVTNNYRASGTFPGAKNATMNRLLNLENRQTIINYIISEKTINPTADNNWGFTESIKDLDLRFQTADKAKNLVTNSKDIQYIASSTKDEGFGDYRFVYTEQEKVDLTEPSHQEKLSQIEKQKIHHMVATAYTKAKASPNITGTVYTQQKEKTLPKTGQEKQSYLAFFGVAILGLVGSLLKKKQI

SEQ ID NO: 8587 - DNA, 1635 bp, Streptococcus agalactiae
atggaagaacgctttaagaaacgactacaagatgatatctctaaacatttttcccgccagtctttaattttatccttgttattgattgcacttttcgtccttttttctttagcgcctcaacagataggtctttataaagatgttaattcagtttcctatagttataagcaattgattcaaaaacatgataccttattagatgacttaggtaaaaatagtttgaaaccatttgtctcaggacacttaggaagtgctgatttgagtaagcaatattatcatttaaggaatcatttacaaagtcaaacagaacttttagtattctcacctaatcaagaacttttgtttgctagtaattcacatttaggtaatttttttagtaagtctatttacattagtgaagttttagataaggctaaaataaatcaaaggctactaaaaattattgtggatagtgagggagggcattaccttgcactcattaagccaattatagttaataaaaaagtttcaggttatgcctttttattgatgaatgggaaagactttttacttccaacgaaggctattaactcagacttgattattgccgatcagctaaataatagctttacttttactaatcgtgattttatctcctctagtttagataaggtagatagtcaattcttaactagatattttagttttcacgatcatcgagcttttgttgttaggaaagtagctctgcaagacaatatcctactttacatgtatcgtcccctgataccagtaactctggtcgtccttttttctctagtatcatcagttattatttttgtgattttacgacaaaaatctagagttctagccgatcgcatcgcagtaaaaaattctagcgccataaatcaaatggtgctagatatggatgccatttcccgccaagaaaaatctagtattgagcttgatagtcaagatgaatttcaatatctatctgtgcaaatcaatcagatggtttcacggttaaaagatttacatgagaaaactcttgatttggaaacacaaaagttgttgtttgaaaagaggatgttagaagctcagtttaatcctcacttcctttataatacccttgagacaattttaataaccagtcactatgattcacaattaacagaaagaatcgttatacaactaacaaaattattgcgctatagccttagtggtagcacagaagcagctgtgcttaaggatgatttagcaatcattgaatcctaccttttgattaatcaagtgagatttgaagaattaacttacactatttcagtatctcctgaacttgaacacatgcgtgtaccaaaacttttcttgttaccgctaattgagaatgctattaaatatggcttaaaagaacgtcatgatgtagcaataaacatagatatttggcaagatagtgatggaatttggtttactgtttcaaataatggatcaggtattagtttggctaggcaacaagccatacgtacaatgttaagatcaactcactcgcatcatgggcttattaattcttatagacgattacaatatcaattttcaacagtattgttagagtttacgaagacagatgatgcttttcgagttagctatatagtaaaggagtga

SEQ ID NO: 8588 - protein, 544 aa, Streptococcus agalactiae
MEERFKKRLQDDISKHFSRQSLILSLLLIALFVLFSLAPQQIGLYKDVNSVSYSYKQLIQKHDTLLDDLGKNSLKPFVSGHLGSADLSKQYYHLRNHLQSQTELLVFSPNQELLFASNSHLGNFFSKSIYISEVLDKAKINQRLLKIIVDSEGGHYLALIKPIIVNKKVSGYAFLLMNGKDFLLPTKAINSDLIIADQLNNSFTFTNRDFISSSLDKVDSQFLTRYFSFHDHRAFVVRKVALQDNILLYMYRPLIPVTLVVLFSLVSSVIIFVILRQKSRVLADRIAVKNSSAINQMVLDMDAISRQEKSSIELDSQDEFQYLSVQINQMVSRLKDLHEKTLDLETQKLLFEKRMLEAQFNPHFLYNTLETILITSHYDSQLTERIVIQLTKLLRYSLSGSTEAAVLKDDLAIIESYLLINQVRFEELTYTISVSPELEHMRVPKLFLLPLIENAIKYGLKERHDVAINIDIWQDSDGIWFTVSNNGSGISLARQQAIRTMLRSTHSHHGLINSYRRLQYQFSTVLLEFTKTDDAFRVSYIVKE

SEQ ID NO: 8589 - DNA, 435 bp, Streptococcus agalactiae
atgtcaatttttcagacaacacgaaacggattattttacactccagtttatcttctagcaggatatttactctatgattattttaatactgacctatttaccaaatcgcgtggtcttaagtatattctcttccttttacttctagctttagagaatgttcttatttattttaatcaagggttggataaaaatttcttcttattagctcctttatgtgcagtattcttatttaactggagtatacgtacatcactgtttaaggaatatcgtttaagtcctttaaaacagttgagtgtctattatttcttccttccccctctttttattggcatagtgtcttactgtttaaaatcaacttccttagttgcacaccatcaagggaaaagtgatttttgtggtgaccttggcattaacaccatgcttgtgctctactca

SEQ ID NO: 8590 - protein, 145 aa, Streptococcus agalactiae
MSIFQTTRNGLFYTPVYLLAGYLLYDYFNTDLFTKSRGLKYILFLLLLALENVLIYFNQGLDKNFFLLAPLCAVFLFNWSIRTSLFKEYRLSPLKQLSVYYFFLPPLFIGIVSYCLKSTSLVAHHQGKSDFCGDLGINTMLVLYS

SEQ ID NO: 8591 - DNA, 1032 bp, Streptococcus agalactiae
gtggataataagcagcataatacatcaatgattagtttgctacaataccttttttccatactggtcattttagttcatagtgggaggttatttagtcaggatgtcattcattttacctttaaaagtttcctaggtcggatggctgttccttattttttgatttgtactgctttctttttgagaggtcgtatacagcaaggtttgtgtaatcactcctactttcgtaaactgattaaaaagtatagcatgtggactatcatttatttgccttatggttatttcttttttgaatctctaaatatagcgaagatctatttgttgccggggtttattgtggcatttttgtatttaggtatgtcacataccctttggtacatccctgctgttattctaggttgggtcattattcaaggattattgaagtatgtaggaactagggggacatttatcacagttgttgtactctattgtattggagcagtagagacctattctgtctttatacagtcaacaaaattttatcccctgatgtccacttatatgtcaatttttcagacaacacgaaacggattattttacactccagtttatcttctagcaggatatttactctatgattattttaatactgacctatttaccaaatcgcgtggtcttaagtatattctcttccttttacttctagctttagagaatgttcttatttattttaatcaagggttggataaaaatttcttcttattagctcctttatgtgcagtattcttatttaactggagtatacgtacatcactgtttaaggaatatcgtttaagtcctttaaaacagttgagtgtctattatttcttccttccccctctttttattggcatagtgtcttactgtttaaaatcaacttccttagttgcacaccatcaaggaaaagtgatttttgtggtgaccttggcattaacacatgcttgtgctctactcataataaaggttgttaataagataccctatcaaaaaattattccattatctctttcgaaa

SEQ ID NO: 8592 - protein, 344 aa, Streptococcus agalactiae
VDNKQHNTSMISLLQYLFSILVILVHSGRLFSQDVIHFTFKSFLGRMAVPYFLICTAFFLRGRIQQGLCNHSYFRKLIKKYSMWTIIYLPYGYFFFESLNIAKIYLLPGFIVAFLYLGMSHTLWYIPAVILGWVIIQGLLKYVGTRGTFITVVVLYCIGAVETYSVFIQSTKFYPLMSTYMSIFQTTRNGLFYTPVYLLAGYLLYDYFNTDLFTKSRGLKYILFLLLLALENVLIYFNQGLDKNFFLLAPLCAVFLFNWSIRTSLFKEYRLSPLKQLSVYYFFLPPLFIGIVSYCLKSTSLVAHHQGKVIFVVTLALTHACALLIIKVVNKIPYQKIIPLSLSK

SEQ ID NO: 8593 - DNA, 1656 bp, Streptococcus agalactiae
atgactaaaaaaattttccgtacaactttatctgctagtttgggaattgttttagttacaattttgatgattatgggatttctctataattacttcaatcacattcagcgagaacagttgagaacacaaacggcactggcgtcacaaggaatttcctttgaaggtaaagattattttgaaaatcttaaaacttcaaatgtgcgtattacttgggtagataataagggacaagtgctttatgatacccaatcagatgcaaaacatatgaaaaatcacgccaatcgtcaagaaattaaagaagctatcaagagtggttatggtgagagcacgaggtggtcagcgacacttactgagaagtctatctatgctgcgcaacgtttaaataatggaacgatagttcgtttatcagttgcgcaacaaactattttttatcttctccttggtatgataagtcccttagcaattatcatcttacttgctattattttatctgtattaattgcacgatatatagcaaaaaaagtatcagagcctttaaacaatattgacttagatcatcctttatcaaatgatagttacgaggagataacaccattattaaggcgtcttgatagccatcaggctaagattcaacatcaaaaactgttattacaaaagcgtcaaaaagaatttgataccattatttctaaaattaaggaaggaatgattcttttagatgatcaagcaagaatcgttagtatcaacgcagaagctttaaagttattccaaattaatgatgattggcatgggcgctttatgatggaagttagccgagatttaactctcaaagacttaatcgatcaaggactaaaagggaaaaagaaagaggctaatattggcattgaaaataatcattaccgcgtcttggtaagaccaactacagataacaaccgagtaacaggattggttgttctactgtttgatgtgactgatcaactccaaatggaacaacttcaacgtgaatttactgccaatgtctctcatgaattgaaaaccccgcttcatgttatttctggttactcagaactgttagctaatcaaatggttccaaacgaagaagtcccacaatttgcagctaaaattcataaagaatctgaacgattagttaaattggttgaggatattatcaacctttctcaccttgatgaacaagaaaaattaccgcaagagacagtaaatctgtatgacttaacacaaaaagttttagaaggtttacaagctaaagcagataagaagcacatacaaatcaattttaatggagaagaagctattttgcgagggaatccagttttattgaattccttggtgtacaacttgtgtgacaatgctatcacctataaccatgagaaaggtcaagtaaatgtgactttgaaaaattcacctgatacaattaccttagaagttagtgatacgggactaggcattgcagagaaggacaaaaaacgtattttcgaacgtttctatcgcgtcgataaaagtcgctcaaaaatagttggggggactggtttaggtttgtctattgtaaagagtgctttagattttcacaatggtagtataaaagtggacagccatttggggcagggaacaacaatgaccgttttacttcacaaacaataa

SEQ ID NO: 8594 - protein, 551 aa, Streptococcus agalactiae
MTKKIFRTTLSASLGIVLVTILMIMGFLYNYFNHIQREQLRTQTALASQGISFEGKDYFENLKTSNVRITWVDNKGQVLYDTQSDAKHMKNHANRQEIKEAIKSGYGESTRWSATLTEKSIYAAQRLNNGTIVRLSVAQQTIFYLLLGMISPLAIIILLAIILSVLIARYIAKKVSEPLNNIDLDHPLSNDSYEEITPLLRRLDSHQAKIQHQKLLLQKRQKEFDTIISKIKEGMILLDDQARIVSINAEALKLFQINDDWHGRFMMEVSRDLTLKDLIDQGLKGKKKEANIGIENNHYRVLVRPTTDNNRVTGLVVLLFDVTDQLQMEQLQREFTANVSHELKTPLHVISGYSELLANQMVPNEEVPQFAAKIHKESERLVKLVEDIINLSHLDEQEKLPQETVNLYDLTQKVLEGLQAKADKKHIQINFNGEEAILRGNPVLLNSLVYNLCDNAITYNHEKGQVNVTLKNSPDTITLEVSDTGLGIAEKDKKRIFERFYRVDKSRSKIVGGTGLGLSIVKSALDFHNGSIKVDSHLGQGTTMTVLLHKQ

SEQ ID NO: 8595 - DNA, 1653 bp, Streptococcus agalactiae
atgactaaaaaaattttccgtacaactttatctgctagtttgggaattgttttagttacaattttgatgattatgggatttctctataattacttcaatcacattcagcgagaacagttgagaacacaaacggcactggcgtcacaaggaatttcctttgaaggtaaagattattttgaaaatcttaaaacttcaaatgtgcgtattacttgggtagataataagggacaagtgctttatgatacccaatcagatgcaaaacatatgaaaaatcacgccaatcgtcaagaaattaaagaagctatcaagagtggttatggtgagagcacgaggtggtcagcgacacttactgagaagtctatctatgctgcgcaacgtttaaataatggaacgatagttcgtttatcagttgcgcaacaaactattttttatcttctccttggtatgataagtcccttagcaattatcatcttacttgctattattttatctgtattaattgcacgatatatagcaaaaaaagtatcagagcctttaaacaatattgacttagatcatcctttatcaaatgatagttacgaggagataacaccattattaaggcgtcttgatagccatcaggctaagattcaacatcaaaaactgttattacaaaagcgtcaaaaagaatttgataccattatttctaaaattaaggaaggaatgattcttttagatgatcaagcaagaatcgttagtatcaacgcagaagctttaaagttattccaaattaatgatgattggcatgggcgctttatgatggaagttagccgagatttaactctcaaagacttaatcgatcaaggactaaaagggaaaaagaaagaggctaatattggcattgaaaataatcattaccgcgtcttggtaagaccaactacagataacaaccgagtaacaggattggttgttctactgtttgatgtgactgatcaactccaaatggaacaacttcaacgtgaatttactgccaatgtctctcatgaattgaaaaccccgcttcatgttatttctggttactcagaactgttagctaatcaaatggttccaaacgaagaagtcccacaatttgcagctaaaattcataaagaatctgaacgattagttaaattggttgaggatattatcaacctttctcaccttgatgaacaagaaaaattaccgcaagagacagtaaatctgtatgacttaacacaaaaagttttagaaggtttacaagctaaagcagataagaagcacatacaaatcaattttaatggagaagaagctattttgcgagggaatccagttttattgaattccttggtgtacaacttgtgtgacaatgctatcacctataaccatgagaaaggtcaagtaaatgtgactttgaaaaattcacctgatacaattaccttagaagttagtgatacgggactaggcattgcagagaaggacaaaaaacgtattttcgaacgtttctatcgcgtcgataaaagtcgctcaaaaatagttggggggactggtttaggtttgtctattgtaaagagtgctttagattttcacaatggtagtataaaagtggacagccatttggggcagggaacaacaatgaccgttttacttcacaaacaa

SEQ ID NO: 8596 - protein, 551 aa, Streptococcus agalactiae; identical to SEQ ID NO: 8594

SEQ ID NO: 8597 - DNA, 882 bp, Streptococcus agalactiae
atgaaaaaacacaaaatgctatctcttttggcggtatctggtcttatgggaattggcatcctagcaggatgctcaaatgattcatcatcttcatctaaagggacaattaacattgtttctagagaggaagggtctggaactcgtggagctttcatagagttatttgggatcgagtcaaaaaataaaaagggcgaaaaagtagaccatacttctgatgcagcaactgttaccaattcaacttcagttatgctaaccactgtctctaaagacccgtcagctattggttattcttcactaggttcattaaatagtagcgttaaagtgcttaaaattgatggcaaaaatgcgactgtaaaagatattaaatcaggaagctataagatttctcgtcctttcaatattgtaacaaaagaaggtaaggaaaaagaagcaacaaaagattttattgattatatcttaagcaaagatgggcaagcagtcgttgagaaaaatggctatattccacttgacaatgctaaagcatatcaagcaaaagtgtcatctggtaaagttgttatagcaggttcaagttcagtaacgccggttatggaaaagattaaagaagcctatcataaagtaaatgcaaaagtagatgttgaaattcaacaaagtgattcttcaactgggattacaagcgcaattgatggatcagcagatataggtatggcatcacgtgaattggataagacagagtcatccaaaggggtcaaagctactgttattgcaacagatggtattgcagtagttgttaataagaaaaataaagttaatgatctatcaacaaaacaagtaaaagacatttttactggaaagacaacgtcttggtctgacttatcaaagtaa

SEQ ID NO: 8598 - protein, 293 aa, Streptococcus agalactiae; identical to SEQ ID NO: 1694

SEQ ID NO: 8599 - DNA, 1554 bp, Streptococcus agalactiae; identical to SEQ ID NO: 1759

SEQ ID NO: 8600 - protein, 518 aa, Streptococcus agalactiae
VNFIEQISENNQFPIIFVGSGITQRYFENAPTWEKLLKDIWLELFDEESYYAKAFELRERFENNDFDIYTNLASLLEKEVSKAFINGNIQVDNLDLKTAYELNISPFKQLVANRFSNLKIREEKIEEIKQFSQMLSKARIIITTNYDNFIEECLKTINVSVKINVGNKGLFLKSSDYGELYKIHGTVDDASTITITKEDYEKNVTKSALINAKILSNLVESPILFLGYSLTDENIRKLLTDFAENSPFDISESAQKIGVVEYLPDSESIETVVSSLPDLSVYYSCLKTDNFTNIYRLISKINQGFLPSEIAKYENVFRKIIEVKGESKDLKTVLTSYEDLANLTEDEIRSKNIVVAFGDERYIYKFPDFKEYVRSYFLDKETIPQEIVIRFIATQPVASHLPIKKYMFAMSEYISKDSNKYTENIKKRLSKEEELSLDDFTSSIGVPLLHSKTLERQTEIVGILEADVPDNVRYNFIATHIKNFPKEELFLLVEKIIDEGIFETSRRRFLKAFDLLHY

SEQ ID NO: 8601 - DNA, 549 bp, Streptococcus agalactiae
atgaaacgtagaaaaatagttttatttttaatggtgttagtgatggcttttatagtttataaagttattcaaaaagataatccagtgattaaaacaagtggtaatcatacaaaagttgaacgagttgaaccgaaacataaggttaagtcttatgattcaactaaagaagcaaaatctactttggaagctagtgatcgtcaagtatctgataaggaaaaggagaaggttaaaagatctataactgtacctattgattaccttgtaaaaatcccaacacaatcagatattaagggtgattatcaaaataaattatccattacaaatcctacagttgcccaaactgtaaaaaccatgttgatggctggttatcattttgatttggaaagtttacaagtatatgagtcagatgcgagtaatgtttatcagtttactattaatttagtaacagataaaagagacaaattaagtttagctggtaattatgtattaggtacagaccaatttgagattgcgagtgtacatggtacacctgtaaatgtagtattttaa

SEQ ID NO: 8602 - protein, 182 aa, Streptococcus agalactiae; identical to SEQ ID NO: 1770

SEQ ID NO: 8603 - DNA, 1287 bp, Streptococcus agalactiae; identical to SEQ ID NO: 1805

SEQ ID NO: 8604 - protein, 429 aa, Streptococcus agalactiae
VGHFSEKSGSLILRRSLFIVDAIYLKKFRKKTGLKQKEFALSSGLTLKSLRNYEQGKRKLTLEKYQEIKSHFGYLVENDSSRLQVMIDYVRITLKDVRDLEFFCRNFLHCAFKEFQPFESKLMNYNHLWKRGDIWIFDFADKHETGNFQITVQLSGRGCRQLELLMETEKFTWHDWLSYLRNSYRDDMNVTRFDIAIDELYLGKDRENEQFHLSDMISKYYRHELDFESLRTWNYIGGGSLNFSDMEEIEQNRQGISLYFGSRQSEMYFNFYEKRYEIAKQEGITVEEALEIFELWNRYEIRLSQSKANAAVDEFISGVPIGEISRGLIVSKIDVYDGKNEYGSFQADRKWQLMFGGVEPLKFVTKPEAYSIERTLRWLSDSVSPSLAMIREYDMIVDGDYLQTILNSGEVNERGEKILDSIKASLGIL

SEQ ID NO: 8605 - DNA, 1716 bp, Streptococcus agalactiae; identical to SEQ ID NO: 1807

SEQ ID NO: 8606 - protein, 572 aa, Streptococcus agalactiae
LARLIPQYRGIKVKPYMRYMSYYLFSFLFILFLTPVGVYSYYYLDLLKMMDKMSMISVGTGLFLAFFVSWYLTWFLQEANPLFNKLDRLKRMSKFLYENGYVYEKRKKSNKKTKTKYRFPKVYVKQGKYDLSVSFEMAGGKFQKKFKDIGGELEDTFFMDFMEKTDDPRFKIYKLAYSAFLSRITVKDVIWNKDKGIKLMDGYYWDFINDPHLLVAGGTGGGKTVLLRSILRCLAEIGVCDICDPKRADFVTMSDLSAFEGRIAFEKADIIEKFENAVTIMFARYDFVRNEMKRLGHKDMKKFYDYGLEPYFFVCDEYNALMSSLSYQEREIVDNAFTQYILLGRQVGCNAIIAMQKPSADDLPTKIRSNMMHHISVGRLDDGGYVMMFGDENRNKEFRFIKYLAGRRVYGRGYSAVFGEVAREFYSPLLPKNFSFYDAFEKINRHENPFDPTENQEVSKAILKDESLREFVEKTSENELLKGSVGFDFDDEMEEMENMSIGDLAKKTGFSFGKIKNLIDMIEKDNYMTFSREDEKVVLNDSDAVVLESLLTQKDEFEGSWKELLLNYFKGE

SEQ ID NO: 8607 - DNA, 855 bp, Streptococcus agalactiae
atgagagatgagcaagaaatatataatttggtgttaaacatagcaaaccaagataagagaatcgaagctgtactattgaatggatctcgggctaacccaaatgtaccgaaagatgattttcaagattatgatattgtttttgttactaattttatagaagatattatttctgacactaattatcataaaaaattcggtgatattcttataatgcagaaaccaaatgagtttagaaataagacggaatacaattgctttgcttacttaatgcagtttcaagatctgacgaggattgatttaagacttattaaaccagaattcttggaggattatttagatgatgctttttcaaaagtacttttagataaaaagaataaatatcttgattataattttgaaagaagttctctgtacgaaacaaagcaattgtcagaagatgaaatcaacaaaattcttaatgaaatatattgggttagtacttatgtagtcaaggggatagcaagaaatgatattatttattcagagtttatgatatctaatcctattaaaaatgcttttattaaacttctaaaacaaaaaatattaatagaaaaagagcttgattcattatcttttggaaagctcgacaaggatatcttgcaatatattacagataaagatcaactattgaaaattttttcaaataaatctttaaaagacattgaggctaatttgcgatttttattggatgaaacaaatcaaatggcgaaatatatttctattaataggaaacttaatctgaaccaaggagaataccaatcagcaatgaaatttatgaatatctttttgtcaaattcatatcaaaatttcaactaa

SEQ ID NO: 8608 - protein, 284 aa, Streptococcus agalactiae; identical to SEQ ID NO: 1834

SEQ ID NO: 8609 - DNA, 606 bp, Streptococcus agalactiae
atgataaagtttaaattattttttaaatccacagaaaaagaggaagaatggatcgataaggttcaaaaaagtggctatgcttttacaggcattaactcatttcttccagccttctattattttaagagagataaagaaaaagacaagatgtcaataaaaatggattttaaaaaatacatgtcgaaagatgactatgctaactatatcactttatttgaggacagtggatggaagcatattagcggtagtcgttggggagggctgcattattttcaaaaaataaagcctgaaaccagttcagagattttttctgatcaagaatcaaaatcagcgatggctatgagttattataaatatacttgtgagcatgcgtttttctctttattttatttctttctcttgataagaacaacttctatcaccatatttgatccaaaaagttggtatctgacgcaaggtctatgggaaatgcaagggaaaatattttggttagcattcttatttgaaacaccatttgccttattaagaatattacctatgttttactttttaatttctggaatatactatattacacgagctgtaaaacccaaggaaattataaat

SEQ ID NO: 8610 - protein, 202 aa, Streptococcus agalactiae
MIKFKLFFKSTEKEEEWIDKVQKSGYAFTGINSFLPAFYYFKRDKEKDKMSIKMDFKKYMSKDDYANYITLFEDSGWKHISGSRWGGLHYFQKIKPETSSEIFSDQESKSAMAMSYYKYTCEHAFFSLFYFFLLIRTTSITIFDPKSWYLTQGLWEMQGKIFWLAFLFETPFALLRILPMFYFLISGIYYITRAVKPKEIIN

SEQ ID NO: 8611 - DNA, 612 bp, Streptococcus agalactiae; identical to SEQ ID NO: 1849

SEQ ID NO: 8612 - protein, 204 aa, Streptococcus agalactiae
VNKKSFFQCVILLVSFLVLTLAVKSQSDMISYLDNITSAFFQSIRNPDLTNLMTIISTVVSPLTTSLIALVILGYQYFLNQRIAVWLFMLFFGTNALALLLKDIIARHRPMNQLVFDSGYSFPSGHTISAFLLMILVLVVARQRLRRVLSQVVFVIFALVILASVIFSRLYLENHFLTDILGSLLLGASSYYGLSAIVSLKELQ

SEQ ID NO: 8613 - DNA, 375 bp, Streptococcus agalactiae
ttgaatcaagaaaaaaagagacttaacctaatcgggctgatacttttagctcaggctattgttttaagtttggcgactacactatttgctgaaatcttacaaaatgatgtctggataggtatagcaagtactttaatcgccttactcattccttgtttttttatgggttttaaaaatttaaaaaaacatctaacggcaacccatcatacaatcactttcaccactattttattcttgttaagcattatatatactactaataatatagtctccacaatatgggatgttgtgctaaatcatctcaatattatggaatcggaaagtcaaaattatgatgccacattcaatatacttatgattagttatctgttgttg

SEQ ID NO: 8614 - protein, 125 aa, Streptococcus agalactiae
LNQEKKRLNLIGLILLAQAIVLSLATTLFAEILQNDVWIGIASTLIALLIPCFFMGFKNLKKHLTATHHTITFTTILFLLSIIYTTNNIVSTIWDVVLNHLNIMESESQNYDATFNILMISYLLL

SEQ ID NO: 8615 - DNA, 1080 bp, Streptococcus agalactiae
atggcaagaatcccttatcagaaaacacttattttttgtgtagccgttattattgctatttttattttggggttatctaaggatttagcacaatctaaagggcaaaaggttgcaaataataatactgtaaaaacagcacgtgtggttgcaaacggagatattttgctgcacgatgtactatatgccagtgcgcgccaacccgacggcacttataattttactccttattttaaagaggtaaaatcttggattgagagcgctgatttagcgattggtgattatgaagggacgattagttcagaatatcctttagcgggctatcctttatttaatgctcctaatgagattgcaactactatgaaagaaactggatatgatgtcgttgacttagcacataatcatattctggattcacaactggcaggtgctatcaatactgtcaagacttttaatcgtctgggattggatactattggggtttatttaaaggatagaaataaagaagatatcttaattaagcatgtaaatggtattaaaattgctattttaggttattcgtatggctacaatggtatggaagctaatgtttcaaagagtgactatgaaaaacatatgtctgatttagatactaaaaagattaagcaagatattaaaaaggctgaaaaagaagcagatatcaccattgtcatgccacagatggggatagaatatcaaaaaaaacctactacagaacaagtaatgctttatcatagtatgattaaatggggggcagatattatattcggaggacaccctcacgttgttgaaccgtctgaagtgataaaaaaagatggccagaaaaaatttattatttactctatgggaaattttatttcaaatcagcgtttagaaacggttgatgatatctggacagaaagaggattattaatggatgtaaccatagagaaaaaaggtcaaaaaacagtaattaaaaaagttaaggcgcatccaacactagtagaagcaaaaccaaatggccgttatgttgaagaaggctttccagcttatgattataggacgctagttttagaggaattatat

SEQ ID NO: 8616 - protein, 360 aa, Streptococcus agalactiae
MARIPYQKTLIFCVAVIIAIFILGLSKDLAQSKGQKVANNNTVKTARVVANGDILLHDVLYASARQPDGTYNFTPYFKEVKSWIESADLAIGDYEGTISSEYPLAGYPLFNAPNEIATTMKETGYDVVDLAHNHILDSQLAGAINTVKTFNRLGLDTIGVYLKDRNKEDILIKHVNGIKIAILGYSYGYNGMEANVSKSDYEKHMSDLDTKKIKQDIKKAEKEADITIVMPQMGIEYQKKPTTEQVMLYHSMIKWGADIIFGGHPHVVEPSEVIKKDGQKKFIIYSMGNFISNQRLETVDDIWTERGLLMDVTIEKKGQKTVIKKVKAHPTLVEAKPNGRYVEEGFPAYDYRTLVLEELY

SEQ ID NO: 8617 - DNA, 1119 bp, Streptococcus agalactiae
atgagatatttaactgctggtgagtcacatggacctagtttaacagctattatcgaagggattcctgcgggactgaaattatctgctaaagatattaatgaagatttaaaacgccgccaaggtggttatggtcgtgggaatcgaatgaaaattgaaactgatcaagtgatcattagttctggtgtgcgccatggaaaaaccttgggttcacctattacactgacagtaactaataaggatcatagcaaatggctggacatcatgtcagtcgaagacattgaagagcgcctaaagcaaaaacgtcgtattaagcatcctagacctgggcacgcagatttagtaggtggaattaaataccgtttcgatgatttgagaaatgctttagagcgttcttcggctcgtgagaccacaatgcgagtagctattggtgcgattgctaaacgtatcttgaaagaaattggtatcgaaattgccaaccatattgtagtttttggtggcaaggagattactgtccctgataagctaacagttcaacaaatcaaagtgttatctagtcaatcgcaagtagctatcgtcaatccatccttcgaacaagaaatcaaggattatattgacagtgtgaaaaaggctggagatactatcggaggagtggttgaaactatcgttggaggagttcccgttggtttaggctcttatgtacactgggatagaaagttagatgctaagatagcgcaagcagttgtatctatcaatgcttttaaaggtgttgaatttggtctaggttttaagtcagggtttttaaaaggaagtcaagtaatggactccatatcatggacaaaggaccaaggttatatacgtcagtcaaataatttaggcggttttgaaggcggtatgactaatggagagcctattatcgttaggggagtaatgaaaccaattcctacgctttacaagccactaatgtcagttgatattgatactcacgagccttatagagctacagtggaacgttctgatcccacggcacttccggctgcaggtgtcgttatggaagctgtagtagccaccgtcctggtgacagaagtgctagaaaaattttcttcagacaacatgtataac

SEQ ID NO: 8618 - protein, 373 aa, Streptococcus agalactiae
MRYLTAGESHGPSLTAIIEGIPAGLKLSAKDINEDLKRRQGGYGRGNRMKIETDQVIISSGVRHGKTLGSPITLTVTNKDHSKWLDIMSVEDIEERLKQKRRIKHPRPGHADLVGGIKYRFDDLRNALERSSARETTMRVAIGAIAKRILKEIGIEIANHIVVFGGKEITVPDKLTVQQIKVLSSQSQVAIVNPSFEQEIKDYIDSVKKAGDTIGGVVETIVGGVPVGLGSYVHWDRKLDAKIAQAVVSINAFKGVEFGLGFKSGFLKGSQVMDSISWTKDQGYIRQSNNLGGFEGGMTNGEPIIVRGVMKPIPTLYKPLMSVDIDTHEPYRATVERSDPTALPAAGVVMEAVVATVLVTEVLEKFSSDNMYN

SEQ ID NO: 8619 - DNA, 2142 bp, Streptococcus agalactiae; identical to SEQ ID NO: 1899

SEQ ID NO: 8620 - protein, 714 aa, Streptococcus agalactiae
VKKIKDFASRAINTRLGFILLLVVIYWLKTIWAYHTDFNLGLENSYQLFLTIINPIPLGLLIIGLALYVKRTKAFYITAFITYAIVNILLIANAIYYREFSDFITVSAVLASSKTSAGLGDSALNLLRIWDLVYVFDFIILIFLFATKKIHLDDRPFNKRASFSITALSGLLFSINLFLAEIDRPELLSRGFSNTYIVKALGLPSFSIYSGNQTYQAQKERNGATAQELATAKKYVAEHYAKPNPEYYGIGKGRNVIMIHLESFQQFLIDYKLNIDGKEHVVTPFINSLYHSKETVSFSNFFHQVKAGKTSDAETLMENSLFGLSSGSFMVNYGGENTQFAAPHILAQNGGYSSAVFHGNVGTFWNRNNAYKQWGYDYFFDSSYFSKQTKDNSFQYGLNDKYMFADSIKYLEHMQQPFYTKFITVSNHYPYTSLKGESDEEGFPLAKTNDETINGYFATANYLDTALKSFFEYLKAAGVYDNSIIVMYGDHYGISNTRNPSLAELLGKDPETWSEYDNAMLQRVPYMIHIPGYSKGFISNTYGGEVDNLPTLLHILGIDTSKYTQLGQDLLSKDNKQMVAMRTTGQYITPKYTNYSGHLYYTDSGQEITNPDETTKAEIKAIRDATNKQLSTSDSIQTGDLLRFDENNGLKTVEVEKFNYTHSLKALKAKERKLKDRSTSIYSKHNNKSTVDLFHAPSYLELQDPNKTHKTSKK

SEQ ID NO: 8621 - DNA, 960 bp, Streptococcus agalactiae
atgaaaaagctattaaccactcctgtaatgggttgtactttggttatactttctctaacgtccctatttgttggtgtgaaatctatcccactggagcaaataacacaccttgatcaatcacaggtagatatttttttaacgagtcgcttaccaagaaccattagtatcctaatatctggtgcaagtttgtcagtctgtggcctgctgatgcaacaactaacccaaaacaagttcgtttcaccgacaacttcagggactatggattgggcgaaattaggagtagttgttacgctgattttctttaaaaatacctctatttttattcaactatgtatagcttcaggttttgccattttaggatcgcttctttttgtaaccattttaaaaatgattacttttaaggataatatttttatacctcttatcggactgatgcttggacaaattgtagcagcagcaacagtatttttaggaacacattttcaagtactacaatctgtcaacagttggcttcaaggtaatttttccatcatgactagccatcgctacgaaattctttacttagcattgccatgtttgtttttagtatatttttttgctcatcagtttaccattgttgggcttggagaaagcttcgctaagaatttaggggttgcttatgaaaagatgatttactttggtttagttttggtttcaattatgacatccctagtcattattatcgtaggagctttacctttcttaggtttaatcgtacctaatctaattagcataactaaaggagatcatatgtcctcaactatcttagagacatcgcttttaggggcttgtatcgtcatgatatgtgatctttttggtcgcttagttatttttccttatgaagtctcaataggagttacgctaggagtattaggtagtgcctttttcctgatttcaattataagaaatgagggaaaatca

SEQ ID NO: 8622 - protein, 320 aa, Streptococcus agalactiae
MKKLLTTPVMGCTLVILSLTSLFVGVKSIPLEQITHLDQSQVDIFLTSRLPRTISILISGASLSVCGLLMQQLTQNKFVSPTTSGTMDWAKLGVVVTLIFFKNTSIFIQLCIASGFAILGSLLFVTILKMITFKDNIFIPLIGLMLGQIVAAATVFLGTHFQVLQSVNSWLQGNFSIMTSHRYEILYLALPCLFLVYFFAHQFTIVGLGESFAKNLGVAYEKMIYFGLVLVSIMTSLVIIIVGALPFLGLIVPNLISITKGDHMSSTILETSLLGACIVMICDLFGRLVIFPYEVSIGVTLGVLGSAFFLISIIRNEGKS

SEQ ID NO: 8623 - DNA, 1482 bp, Streptococcus agalactiae
atggtaacatttttaggaggggtagcccttttaattgttggttatttcacgtacggtagatacattgaaaagaattttcaaattgatgaaaatcgccaaacacctgcagaagcattaagggatggatatgattttgttcctatgccaaaatggaagaatgggatgattgagttattgaacatcgcaggaaccggacctatctttggccctattttaggagcactctatggtccagttgcttatatctggatagtcttaggatgtatttttgcaggggctgttcatgattatatgattggaatgatttctcttagaaataatggtgcatatcttcctgaattagctagtcgctatcttggaaagtcaatgaagcatgtgatcaacattttttcaatgctattacttattttagttgcaaccgtatttgtggtaactccagctaatcttatcctaagtattttaccagctgggacactatctttaccttggataatcggtcttattttcgtttattaccttatttctacagtcttacctattgataaagcacttggtaaagtttatcctgtattctgcgtcatcttaatggttagtacggcagcagttggcttccgtttattaactggtggctttgatatgccaaacttaacttttgaaacctttaaaaatatgcatccagctgggcttgggatattccctgctttattctttaccatttcatgtggagccatctctggtttccatgctacccaagcacctatggtctcaagaacaactgttaatgagagagaagggcgtttcactttctacggcatgatgattgcagaaggagtaattgcgatgatttgggcaggtgcttcaatgagcttgttcaaaggtcaaaatctctatgaaatgattgctgctgggacaccttctgcagttgtcaatcaagtaatgttaatgttactcggtagtgtaattggaactatcgctatcattggtgttattgttctccctgtttcatctggtttatcagctttccgtagcttacgtactatcgttgctgattatatccatgtcaaacaagatactcttccaaaaatctttgctgtaactatcccattatatgttatttcatttgtccttacacacgttgattttaatctcctatggcgttactttaactgggcaaatcaagtaactgctgttattggtttattagttgctacaagatatctcatcctaaaaagacgaaattattgggtaacatttgtaccagctatgttcatgttgtatgcagtagttgtttatattttatctcaaccaattggatttaatatgggcttaggcatcttaacttattcacttgctttagtgttaacaggtattcwtgttggacttttctggaaatctggtcaaaaacaattaaaaactgttcatcctgaagcattcctgtttaacgatcatagaccaattaattattacagtagtttagattct

SEQ ID NO: 8624 - protein, 494 aa, Streptococcus agalactiae
  MISC_FEATURE (1)..(494): Xaa = Any Amino Acid
MVTFLGGVALLIVGYFTYGRYIEKNFQIDENRQTPAEALRDGYDFVPMPKWKNGMIELLNIAGTGPIFGPILGALYGPVAYIWIVLGCIFAGAVHDYMIGMISLRNNGAYLPELASRYLGKSMKHVINIFSMLLLILVATVFVVTPANLILSILPAGTLSLPWIIGLIFVYYLISTVLPIDKALGKVYPVFCVILMVSTAAVGFRLLTGGFDMPNLTFETFKNMHPAGLGIFPALFFTISCGAISGFHATQAPMVSRTTVNEREGRFTFYGMMIAEGVIAMIWAGASMSLFKGQNLYEMIAAGTPSAVVNQVMLMLLGSVIGTIAIIGVIVLPVSSGLSAFRSLRTIVADYIHVKQDTLPKIFAVTIPLYVISFVLTHVDFNLLWRYFNWANQVTAVIGLLVATRYLILKRRNYWVTFVPAMFMLYAVVVYILSQPIGFNMGLGILTYSLALVLTGIXVGLFWKSGQKQLKTVHPEAFLFNDHRPINYYSSLDS

SEQ ID NO: 8625 - DNA, 681 bp, Streptococcus agalactiae; identical to SEQ ID NO: 1967

SEQ ID NO: 8626 - protein, 227 aa, Streptococcus agalactiae
LKQSNHRYHGPLIEFEIEYSYIKIFPWIGLFISCIGLYASNFGDPLGFIKFIFSVCIFVNLVSIIISLFFKKISNFLKKISYILLSLVFLTLIIGFDFIGLAMFLNNRNFGHVQSIYYTEMAKMYIMIMLIIFIVFSGIYYFYYLPKNQGKKWKFNQWKLQKGKKEQLKINYGIIFGLVMLSPVFLVGSIENIFGLIGGVLFTATFPALIVDSLYAAYYIHKHPEYE

SEQ ID NO: 8627 - DNA, 426 bp, Streptococcus agalactiae; identical to SEQ ID NO: 1989

SEQ ID NO: 8628 - protein, 142 aa, Streptococcus agalactiae
LKKDKYIALCLLCAIATSNLSAVTVFAQDAQTILTQATTVTDQTIEKAGENSSAEATSASESVSSEATTVVPEASLPSTDLHAQPADSKTAPTETVIEGQTETNPTTSPDKQFLQQVIPKEKHRLGRKQIQANPKLQLLVSL

SEQ ID NO: 8629 - DNA, 1716 bp, Streptococcus agalactiae
atgggcatctcagacttacctcaaccgtggctaccgcctctaagcaatcagattgcagtaaccgatctccgtaaggagggatcagtagacctctggagcaaggccccatcttacaaagctgttcttggctttatggatataccaagccaacaagcacaagaagtggcttaccacgattttgaagacgatgggcatttgtcaatttttgcaggaccaagtatggggaaatccacagcccttcaaactgtaacaatggacttagcacgtcataatagtccagaatttttaaacctttacctctttgattttggtaccaatggcctcttacctctaagacgtttgccacatgtagcagatttctttaccattgatgatgacgaaaaaatagccaagtttattgcccgtatcaaagttgaaatgtctgatcgtaaaaaagccctcagtcgctacaatgtcgcgacagcaaaactttaccgtcaggtatctggggaaaccatgcctcaaatcctgattgttattgacagttatgaagggctacgggaagctcaaacaccgactaacttagaagcttgtttccaaaatatttcgcgtgatgggtcgtcacttggcatttccttagttatctcagctggtcgtacggcagctttgaggtcgtccttaatggcaaaccttaaagaacgtatcgctcttaaattaacagatgactctgaatcacggacacttgtcggtcgtcaccaacacatcatggaagatattccaggacgtggattaatcaaacgtgatgacattgaagtgttacaagtggctctctcaacagaaggcactgaaacctttgacatcatcaataacatccaaaacgaatctgacgccatgaacagcaaatggactggaccaagaccaaaagcaataccaattgttcccgaagaattaacctttgacgactttatggctacagatagtgttcaagctgacctatcagctaatcgtttaccacttgggcttgaaatggttgacgttgaaagttatagtttagcacttaatcgctttaagcatatgctttacatgtctgattctgacgagtcactcgaagcagttggttcccatatcatcaaggtcttgcttaacgtcccaaattaccataacatgatcatcgattcgcttggcgaatatgaaagctatcaaggtcaggtacgtacttatgtgggttctgatatgattgaagatatggcggatcagttgatctatgagttgcagcaacgtgaaagccaatctgagatagctgaatggtttatcatgattccagattttgaaagctttgtggctaagagcaatatgaagcttgaacaggttcaggcattgcttgacaatggaccacgctatggtttacatctgattcttggatcaagctataactatgttgggactaagatcgatgctgtgcctaaatacgttcgcacaacgacccagtatgtgctggctggcatgaggctcatggatcaaaccttccttgaaaaagtgtataatagtaaggaaatccgtccaaacaaagacgaagcctacattcacgatagaaaaacctatcaaaaattaaaactcaccatagactaagaaaggagaccaaatggcaaaaatacaaagtgatgcctccgtcgcatccacctgtgcaactgcaatacaatcaggagccagtggaatcacagcagtaggagctccaac

SEQ ID NO: 8630 - protein, 535 aa, Streptococcus agalactiae
MGISDLPQPWLPPLSNQIAVTDLRKEGSVDLWSKAPSYKAVLGFMDIPSQQAQEVAYHDFEDDGHLSIFAGPSMGKSTALQTVTMDLARHNSPEFLNLYLFDFGTNGLLPLRRLPHVADFFTIDDDEKIAKFIARIKVEMSDRKKALSRYNVATAKLYRQVSGETMPQILIVIDSYEGLREAQTPTNLEACFQNISRDGSSLGISLVISAGRTAALRSSLMANLKERIALKLTDDSESRTLVGRHQHIMEDIPGRGLIKRDDIEVLQVALSTEGTETFDIINNIQNESDAMNSKWTGPRPKAIPIVPEELTFDDFMATDSVQADLSANRLPLGLEMVDVESYSLALNRFKHMLYMSDSDESLEAVGSHIIKVLLNVPNYHNMIIDSLGEYESYQGQVRTYVGSDMIEDMADQLIYELQQRESQSEIAEWFIMIPDFESFVAKSNMKLEQVQALLDNGPRYGLHLILGSSYNYVGTKIDAVPKYVRTTTQYVLAGMRLMDQTFLEKVYNSKEIRPNKDEAYIHDRKTYQKLKLTID

SEQ ID NO: 8631 - DNA, 471 bp, Streptococcus agalactiae
atgaagttgaaacgatttttagcctgtctactaatattatcctgtatgagtcaaacatcagtattttctgatgggttaaagaataatgatattcattttgatacaaaacgtttagaatcagattcacaaaaaaattctggttttcaaactgaattaactaaagatttatttaaaaaagaagaccttaaaaaattggataaaaaccgtcaatctaaagtctcactccagaaaaagcagtctaagcaactgtttcaatattcaaataaaggacaatctgataggaaaaaacgtatcaaacaattattttctgaagaaagtaatcaatttaaatttgttacaagaacagaagaaccgactgtttcggctgatattggtcatataattatatacctggttctcattagtttggtactaatattagcttctataatgacttttaaaataaaggacaaaaaggatgaatacacatat

SEQ ID NO: 8632 - protein, 157 aa, Streptococcus agalactiae
MKLKRFLACLLILSCMSQTSVFSDGLKNNDIHFDTKRLESDSQKNSGFQTELTKDLFKKEDLKKLDKNRQSKVSLQKKQSKQLFQYSNKGQSDRKKRIKQLFSEESNQFKFVTRTEEPTVSADIGHIIIYLVLISLVLILASIMTFKIKDKKDEYTY

SEQ ID NO: 8633 - DNA, 3009 bp, Streptococcus agalactiae
atgaaaagaaataactttagaatactttggtatattatagctgttgctctctttttagtagctattgctggccttaatcttaagcttcaaggcgatcatgcaaaagagaataaaacaacacagtcagctactaacactaaactaaatatagcattagtcaacgaagatcaaaatgtatctaatggtaaagaaagttataatttaggagctagttatattaagtctatcgaacgtgataatagtcaaaattggtcagttgttagtcgaggtactgctcaaaatggattagacaaaggtgattatcaattaatggttatcatccctaataacttttctcaaaaacttcttgatgtcaataaagcaaatgcagagcaaacaactatctcttataaggttaatgccaaggggaatttagcattagagaaaaaggcaactgaaaaagagaaagatattgtttcagagttaaatagccacttagtaaatatgtacatggcaagtattttaagtaacttatatacagctcaagaaaatgtacaggccatggtaaatgttcagtcaggtaatatctcaaattaccaaaaaaatcttttagattctgcaactaatttccaaaatatctttccagccctcgttaaccagtctagtagttccattactgctaacgaatcactgaaaaaatctttagaagcttctgataacatgtttaatgatttggtgacaacccagacaaatactggaaaagatttatcaagcttaatagaacagcgccatcaagatagcatttcgtatgaagcgttttcgacctcattactagaaatgaataacgagttattagagaagcaattatctgatattatcacacaagcacaaaaagaccaagaaacattatcatcacaactcaatagtattatgggtgatgataacaatcataatcataaagaaaactcatcagcttatctaaatgttgcaaggcaaaaaatccaagaactatctgaagcactcaagtcacaagataacattgctaaagatcaaagtgaacaactagataaaattgttagagagggactagcaagttactttgctaagaataataaagataatattactttattagaattattgaagagtcattctactaatgagaagactttgaaagattttaaagctaaggtagcagatttcacaaattctctcatttcaagcattccttcactaaacctttcggagttgcacttaacccaagaagaagaaaaagccattcagtttacatcttctgattcggaaatcattaaaaaagtaagcaacgaaagaactctgtatttaaatactaatttattgaatcgtctttttgaagctaggaaaaatagagatgaagctaaaaataaagttaatcaattaaaattgtcatctagttctactcgaactggtgagcagatagtttctgttgaatcaaataatccagattacagggtagatacctggacggttaatggtaagcaaacaagaaccttggaccccagccaaaacaataatattattatcaatagcagttatcaaagggaatcatctaactctagtattacgaaaccaagctatacaatcactatcgggaatcagaaacaaattgtacaaaatgatgacggtaaaatccaacggtcttactttgaggcagaggcaacgtatcaacgaactctacaagaagtaaatgatgcatataacaccactcacggattagtagctaaatactacattatttctgatggcgaagaaccgcaaaatttatttgatcaatttttaaatcaaagtgttaacgatacgatggttgatctggtcaaaaatggtataactaagtatttgatggatgaaaacactgctgatgcgcaacagaaagttaaagatgtcatggaggaagttgaaaatagtcaagatgaattggcggatcaaatggcaaaagtaactgagacaaatgtacgactaacagatgcaatcaaaaaacagcttgaaacccttcaatcaattaacatgaaggtccaaaacatcacacaggatcaatctaaagtaaacgactcacagaaaacaactgatcaacaattatctgatttgaagaaccagctagatgggctaatgacctctgcagcgggcgtaaaagatatgtccaaatctaatagtcaagaggcggaccaagttaatcaaatattcacatcattcaataaagatgttcaagatgctaaaaattcgggcaacaaactttcgacggatgcaaccgatttaatggctaacttccaaaaagaattggccaataatggtgatttcgtagcttctttctctaaagtttttaatactgcttataaaaatggagtgccaaatgatattctccttaatttcttatcacgacctgtcgctgaatcagcgtctgcagttagggcaactgaaaatacttatcgcccattcacttggatactattattagaagttgttagcctatttacagcatatatctttgcgactcaaaaccttattaagaaattgacagataggtataatgtcaaccgctggcttcaaacagactttttaaatgtcattgtcatttcaggcctctctcttgttattggtttagcactgggagttatctcaagcagaagtcttcatgtcatgcctgaatatgtaccatcttggttcctagttatgactctgtttagttttttattaattcatagtcagtatttctttattaaaaattttaaagcagttggtatgggtttagctttgtttatgattattagttttgtgtatctatcaaatgccgtaggcacagtagcgactgttagtggacttccaaaattactaaaagctattaatccactatctatccttgaaaatcaattatcatcttattttgataatgtgacaactggatttattttccttatcttagtacttcttgtggatgttgcttttattatcatgaatatttttatcaccttaaattttgaagctaaagtaaaagag

SEQ ID NO: 8634 - protein, 1003 aa, Streptococcus agalactiae
MKRNNFRILWYIIAVALFLVAIAGLNLKLQGDHAKENKTTQSATNTKLNIALVNEDQNVSNGKESYNLGASYIKSIERDNSQNWSVVSRGTAQNGLDKGDYQLMVIIPNNFSQKLLDVNKANAEQTTISYKVNAKGNLALEKKATEKEKDIVSELNSHLVNMYMASILSNLYTAQENVQAMVNVQSGNISNYQKNLLDSATNFQNIFPALVNQSSSSITANESLKKSLEASDNMFNDLVTTQTNTGKDLSSLIEQRHQDSISYEAFSTSLLEMNNELLEKQLSDIITQAQKDQETLSSQLNSIMGDDNNHNHKENSSAYLNVARQKIQELSEALKSQDNIAKDQSEQLDKIVREGLASYFAKNNKDNITLLELLKSHSTNEKTLKDFKAKVADFTNSLISSIPSLNLSELHLTQEEEKAIQFTSSDSEIIKKVSNERTLYLNTNLLNRLFEARKNRDEAKNKVNQLKLSSSSTRTGEQIVSVESNNPDYRVDTWTVNGKQTRTLDPSQNNNIIINSSYQRESSNSSITKPSYTITIGNQKQIVQNDDGKIQRSYFEAEATYQRTLQEVNDAYNTTHGLVAKYYIISDGEEPQNLFDQFLNQSVNDTMVDLVKNGITKYLMDENTADAQQKVKDVMEEVENSQDELADQMAKVTETNVRLTDAIKKQLETLQSINMKVQNITQDQSKVNDSQKTTDQQLSDLKNQLDGLMTSAAGVKDMSKSNSQEADQVNQIFTSFNKDVQDAKNSGNKLSTDATDLMANFQKELANNGDFVASFSKVFNTAYKNGVPNDILLNFLSRPVAESASAVRATENTYRPFTWILLLEVVSLFTAYIFATQNLIKKLTDRYNVNRWLQTDFLNVIVISGLSLVIGLALGVISSRSLHVMPEYVPSWFLVMTLFSFLLIHSQYFFIKNFKAVGMGLALFMIISFVYLSNAVGTVATVSGLPKLLKAINPLSILENQLSSYFDNVTTGFIFLILVLLVDVAFIIMNIFITLNFEAKVKE

SEQ ID NO: 8635 - DNA, 915 bp, Streptococcus agalactiae
atgaaaaatcaagaattagctaaaaaattaacatctccttcaaaaaactctcgattagaaaaatttggtaaaggaataacttttctttcgcttgccctaatcgtcttcattgttgcgatgattttgatttttgttgctcaaaaaggactatctacattttttgttgatggcgttaaattaacagacttcttatttaatacaaaatgggaaccaagtgctaagtcatttggtgcttttccaatgatagctggatcatttattgttactattctatcagctatcattgctacaccatttgctatcggtgctgccgtatttatgactgaaatctcacctaaatatggttctaaaattttacaacctgcagttgaattactagttgggattccttctgttgtttacggttttattggtttacagattattgttcccttcgttcgctctatttttgggggaacaggttttggcattttatctggggtctgtgtcctcttcgtcatgattctaccaactgttactttcatgacagtagatagccttagagctgtgccacgtcactataaagaagcaagtttagccatgggggcaactcgttggcaaacaatttggcgtgttatattaaacgctgcacgtccaggaattttcactgcaattgtttttggtatggcacgtgcatttggtgaagctctagcaattcagatggttgtcggaaactctgcaattttaccaacgtcattgacaacaccagcagcaacattaacgtctgttctaacaatgggtattggtaatactgtaatgggaactgtacaaaacaatgtcctctggtcgctagccttagtacttttaattatgagtttagcatttaatacagttattaagttaattacaagggaaggaaagaaaaactatgaacgc

SEQ ID NO: 8636 - protein, 305 aa, Streptococcus agalactiae
MKNQELAKKLTSPSKNSRLEKFGKGITFLSLALIVFIVAMILIFVAQKGLSTFFVDGVKLTDFLFNTKWEPSAKSFGAFPMIAGSFIVTILSAIIATPFAIGAAVFMTEISPKYGSKILQPAVELLVGIPSVVYGFIGLQIIVPFVRSIFGGTGFGILSGVCVLFVMILPTVTFMTVDSLRAVPRHYKEASLAMGATRWQTIWRVILNAARPGIFTAIVFGMARAFGEALAIQMVVGNSAILPTSLTTPAATLTSVLTMGIGNTVMGTVQNNVLWSLALVLLIMSLAFNTVIKLITREGKKNYER

SEQ ID NO: 8637 - DNA, 720 bp, Streptococcus agalactiae; identical to SEQ ID NO: 2091

SEQ ID NO: 8638 - protein, 240 aa, Streptococcus agalactiae
LSAIIDKKVVIFMYLALIGDIINSKQILERETFQQSFQQLMTELSDVYGEELISPFTITAGDEFQALLKPSKKVFQIIDHIQLALKPVNVRFGLGTGNIITSINSNESIGADGPAYWHARSAINHIHDKNDYGTVQVAICLDDEDQNLELTLNSLISAGDFIKSKWTTNHFQMLEHLILQDNYQEQFQHQKLAQLENIEPSALTKRLKASGLKIYLRTRTQAADLLVKSCTQTKGGSYDF

SEQ ID NO: 8639 - DNA, 1962 bp, Streptococcus agalactiae; identical to SEQ ID NO: 2113

SEQ ID NO: 8640 - protein, 654 aa, Streptococcus agalactiae
VNNMFYLKIAWHNLKHSIDQYIPFLLASLLLYSLTCSTLLILMSAVGRDMGTAATVLFLGVIVLSIFAVVMEHYSYNILMKQRSSEFGLYNILGMNKRQVARVASLELFIIYIFLISIGSLFSAFFAKFIYLIFVNIINYHALNLSLSLWPFIICIVIFTGIFLTLEVPVIRHVHLSSPLSLFRKKQQGEKEPKGNLILAILALVAIAIAYTMALTSGKAPALAVIYRFFFAVLLVIAGTYLFYISFMTWYLKRLRQNKHYYYKSEHFVSTSQMIFRMKQNAVGLASITLLAVMALVTIATTVSLYSNTQNVVTGLFPKSVSLSIDNSKGDAKNIFEEKILKKLGKSSKEAITYNQTMISMPVSQSSELNITSKNVKHVDITKTGFMYLITQNDFRRLGHQLPKLKDNQVAYFVQKGDSRLKKINLLGNKFDVVKNLKEAYVPETTNTYNPGLIIFANNKQIDNIRKAYLPYTKNINTFPKTFKAYLDLNSQEINSISKNDIIEVDGKYVGNISTKQSFLKEGYQMFGGLLFTGFLLGISFLLGIALIVYYKQYSEGHEDKRSYRILQEVGMSKKLVKRTINSQIMIFFFQPLVVAVIHFGVAIPMLKQMLLVFGVLNSTIVYVVSGLTVLAISIIYFIIYRITSRTYYHIIER

SEQ ID NO: 8641 - DNA, 963 bp, Streptococcus agalactiae
atgcggcgaaaaatagttttactttttgtagttccaatgcttatagttttaggaattttaggagtggtagttcattattatggttcagcattaaatatttatctattacctcctagtagcgaacgttatggacgtgttattttagatcgtgttgaacagcgtggtttgtattcgcaaggtcgtcaatggcaaattataagacaacgatcagaaaaaaagttgaaaacgtcaaaatcttaccaagagagtcgcaacattgtacaggaagcagtacggtatggaggcggtaaacatagtcaaatattatccaaagagactgtacgaagagataccctagatagtcgatatccagaatatcgaagattaaacgaagacattctcttaattactattccttctataagtaagttagataaacgatctattagccattatagtggtaaattacaaaatatattgatggaaaaaagttataagggactcattttagacttatcgaataatactggcggcaatatgatccctatgattgggggggtagcctctattttaccaaatgataccctatttcattatactgataagtatggaaataagaaaacaatcacgatgaaaaatataccgctagaagcattaaaaatatctaggaaaacaatcaatactaagcatgttccaatcgctattataactaatcataaaactgctagttcggcagaaatgacttttttatcatttaaaggattacctaatgttaaaagctttggtcaagctacagcaggatatacgactgttaatgaaactttcatgctttacgacggtgctagattagctttaactacaggaatagttagtgatcgacaaggatataaatacgagaacacccctatcttaccagatcaagtaaccagccttcctttacaagagtcacagtcttggttaaagagtagaatcaatcaaaattag

SEQ ID NO: 8642 - protein, 320 aa, Streptococcus agalactiae; identical to SEQ ID NO: 2122

SEQ ID NO: 8643 - DNA, 867 bp, Streptococcus agalactiae
atggaaatgcaagttcaaaaaagttttaaatcaaatatacattacggaacactctatctagtcccaactccaattggtaatctagatgatatgacttttcgtgccattaggattttaagagaagttgattttatttgtgcagaggatacacgaaatacgggacttttactcaagcactttgatattactactaaacaaattagttttcacgaacacaatgcttacgataaaatctctgggttaattgatttgttaaaagaagggaaatctttagcccaagtatctgatgcaggaatgccctctatttctgacccaggacatgaccttgtcaaggctgctattgaaggggatatcccagttgtatctataccaggagctagcgctggtattactgctctcatcgcttcaggtttagctccacaacctcatattttttatggcttcttacctcgtaagaaaggtcaacaaataactttctttgaaacaaagcaagattaccctgaaacacaaatcttttatgagtcaccgtttcgagtctctgatacgctaaaacacatgaaagagatttacggagatcgccaagttgttttagtacgcgaattgacgaaactctatgaagagtatcaaagaggaaccattagtcaacttttagagcatattgaaaaggtccctctcaaaggtgaatgcttaattattgttgatggtaagagagataccgagcgagtgaaagacagtagccaacaagatccactagtattagtaaaagaatatatcgctaatggtgataaaactaatcaagcgataaaaaaagtagcaaaagaatttaatctcaatagacaagaactctatgctagtttccatgattta

SEQ ID NO: 8644 - protein, 289 aa, Streptococcus agalactiae
MEMQVQKSFKSNIHYGTLYLVPTPIGNLDDMTFRAIRILREVDFICAEDTRNTGLLLKHFDITTKQISFHEHNAYDKISGLIDLLKEGKSLAQVSDAGMPSISDPGHDLVKAAIEGDIPVVSIPGASAGITALIASGLAPQPHIFYGFLPRKKGQQITFFETKQDYPETQIFYESPFRVSDTLKHMKEIYGDRQVVLVRELTKLYEEYQRGTISQLLEHIEKVPLKGECLIIVDGKRDTERVKDSSQQDPLVLVKEYIANGDKTNQAIKKVAKEFNLNRQELYASFHDL

SEQ ID NO: 8645 - DNA, 840 bp, Streptococcus agalactiae
atgaaaaaattacttagatggcttcctcctgtacttttcattattatccttataggaatgactatcttaggtaagtcctatatcaataaagtaacagctcacaaaataaaactctataactctcgaatgactcctactattttaattccaggatccagtgctactcaagaacgatttaacagcatgttagcacagctcaaccaaatgggagaaaaacatagcgttttaaagttaactgtcaaaaaagacaatagcattatctacaatggacaaattagcggcaatgaccacaaaccctacattgtcattggatttgaaaataatgaagatggttatagtaacatcaaaaaacaaacaaaatggctacagattgctatgaatgatcttcagaagaaatataaatttaaacgttttaacgctatcggtcattcaaatggtggcttatcatggactattttcctagaagattattacgactctgatgaatttgatatgaaatcattgttaacaatgggaacaccttttaactttgaagaaagtaacacctcaaatcatactcaaatgcttaaagatttaatcagtaataaaggaaatattccatcaagtctcatggtatacaatttggcaggaactaattcatatgatggtgataaaattgttccatttgctagtgtggagactggtaaatatattttccaagaaaccgctaaacactatacccaactaacagtaactggtaataatgctacacattctgacttgcctgataatcctgaagttatccaatatgtcgcagaaaaaattcttaaaaatgagaaaggtaaattaccaaaacctcac

SEQ ID NO: 8646 - protein, 280 aa, Streptococcus agalactiae
MKKLLRWLPPVLFIIILIGMTILGKSYINKVTAHKIKLYNSRMTPTILIPGSSATQERFNSMLAQLNQMGEKHSVLKLTVKKDNSIIYNGQISGNDHKPYIVIGFENNEDGYSNIKKQTKWLQIAMNDLQKKYKFKRFNAIGHSNGGLSWTIFLEDYYDSDEFDMKSLLTMGTPFNFEESNTSNHTQMLKDLISNKGNIPSSLMVYNLAGTNSYDGDKIVPFASVETGKYIFQETAKHYTQLTVTGNNATHSDLPDNPEVIQYVAEKILKNEKGKLPKPH

SEQ ID NO: 8647 - DNA, 693 bp, Streptococcus agalactiae
atgtctaaaaagtctcaccgtcaatatcaaatatatgaagggctcaggtgtgcggttgcactctgttttatttcaggttatatcaatgcttttacttatgtaacacaaggaaaacgttttgcaggtgtacaaacagggaatttgttatcttttgctattcatcttagtaataagcattatagtcaagcgcttgcttttttgctacctataatggttttcatgttaggtcaatcgtttacttatttcatgaatcgttgggcgaataaacatcaactgcactggtacctattatctagttttgcgttgacacaggttgctatagtaacaattatattgactcctttcttaccatcgtcgtttactgtggcaggactagccttctttgcttcaatacaagtagatacctttaaatcgctcagaggagcaccttatgctaatatgatgatgactggtaatatcaagaatgctgcttatttattaacaaagggactttacgaaaaaaattctgatattttcttaattgctagaaatacgattattattattggaggatttatctttggtgttgtttgctcgacttatttttcaagtaaactgggcgaatggagcttatcattaatattaattcctcttttatatgtcaacttgctgttaggccatgaattttataacctacaagtagaaaggcactcc

SEQ ID NO: 8648 - protein, 231 aa, Streptococcus agalactiae
MSKKSHRQYQIYEGLRCAVALCFISGYINAFTYVTQGKRFAGVQTGNLLSFAIHLSNKHYSQALAFLLPIMVFMLGQSFTYFMNRWANKHQLHWYLLSSFALTQVAIVTIILTPFLPSSFTVAGLAFFASIQVDTFKSLRGAPYANMMMTGNIKNAAYLLTKGLYEKNSDIFLIARNTIIIIGGFIFGVVCSTYFSSKLGEWSLSLILIPLLYVNLLLGHEFYNLQVERHS

SEQ ID NO: 8649 - DNA, 1335 bp, Streptococcus agalactiae
atggtaaaaaaaggctttttaacgggattactcttatttggtatcttctttggtgcagggaacctcatttttccaccagcattaggtgtagcatctggacaagatttctggccagcgattttaggattttgtttgtcaggagttggattagctattattaccctcctactaggcacactaactaatggtggttataagacagagatgtcggaaaaatttagtccgtggttttctttaacatttttagttatactctacctaactattggtccactttttgctattcctagaacagcaacggtttcttttgaaattggggttgctccaattgtagggcatagtccgattgctcttttgtgttttacagcctgtttttttgctgcagcttattatctcgctattagaccaaatggtatattagatagtgttggaaaaatcttaacgcctgtttttgcctttttaattctctctttggttgttgttggagctattgcttatggaaacttggagagtgctaaggcgagtgctgactatgcaggaaaagcgtttggaagtggtgtcttagcaggctataatacacttgatgcacttgcagcagttgctttttgtctagtagcaacagaaacgcttaaaaagtttggttttaaaactaaaaaagaatatttatcaaccatttggattgttggaattgttactagtttagcatttagtattttatatattggcttaggttttttagggaataagtttcctgtcccagctgatattttagctgacccaaatgttaataaaggagcttatgtattatcacaagcatcttataaattatttggaaattttggtcgttatttcttgagtattatggtaacattgacatgctttacaacaacagttgggcttattgtgtcagtatctgaattttttgataagaactttcgttttgggaattataaattatttgctactgtttttactttgattggctttttaattgctaatcttggtttaaatgctgtaattactttttcagttcctgtgctaactttattgtatccgattgttattgttattgtcttaattattttgattaataagtggttgccgctttcaaaaaagggaatgtctttgacaattggtcttgtcactttagtgtcgtttgttgaggttctagcgggacaatggcaagaaaaaacattaactcagttagttggattcctcccctttcatactatttcaatggggtggctagttccaatgttgattggtatagtattttctttggtgctgtcagataaacaaaaaggccaagcatttgatttagagaaatttgaagga

SEQ ID NO: 8650 - protein, 445 aa, Streptococcus agalactiae
MVKKGFLTGLLLFGIFFGAGNLIFPPALGVASGQDFWPAILGFCLSGVGLAIITLLLGTLTNGGYKTEMSEKFSPWFSLTFLVILYLTIGPLFAIPRTATVSFEIGVAPIVGHSPIALLCFTACFFAAAYYLAIRPNGILDSVGKILTPVFAFLILSLVVVGAIAYGNLESAKASADYAGKAFGSGVLAGYNTLDALAAVAFCLVATETLKKFGFKTKKEYLSTIWIVGIVTSLAFSILYIGLGFLGNKFPVPADILADPNVNKGAYVLSQASYKLFGNFGRYFLSIMVTLTCFTTTVGLIVSVSEFFDKNFRFGNYKLFATVFTLIGFLIANLGLNAVITFSVPVLTLLYPIVIVIVLIILINKWLPLSKKGMSLTIGLVTLVSFVEVLAGQWQEKTLTQLVGFLPFHTISMGWLVPMLIGIVFSLVLSDKQKGQAFDLEKFEG

SEQ ID NO: 8651 - DNA, 1431 bp, Streptococcus agalactiae
atgagagggaaggttatttacggcacaacccttataggtctttttctattcttatttttctatttttggattcctaagcatcacatcgagagaatacatcatcatcgtataaagcaggtagatgcgaagagtgatttaacaggatttaaaacccatttgcccattatcagcattgatacaaagcaacaagttattcctcttgttacaaaagaaggcggaaaatatgtcaaagctagggataatattaatgttgatatcgaattacgggattctccaagtagatcacatcatttatcagaaaagccgagaattaggacaaaagggttaatatcatatagaggaaatacctctcgttactttgataagaagtcattgaaagttaagtttgttactaataagttaaaggaaaagaagcatcgattagcaggaatgcctaaagaatcggagtgggtattgcatggtccctttctagacagaacattattaagaaattatctgagttataatattgctggtgagattatgtcctatgccccaaacgttcgctactgtgagttatttgtcaatggtgagtatcagggagtatatctagcagttgagaatatcgaacaaggtgagcaacgagttcccattgaaaaaagtgataaaaagttgcataaaacaccttatatcgttgcttgggatcgtgaacataaggcaaagcaaaagttagataactatgtacattatacacaccagtctggtatctcagctcttgatgtgaaatatccaggtaaacaaagattgacatcaaaacaattagagtttattaataaggacatcaatcatattgaaaaagtcctttattcttatgatttttcacaatatcctaaatatattgatagagaatcatttgcaaattattttgtcatcaatgaattttttagaaatgtggatgcgggtaaattttcaacctatctatataaagatcttcgtgatagagcaaaactagtagtttgggattttaataatgcttttgataatcaaattgaaggacgtgttgatgaggcagattttaccttgacggatgcaccgtggttcaatatgctcattaaggacaaagcatttatagacctggttgttcatcgctataaagaattacgaaagggagttctagcgacagaatatttatctaattacatagacgagacaaggcattttttaggtccagctattgatcgaaattataaaaaatggggctatgtctttgatttaaagaatactgatccaaggaattatttgattcctactgaacgcaatgtgacaagttatcacaaatcagtagaacaattaaaagattttatcaaaaagcgtggcagatggatggatagaaatattgagaccttgtatcaatatagtgcaccatcgaaaaatactaatactttactggag

SEQ ID NO: 8652 - protein, 477 aa, Streptococcus agalactiae
MRGKVIYGTTLIGLFLFLFFYFWIPKHHIERIHHHRIKQVDAKSDLTGFKTHLPIISIDTKQQVIPLVTKEGGKYVKARDNINVDIELRDSPSRSHHLSEKPRIRTKGLISYRGNTSRYFDKKSLKVKFVTNKLKEKKHRLAGMPKESEWVLHGPFLDRTLLRNYLSYNIAGEIMSYAPNVRYCELFVNGEYQGVYLAVENIEQGEQRVPIEKSDKKLHKTPYIVAWDREHKAKQKLDNYVHYTHQSGISALDVKYPGKQRLTSKQLEFINKDINHIEKVLYSYDFSQYPKYIDRESFANYFVINEFFRNVDAGKFSTYLYKDLRDRAKLVVWDFNNAFDNQIEGRVDEADFTLTDAPWFNMLIKDKAFIDLVVHRYKELRKGVLATEYLSNYIDETRHFLGPAIDRNYKKWGYVFDLKNTDPRNYLIPTERNVTSYHKSVEQLKDFIKKRGRWMDRNIETLYQYSAPSKNTNTLLE

SEQ ID NO: 8653 - DNA, 876 bp, Streptococcus agalactiae
atgaaaaaatatctaagtattgtagcccttttaactattttgtttagctctatttattatttgtattactttgatggtagtttgtatttaccaaagggcttattaaaagaaaatacaagaactaactttgttgttaaaggtgatactgtacttcacaagcccaccaataaaccttttgttgttaaaggagtagacgttgagtcttccttagcgggttatcatcacaacgattttcctattactcaaaaaacgtatcgtgaatggttccatttaatttccaacatgggggcaaatactgtaagagtcaaggtaccgatgaatgttgcattttacgatgccttatatcaccacaacaaagcatcaaagaggccactgtatttgttgcaaggaatacgtatagattcttatcgcaataatgcttctataacagcttttaatgataattatagggggtatttaaaacgagaagcaaaaggcgttgtggatattctccatgggcgtaagcaagtatggaatactgatttgggtagccgtcattatcattatgatcttagtccttgggtacttggttatgtcgtaggggatgattgraatagtggtactgtcgcttatactaatcatcaagagaaaaaaacgcaatataaagracgttattttaaaacttctgtggcagctaatccatttgaggtcatgctagctcaagtaatggatgaattgacacattatgagacagctaaatatggttggcaacatttgattagtttttcaaactcaccaacaacagacccttttcattatcgaaaaccatttgaggcacaggctcctaaatacgtacaactaaatgtagaaaatattcaagctaattcaaatggttaa

SEQ ID NO: 8654 - protein, 291 aa, Streptococcus agalactiae
  MISC_FEATURE (1)..(291): Xaa = Any Amino Acid
MKKYLSIVALLTILFSSIYYLYYFDGSLYLPKGLLKENTRTNFVVKGDTVLHKPTNKPFVVKGVDVESSLAGYHHNDFPITQKTYREWFHLISNMGANTVRVKVPMNVAFYDALYHHNKASKRPLYLLQGIRIDSYRNNASITAFNDNYRGYLKREAKGVVDILHGRKQVWNTDLGSRHYHYDLSPWVLGYVVGDDXNSGTVAYTNHQEKKTQYKXRYFKTSVAANPFEVMLAQVMDELTHYETAKYGWQHLISFSNSPTTDPFHYRKPFEAQAPKYVQLNVENIQANSNG

SEQ ID NO: 8655 - DNA, 1266 bp, Streptococcus agalactiae; identical to SEQ ID NO: 2245

SEQ ID NO: 8656 - protein, 422 aa, Streptococcus agalactiae
LYHILFRRKSIVPAYNESTTIVSSIDSLLHLDYEAYEIIVVDDGSSDNTSDVLKEEFALMKISNTIDSIIATQTCKDVFQRQVGKVKLTLIVKENGGKGDALNMGINAANYDYFLCLDADSMLQVDSLSQISKSIQVDPTVIAVGGLVQVAQGVKIEQGKVASYRLPWRIIPCAQALEYDSSFLGARIFLDYLRANLIISGAFGLFKKDLVKAVGGYDTQTLGEDMELVMKLHFFCRNNNIPYRICYETDAVCWSQAPTNLGDLRKQRRRWYLGLYQCLKKYKSIFANYRFGAVGSISYIYYILFELLTPFIECFGIVIIFLSLLFNQLNIPFFISLVSLYIFYCVLITLSSFLHRIYSQQLVIGILDIVKVFYIAVFRYLILHPVLTFVKVASVIGYKNKKMVWGHITREKQMKDFETSVT

SEQ ID NO: 8657 - DNA, 813 bp, Streptococcus agalactiae
atgactggatctaaaaaattagcaaaaagtgattacactaaaacagctttacgtgccttttatttacaaaatggctttaattacagtaactatcaaggtcttggttatgctaatgtcatatatccagctctcaaaaaatattatggagatgacaaaaaagctttagcgggagctctagaagaaaatgtggagttttacaatacaaaccctcatttcttaccttttgtaactagcttacatttagcaatgcttgataatgagcggccagaagaagaaattcgcggtattaagatggcgcttatggggcctcttgcaggtatcggtgattctttatcacaattttgcttagcacccttgttctcaacgattgcagcctctttagcgacagatggtttggtgatgggaccgattctgttctttgtggctatgaatactattttaacgggaattaaattagttactggcatgtatggttatcgtcttgggaccagttttattgataaattgagtgaacaaatgtcagttatctcacgggcagctaatatcgttggtgtaacggtcatctcaagtttagctgcaacacaagttaagcttacaatcccttacacttttgctccagaaaaagtaactagtacaacgcaaaagattgttactgtccaaggtatgcttgataaaattgcaccagctctacttccagcactctacactttccttatgttttaccttattaaaaataaaaaatggacaacttataagttagttatccttacagttattattggtatccttggtagctggttaggtattttagct

SEQ ID NO: 8658 - protein, 271 aa, Streptococcus agalactiae
MTGSKKLAKSDYTKTALRAFYLQNGFNYSNYQGLGYANVIYPALKKYYGDDKKALAGALEENVEFYNTNPHFLPFVTSLHLAMLDNERPEEEIRGIKMALMGPLAGIGDSLSQFCLAPLFSTIAASLATDGLVMGPILFFVAMNTILTGIKLVTGMYGYRLGTSFIDKLSEQMSVISRAANIVGVTVISSLAATQVKLTIPYTFAPEKVTSTTQKIVTVQGMLDKIAPALLPALYTFLMFYLIKNKKWTTYKLVILTVIIGILGSWLGILA

SEQ ID NO: 8659 - DNA, 1074 bp, Streptococcus agalactiae
atgatatcttattatagagataagggcttaccatcaccccaagttgaattattgttttcaattccttcgatggctattatcttcatcttgcttatcacaccttggttaagtaaaaaactttctgagaaacatatgattatctttgggctattgctaacagcattagggggaggattgccggttgtcagtcagaactaccttttagtatttgtatcgcgtcttttattggggagtggtattggttttattaatactagggccattagtgtgattagtgaatattatcaaggcaaagaaagaagaaaactcttaggattaagggggtcctttgaagttttaggaaatgctggtttgacagctttagttgggctgttgttgacttttggttggtccaaatcatttatgatttattttttagctttaccaatcttagttctatatcttgtttttgcgcctaagaaagtggtgaaagatacaaatgacaagattaaaactaaaggtcaaaaaatccctaaagctgatttaacttatattgtcgccttagctattttagcaggatttgtcataactataaatactgggattaatcttaggatacctctgctagtagtagaatttggtttgggtacgccagctcaagctagtcttgttcttagtgcgatgatgcttatgggaataatagcaggtatgagttttggtcagttgatagctatgtttcataaacaattaattccaatctgcctcgtcttattttctttaacattgcttggagttggattgccttctaatctaatggtactaacaattagtgcgatggcatcaggtttcctttacagcctgatggtcactgctgtgtttagcctagtagcagaccgtgttgaatattcgttggttggttctgcaacgacattagttttagtattttgtaatattggtggagctagtgcggctattcttctgtcttgttttgatcatttactaggacaaataaatgcagttttctatgtttatgctattttaagtttagcagttggtatgatttatttctttaaacgcctattttttaagaaaatg

SEQ ID NO: 8660 - protein, 358 aa, Streptococcus agalactiae
MISYYRDKGLPSPQVELLFSIPSMAIIFILLITPWLSKKLSEKHMIIFGLLLTALGGGLPVVSQNYLLVFVSRLLLGSGIGFINTRAISVISEYYQGKERRKLLGLRGSFEVLGNAGLTALVGLLLTFGWSKSFMIYFLALPILVLYLVFAPKKVVKDTNDKIKTKGQKIPKADLTYIVALAILAGFVITINTGINLRIPLLVVEFGLGTPAQASLVLSAMMLMGIIAGMSFGQLIAMFHKQLIPICLVLFSLTLLGVGLPSNLMVLTISAMASGFLYSLMVTAVFSLVADRVEYSLVGSATTLVLVFCNIGGASAAILLSCFDHLLGQINAVFYVYAILSLAVGMIYFFKRLFFKKM

SEQ ID NO: 8661 - DNA, 744 bp, Streptococcus agalactiae
atggcacaacgcagaatgtttagtagaaaaatcactgagactgaccgttttttggaaatgccactatcatcccaagctctctatttccatttgaacatgggagctgatgatgagggctttatagataaggcaaagacgattcagagaactattggcgctagtgatgatgatatgaaattactgattgcaaaagggttcttgattccctttgatagtggtgtagtcgttatccgtcattggcggattcacaactatatccagtctgaccgctttcaatcaaccttataccagtcagaaaaggctcagctagagtatgacaagtcaaaaacagctagtcttaaacctattggaaattgtatacaaaatgtatccaaaatggagacacaggttaggttaagtaagggtagcttagataaggatagcttaactacctatcctacagtttcagacaatgaggaagaagatattccatacaaggaaattatttcttacttgaatgaaaaagctaatagaaattacagacctaacattcagaaaaacaaaactcttatcaaggctagatggtcagaaggattcaggttagatgatttcaaacatgtgattgataccacggtcaaggattggtcaggcactaagtatgaaaagtatctcagacctgaaacgctctttggttctaagtttgaaggctatttgaatcaagcaccacgaatcaagacggaaacaattgacggaaggttgggcttt

SEQ ID NO: 8662 - protein, 248 aa, Streptococcus agalactiae
MAQRRMFSRKITETDRFLEMPLSSQALYFHLNMGADDEGFIDKAKTIQRTIGASDDDMKLLIAKGFLIPFDSGVVVIRHWRIHNYIQSDRFQSTLYQSEKAQLEYDKSKTASLKPIGNCIQNVSKMETQVRLSKGSLDKDSLTTYPTVSDNEEEDIPYKEIISYLNEKANRNYRPNIQKNKTLIKARWSEGFRLDDFKHVIDTTVKDWSGTKYEKYLRPETLFGSKFEGYLNQAPRIKTETIDGRLGF

SEQ ID NO: 8663 - DNA, 2733 bp, Streptococcus agalactiae
atgactgaaacgtttgaaggcttatacgtcaaatttggtgctaatactgttgaatttgataggtctgtaaaaggtatcaacactgccttatctagtttgaaaaaagacttcaataacatcaacagacaattgaagatggatccagacaatgttgacttgttgaatcgtaagttggttaacttgcaagaacaggctcgtgttggtgctataaaaattgctgaactcaaaaagcaacagaaggcactgggagaatctgaagttgggtcagcacagtggaataagcttcaacttgaaattgctaaggttgaatcacagatgaagattgttgataaggcaatggagtcaacaaagaaacacattgaagatgtaggagacccaaagtctattctgaatcttaacaaagaacttgataatgttgctaaagagcttgatattgtcaatcaaaagcttgagctagaccctgacaatgtcgaactagcagagcaaaaaatgaaactacttggcaaacagtcggaattggctggggataaagtccaagaattaaagaaaaaacaagctgcccttggcgatgagaaaataggtacagaagaatggcgtcaacttcaaaatgaaatcggtcaasctgaagttgaagttctaaagattgaccgtgcaatggacattcttggtgagtcaagccgttctgcaactggagacatcaaagaggcaaccagctatttaagagctgatgtcatgatggatgttgcagataaggctggtcagattggccagaaaatggttgacgctgggaaaatgacagtagatgcttggtctgagatagatgaggctctggacaccgtcacaaccaaaactggtctgactggtgatgccttagcagagcttcaggaaattgctaaagacattgctactggtatgcctaccagctttcagaatgctggtgatgccgttggggaattgaatactcagttcggtttgactggggaaaagctgaaatcagcatctgaattacttatcaagtatgctgagattaacgaaacagacatttcaagctctgccatttctgcaaaacaagctattgaagcttacggtttgacagctgaagacttgggaatggtcttagacaatgtgaccaaagccgctcaagatacaggacagtcagttgacacgattgttcaaaaagccattgacggtgctcctcagattaaaggtttgggactttcttttgaagaaggtgctgcactgatcggtaagtttgagaaaagcggtgtggattcatctgctgctctatcctctctatcgaaagctgctgtcatctatgctaaagacggtaagactctgacagatggattgaatgagactgttagtgctattcaaaattctactagtgagacagaggctttaagtattgcctcagaaatctttggtagtaaggctgctcctagaatggtcgatgctattcagcgtggtgcttttagctttgatgacttagctgaagcagctaaaagttcctctggtactgtctccaccacatttgatgagacgcttgacccaatagataagttgactcagtattctaaccaagcaaaagagggaatggcagaacttggcggtaaattgcttgagactgtcatcccagctttagaacctttgatgggtatgcttgaatcttctgtcaattggtttactagcctaaacgaaactgatcaacagactatcgtgattcttggcctagttacaactgctgtgatgatgttgcttggtgcaattgcaccgctggtcatcgccataggggcaataggtgcgcctgtcggaattgtagtggcggcaatagtaggggctattgccgtcataacacttatcatccaagcaatcatgaactggggagccataactgaatggcttcagtcaacgtgggattcttgtgctgcctggsyttctgaattgtggactaacatagtcacgactgccaccacagcgtggtcaaatttcactgcctggctttctggcctttggtcttcagtagtctcaactggacagtctttgtggtctagctttactagttccttgtccaatattttctcaagtttgattacaggtgctcagtctctgtggtcaagtttcacttccactctttccaatttgtggtctggactggtctcaactgggtcaaatttgtttaataatttgagtagcacgatttcaggaatttttaatgggatactttcaacagcaagcaatatttggaattccataaaatccactatttccaatgcaatagatggggcgaaaaatgcagtgtccaacggggtcaatgccatcaagaatctgtttaacttccagattaaatggcctcatattccactacctcacttccgtgtgagtggttctgctaaccctctggattggctaaaaggtggcttaccaagtatcggcattgactggtatgccaagggcggtatcatgaccaaaccaaccctatttggcatgaatggaaaccgtgcaatggttggcggtgaggctggcgctgaagccatcttgccattgaataagtcaaccctgggggcaattggtcaaagtattgctaacacgatgaatacatcgaacaatattaacgttaacttctctggcgtcactatcagggaagaagctgaccttaacagactagccaacgtggttggaaatcgtattgctgaagaattgcaacgtaaaactaatttgagaggaggaatggca

SEQ ID NO: 8664 - protein, 911 aa, Streptococcus agalactiae
  MISC_FEATURE (1)..(911): Xaa = Any Amino Acid
MTETFEGLYVKFGANTVEFDRSVKGINTALSSLKKDFNNINRQLKMDPDNVDLLNRKLVNLQEQARVGAIKIAELKKQQKALGESEVGSAQWNKLQLEIAKVESQMKIVDKAMESTKKHIEDVGDPKSILNLNKELDNVAKELDIVNQKLELDPDNVELAEQKMKLLGKQSELAGDKVQELKKKQAALGDEKIGTEEWRQLQNEIGQXEVEVLKIDRAMDILGESSRSATGDIKEATSYLRADVMMDVADKAGQIGQKMVDAGKMTVDAWSEIDEALDTVTTKTGLTGDALAELQEIAKDIATGMPTSFQNAGDAVGELNTQFGLTGEKLKSASELLIKYAEINETDISSSAISAKQAIEAYGLTAEDLGMVLDNVTKAAQDTGQSVDTIVQKAIDGAPQIKGLGLSFEEGAALIGKFEKSGVDSSAALSSLSKAAVIYAKDGKTLTDGLNETVSAIQNSTSETEALSIASEIFGSKAAPRMVDAIQRGAFSFDDLAEAAKSSSGTVSTTFDETLDPIDKLTQYSNQAKEGMAELGGKLLETVIPALEPLMGMLESSVNWFTSLNETDQQTIVILGLVTTAVMMLLGAIAPLVIAIGAIGAPVGIVVAAIVGAIAVITLIIQAIMNWGAITEWLQSTWDSCAAWXSELWTNIVTTATTAWSNFTAWLSGLWSSVVSTGQSLWSSFTSSLSNIFSSLITGAQSLWSSFTSTLSNLWSGLVSTGSNLFNNLSSTISGIFNGILSTASNIWNSIKSTISNAIDGAKNAVSNGVNAIKNLFNFQIKWPHIPLPHFRVSGSANPLDWLKGGLPSIGIDWYAKGGIMTKPTLFGMNGNRAMVGGEAGAEAILPLNKSTLGAIGQSIANTMNTSNNINVNFSGVTIREEADLNRLANVVGNRIAEELQRKTNLRGGMA

SEQ ID NO: 8665 - DNA, 3507 bp, Streptococcus agalactiae
atgctgattaagtcgcctgtgcctgtgctgggcgctcagctgttccgtatcaagaagcctattgagaatgacgacagcatggacatcactgcctatcatgtctctgatgacatcatgaagcggtctatcactcctgtgagtgtggttggtcaaggctgtgctatggcactgtctcagatggttcaaaatgctaagactgggctaggtgatttctcctttaccagcgatattatggacagccgaacctttaacacgactgaaacggaaacgctctactctgtccttatggacggtaaacacagtattgttggaacgtgggaaggtgagcttgtccgtgataactttgccttatctatcaaacgtagccgtggggctgatcgtggtgttgtcatcacaacacacaagaacctcaaatcctatcaacgaaccaagaactctcagggtgttgtcacaaggattcatgcacggtcaaccttcaaacctgatggagctgaagatgaagtgacgctcagagtgtctgttgacagtccactaataaactcttatccctacatcaatgagaaagagtatgagaacaacaacgctgaaaccgttgaagaccttagaaagtgggctgaggctaagtttacaaatgagggcattgataaggtttctgatgccattgagattgaagcctatgagcttgacggtcaagttgtaaatctgggcgacacggttaacctcaagagtagaaagcacagtgctgacctctacaagaaggccattgcctacgagtttaacgctttaacggaagagtatatctccataacttttgatgataagccaggagttggtggttctggggtgtcaagtggcttgtctaatgttgctgatgctatacttgtagcaagtgccacagctcaggacgttgctgttcaaagggctgtgaaaaatgctaacgctgcctttgatgcagagtttggtaaaacaaaaacaaaaattaatgatgatatcgaaatcgcaaaagccaaagtagaaagctttaaatcggaactatctaatcgcatggataatcagcttcttccccttgcgacagaagctaagaatttagccagtcaggcacaagcagacttgaccagaaaagaaatagagcttagagctgaattaaatagacaagtcacaagcacagaagctgtaaaaatctctctaacaaatcttagtcacaatatggatatcattaagcaaaaagccctaaacgaccttagagacgcagagacaaggctaaaggaagctgatagcgtccaacaacttgcgacaaagcgggttgaggataaactgacaggacttagcacgaaactggagtcattctctgttggtggctataattatgtcattgacggcggagaacctaaagaactaatggctaacttctatggtaagacctatgatattaatccccaactactcgaacgaactagtcaagcgaccttgagttttagctatgaagcagaatcaactagtcgtttagaagttagactttataaaaagatgcacaccggggacactagtaagattacaattattgtcatgcctaactttgacttatctccagggaaaggctttatctctcagagctttgatttaggtggtgttatgcctgaccctagaaaccaagcctggcttgtgatgcgggggacaaatgctaaccccttgacgctctcgaaagttaagctggaacgtggtaccgttgctacagactggaataatcgcgatgaaaccttaaaagctagcttcgccgaatacaagcagaccgttgatgaaaacttagccaaccttagaacaagtacggaaaccttggcaggtcaactgacaagtgctgagtctagcattaggcagacgtcggaatcctttagcaatcgtttagttagtcttgagacctataaagatagtgaaccaaatcgagctagtcgttactttgaagcaagcaagtctgaaaccgctaagcagctatcagccttacgaacagaggttaatggctcttatgtggataagtcaacctatgaggaaaatgcaagaggtttgataagacgctttgaaagtctgtcatcagggacacagaactatgctttggggactgaaagagatgtctatctaaacgtttcagggactaccgtctatgacctttatagcttcggtactaccttagccgtaaaagggattgaaatgggagatactgtaactattgcatttaactattttgcggatagtcggacggcttttggttcttatgaactggagctatacggacatgcaggcaaaatcgaacgggttggtgaggtacagagaacgatatcaaatcgtggtacctataccgcatcttttgtggcaaacaatgccaatttcagggcaaactcccttaaaattagatttacggatagccaacttaagtttagagtgacaacacttcgtgtgactaaggggacaattcctgcggactggagtccatctccagatgacctgaaagcctactcagatactaagcttgaacagacagctaatgagattaaagctagtgtaacaagtcttgatcataaaactcttaagcaaactgatattactatgacttctgaagggattgtcctgagagcaggcaagacgagtaatgatgtggcaagagctattggctcttactttaaggtcactcctgatgctatagctctgtttagctcactgataaaagttagcgggaacatgttggttgatggttctgtaactagtcgtaagttggtaacaggcgctgtcgaaacgggacatgttaaggctggagcaatcacaggagtgcttttagcagctgaagctgtaacggcagaaaaacttaaagtcgaccaagctttctttaacaagttgatggccaacgatgcctacttgaagcaactatttgccaagtcagccttcatcactcaggttcaatccgtgacaatatctgccagtcagatttcgggcggtgttattaaagctttgaataatgccatggaaatccagatgaacagtggtcagatactttactacactgaccaagctgcactgaaacgggttttgagtggctatcctactcagtttgttaagttcgcaactggtacagtatctggtaaaggaaatgctggtgttacggtcattggttctaaccgctacggtacagaatcaaccaatgatggtggatttgttggagtccgtgcatggaacggctcaaacattgactcacttgacttagttggtgatgaaatccgattagcaagctctgcctttgacaattcagatggttgggatgttcggacacttgattcaggcttgaaaatcacaccacacaatagggctgctgaacgcaatagccgaattgaggttggtgatgtctggattttaaaaggaaatggatcctattcttctctcagagatattttgaactcattcaatgagaacttctcaaaaggcccaaatgctgactcttacacttactacccttcagggttc

SEQ ID NO: 8666 - protein, 1169 aa, Streptococcus agalactiae
MLIKSPVPVLGAQLFRIKKPIENDDSMDITAYHVSDDIMKRSITPVSVVGQGCAMALSQMVQNAKTGLGDFSFTSDIMDSRTFNTTETETLYSVLMDGKHSIVGTWEGELVRDNFALSIKRSRGADRGVVITTHKNLKSYQRTKNSQGVVTRIHARSTFKPDGAEDEVTLRVSVDSPLINSYPYINEKEYENNNAETVEDLRKWAEAKFTNEGIDKVSDAIEIEAYELDGQVVNLGDTVNLKSRKHSADLYKKAIAYEFNALTEEYISITFDDKPGVGGSGVSSGLSNVADAILVASATAQDVAVQRAVKNANAAFDAEFGKTKTKINDDIEIAKAKVESFKSELSNRMDNQLLPLATEAKNLASQAQADLTRKEIELRAELNRQVTSTEAVKISLTNLSHNMDIIKQKALNDLRDAETRLKEADSVQQLATKRVEDKLTGLSTKLESFSVGGYNYVIDGGEPKELMANFYGKTYDINPQLLERTSQATLSFSYEAESTSRLEVRLYKKMHTGDTSKITIIVMPNFDLSPGKGFISQSFDLGGVMPDPRNQAWLVMRGTNANPLTLSKVKLERGTVATDWNNRDETLKASFAEYKQTVDENLANLRTSTETLAGQLTSAESSIRQTSESFSNRLVSLETYKDSEPNRASRYFEASKSETAKQLSALRTEVNGSYVDKSTYEENARGLIRRFESLSSGTQNYALGTERDVYLNVSGTTVYDLYSFGTTLAVKGIEMGDTVTIAFNYFADSRTAFGSYELELYGHAGKIERVGEVQRTISNRGTYTASFVANNANFRANSLKIRFTDSQLKFRVTTLRVTKGTIPADWSPSPDDLKAYSDTKLEQTANEIKASVTSLDHKTLKQTDITMTSEGIVLRAGKTSNDVARAIGSYFKVTPDAIALFSSLIKVSGNMLVDGSVTSRKLVTGAVETGHVKAGAITGVLLAAEAVTAEKLKVDQAFFNKLMANDAYLKQLFAKSAFITQVQSVTISASQISGGVIKALNNAMEIQMNSGQILYYTDQAALKRVLSGYPTQFVKFATGTVSGKGNAGVTVIGSNRYGTESTNDGGFVGVRAWNGSNIDSLDLVGDEIRLASSAFDNSDGWDVRTLDSGLKITPHNRAAERNSRIEVGDVWILKGNGSYSSLRDILNSFNENFSKGPNADSYTYYPSGF

SEQ ID NO: 8667 - DNA, 330 bp, Streptococcus agalactiae
atgacacaaattacagatattatcatcagctcagctatgggaattttgaccattttggcaggaattgcagtgcaagctgtcaaggtttatttgattaaaaaaggcggtgaaaaggccgtcttgattacagaaatcttggccaagaacgctgttaatgctgtggagcaagtggccactgaaactggcttcaaaggagctgacaagctaacttctgctaaggctcagattttagctgagttgcaaaaatacaatatccacatgtcagacgatgatctcactttgtttgttgaatcagctgtcaaacaaatgcacgatgcctggaaggagtaa

SEQ ID NO: 8668 - protein, 109 aa, Streptococcus agalactiae; identical to SEQ ID NO: 2510

SEQ ID NO: 8669 - DNA, 1404 bp, Streptococcus agalactiae
  misc_feature (1)..(1404): n = a, c, g, or t
atggaaatcaacactgaaatagccattgcctggatgtctgcacgtcaaggcaaggtcagctattccatggactaccgtgacgsccctaacagctatgactgttccagctctgtctattatgctctcaggtcagctggtgcaagctcagcaggttgggcggtcaacactgagtacatgcacgattggctgattaaaaacggttatgagcttattgctgaaaacgtggattggaatgctgtccgtggtgatatagcaatttggggcatgcgagggcactcaagcggagctggtggtcatgtagtcatgtttattgaccctgaaaatatcattcactgtaactgggcaaataatggcatcacagtgaacaactacaatcagacagcggctgctagtggctggatgtattgctacgtttaccgtttgaaaagcggagcttctacccaaggaaaaagccttgataccttggtcaaggaaacccttgctggtaactacggtaatggcgaagcacgcaaggcagtgcttggcaatcaatatgaggctgttatgtcagtcatcaatggcaaaactacgactaatcaaaagactgttgaccaacttgttcaagaggtaatcgctggcaaacatggcaacggtgaagctcgtaaaaagtcgcttggtagtcaatatgatgcagttcagaaacgagtgacggaattgctcaaaaaacagccctctgagccgtttaaggctcaagaggtaaacaagcccacggaaaccaaaacaagccaaacagagctaactggacaagccacagccaccaaagaagagggcgacctctctttcaatgggactatcttgaaaaaagcggtgctggacaagattctgggcaactgtaaaaagcatgatattcttccaagttatgcactgactatcctacactatgaaggtctttggggaacttcagcagttgggaaggcagataataactggggcggtatgacctggactggtcaaggcaaccgtccaagcggtgtcactgtcacacaaggttccgcacgtccttcaaatgagggcggtcactatatgcactatgcaagcgtggatgactttctgacagactggttttatcttctaagggctggtggctcttacaaggtgtctggtgctaaaaccttcagtgaggctatcaagggaatgtttaaagttggcggtgctgtctatgattatgctgcaagcggctttgatagctatattgtcggagcttcaagccgcctcaaggctattgaggcagaaaatggttcactggacaagtttgataaagctaccgacattggtgacggtagcaaagacaagattgacattactattnaaggtattgaagttaccatcaacggtatcacttatgaactgactaaaaagccagtt

SEQ ID NO: 8670 - protein, 468 aa, Streptococcus agalactiae
  MISC_FEATURE (1)..(468): Xaa = Any Amino Acid
MEINTEIAIAWMSARQGKVSYSMDYRDXPNSYDCSSSVYYALRSAGASSAGWAVNTEYMHDWLIKNGYELIAENVDWNAVRGDIAIWGMRGHSSGAGGHVVMFIDPENIIHCNWANNGITVNNYNQTAAASGWMYCYVYRLKSGASTQGKSLDTLVKETLAGNYGNGEARKAVLGNQYEAVMSVINGKTTTNQKTVDQLVQEVIAGKHGNGEARKKSLGSQYDAVQKRVTELLKKQPSEPFKAQEVNKPTETKTSQTELTGQATATKEEGDLSFNGTILKKAVLDKILGNCKKHDILPSYALTILHYEGLWGTSAVGKADNNWGGMTWTGQGNRPSGVTVTQGSARPSNEGGHYMHYASVDDFLTDWFYLLRAGGSYKVSGAKTFSEAIKGMFKVGGAVYDYAASGFDSYIVGASSRLKAIEAENGSLDKFDKATDIGDGSKDKIDITIXGIEVTINGITYELTKKPV

SEQ ID NO: 8671 - DNA, 591 bp, Streptococcus agalactiae; identical to SEQ ID NO: 2575

SEQ ID NO: 8672 - protein, 197 aa, Streptococcus agalactiae
VVQYLMTIKKELFMLRALKEDFFLTLTSLKNQFWVYIGTGILIQTLVAYLVKGILSFIFRRILILSNTPAVTKDNWTLLFNHPLALLLFILYIVILIGFIYTEFAIYTIAILKTEFSLSIKKWLTIFPKKIKSLLGPQLIWVSIYLLLTIPLANLGLRSSILEHLKIPDFISGELTKTVFGKIGYSTLLLLICYLNL

SEQ ID NO: 8673 - DNA, 3759 bp, Streptococcus agalactiae
atgaaaagaaaagacttatttggtgataaacaaactcaatacacgattagaaagttaagtgttggagtagcttcagttgcaacaggggtatgtatttttcttcatagtccacaggtatttgctgaagaagtaagtgcttctcctgcaaatacagcgattgcagagtcgaatattaatcaggttgacaaccaacaatctactaatttaaaagatgacataaactcaaactctgagacggttgtgacaccctcagatatgccggataccaagcaattagtatcagatgaaactgacactcaaaagggagtgacagagccggataaggcgacaagcctgcttgaagaaaataaaggtcctgtttcagataaaaataccttagatttaaaagtagcaccatctacattgcaaaatactcccgacaaaacttctcaagctataggtgctccaagccctaccttgaaagtagctaatcaagctccacggattgaaaatggttactttaggctacatcttaaagaattgcctcaaggtcatcctgtagaaagcactggactttggatatggggagatgttgatcaaccgtctagtaattggccaaatggtgctatccctatgactgatgctaagaaagatgattacggttattatgttgattttaaattatctgaaaaacaacgaaaacaaatatcttttttaattaataacaaagcagggacaaatttaagcggcgatcatcatattccattattacgacctgagatgaaccaagtttggattgatgaaaagtacggtacacatacttatcaacccctcaaagaagggtatgtccgtattaactatttgagttcctctagtaactatgaccacttatcagcatggctctttaaagatgttgcaaccccctcaacaacttggccagatggtagtaattttgtgaatcaaggactatatggaaggtatattgatgtatcactaaaaactaacgccaaagagattggttttctaatcttagatgaaagtaagacaggagatgcagtgaaagttcaacccaacgactatgtttttagagatttagctaaccataaccaaatttttgtaaaagataaggatccaaaggtttataataatccttattacattgatcaagtgcagctaaaggatgcccaacaaattgatttaacaagtattcaagcaagttttacaactctagatggggtagataaaactgaaattttaaaagaattgaaagtgactgataaaaatcaaaatgctatacaaatttctgatatcactctcgatactagtaaatctcttttaataatcaaaggcgactttaatcctaaacaaggtcatttcaacatatcttataatggtaacaatgtcatgacaaggcaatcttgggaatttaaagaccaactttatgcttatagtggaaatttaggtgcagttctcaatcaagatggttcaaaagttgaagccagcctctggtcaccgagtgctgatagtgtcactatgattatttatgacaaagataaccaaaacagggttgtagcgactaccccccttatgaaaaataataaaggtgtttggcagacgatacttgatactaaattaggtattaaaaactatactggttactattatctttacgaaataaaaagaggtaaggataaggttaagattttagatccttatgcaaagtcattagcagagtgggatagtaatactgttaatgatgatattaaaacggctaaagcagcttttgtaaatccaagtcaacttggacctcaaaatttaagttttgctaaaattgctaattttaaaggaagacaagatgctgttatatacgaagcacatgtaagagacttcacttctgatcgatctttggatggaaaattaaaaaatcaatttggtacctttgcagccttttcagagaaactagattatttacagaaattaggagttacacacattcagcttttaccggtattgagttatttttatgttaatgaaatggataagtcacgctcaacagcttacacttcctcagacaataattacaattggggctatgacccacagagctattttgctctttctgggatgtattcagagaaaccaaaagatccatcagcacgtatcgccgaattaaaacaattaatacatgatattcataaacgtggcatgggggttatacttgatgtcgtctataatcacactgcaaaaacttatctctttgaggatatagaacctaattattatcactttatgaatgaagatggttcaccaagagaaagttttggagggggacgtttaggaaccactcatgcaatgagtcgtcgtgttttggttgattccattaaatatcttacaagtgaatttaaagttgatggtttccgttttgatatgatgggagatcatgatgcggctgcgattgaattagcttataaagaagctaaagctattaatcctaatatgattatgattggtgagggctggagaacattccaaggcgatcaaggtcagccggttaaaccagctgaccaagattggatgaagtcaaccgatacagttggcgtcttttcagatgatattcgtaatagcttgaaatctggttttccaaatgaaggtactccagctttcatcacaggtggcccacaatctttacaaggtatttttaaaaatatcaaagcacaacctgggaattttgaagcagattcgccaggagatgtggtgcagtatattgctgcacatgataaccttaccttgcatgatgtgattgcaaaatcaattaataaagaccctaaggtagctgaagaagagattcatagacgtctgcgtttaggaaatgtaatgattttaacatctcaagggacagcattcattcattctggtcaagagtatggtcgtacgaagcgtttacttaaccctgattacatgacaaaagtttcagatgacaaattgcctaataaagcaacacttattgaagctgttaaagaatacccatattttattcatgattcatatgattcttcagatgccattaatcattttgattgggcagcagccacagataataacaaacacccaatttcaacgaaaacacaggcctatacagcaggtttaatcacattaaggcgttcaacagatgctttccgaaaattgagcaaagcagaaattgatcgtgaggttagcttgattacagaggtaggtcaaggtgatattaaagaaaaagatttggttattgcttaccaaacaatagattctaaaggtgatatttacgcagtatttgttaatgctgatagtaaagctagaaacgttttactaggtgaaaaatataaacaccttttaaaagggcaagtaattgttgatgctgatcaagcggggattaaaccaatctcaactcctagaggtgttcattttgaaaaagatagtttgctgattgatccattaacagcaattgtgattaaagttggcaaagttgctcctagccctaaggaggaattgcaagcagattatcccaaaacacaatctttcaaggaatctaaaacggtagaaaaagtaaatagaatagctaataagacctcaataactcctgtagtttctaagaaggccgattcatatctgacaaatgaagctaatttgccaaaaactggagataagtcatcaaaaatactaagtgtagtaggaataagcattctagcaagtctacttgctctagtaggtctctctttaaagaggaatcgtcacttaaaataa

SEQ ID NO: 8674 - protein, 1252 aa, Streptococcus agalactiae; identical to SEQ ID NO: 2598

SEQ ID NO: 8675 - DNA, 915 bp, Streptococcus agalactiae
atgaaaaattgggaaaaaccaccattagtgatggcgggattagtattagggctattagctttggggaaccttctagagggatatggcacctatgttcgctattgtttagggctagtagcacttgttttttggatttttttaatcaaaggaatattaaaaaataaaaaagaaagcaggaaggagttaagcaatcctttgattgcttctgtctttactactttttttatggcaggtatgattttatcaacctatatcttattatttagaagtttaggaatatgggtagcagttctgtcaaaaggtgtatggtggttgtcatttattgcgttaatcattcatatggctattttttcatggaaatatttgagacacttttcgatggctaatctttttccttcttggtctgtcctctatgttggtataggggtagctagcctgacagcaccaattagtggacaatttactattgggaaaatagtcttttggtatggttttattgcaactttagtattattaccatttctattcattaaagcatataaaatcgggctaccttcggcagttaagcctaatataactactatttgcgctccaatgtcgctaatcacagcgggatatgtcaatagttttgtgtcaccaaatagaggtttattactgctattaatcgtaatggcacaatttctttattttttcattctttttcaggtgcctaaattactgattggtgattttacaccaggtttctcagcctttactttcccccttgttatctcagctacctcacttaaattaagtattcagcatctatcattaccagttgatatacaggggctagtccactttgaaattgggacaacaactcttattgttatgatagtaatggtacgttatattttctttttaaggcgaacaatt

SEQ ID NO: 8676 - protein, 305 aa, Streptococcus agalactiae
MKNWEKPPLVMAGLVLGLLALGNLLEGYGTYVRYCLGLVALVFWIFLIKGILKNKKESRKELSNPLIASVFTTFFMAGMILSTYILLFRSLGIWVAVLSKGVWWLSFIALIIHMAIFSWKYLRHFSMANLFPSWSVLYVGIGVASLTAPISGQFTIGKIVFWYGFIATLVLLPFLFIKAYKIGLPSAVKPNITTICAPMSLITAGYVNSFVSPNRGLLLLLIVMAQFLYFFILFQVPKLLIGDFTPGFSAFTFPLVISATSLKLSIQHLSLPVDIQGLVHFEIGTTTLIVMIVMVRYIFFLRRTI

SEQ ID NO: 8677 - DNA, 2538 bp, Streptococcus agalactiae
atgtacaaaaaaggcaaattttgggtcgttgcaggtatcgttaccattttaggtggtagtgcaattcttggtcaagatgtcaaggcagaacaggcagaagcagtaacttcaacgatctcagagaaaactgatagcagtcagactatttcggatacttccaagttaacgttacctgttaattcctcggaggctatgaaaaatagtgcagagcctttaataaaaacagcctttgctacatctgtttcatctaatcctagagagatagcagctaccccagtcaaaacctttgatgctagctcaaaagttgttgtaaaagctagtactgctgagcactcagcaaatcaaacaaattctaatgttaatcaagtagctaatgatagtgaagttattactcaacaaaattcaacaaagcaattaccaacagtgacttactctgctcatgttcaagatattggatggcaaaagtcggttgataatgcaacagtttcaggaacagtaggacaagaaaagcaggttgaggcaataaaattgtctattaaagcacctgaaggaataacaggaaaacttagctataaaacttatgttaaaggacaaggttggcaaccttcagtagagagtggtcaagttagtggtactgttggtcagagtagacctattgaagcactaagcattaaccttactgataatttacaaaaattatatgatgtctattatcgtgttcatgttcaagatatcgggtggatggcttgggctaaaaatggagcttacgctgggactttgggaatgtcaaagcgccttgaagcttacgaagtaaaatttacccttaaaggacaatctgttttaacaccaactatacctaaggaagagagacctgtcttaaattatcaggttaaggtaggccaaaatggttggcaatctaataaacttgaaggacaaatggcgggaactttaggagaatccaaagccctagatggagtaaaattcactcttagcaccttgaagtatggggacattctctatcgtactcatgtacaagataaaggttggggagaaattttaggtagtcaaacaagtaaggattatcaaggaaaaagactagaagctattcaattggacttaagtgggaatttaaaacaaaattatgatatttattatcgcgctcacgtccaagataaaggttggatggcttggcaaaaaaataatagtgtagcaggtacagtcggagaatcgaaacgtttagaggctttggaggtaaaactagtagctaaagcttcagattttagttcccaaacaaatcattcattcttagaaatgaagcatcctggattaagttatcaaacttatcttcaaaaagatggttggaaaccaacggttttggaaggccaattaggaggtagtattggactttcaaaatctataaaagccatcaaacttaacttaggtagtacagctctaggaaatatagaatatagaacttttcttaatggttcaggttggcaaactgttgttaattcagggagagaaagtaatgtaccaaatgaatctcaacaagtagaagctattcagatgcgattgacaggtctgctatcgaaaacctatagtgtgatgtatcgagttcacatgcaagattatggttggcaggattggacttataacaatgacatcgctggtagtactaaccaaggaaaacgaattgaagcaatcgaaattaaattagttgagactgctaaaataccggtaactgtccaaacgacttataagggaactggaaactataatgtacgagtgacaaatgttattagtcctggggatttaaaaattgctatttggtcagataaaaacaatcaggatgaccttaagtggtataccgtcgcacccaaaaatcatgaagctacattgacatttaatgttacaaatcatagagacaatggtaaatactttatccatgtttatcaggaaaatgcttctaatcaaaaacaattattggtaaaaacttctctacaagtcgcacattcaaattataatactccttactttagccaacgtgatggaaggtgggcaagtcgaagatatggtatggcaactttaggagaaactggttgtgtaccaacttctctagctatgattttgtcttctttgaaaggagaaactgttttaccaacgcaaattgcagattacctttaccataagacagttgaatttaatcgtggtgttcaaggaacaacttctagaggaattttaaaagcagccaaagaatggggtgtaactgcaactgcattaggaactcaagctaaccttgtacaagcgttgaaggatggttatcatgtcctagcggcagtacaaaataatgtttttgttcttcatggaagtcatgaaatcgttctcaaaggatataataacggactgacacatgtctctgacccttacacaccgtccttgtctggttggtatccaatttcacaactttggaaagaacagagctattatagtgaggatagaattgatattggagcaccttttgtcaaggtaacagatgcc

SEQ ID NO: 8678 - protein, 846 aa, Streptococcus agalactiae
MYKKGKFWVVAGIVTILGGSAILGQDVKAEQAEAVTSTISEKTDSSQTISDTSKLTLPVNSSEAMKNSAEPLIKTAFATSVSSNPREIAATPVKTFDASSKVVVKASTAEHSANQTNSNVNQVANDSEVITQQNSTKQLPTVTYSAHVQDIGWQKSVDNATVSGTVGQEKQVEAIKLSIKAPEGITGKLSYKTYVKGQGWQPSVESGQVSGTVGQSRPIEALSINLTDNLQKLYDVYYRVHVQDIGWMAWAKNGAYAGTLGMSKRLEAYEVKFTLKGQSVLTPTIPKEERPVLNYQVKVGQNGWQSNKLEGQMAGTLGESKALDGVKFTLSTLKYGDILYRTHVQDKGWGEILGSQTSKDYQGKRLEAIQLDLSGNLKQNYDIYYRAHVQDKGWMAWQKNNSVAGTVGESKRLEALEVKLVAKASDFSSQTNHSFLEMKHPGLSYQTYLQKDGWKPTVLEGQLGGSIGLSKSIKAIKLNLGSTALGNIEYRTFLNGSGWQTVVNSGRESNVPNESQQVEAIQMRLTGLLSKTYSVMYRVHMQDYGWQDWTYNNDIAGSTNQGKRIEAIEIKLVETAKIPVTVQTTYKGTGNYNVRVTNVISPGDLKIAIWSDKNNQDDLKWYTVAPKNHEATLTFNVTNHRDNGKYFIHVYQENASNQKQLLVKTSLQVAHSNYNTPYFSQRDGRWASRRYGMATLGETGCVPTSLAMILSSLKGETVLPTQIADYLYHKTVEFNRGVQGTTSRGILKAAKEWGVTATALGTQANLVQALKDGYHVLAAVQNNVFVLHGSHEIVLKGYNNGLTHVSDPYTPSLSGWYPISQLWKEQSYYSEDRIDIGAPFVKVTDA

SEQ ID NO: 8679 - DNA, 561 bp, Streptococcus agalactiae
atgaaaaagatagcaattattggtgcaggagcagtcggagcgacactagcctattacttatcaaaagaaaaggatattcaggttactgtttttgattatggagttggacaagcaactaaggctgctgcggggattattagcccatggttttcaaaacgtcgtaataaagcctggtatcgtatggcgaggttgggggctgatttttattcaaagctagtcacggatttacaaaaagatggttttgaaacaaaattttatcagcaaactggtgttttcttattaaaaaaggacgagagtcagttagagtcattgtttgcactagcagataaacgtcgactagaatctcctctaataggtgatttacaaatactaaataaaagtgaagcaaatactcactttcctgagttagatggctatgaacagttactttatgcgagcggaggagcacgagtagaaggggcggacttaacacgaatattgktagaagcaagtggtgttaatgtcatcaaggatgaaagtcactttacgataactgataaatggctttcgtgttcaaggaat

SEQ ID NO: 8680 - protein, 187 aa, Streptococcus agalactiae
  MISC_FEATURE (1)..(187): Xaa = Any Amino Acid
MKKIAIIGAGAVGATLAYYLSKEKDIQVTVFDYGVGQATKAAAGIISPWFSKRRNKAWYRMARLGADFYSKLVTDLQKDGFETKFYQQTGVFLLKKDESQLESLFALADKRRLESPLIGDLQILNKSEANTHFPELDGYEQLLYASGGARVEGADLTRILXEASGVNVIKDESHFTITDKWLSCSRN

SEQ ID NO: 8681 - DNA, 861 bp, Streptococcus agalactiae
atgattatttcatcagtttcacaaggtttattatgggggatattaggattagggatatacttaacctttagaatcttaaaatttccagacatgacaacagagggctccttccctctagggggagcggtttgtgttaccttaatgaatcaaggggttaatcctattttggcgacgattctaggcatgctatcagggatgttagcgggatttgttactggtttactttatactaaaggaaagataccgacgattttagcagggattttagtaatgacctcatgccactctattatgctaatggttatgaaaagagcaaatctaggtttaaatgagattcaaacattgaaagattttcttccgttttcaaatgatttaaatcttctcgtattaggcttgatagctattctcttggtgatttctgccttaatttattttctctatacacgcttggggcaagcttatattgcaacaggagataaccctgatatggcaaagagcttcggcattgataccgacaaaatggaaatgcttggcttaattgtatcaaatggcttaattgctttatcaggagctttagtaagtcaacaagatggatatgctgatgtatcaaaaggtataggtgttattgktattgggttagctagtattattattggagaggtactttactctactggtttaactctctttgaacgtttaattgctatagtggtgggttctattctttatcaatttttaataacggcagtaatcgccttaggatttaatacgaattacctaaaattatttagtgcaatagtgcttggaatttgtttaatggttcctgtcctaaaaacgaagattttgaaaggagtacgctta

SEQ ID NO: 8682 - protein, 287 aa, Streptococcus agalactiae
  MISC_FEATURE (1)..(287): Xaa = Any Amino Acid
MIISSVSQGLLWGILGLGIYLTFRILKFPDMTTEGSFPLGGAVCVTLMNQGVNPILATILGMLSGMLAGFVTGLLYTKGKIPTILAGILVMTSCHSIMLMVMKRANLGLNEIQTLKDFLPFSNDLNLLVLGLIAILLVISALIYFLYTRLGQAYIATGDNPDMAKSFGIDTDKMEMLGLIVSNGLIALSGALVSQQDGYADVSKGIGVIXIGLASIIIGEVLYSTGLTLFERLIAIVVGSILYQFLITAVIALGFNTNYLKLFSAIVLGICLMVPVLKTKILKGVRL

SEQ ID NO: 8683 - DNA, 1254 bp, Streptococcus agalactiae
atggtttctcgattatactatgctgtcaagtttatgatagccgttctatttatgacagttatggcaggagttggagctatcttaatgcactatgtattaatgtttacagagtggttagcatttggtgatagtagagaaaatactctgtctttgttaaatagtgtcacaccaattaaaagagtgttatcacttactttagtctcctttttagcatcccttagttggtattacttacaaatcaaaccaaagcaaataactagtattaaacaacaggttgtttttaaggatttttctgtaaaaaaatcaccttactggctacatataggtcacgcatttttgcaattgatttatgtaggaactggtggccctattggaaaagaaggagcgccacgagagtttggagccataaatgctgggaaaatatcggatttattagcacttaaagtgctggataaacgtttattaatcattagtggtgcagctgcaggtttgtcagcagtttatcaagtccccctagctagtgtattctttgcttttgaaactttagctttaggaatctcactgaaaaatattgtgacattgctagcctctacttttggtgcagctagtattgctcaattagttatttcgacagcccctctttatcatatttcaaagatgagtctgaattcacagtcattagcttttatgttcttgatcgttttatgtgtaactccgattgcgattagctttagatatttaaatcaaaaagtgacagagagacgtattaaaaatataaaaatattgttaagtttgccagtagtgtcattgatagtatctgttttatcaatcgtctatccccagattttaggaaatggtaatgccctagttcaagaagtctttaaagggaccacagttagcttaatcgctattttagttgttctcaagatgatagcaacattatccactctttacgctggtgcttatggcggtatactgacaccatctttttccattggtgcttgtttaggttttttgttagctagtatttctattcctttacttccccacatatcgatagtaaccagtatgttggttggtgcagctatttttttagctattacaatgagagcgccactgacagctgtcggtttagtcatatcttttactggtcaatctgttataactattgttcccctaactatagcagtactttttgctactgcctatgattattttataagaaaaatgaggagtttatatgtcaatccatat

SEQ ID NO: 8684 - protein, 418 aa, Streptococcus agalactiae
MVSRLYYAVKFMIAVLFMTVMAGVGAILMHYVLMFTEWLAFGDSRENTLSLLNSVTPIKRVLSLTLVSFLASLSWYYLQIKPKQITSIKQQVVFKDFSVKKSPYWLHIGHAFLQLIYVGTGGPIGKEGAPREFGAINAGKISDLLALKVLDKRLLIISGAAAGLSAVYQVPLASVFFAFETLALGISLKNIVTLLASTFGAASIAQLVISTAPLYHISKMSLNSQSLAFMFLIVLCVTPIAISFRYLNQKVTERRIKNIKILLSLPVVSLIVSVLSIVYPQILGNGNALVQEVFKGTTVSLIAILVVLKMIATLSTLYAGAYGGILTPSFSIGACLGFLLASISIPLLPHISIVTSMLVGAAIFLAITMRAPLTAVGLVISFTGQSVITIVPLTIAVLFATAYDYFIRKMRSLYVNPY

SEQ ID NO: 8685 - DNA, 261 bp, Streptococcus agalactiae
ttgatagcatcttctttcttagtgctatctttcatttctaatactttaacggtcaacaatttattaccaaaacgaatttcaacttggtcattaagctttaggtcagttgatgactttgctaatacgccattcaccttgacacgtcctttgtctgcaacttctttagcaacgggacgacgcttaatgatacgcgacacttttagatacttgtctaatctcactgatgatcacatccttctatctaaattaactctactattt

SEQ ID NO: 8686 - protein, 87 aa, Streptococcus agalactiae
MIASSFLVLSFISNTLTVNNLLPKRISTWSLSFRSVDDFANTPFTLTRPLSATSLATGRRLMIRDTFRYLSNLTDDHILLSKLTLLF

SEQ ID NO: 8687 - DNA, 1386 bp, Streptococcus agalactiae; identical to SEQ ID NO: 2771

SEQ ID NO: 8688 - protein, 462 aa, Streptococcus agalactiae
LKEKENIQKIIIAMIQTVVVYFSASLTLTLITPNFKSNKDLLFVLLIHYIVFYLSDFYRDFWSRGYLEEFKMVLKYSFYYIFISSSLFFIFKNSFTTTRLSFFTFIAMNSILLYLLNSFLKYYRKYSYAKFSRDTKVVLITNKDSLSKMTFRNKYDHNYIAVCILDSSEKDCYDLKHNSLRIINKDALTSELTCLTVDQAFINIPIELFGKYQIQDIINDIEAMGVIVNVNVEALSFDNIGEKRIQTFEGYSVITYSMKFYKYSHLIAKRFLDITGAIIGLLICGIVAIFLVPQIRKDGGPAIFSQNRVGRNGRIFRFYKFRSMRVDAEQIKKDLLVHNQMTGLMFKLDDDPRITKIGKFIRKTSIDELPQFYNVLKGDMSLVGTRPPTVDEYEKYNSTQKRRLSFKPGITGLWQISGRNNITDFDEIVKLDVQYINEWSIWSDIKIILLTLKVVLLGTGAK

SEQ ID NO: 8689 - DNA, 696 bp, Streptococcus agalactiae
atggatatttttggagaattcttaggaacagctctcttagtcttacttggtaatggtgttgtagcaggtgttgttttgcctaaaacgaagaatcataattctggatggattgttatcacatttggatggggacttgctgtagctattgcagcgttggtatctggcaatattagccctgcccacttgaatccagctgtgtcattagcttttgcgatcaaaggtgatttagcttggggaacagctattctttatatgattgcacagattattggtgcaatgctaggttcacttcttgtttatttgcaatttagaccccattatgaggctgcagaaaatagagcagacatccttggaacttttgcaactggtccggctttgaaggataatttttccaattttttaagtgaagtattgggaacacttgttcttgtacttactatttttgccatcggaaaatacaatatgcctccaggagttggtacgatgagtgttggtatgttagtggttgggattggtctatcgctcggtggaacaacaggttatgctattaatcctgcacgtgattttggtcctcgtttattgcatgccttgttaccgatgaagaacaaaggtgattctgattggacttattcatggattccgatagtaggacctatggtaggagctattttagcagccttaatatttgctatgatg

SEQ ID NO: 8690 - protein, 232 aa, Streptococcus agalactiae
MDIFGEFLGTALLVLLGNGVVAGVVLPKTKNHNSGWIVITFGWGLAVAIAALVSGNISPAHLNPAVSLAFAIKGDLAWGTAILYMIAQIIGAMLGSLLVYLQFRPHYEAAENRADILGTFATGPALKDNFSNFLSEVLGTLVLVLTIFAIGKYNMPPGVGTMSVGMLVVGIGLSLGGTTGYAINPARDFGPRLLHALLPMKNKGDSDWTYSWIPIVGPMVGAILAALIFAMM

SEQ ID NO: 8691 - DNA, 2256 bp, Streptococcus agalactiae; identical to SEQ ID NO: 2903

SEQ ID NO: 8692 - protein, 752 aa, Streptococcus agalactiae
VTFFKKLKKIFLDYVIHIRDRRSPQKNRERVGQNLMILTIFLFFIFIINFVIIVGTDSKFGVNLSKEAKKVYQQSMTVQAKRGTIYDRNGNPIAEDATTYSLYAIISKNYTTATGQKLYVQPSQYEKVASILENKLGMKKNLVLKQLNQKKLFQVSFGSSGSGLSYTKMADIKKTMEKSDIKGIGFSTSPGRIYPNGIFASQFIGFTLPQDDGDGKKLVGNTGLEAALNKVLSGTDGKVTYEKDRSGNVLLGTATTERRAVNGKDIYTTLSEPIQTVLETQMDVFAEKTKGKFASATVVNAKTGEILATSQRPTYNPSTLKGYDKKNLGTYNTLLYDNFFEPGSTMKVMTLASAIDSKHFNSTEVYNSAQYKIADAIIRDWDVNEGLSSGSYMTFPQGFAHSSNVGMVTLEQKMGRDKWLNYLSKFKFGYPTRFGMLHESGGLFPSDNEVTIAMSSFGQGIGVTQVQMLRAFTSISNDGVMLQPQFISSIYDPNTGTSRTARKEVVGKPVSKEAASKTRDYMVTVGTDPYYGTLYAAGAPVIQVGNQSVAVKSGTAQIAQEGGGGYLQGKNDTINSVVAMVPSENPDFIMYVTIQQPEKFSITFWKDVVNPVLEQATAMKETILKPGLNDSEHQTKYKLSKIVGENPGHVAEELRRNLVQPIILGNGSKVSKVSKRPGANLAENEQLLVLTNKLTELPDMYGWSKANVEQFAKWTGIKVTYKGSTSGKVRKQSIDVGKSINKIKKIKITIGD

SEQ ID NO: 8693 - DNA, 813 bp, Streptococcus agalactiae
atgtttaaaaaaataatattatctattgcaactatagccgcaaccgccagcctagcagtatcagttcaggcgtcagagaaagtagaacttaaagtagctacagattctgacacggcaccatttacttatcaaaaagacgggaaattcaaaggttatgatgttgatgttgtcaaagctgtttttaaaggtagtaagtacaaagtaaccttcaagacagttccttttgatactatttcaacaggtattgatgcagggaaatttgatttatcagctaatgatttttcatacaataaagaaagagcagaaaaatatctcttctcagatcctwtatcccgttcaaattatgccgtagtagggaagaaggggagccattacaaatcattaagtgacctctctggaaaatcaaccgaagttttatctggcgttaactatgcacaggttctagaaaattggaataaaaatcatcctaataaaaaaccaataaaaatcaaatatgtttctgggacaactggtgttactagcagattaaaaaatattgagagtgggaaaattgactttatcctatatgatgccatttcatccgactatattgtaaaagaccaatcattaaacttaagcgtttctcctttgaaaggtaaaattggtaataataaggatggactagaatacctccttttaccaaaagataaaaaaggtaaaactctacagaaatttataaataagcgtattaaagttttgaaagaaaatggtactttggcacgtttaagtaaacaatatttcggtggagattacgtttcaaacattgataaataa

SEQ ID NO: 8694 - protein, 270 aa, Streptococcus agalactiae
  MISC_FEATURE (1)..(270): Xaa = Any Amino Acid
MFKKIILSIATIAATASLAVSVQASEKVELKVATDSDTAPFTYQKDGKFKGYDVDVVKAVFKGSKYKVTFKTVPFDTISTGIDAGKFDLSANDFSYNKERAEKYLFSDPXSRSNYAVVGKKGSHYKSLSDLSGKSTEVLSGVNYAQVLENWNKNHPNKKPIKIKYVSGTTGVTSRLKNIESGKIDFILYDAISSDYIVKDQSLNLSVSPLKGKIGNNKDGLEYLLLPKDKKGKTLQKFINKRIKVLKENGTLARLSKQYFGGDYVSNIDK

SEQ ID NO: 8695 - DNA, 2250 bp, Streptococcus agalactiae; identical to SEQ ID NO: 2947

SEQ ID NO: 8696 - protein, 750 aa, Streptococcus agalactiae
VITIKKESVIKLLKYAFGIIMGFIILAIVIGGLLFAYYVSRSPKLTDQALKSVNSSLVYDGNNKLIADLGSEKRESVSADSIPLNLVNAITSIEDKRFFKHRGVDIYRILGAAWHNLVSSNTQGGSTLDQQLIKLAYFSTNKSDQTLKRKSQEVWLALQMERKYTKEEILTFYINKVYMGNGNYGMRTTAKSYFGKDLKELSIAQLALLAGIPQAPTQYDPYKNPESAQTRRNTVLQQMYQDKNISKKEYDQAVATPVTDGLKELKQKSTYPKYMDNYLKQVISEVKQKTGKDIFTAGLKVYTNINTDAQKQLYDIYNSDTYIAYPNNELQIASTIMDATNGKVIAQLGGRHQNENISFGTNQSVLTDRDWGSTMKPISAYAPAIDSGVYNSTGQSLNDSVYYWPGTSTQLYDWDRQYMGWMSMQTAIQQSRNVPAVRALEAAGLDEAKSFLEKLGIYYPEMNYSNAISSNNSSSDAKYGASSEKMAAAYSAFANGGTYYKPQYVNKIEFSDGTNDTYAASGSRAMKETTAYMMTDMLKTVLTFGTGTKAAIPGVAQAGKTGTSNYTEDELAKIEATTGIYNSAVGTMAPDENFVGYTSKYTMAIWTGYKNRLTPLYGSQLDIATEVYRAMMSYLTGGYSADWTMPEGLYRSGSYLYINGTTTTGTYSSSVYKNIYQNSGQSSQSSSSTSSEKQKEDKNTANDANSSSPQVETPNNGNATTPNNSNQTVPGTGHGNGNGNGNNNTVPNGN

SEQ ID NO: 8697 - DNA, 690 bp, Streptococcus agalactiae
atggcaaaagatataattaaggttgatcatatatttaaaagcatcgggcaaaaaacgattttagaagatatatcatttagtatagcttctaaccaatgtgtagcattgattggacctaatggtgcagggaaaacaactctgatgtcaactttgttaggtgatattagtatttcttcaggatcattgacgatttttaatctgcctgcacaccacaataggttaaaatataaggtggccatcttaccacaagaaaatgtattgccctcaaagtttacagtgagagaactcattgatttccaaaggtgtttatttccagaagtgctgccaatgtctctgattttagactatctacagtggagtgatacgcacttgcaacaatttacagagactttatctggagggcaaaaacgacttttagcttttgttttaactttggttggtaagccccaattactatttttagatgaacctacttccggaatggatacttccacacgtcaacgattttgggagctgattgcgacactaaaaaaagaaggtgtcacaattgtctattctagtcattatatcgaagaggtagaacatacagctgataggattttagtacttcataaaggaaagttattacgcgatacaacccccctttgccatgaagcaagaaaaaaccgaaaagttattcaccgttccgct

SEQ ID NO: 8698 - protein, 230 aa, Streptococcus agalactiae
MAKDIIKVDHIFKSIGQKTILEDISFSIASNQCVALIGPNGAGKTTLMSTLLGDISISSGSLTIFNLPAHHNRLKYKVAILPQENVLPSKFTVRELIDFQRCLFPEVLPMSLILDYLQWSDTHLQQFTETLSGGQKRLLAFVLTLVGKPQLLFLDEPTSGMDTSTRQRFWELIATLKKEGVTIVYSSHYIEEVEHTADRILVLHKGKLLRDTTPLCHEARKNRKVIHRSA

SEQ ID NO: 8699 - DNA, 1083 bp, Streptococcus agalactiae; identical to SEQ ID NO: 2989

SEQ ID NO: 8700 - protein, 361 aa, Streptococcus agalactiae
LKNKKNNYDLMYFIPLVFLIYPIGGILYYHYPFWTLFFTLAFVGAYLYSVIIRGESKYHMIAWSTMLTYIFYMTIFINSGFIWYIYFLSNLLVYRFRDKLKSFRFISFACTLATVVFLCFFKASDFGDRIMFLIVPIFCIGYMWIAIENRNSEEQREKIAEQNQYINILSAENERNRIGRDLHDSLGHTFAMMTLKTELALKLLEKRNYDKVQKELSELNHISHQSMSEVRQIVSNLKYRTVVEEIDELYRLFQLSNIKLTVVNKLETSQLSPVTQSTITMILKELSNNIVKHAEADSVELSLVRQGATINIEMIDNGCGFTNLDGDELHSIQERLTIVEGTLTILSRSKPTHIQVVLKEV

SEQ ID NO: 8701 - DNA, 1020 bp, Streptococcus agalactiae
atgaaaaagcaccactactttttagctttcttctatggaagtgtcattatatttgccatttgttttgtcattattgatagtttgggtgttaatttggtgcacctctatcaaacgtctcgtttgtggctgattgaacaattgattttctctattttctttctatctttagcggtaactatccttttattgctaacttggtttttattagatgataatagtaaacgtcaaattaaccataatttacgtcgcattttaaataaccaatcaataaatgttaccgatgatggtactgaaatatcgaccaatattcaacggctctctaaaaaaatgaatttaatgacagcaagtctacaatctaaggaaaatagtcgtattttaaaaagccaagaaattgtgaaacaagaacgtaagcgtattgcacgtgatttacacgacacagttagtcaggatttgttcgctgcttccatggttttgtcagggatagcacagaatgtttctcagctagacgttgatcaggttggctcgcaattattagcagtagaagaaatgcttcagcatgcacaaaatgatttgagaattctgctacttcatttgaggccagttgaattagaaaataagaccctatctgaaggattcagaatgatattgaaagaattgaccgataagagcgacattgaagttgtttatcatgaatcaattctaaccttacccaaaaagattgaagacaatatttttagaattggtcaagaatttatcagtaatactttaaagcattcacaagccagtcgtctcgaagtttaccttaatcaaacagagaatgaattgcagttaaaaatgattgataatggtattggatttgatatggattctgtctatgatttaagttatgggttaaaaaatattgragatcgagtagaagatttagcaggaaatttacagcttctcagtcagcctggtaaaggagttgctatggatataagattacctttagtaaatcagagtgaggataaaaatggataa

SEQ ID NO: 8702 - protein, 339 aa, Streptococcus agalactiae
  MISC_FEATURE (1)..(339): Xaa = Any Amino Acid
MKKHHYFLAFFYGSVIIFAICFVIIDSLGVNLVHLYQTSRLWLIEQLIFSIFFLSLAVTILLLLTWFLLDDNSKRQINHNLRRILNNQSINVTDDGTEISTNIQRLSKKMNLMTASLQSKENSRILKSQEIVKQERKRIARDLHDTVSQDLFAASMVLSGIAQNVSQLDVDQVGSQLLAVEEMLQHAQNDLRILLLHLRPVELENKTLSEGFRMILKELTDKSDIEVVYHESILTLPKKIEDNIFRIGQEFISNTLKHSQASRLEVYLNQTENELQLKMIDNGIGFDMDSVYDLSYGLKNIXDRVEDLAGNLQLLSQPGKGVAMDIRLPLVNQSEDKNG

SEQ ID NO: 8703 - DNA, 702 bp, Streptococcus agalactiae
atgactaaatttattgttgattcatcgtactggaatttgtttccaacttctaaaattggagtaatcttaatcaaagattatcacatggacagaaaccttgaaacagaacttaaacagttactgtctgatagtcattctttagcaaaaaaatatttgcaagagaaagaattcagtcaaaacagagttatccaaacttatcgcaaagcatatcaaacctttaaaactaaaaaaggtgcacgttcaagtatcgaagcattattgaagcgagttaattcaggaaacgaaattactagtataaatcctctagttgatatctataatgccgctagccttaggtttggattacctattggtgctgaggatagtgatacatttagaggtgatttaaaactaactattaccaatggtggtgatgaattttacttgattggcgaagattttaacagaccaactctttcaggtgagcttgcctatgttgatgatgttggagcagtttgccgctgttttaattggcgtgatggaaaacgtactatgattaccgataatactcagaatgcttttttagttatcgaattaattgataatggaagagaaattatttttaaagaagcgttggactttatcgccaccaatacaaatcgttttctaaaagctaaaacacagaccatcatattagataaagaacacagtgaaataacgcta

SEQ ID NO: 8704 - protein, 234 aa, Streptococcus agalactiae
MTKFIVDSSYWNLFPTSKIGVILIKDYHMDRNLETELKQLLSDSHSLAKKYLQEKEFSQNRVIQTYRKAYQTFKTKKGARSSIEALLKRVNSGNEITSINPLVDIYNAASLRFGLPIGAEDSDTFRGDLKLTITNGGDEFYLIGEDFNRPTLSGELAYVDDVGAVCRCFNWRDGKRTMITDNTQNAFLVIELIDNGREIIFKEALDFIATNTNRFLKAKTQTIILDKEHSEITL

SEQ ID NO: 8705 - DNA, 540 bp, Streptococcus agalactiae
atgatgaagaaagaaaatattccgaatctattaactgtagtcagaattttaatgattccgttatttatagtattaacttcagtaacaacaagtacaacttggcatattgttgcagctattgtatttgctattgcaagtttgaccgattacctagatggttatctagcacgtaaatggcaagtagtaacaaattttgggaaatttgcagacccattagctgataaaatgctagttatgagtgcttttatcatgttagttggactagacttagcaccagcttgggtttcagctattatcatttgtagagagttagcagttacaggtttgcgtttacttttagttgaaacaggtggaacagtacttgctgcagctatgccagggaaaataaagacggctactcaaatgtttgcagttatttttttgttagtacattggatgacacttggtaacatcatgttatacattgctctattctttaccttgtattcaggctacgactattttaaaggtgcaggcttcttatttaaggatacttttaaa

SEQ ID NO: 8706 - protein, 180 aa, Streptococcus agalactiae
MMKKENIPNLLTVVRILMIPLFIVLTSVTTSTTWHIVAAIVFAIASLTDYLDGYLARKWQVVTNFGKFADPLADKMLVMSAFIMLVGLDLAPAWVSAIIICRELAVTGLRLLLVETGGTVLAAAMPGKIKTATQMFAVIFLLVHWMTLGNIMLYIALFFTLYSGYDYFKGAGFLFKDTFK

SEQ ID NO: 8707 - DNA, 792 bp, Streptococcus agalactiae
atggataaattgattttgggacgttacataccaggtaattctctcattcataaattagatcctcgaagtaagttactagccatgttgctttttatcattattgttttttgggcaaataatgtagtgacaaatgtgatcgtattcatttttacgttggttattgtgggtttatctcagataaaattttcctattttttcaatggtattaaaccgatggttggtattattttatttacaaccctcttccagatgctgtttgcacaaggcgggcaggttatcttctcgttttggatttttagcatcactagccttgggttacaacaagcagcacttatttttatgagatttgttttaattatcttcttttcgacattacttaccttaactactactccgttaagtttagcagatgctgttgaatctttgttaaaaccattggaagtactgagagtaccagcacacgagattggtttgatgttatcccttagcttacgtttcgttcctactttaatggatgatacaacacgtatcatgaatgctcaaagagctcgtggagttgattttggagagggaaacctaattcataaggttaagtctattatccctattttgattccattatttgcttctagttttaaaagagcagatgcgttggcaattgctatggaagcaagaggttatcaaggcggagccaatcgtagtaagtaccgtttattgaagtggactgttcgggatacttttagtatattacttatgttattattgggtttgagtttgtttctattaaaaaat

SEQ ID NO: 8708 - protein, 264 aa, Streptococcus agalactiae
MDKLILGRYIPGNSLIHKLDPRSKLLAMLLFIIIVFWANNVVTNVIVFIFTLVIVGLSQIKFSYFFNGIKPMVGIILFTTLFQMLFAQGGQVIFSFWIFSITSLGLQQAALIFMRFVLIIFFSTLLTLTTTPLSLADAVESLLKPLEVLRVPAHEIGLMLSLSLRFVPTLMDDTTRIMNAQRARGVDFGEGNLIHKVKSIIPILIPLFASSFKRADALAIAMEARGYQGGANRSKYRLLKWTVRDTFSILLMLLLGLSLFLLKN

SEQ ID NO: 8709 - DNA, 540 bp, Streptococcus agalactiae
atgtcaataacctcggttaaaaaatcaaaaccatttaaattaggagtggcaggtcttttagtgggtgcttcattagctttaccactttcagtaagcgcagcatcttataccgtgaaatcaggtgataccttatcagctattgctaaaaatcataaaactacggtacaagagttagtgtctctcaatagtatcagtaacgctgatgtcatcagtataggtgatgttttaaaattggataattctacagctagtcaagcagaagcaaaatctcaaccaacaattgaaaattcaatgaattcttcatcaaatttgagttcaagtgattcagccgcaaaagaagaaatagctcgtcgtgaatcaaatggtagttatactgcacagaatggacaatattatggaagatatcaactgtctcaatcttacctaaatggcgacttatctcctgaaaatcaagaaaaagtagcggacaattatgtggtttctcgttacggatcttggtcggcagcgctatcattttggaatagtaacggctggtattaa

SEQ ID NO: 8710 - protein, 179 aa, Streptococcus agalactiae; identical to SEQ ID NO: 4

SEQ ID NO: 8711 - DNA, 354 bp, Streptococcus agalactiae
atgtcaataacctcggttaaaaaatcaaaaccatttaaattaggagtggcaggtcttttagtgggtgcttcattagctttaccactttcagtaagcgcagcatcttataccgtgaaatcaggtgataccttatcagctattgctaaaaatcataaaactacggtacaagagttagtgtctctcaatagtatcagtaacgctgatgtcatcagtataggtgatgttttaaaattggataattctacagctagtcaagcagaagcaaaatctcaaccaacaattgaaaattcaatgaattcttcatcaaatttgagttcaagtgattcagccgcaaaagaagaaatagcttcgtcg

SEQ ID NO: 8712 - protein, 118 aa, Streptococcus agalactiae
MSITSVKKSKPFKLGVAGLLVGASLALPLSVSAASYTVKSGDTLSAIAKNHKTTVQELVSLNSISNADVISIGDVLKLDNSTASQAEAKSQPTIENSMNSSSNLSSSDSAAKEEIASS

SEQ ID NO: 8713 - DNA, 705 bp, Streptococcus agalactiae
atgaataaaagaagaaaattatcaaaattgaatgtaaaaaaacatcatttagcttatggagctatcactttagtagcccttttttcatgtattttggctgtaatggtcatctttaaaagttcacaagttactactgaatctttgtcaaaagcagataaagttcgcgtagccaaaaaatcaaaaatgactaaggcgacatctaaatcaaaagtagaagatgtaaaacaggctccaaaaccttctcaggcatctaatgaagccccaaaatcaagttctcaatctacagaagctaattctcagcaacaagttactgcgagtgaagaggcagctgtagaacaagcagttgtaacagaaaacacccctgctaccagtcaggcacaacaagcttatgctgttactgagacaacttatagacctgctcaacaccagacgagtggccaagtattgagtaatggaaatactgcaggggctattggctcagcagctgcagcacaaatggctgctgcaacaggagtccctcagtctacttgggaacatattattgcccgtgaatcaaatggtaatcctaatgttgctaatgcctcaggagcttcaggacttttccaaacgatgccaggttggggttcaacagctacagttcaggatcaagttaattcagctattaaagcttatcgtgctcaaggtttatcagcttggggttactag

SEQ ID NO: 8714 - protein, 234 aa, Streptococcus agalactiae; identical to SEQ ID NO: 3180

SEQ ID NO: 8715 - DNA, 609 bp, Streptococcus agalactiae
atgatttcaaaatttattttagctttcatggcttttttcgccattatgaatcccatttctaatttgccagcttttatggctttagtagctgatgatgatcagaagatttcacgtcggattgcagcaaaaggagtattacttgcttttgtcattattgtaatctttgtattaagtggccacttactttttaacttatttgggattaccctagccgccctaaaaatatctggtggaatattggtaggcattataggttataaaatgattaatggtatacattcaccaaccaataaaaacctagaggagcataaggatgatccaatgaatgtggcagtttcaccattagcaatgccccttttggcaggtccgggtactattgcaactgctatggggttatcaagtggtggtttatctggcaaactcattactatacttgcttttgccatattatgtgtgataatgtatgttattttaataagtgcaaacgaaattactaaatttcttggaaaaaatgcaatgactataatcaccaaaatgatgggacttattttgatgactatcgggatagagatgctaataacaggcataaaaattggttttcatttwaca

SEQ ID NO: 8716 - protein, 203 aa, Streptococcus agalactiae
  MISC_FEATURE (1)..(203): Xaa = Any Amino Acid
MISKFILAFMAFFAIMNPISNLPAFMALVADDDQKISRRIAAKGVLLAFVIIVIFVLSGHLLFNLFGITLAALKISGGILVGIIGYKMINGIHSPTNKNLEEHKDDPMNVAVSPLAMPLLAGPGTIATAMGLSSGGLSGKLITILAFAILCVIMYVILISANEITKFLGKNAMTIITKMMGLILMTIGIEMLITGIKIGFHXT

SEQ ID NO: 8717 - DNA, 1983 bp, Streptococcus agalactiae
atgaaaagatttcgttttgcaaccgtccatttagttttaataggcctgattttatttggactattagctatttgtgttaggttatttcaatcctatacggctctattattggctatttttgttgctttatcttttgttgttgccttattatattaccaaaagataacttatgaactatctgaagttgaacaaattgaattacttaatgatcaaacagaagtttctcttaagagtcttcttgaacaaatgccagttggtgttatacaatttgatcttgaaacaaatgatattgagtggtttaacccttatgcagaattgatttttactggggataatggtcattttcagtctgctactgttaaagatatcattactagtagacgtaatggaacggctgggcaatcatttgaatacggtgataacaaatattcagcttatttggatacagagacgggtgttttctatttcttcgataatttcatggggaatagaagaaactatgatagttcaatgctacgtccagttattggtattatttccattgataactacgatgatattatggatactatgttagaggctgatatgtcaaagattaacgccytcgtgactagttttawttctgattttacacagtctaaaaatattttttatcgtcgtgtcaatatggatcgatactatatttttaccgactatagcgttttaaatacattgataaaagataaatttgatattttaaatgagtttcgaaaacgcgctcaggaaaaccatttatcattaacattaagtatgggaatttcttatggtgatggtaaccataatcaaattgggcaaattgctttagaaaatcttaatacagcactcgttcgcggaggagatcaaatagtagtacgtgaaaatgatagtagtaaaaaagcactttactttggtggtggtgctgtttcaactattaaacgttcacgaacacgtaccagagctatgatgactgctatttctgaccgtttgaaagtagttgatagtgtctttattgtgggacacaggaaattggacatggatgcactaggtgcatctgtagggatgcaattttttgctagtaatattgttaatgccagttatgtagtttatgacccaaatgacatgaattctgatattgaaagagcaattgattacttgcaagaagacggcgaaacacgtctcgtaagtgttgagagagcttttgaattaattactcaaaattctttattagtcatggtagaccattctaaaacagctttaaccttatctaaggaattctttaacaagtttgcagatgttattgtggtagatcatcatagaagagatgaagattttccaaaaaatgctgttctttcatttatagaaagtggcgcaagtagtgccagcgaattagttacagaattgattcaatttcaacaagctaaagataaattaagccgcagtcaagcaagtattttaatggctggtatcatgcttgatacaagaaattttgcatctaatgtaacgagtagaacttttgatgtggcaagctatttacgcggtttaggtagtaatagtatggctattcaaaaaatatcagctacagattttgatgaatatcgtttaattaatgaattgattttaaaaggtgagcgtatttatgataacatcattgttgctaccggagaagaacataaagtttactcgcatgttatagctagtaaagcagctgacaccatgttgacaatggcaggtattgaggctacttttgttattactaaaaacagttcaaatattggtatttcagcgcgcagtagaaataatatcaatgtccagcgtattatggaaaaacttggtggtggcggacattttagttttgctgcttgtcaaatacaagacaagtctgtaaagcaagttagacgtatgttactggaaataattgacgaagatttaagagaaaatagtacagtcgaaaatagaagggattaa

SEQ ID NO: 8718 - protein, 660 aa, Streptococcus agalactiae
  MISC_FEATURE (1)..(660): Xaa = Any Amino Acid
MKRFRFATVHLVLIGLILFGLLAICVRLFQSYTALLLAIFVALSFVVALLYYQKITYELSEVEQIELLNDQTEVSLKSLLEQMPVGVIQFDLETNDIEWFNPYAELIFTGDNGHFQSATVKDIITSRRNGTAGQSFEYGDNKYSAYLDTETGVFYFFDNFMGNRRNYDSSMLRPVIGIISIDNYDDIMDTMLEADMSKINAXVTSFXSDFTQSKNIFYRRVNMDRYYIFTDYSVLNTLIKDKFDILNEFRKRAQENHLSLTLSMGISYGDGNHNQIGQIALENLNTALVRGGDQIVVRENDSSKKALYFGGGAVSTIKRSRTRTRAMMTAISDRLKVVDSVFIVGHRKLDMDALGASVGMQFFASNIVNASYVVYDPNDMNSDIERAIDYLQEDGETRLVSVERAFELITQNSLLVMVDHSKTALTLSKEFFNKFADVIVVDHHRRDEDFPKNAVLSFIESGASSASELVTELIQFQQAKDKLSRSQASILMAGIMLDTRNFASNVTSRTFDVASYLRGLGSNSMAIQKISATDFDEYRLINELILKGERIYDNIIVATGEEHKVYSHVIASKAADTMLTMAGIEATFVITKNSSNIGISARSRNNINVQRIMEKLGGGGHFSFAACQIQDKSVKQVRRMLLEIIDEDLRENSTVENRRD

SEQ ID NO: 8719 - DNA, 381 bp, Streptococcus agalactiae
atgtcaaagtatttaggaggagaagatatgtctactttaacaataattattgcaacattaactgctttggaacatttttatattatgtatttggagacgttagccacccagtcaaatatgactgggaagatttttagtatgtctaaagaagagttgtcatatttacccgttattaaactttttaagaatcaaggtgtatacaacggcttgattggcctattcctcctttatgggttatatatttcacagaatcaagaaattgtagctgtttttttaatcaatgtattgctagttgctatttatggtgctttgacagttgataaaaaaatcttattaaaacagggtggtttacctatattagctcttttaacattcttattt

SEQ ID NO: 8720 - protein, 127 aa, Streptococcus agalactiae
MSKYLGGEDMSTLTIIIATLTALEHFYIMYLETLATQSNMTGKIFSMSKEELSYLPVIKLFKNQGVYNGLIGLFLLYGLYISQNQEIVAVFLINVLLVAIYGALTVDKKILLKQGGLPILALLTFLF

SEQ ID NO: 8721 - DNA, 2541 bp, Streptococcus agalactiae; identical to SEQ ID NO: 3235

SEQ ID NO: 8722 - protein, 847 aa, Streptococcus agalactiae
LLKKLIEKVKSLTSVIKIVFFISVLVLIIVEMIHLKRTISVEQLKSVFGQLSPMNLFLIILVGVIAVLPTTGYDFVLNGLLRTDKSKRYILQTSWCINTFNNLSGFGGLIDIGLRMAFYGKKGQEKSDLREVTRFLPYLISGLSFISVIALIMSHIFHAKASVDYYYLVLIGASMYFPVIYWISGHKGSHYFGDMPSSTRIKLGVVSFFEWGCAAAAFIIIGYLMGIHLPVYKILPLFCIGCAVGIVSLIPGGLGSFELVLFTGFAAEGLPKETVVAWLLLYRLAYYIIPFFAGIYFFIHYLGSQINQRYENVPKELVSTVLQTMVSHLMRILGAFLIFSTAFFENITYIMWLQKLGLDPLQEQMLWQFPGLLLGVCFILLARTIDQKVKNAFPIAIIWITLTLFYLNLGHISWRLSFWFILLLLGLLVIKPTLYKKQFIYSWEERIKDGIIIVSLMGVLFYIAGLLFPIRAHITGGSIERLHYIIAWEPIALATLILTLVYLCLVKILQGKSCQIGDVFNVDRYKKLLQAYGGSSDSGLAFLNDKRLYWYQKNGEDCVAFQFVIVNNKCLIMGEPAGDDTYIREAIESFIDDADKLDYDLVFYSIGQKLTLLLHEYGFDFMKVGEDALVNLETFTLKGNKYKPFRNALNRVEKDGFYFEVVQSPHSQELLNSLEEISNTWLEGRPEKGFSLGYFNKDYFQQAPIALVKNAEHEVVAFANIMPNYEKSIISIDLMRHDKQKIPNGVMDFLFLSLFSYYQEKGYHYFDLGMAPLSGVGRVETSFAKERMAYLVYHFGSHFYSFNGLHKYKKKFTPLWSERYISCSRSSWLICAICALLMEDSKIKIVK

SEQ ID NO: 8723 - DNA, 831 bp, Streptococcus agalactiae; identical to SEQ ID NO: 3241

SEQ ID NO: 8724 - protein, 277 aa, Streptococcus agalactiae
VKFYIIDDDPTITMILQDIIEEDFNNTVVRVNNVSSKAYNELLIADVDIVLIDLLMPILDGVTLVQKIYKQRSDLKFIMISQVKDNDLRQEAYKAGIEFFINKPINIIEVKSVVKRVTDTIEMQKKLNTIQNLLENTPSYQKPITTSNLTKIRSILSYLGITSETAYTDILNICELLLKQELNFAQFDFQKELSIDEHQQKIILQRIRRAVKKAMINMAHLYIDDFENELTLQYANALFGFQNIHNEAQLIQGKSMYGGKISLKHFFDELILQSKTF

SEQ ID NO: 8725 - DNA, 1230 bp, Streptococcus agalactiae
gtgaaagagttttttgctttgccaaaacagctacagttaagagaattattgcgttttatttccattacggttggttcagctatttttccttttatggcaatgtattatgttcaatattttggaaatctagttacaggaatcttgatcatcataactcaactatcagggtttgtagcgaccttatatggaggccatttgtcagatgctatggggaggaaaaaagttgtgattataggttcactgctggcaaccattggttgggctataactatagctgcaaatgttccaaatcatattacgccacacttgacctttgtaggtatccttatcattgaaatagctcaccaattttatttccctgcctatgaagctatgaccattgatttgacgaacgaacagaatcgtcgctttgtttacactataggttattggttggttaacatcgctgtaatgctaggttctggaattgctgggattttctatgatcaccatttttttgaattattaatagttcttcttattatttcagcgatttgttgtttcgtggtctacttcaagtttgatgagacaaaaccacaggagggaaccttcaagcatgataaaggagttttaggaacttttaaaaattatagtcaggttttagtggataaagcgtttgttgtttatactttaggagcaattggttccagtgttgtctggctccaggttgataattatttctcggtcaatcttaagcaaaattttgaagtagtgtccattttaggacatacaatcacaggtgctaaaatgcttagtttagcagtctttacaaacactctattaattgtcttactaatgacaactataaataaattcatagagaattggcctttgaaacgtcaactaatattagggagcttgatttgtggttttggaatgctttttaatatttctctaaacacttttggagctattttgattgccatgacgtttttcacctttggcgaaatgatttatgttccagctagtcaggttctaagggcggagatgatggtggagggaaaaattggatcatattctggatttttagctatcgcacaacctgttgcaagtgtattagcaggtgccatggtttcgctcagctattttacaggaaaaataggtgttcaaataacattgaccatttttatgttagcaggtctggttttaatcttatatgctaccaaaatgaaaaatattgagataggaaaa

SEQ ID NO: 8726 - protein, 410 aa, Streptococcus agalactiae
VKEFFALPKQLQLRELLRFISITVGSAIFPFMAMYYVQYFGNLVTGILIIITQLSGFVATLYGGHLSDAMGRKKVVIIGSLLATIGWAITIAANVPNHITPHLTFVGILIIEIAHQFYFPAYEAMTIDLTNEQNRRFVYTIGYWLVNIAVMLGSGIAGIFYDHHFFELLIVLLIISAICCFVVYFKFDETKPQEGTFKHDKGVLGTFKNYSQVLVDKAFVVYTLGAIGSSVVWLQVDNYFSVNLKQNFEVVSILGHTITGAKMLSLAVFTNTLLIVLLMTTINKFIENWPLKRQLILGSLICGFGMLFNISLNTFGAILIAMTFFTFGEMIYVPASQVLRAEMMVEGKIGSYSGFLAIAQPVASVLAGAMVSLSYFTGKIGVQITLTIFMLAGLVLILYATKMKNIEIGK

SEQ ID NO: 8727 - DNA, 1134 bp, Streptococcus agalactiae
atgacgttgattttctatataatgaatattgtcttaggattcggtggtatgtacccaatacagtgggcattaccttttatgctcatttcgctatggtttttaattaaattttgtgtcgataatatcgttgatgaagcatttatattttatggcattttagcagcattctcactatttatagatccccaaacactgattttttggctttgctcttttgttctcttaacagcaaccaatattaagcaaaagcagtcactacgaggattttatcagtttttatgcgttgtttttggtatgattttaattgcttatactgttggttactttatgtttaatctacagattatctcttcttatattgacaaagctattttttacccctttacgtatttcgctaggacaaaccactcattccttcttagtttagcaattcaaattgttgtccttctagggtcaggttgtctctttggactatgggattttattcaaaatcgtaaaaaagcatcttatcaaatcggcttgaactttattgcctgtatttttattatttacgctataatggccattttttcaagagattttaacctttaccactttttacctgctttaccatttggtcttttgctaacgagtaataaaattactattctttaccaaaaagtgattgacagacgttcacatagacgtcagtatttctctggtaaatctcttatcgtagacctttttgtaaagaaaacatattatttgcccctcttactagtttccttatcgatagggttactagtttataatacttatcaaaatgttactcttagtaaagaaaggcgtgacatttcacattatttgactacaaaaattgatagagatggtaagatttatgtttgggacaaagttgctagcatttatagccagactcggttaaaatctgcttctcaatttgttttgccacatattaatacagcgcaaaaaaataatgagaaaattttgaaggacgagctgcttcagcatggggctaaatactttatcttaaataaaaatgagaagttaccaaatgaactgaaatctgatattaagaagcactaccaagaagttcctctatcaaatatcactcattttgttctatatcgtttcaaa

SEQ ID NO: 8728 - protein, 378 aa, Streptococcus agalactiae
MTLIFYIMNIVLGFGGMYPIQWALPFMLISLWFLIKFCVDNIVDEAFIFYGILAAFSLFIDPQTLIFWLCSFVLLTATNIKQKQSLRGFYQFLCVVFGMILIAYTVGYFMFNLQIISSYIDKAIFYPFTYFARTNHSFLLSLAIQIVVLLGSGCLFGLWDFIQNRKKASYQIGLNFIACIFIIYAIMAIFSRDFNLYHFLPALPFGLLLTSNKITILYQKVIDRRSHRRQYFSGKSLIVDLFVKKTYYLPLLLVSLSIGLLVYNTYQNVTLSKERRDISHYLTTKIDRDGKIYVWDKVASIYSQTRLKSASQFVLPHINTAQKNNEKILKDELLQHGAKYFILNKNEKLPNELKSDIKKHYQEVPLSNITHFVLYRFK

SEQ ID NO: 8729 - DNA, 609 bp, Streptococcus agalactiae
atgaaagtaaaactatttgcgatacatctattttttattgttatttcttttgggattaaatattatcatttgcagggaccaaatttgatttggaatatgactctagccctaatagcgttagattttgcataccttactagtttatttaagaaaaaaattcttatcggtctttttgcacttgcttggttttttttctatcctaataccttttatatgttgacggatatcattcatatgcattttgtcggagacgttctttataataagacaaatttaatactttatatcttgtatgtatctagtatcttgtttggttttttatcaggtatcgaaagtttttctgtgattatgcgtaaatttagaattagcaatatatttttaagatggggaattattggaattgtatcattagtttcaagttttggtattcatattggtcgttatgcccgtctaaattcatgggatatcttaacgaagccacaagtggtaattaacgaacttttagcggttccgagtagggattcattccactttattttaggatttacatttttacaggtattgtgtcttatttttatggattattctgcagggaaaaagcttgaaaag

SEQ ID NO: 8730 - protein, 203 aa, Streptococcus agalactiae
MKVKLFAIHLFFIVISFGIKYYHLQGPNLIWNMTLALIALDFAYLTSLFKKKILIGLFALAWFFFYPNTFYMLTDIIHMHFVGDVLYNKTNLILYILYVSSILFGFLSGIESFSVIMRKFRISNIFLRWGIIGIVSLVSSFGIHIGRYARLNSWDILTKPQVVINELLAVPSRDSFHFILGFTFLQVLCLIFMDYSAGKKLEK

SEQ ID NO: 8731 - DNA, 1002 bp, Streptococcus agalactiae; identical to SEQ ID NO: 3495

SEQ ID NO: 8732 - protein, 334 aa, Streptococcus agalactiae
LKPSFKKLLLLFSIITILSIACTPHAKASGRSWKSWFIEQYFWLKRDKSYYKVQDESSFQKYLNASREQSDKGYYLDPNSVNGGLVQERLFDMQVYSWNDNGKANQKTIFYLAGGSYLNNPTPYHISMLKTLSTSLDAKIILPIYPKTPRYTYDYAIPRLVNLYRHFHEKNANLTLMGDSAGGGLALGLAHALSHQSGQEAIPQPKNIILLSPWLDVTMKHPEIPKYEDTDPILSAWGLARVGEIWANGSNNTNHTYVSPKNAPATKLAPITLFTGTREIFFPDIRDYAAQLQAANHPVNYIAQEGMNHVYPIYPIEEAKTAQYQMIDIINKTP

SEQ ID NO: 8733 - DNA, 612 bp, Streptococcus agalactiae
atgtcaattgatatttggaacattttaagtttggttggaaccgtagcttttgcaagttcgggagctattgtggcgattgaggaagaatttgatattctagggctttttatcttaggttttgtaacggcatttggtggtggagctattagaaatgtactaattggcttgcctattgaaacactttggagtcaaggaattgctttttatgcagcagcagcagctattttatttattatgattttccctaatttgttgagtggtaagggacgggatgccgaagttgtatcagatgctattgggttagcagcgtttagtgttcaaggagcactatatgcgactcaatctcatcaacctcttagtgctgtcattgtcgcagcagtactaactggtgcaggtggtggtattgtcagagatgttctggctggccgaaaacctggagtactaagaagtgaaatatatgcaggttggtcaatattagtggggatcattttatattttaaaattgctaaaacaacaactgactattatttgttagtgttagttgtaactagcctaaggatgttgggttataagaaacaatggcacttgccagttgtcagaccacgtaagaaa

SEQ ID NO: 8734 - protein, 204 aa, Streptococcus agalactiae
MSIDIWNILSLVGTVAFASSGAIVAIEEEFDILGLFILGFVTAFGGGAIRNVLIGLPIETLWSQGIAFYAAAAAILFIMIFPNLLSGKGRDAEVVSDAIGLAAFSVQGALYATQSHQPLSAVIVAAVLTGAGGGIVRDVLAGRKPGVLRSEIYAGWSILVGIILYFKIAKTTTDYYLLVLVVTSLRMLGYKKQWHLPVVRPRKK

SEQ ID NO: 8735 - DNA, 1566 bp, Streptococcus agalactiae
atgaaaatatcacaatacaataaatggtcaattcgccgattgaaagttggagctgcatctgtaatgattgctagtggaagcattgttgctttagggcaatctcatattgtttcagcagatgagatgtcccaacctaaaacaaccattacagctccaacagctaacacttctacaaatgtagaaagtagtactgataaggcattatcaaaagttactacgatggagacaagttcagaaatgcctaaaatgcaaaatatggcaaaagttgaaaaaacgagtgacaaacctatgatggtggctacctctgttagaaaaatgatggcaacgccgacacctgtagcgatgaccaaaacgactagtgtagatgaggtaaagaaatcaactgatactgcttttaaacagacagtagacgttccggctcattatgttaatgcagcaaaagggaatggcccatttctagcaggtgtaaatcaaacgattccatatgaagcgtttggtggagatggcatgttaacgcgtttaatccttaaatcttctgaaggagcaaaatggtcagataatggtgttgataaaaatagtccattattaccattgaaaggcttaactaaaggtaaatatttctatcaagtttctttaaatggtaatacgacaggtaaagagggacaagctctcttagatcaaattaaagctaatgataaacatagctaccaagccacaattagagtttatggtgctaaagatggtaaagttgatttaaaaaacatgattagcccaaaaatggtaaccattaacattcctcacattacaactgatatggaagtaaaaaattctctaaagatggcctttaaagaaaaagtagacgtcccagcaaaatatgttagtgctgcaaaagctaaaggtccatttttagcaggtgttaacgaaacgattccatatgaagcgtttggtggggatggcatgttaacgcgtttaatccttaaagcttcagagggagcaaaatggtcagacaatggtgttgataaaaatagtccattattaccgttaaaagatttaactaagggtaaatacttctaccaagtctctcttaatggcaatacagccggtaaaaaaggccaagctctcttagatcaaattaaggcaaatggaagccatacttatcaagcaactatcactatttatggtacgaaagatggcaaagttgatatgaatactattttaggacaaaagacagtgatgattcatattaatgtcgctaaaaaagatatgaatagcacatcaatgatgatgaaaaaagataagatgacaatgcctatgaagaaagaaatgacttcatctaaaataaataccggtatgatgatgtctaacaacaagatgtcagctaatatgcaaatgtcatcacaagccaaatcaaatgataaagctggtaaaaaaatgtctatgatgtctaaaaatttacctaatacaggtgaaacaaagcaacaaaatgtaggtgtgctaggtatgcttagtctagcctttgcgacaggtctaactgcgctaggtcttaaaaaatctaaacaaagatag

SEQ ID NO: 8736 - protein, 521 aa, Streptococcus agalactiae; identical to SEQ ID NO: 3532

SEQ ID NO: 8737 - DNA, 1038 bp, Streptococcus agalactiae
atgaaattaaaatattatattgttattggttaccttatttctatgttaataactgtagcaggtgttttctttgggcttaatcatatgctgattgagactcgaggtgtttactacatcctttcagttacaattattgcctgtattgtaggtggtatagttaatttgttcttattatcaagtgtatttacatctttgaaaaagttaaaacaaaaaatgaaggatatttctcaaagatgttttgatacaaaagcacaaatttgttcaccacaagaattcaaggatttagagacagcctttaaccaaatgtcttcggagttagagtcaacgtttaaatctctaaacgagagtgaacgcgaaaaaacaatgatgattgcacaactttcacatgatatcaagactccaattacttctatacaatcaacagtagaaggtattttagatggtattatatctgaagaagaagttaactattatctcaataccatttctcgtcaaacaaaccgtcttaaccatctggttgaagaattaagttttattacattagagactatgtcagacacggctgaacctcataaagaagaaacaatttatctggataaactactgattgatattttatctgaatttcaattggtgtttgaaaaagaaaatcgccaagtaatgattgatgttgcgccagatgtttcgaaattatctagtcaatatgataaattatcacgaattttattgaatttgattagcaatgcartcaaatattctgatcctggaagtcccttgactatcaaggcctattcaaatcgtcaagatatcgttatcgatattattgaccaaggctatgggataaaagatgaagatcttgcttctatttttaatcgtctttatcgtgtagaatcttcacgaaatatgaagacaggaggacatggtctaggtctttatattgcgcgacaacttgcacatcaactgaatggggatattttggtcgaaagtcagtatcaaaaaggcagtaagttctctttagtacttaaattacaaaaatag

SEQ ID NO: 8738 - protein, 345 aa, Streptococcus agalactiae
  MISC_FEATURE (1)..(345): Xaa = Any Amino Acid
MKLKYYIVIGYLISMLITVAGVFFGLNHMLIETRGVYYILSVTIIACIVGGIVNLFLLSSVFTSLKKLKQKMKDISQRCFDTKAQICSPQEFKDLETAFNQMSSELESTFKSLNESEREKTMMIAQLSHDIKTPITSIQSTVEGILDGIISEEEVNYYLNTISRQTNRLNHLVEELSFITLETMSDTAEPHKEETIYLDKLLIDILSEFQLVFEKENRQVMIDVAPDVSKLSSQYDKLSRILLNLISNAXKYSDPGSPLTIKAYSNRQDIVIDIIDQGYGIKDEDLASIFNRLYRVESSRNMKTGGHGLGLYIARQLAHQLNGDILVESQYQKGSKFSLVLKLQK

SEQ ID NO: 8739 - DNA, 783 bp, Streptococcus agalactiae
atgtgttataatgaaatgaattgtacttttgtgtatggaggagatatgacgaattcagaaattaaaaatgaggcaaaaactatattaagcaatcttcaaggkwagaatcaactttttttactcccgattctccttagtattattacgttatatatatcattttattatcaatataataatatgacactacttgatttttttgtacctcttccagtttatttcttttacacactttttattatttcagtcagttttgtaatgttagatgtcgtcaaaaatcagaaactaaacgttagattctcggacaatacttatgtattttcaagccatattttctggaaattactctcagtacttgttctaaaaggactaattttatctttcttttatctactaagtacttttggtctactaatcatcatttcaagttttaggctacttttgagtggtaaccttatccttgcccctgttttaatagttgttagtagcctaattactactaaggcagttataaaactcgttcaacaatattactcctatagtatctcaactttagtattttacactcaattagaaagtggaaactatgagggaccgtctaaagtactggttgctagtcgagaactaatgaatggtaataaacttagactcttccttttagacttaagttttattggttggcagttccttacaatcttcagtttcggattagtctatatctatctccttccttaccaaactactgcgcgcttaatcttttatagaaacattacaaaaaatagc

SEQ ID NO: 8740 - protein, 261 aa, Streptococcus agalactiae
  MISC_FEATURE (1)..(261): Xaa = Any Amino Acid
MCYNEMNCTFVYGGDMTNSEIKNEAKTILSNLQGXNQLFLLPILLSIITLYISFYYQYNNMTLLDFFVPLPVYFFYTLFIISVSFVMLDVVKNQKLNVRFSDNTYVFSSHIFWKLLSVLVLKGLILSFFYLLSTFGLLIIISSFRLLLSGNLILAPVLIVVSSLITTKAVIKLVQQYYSYSISTLVFYTQLESGNYEGPSKVLVASRELMNGNKLRLFLLDLSFIGWQFLTIFSFGLVYIYLLPYQTTARLIFYRNITKNS

SEQ ID NO: 8741 - DNA, 93 bp, Streptococcus agalactiae
ttgagagaattaagagagctattagctctctttttgttacattatattgacaaatattatcagttcagatatttttcaaaaaaaatgctaaaa

SEQ ID NO: 8742 - protein, 31 aa, Streptococcus agalactiae
MRELRELLALFLLHYIDKYYQFRYFSKKMLK

SEQ ID NO: 8743 - DNA, 666 bp, Streptococcus agalactiae
atgttgattcgtccaaaagctctacggtatattctaggtcttctctcattagctttgttgtttgcctcagtttggatgttaacggatcactttattaatcatacaggtatgactattgaaactaagacaaagacacgtgagatttatagtgcgggtgatagtaaggctccatttggtctcatgatttataaagagattggtactcattcgagtaataatgttttagtttatcgaacagatttaaatcaaaaagaagcaaaagctcactttgttccaaatacaaaagaagtgacaagtgctgtgaaaaaatctgctagctaccaattagctgatgtgaaaaaagccacagtaacaacaaagactaaacgttatgtgtggaaagatagtctttcgaaactactttatggctttgcaggtgaaaatggagaattgatttctcagaaatcagttgctaaaataccacgaaaaacttggctagttttgactaaagagcagtccgaacacttagaatcggctgcggctaaactaaaagaacaaatgacttcgcaagcaaaagtaaacccagtgaaagctatggagataaagacattagctaagacaaatccagaagcttatgctgagatgcaagttaaagcattaaaagaagctcttaatataaaagaatag

SEQ ID NO: 8744 - protein, 221 aa, Streptococcus agalactiae
MLIRPKALRYILGLLSLALLFASVWMLTDHFINHTGMTIETKTKTREIYSAGDSKAPFGLMIYKEIGTHSSNNVLVYRTDLNQKEAKAHFVPNTKEVTSAVKKSASYQLADVKKATVTTKTKRYVWKDSLSKLLYGFAGENGELISQKSVAKIPRKTWLVLTKEQSEHLESAAAKLKEQMTSQAKVNPVKAMEIKTLAKTNPEAYAEMQVKALKEALNIKE

SEQ ID NO: 8745 - DNA, 1536 bp, Streptococcus agalactiae
atgtcaaaacaaaaagtaatggcaactttgttgttatccactttagtcttatcgctatcatcacctttagtgaccttagcagaaactattaatccagaaacaagcctgacaatggcaacagcatcaacagaaagttcttctgaagcagagaaacaggaaaaaacacaacctacagattcagaaactgcttcaccttcagccgaaggaagtatctcaacagaaaaaacagagattggtacgacagagacatcatcaagcaatgaatcatcatcaagttcatcacatcaatcttcttccaacgaagatgctaaaacatctgattctgcttcaacagcatctactcctagcactaatactacaaacagtagtcaagcagacagtaagccaggtcaatcaacaaagactgaattaaaacctgagcctaccttaccattagtagagcctaaaataactcccgctccgtctcagatagaaagtgttcagacaaatcagaatgcttctgttcctgctttatcctttgatgataacttattatcaacaccgatttcaccagtgacagcaacgccattctacgtagaacactggtctggtcaggatgcctactctcactatttattgtcacatcgttacggtatcaaagctgaacaattagatgggtacttaaaatctttagggattcaatatgattctaatcgtatcaatggtgctaagttattacaatgggaaaaagatagtggtttagatgtccgtgctattgtagctattgctgtccttgaaagttcattgggaactcaaggagtggctaagatgccaggtgctaatatgtttggttatggtgcctttgatcatgactctagccatgctagtgcttataatgatgaagaagcaattatgttgttgacaaaaaatacaattattaaaaacaacaactctagctttgaaatccaagatttgaaagcacagaaattatcttctggacaacttaatacagttactgagggtggtgtttattatacagataactctggaactggtaaacgtcgtgcccagattatggaagatttagaccgctggattgatcaacatggagggacaccagaaattcctgctgccttgaaagctttatcgacagcaagtttagcagatttaccaagtggttttagcttatcaacagcagttaacacagctagctatattgcatcaacttatccatggggtgaatgtacatggtatgtctttaaccgcgctaaagagttaggttatacatttgatccatttatgggtaatggtggagattggcaacataaggctggttttgaaacaacacattcaccaaaagtaggctatgctgtatcattttcaccaggacaagctggtgctgatggcacttacggtcacgtagctattgktgaagaagttaaaaaagatggttcagttcttatttcagaatctaatgcaatgggacgtggtattgtctcttaccgtacttttagttcagcacaagctgcacaattaacttatgttattggccataaa

SEQ ID NO: 8746 - protein, 512 aa, Streptococcus agalactiae
  MISC_FEATURE (1)..(512): Xaa = Any Amino Acid
MSKQKVMATLLLSTLVLSLSSPLVTLAETINPETSLTMATASTESSSEAEKQEKTQPTDSETASPSAEGSISTEKTEIGTTETSSSNESSSSSSHQSSSNEDAKTSDSASTASTPSTNTTNSSQADSKPGQSTKTELKPEPTLPLVEPKITPAPSQIESVQTNQNASVPALSFDDNLLSTPISPVTATPFYVEHWSGQDAYSHYLLSHRYGIKAEQLDGYLKSLGIQYDSNRINGAKLLQWEKDSGLDVRAIVAIAVLESSLGTQGVAKMPGANMFGYGAFDHDSSHASAYNDEEAIMLLTKNTIIKNNNSSFEIQDLKAQKLSSGQLNTVTEGGVYYTDNSGTGKRRAQIMEDLDRWIDQHGGTPEIPAALKALSTASLADLPSGFSLSTAVNTASYIASTYPWGECTWYVFNRAKELGYTFDPFMGNGGDWQHKAGFETTHSPKVGYAVSFSPGQAGADGTYGHVAIXEEVKKDGSVLISESNAMGRGIVSYRTFSSAQAAQLTYVIGHK

SEQ ID NO: 8747 - DNA, 1632 bp, Streptococcus agalactiae
atgtcacaaaaaacaacaaaagttagtcagcaagaacaaatggtcaaagggacggcttggttaacagcagggaatttcattagtcgcttgctgggagccatctatattatcccttggtatgcttggatgggaaagcatgctgccgaagcaaatgctttatttgggatgggatatgaaatctatgctttatttcttttgatatcaactgttggaattccagtagcagttgcaaaacaggtatctaagtataacactttaggtaaagaagagatgagcatttatctggttcggaaaatcttgcagtttatgctgattttaggtggaatttttgcattaattatgtatattggttcacctctatttgcttcacttagtaaaggagggcaagaactcgttccaatattgcgtagtctaactctagctgttttagtttttccttcaatgagtgttttacgtggtttttttcaaggttttaataatttaaaaccgtatgccattagtcaagtcgctgagcagattatacgtgtcatatggatgttattaactgctttctatattatgcgtctaggatcaggagattatattgccgctgtgacacagtcaacattcgccgcctttgtcggtatgtttgctagtatagctgtgctgctttatttcttatggcgttataatatgctatctgccttgattggtaaaactccaaagcacattaaattagatactaaagaaatcctaattgagactattaaggaagcaatcccttttattattactggtgcagcaattcaaattttcaaactgattgatcagttttcatttgggaatacgatggcgctctttacgaattattcaagtgaagaattacgggttatgtttgcttacttttcaagcaaccctggtaaagttacgatgattctaattgctgttgctaccgcaattgctggagttggtattccattgttaacagagaattttgttaagaatgataaaaaagccgccgctcgtttggttgttaataatctacaaatgttactaatgtttttactgccagctgttgcaggatccgttattttagcaaaacctttgtatacagtcttttatgggttaccgcagggacaagctttaggactttttgtcatatctcttattcaaacaattattttatctatttatactgttttagcaccaatgctacaagcattgtttgaaaatcgtaaagctattatttacttcctatatggtctggtggcaaaagttattttacaacttccctccattttccttttccatgcctatggaccacttttctcaacgacagtagctctttgtatcccagtaattcttatgtatttgaaaatacatgaaattacaggatttaaacgccaagctattcgtcgtacaagtgctttagtccttattctaacgctattgatgagctttattatttctatgataatatggttaatgaatctggttattgtacccgatagtagactggtaagtctagtttacattatcgttatcggtgcaataggtttaggggtatatggctttatggcactggccacccatctacttgataaaatgattggtagtcgtgctcaagacttacgccgaaagttgcaccttaac

SEQ ID NO: 8748 - protein, 544 aa, Streptococcus agalactiae
MSQKTTKVSQQEQMVKGTAWLTAGNFISRLLGAIYIIPWYAWMGKHAAEANALFGMGYEIYALFLLISTVGIPVAVAKQVSKYNTLGKEEMSIYLVRKILQFMLILGGIFALIMYIGSPLFASLSKGGQELVPILRSLTLAVLVFPSMSVLRGFFQGFNNLKPYAISQVAEQIIRVIWMLLTAFYIMRLGSGDYIAAVTQSTFAAFVGMFASIAVLLYFLWRYNMLSALIGKTPKHIKLDTKEILIETIKEAIPFIITGAAIQIFKLIDQFSFGNTMALFTNYSSEELRVMFAYFSSNPGKVTMILIAVATAIAGVGIPLLTENFVKNDKKAAARLVVNNLQMLLMFLLPAVAGSVILAKPLYTVFYGLPQGQALGLFVISLIQTIILSIYTVLAPMLQALFENRKAIIYFLYGLVAKVILQLPSIFLFHAYGPLFSTTVALCIPVILMYLKIHEITGFKRQAIRRTSALVLILTLLMSFIISMIIWLMNLVIVPDSRLVSLVYIIVIGAIGLGVYGFMALATHLLDKMIGSRAQDLRRKLHLN

SEQ ID NO: 8749 - DNA, 879 bp, Streptococcus agalactiae; identical to SEQ ID NO: 3741

SEQ ID NO: 8750 - protein, 293 aa, Streptococcus agalactiae
VKTKKIIKKTKKKKKSNLPFIILFLIGLSILLYPVVSRFYYTIESNNQTQDFERAAKKLSQKEINRRMALAQAYNDSLNNVHLEDPYEKKRIQKGVAEYARMLEVSEKIGTISVPKIGQKLPIFAGSSQEVLSKGAGHLEGTSLPIGGNSTHTVITAHSGIPDKELFSNLKKLKKGDKFYIQNIKETIAYQVDQIKVVTPDNFSDLLVVPGHDYATLLTCTPIMINTHRLLVRGHRIPYKGPIDEKLIKDGHLNTIYRYLFYISLVIIAWLLWLIKRQRQKNRLASVRKGIES

SEQ ID NO: 8751 - DNA, 729 bp, Streptococcus agalactiae
atgatgaaaaaaattttactagtgatacctgcttataatgaagaaggtagtattgcaaagacagtccagactattgtagattttaaggcgtctcgctcactaccttttgagctggattatattgttattaacgatgggtcaaccgatggtactccagagttattagatagattgggtttaaatcatattgaccttgttcaaaatctaggtattggtggctgtgtgcagacaggatacttatacgctaatcgtaatcattacgatgttgccgttcaatttgatggtgatggtcaacatgatattagaagcattgaagatgttgttatgccaatcttaaatgacgaagcagattttgttattggttctcgctttgttgataaaaaacatcaaaattttcaatcgacagcaatgaggcgtcttggcataaatttaatatctgctgctataaaattaacgacgggacacaaagtctatgatacaacaagtggttatagggcagccaacgcggcgctaatagcttatttatcgtgtcattatccagtacaatacccagagcctgaatcaactgctcggattttgaaaaaaggctatcgtttgaaggaagtcacagctaatatgtttgaacgtgaggcaggtacttcaagtataagttccctaaaatcgattttttatatgacggatgttttaacatcaattattattgcagggtttattaaggaggatgataaa

SEQ ID NO: 8752 - protein, 243 aa, Streptococcus agalactiae
MMKKILLVIPAYNEEGSIAKTVQTIVDFKASRSLPFELDYIVINDGSTDGTPELLDRLGLNHIDLVQNLGIGGCVQTGYLYANRNHYDVAVQFDGDGQHDIRSIEDVVMPILNDEADFVIGSRFVDKKHQNFQSTAMRRLGINLISAAIKLTTGHKVYDTTSGYRAANAALIAYLSCHYPVQYPEPESTARILKKGYRLKEVTANMFEREAGTSSISSLKSIFYMTDVLTSIIIAGFIKEDDK

SEQ ID NO: 8753 - DNA, 375 bp, Streptococcus agalactiae
atgattaaagaactaaaagaatttttatttaagggtaatgttttagaccttgctgttgctgttattttaggtgcagcttttaatgctatcatcacttcacttgttaaagacgttattacaccgcttatccttaatcctgtattaaaagctgctggcgtttcaaatatcgcacagctttcatggaatggtgttgcttacggtaatttcttaagtgcagttattaatttcttaatcgttggtactactttattcttcatcgttaaagctgctaacaaggttatggctaagaaacctgytgaagaagaaattattgaagttgttgaaccaacacaagagcaattacttgytgaaatccgcgacttactcgctaacaaa

SEQ ID NO: 8754 - protein, 125 aa, Streptococcus agalactiae
  MISC_FEATURE (1)..(125): Xaa = Any Amino Acid
MIKELKEFLFKGNVLDLAVAVILGAAFNAIITSLVKDVITPLILNPVLKAAGVSNIAQLSWNGVAYGNFLSAVINFLIVGTTLFFIVKAANKVMAKKPXEEEIIEVVEPTQEQLLXEIRDLLANK

SEQ ID NO: 8755 - DNA, 1443 bp, Streptococcus agalactiae; identical to SEQ ID NO: 3813

SEQ ID NO: 8756 - protein, 481 aa, Streptococcus agalactiae
VKKTIGIIGMGVSGLAVLLALSRKKEKELKQLAIFCFDDTVHFGRGIPFQEDVDSALINSPINDISFDYRHMSDFMDWLEENYYDTNLTYVSRTLYGQYLSERTKLLLDKLPVTVIKTRVDKLNYLSDEQQWQVYIQDKLFPVTFDELHLACGALPVIEPYHLEGKTDYIKDPYPIKYLAQENWKGKTVAIIGTGLAAIDVIKWLLLNTQSSVKAFSRTNYFPSVRIVNDLPLTWHFFTNDNLKAFLSHPSKTFTIADFNDLMSGELEHLGFKNWKNTTETFLSPGIDGLKLAFKYPKQLYLLQQLASRITVWLTDLWPLMSLSDKKEYKALYGKAIINLRNPMPDESAKVILKAAQKGTFSLINNVKTITKNDEGFSIEKEKQNHISVDRVINATGYQLNTKNWTKANPLLKSLINQEFCQIDDQGGITILTENAQVLSPKYGPMPGLYAHGALVNGVVYQNNSTIKIQQMAERAFSDNK

SEQ ID NO: 8757 - DNA, 1317 bp, Streptococcus agalactiae; identical to SEQ ID NO: 3823

SEQ ID NO: 8758 - protein, 439 aa, Streptococcus agalactiae
LIDNVEVDREYLTTSIVILEIIKIEKGGKIVNLWTLSLAYLKRQKMKTVTLFLVFLTIGTCLISLMSIQHSLEKNILTKQGKSIYLTSKEKAYWPEQAYEALKKAKMVESVEASLSIDVGSRLKSVSPYNSSKEENQVTLAGYQSTEDLRAFQTKALVLKKGSHLAADNTKQVLVPLKLAQKNHLSVGNKLRLGKENVTIAGIYDANSAKSKNTFNPNIDNTLIAQATLVRKISKQKGYQTVAVRLSDKRLVDTVIQNIKQWPLDFGKLDVQTAKEFYGDSYRNIETLHRLVGRIILIVSLVAMAILVVMLTFWINNRIKETGILLAIGKTKFEIIGHYLIEVLLVAGAAFTLSIIGGVFLGKTFAAGLLSQVNGGVSSQIVQNSSLIIDRIDNLAVSVGVMDVFRLYAQGALICLFAVVLSSYSILKLQPKQILSRMS

SEQ ID NO: 8759 - DNA, 1017 bp, Streptococcus agalactiae
atgaataaaataacgaaattatcaaccgttgccctcgctttgatgctttgcgttggatgttctgccaataaagataatcaaaaaactaaaactgagcagcctaagcaagaaaagtcaatcgctaagcaaaaacaagagagagaagcagaaaaagctatgattgctaaaggtgctattgacctaactaaatataaagcgaaaccaattgaagattacggacaaaaaattgatgtcggtgacggtaaaaaaatgaacatatatacaatgggtcaagggaaaattccgctagtagtcttccctggtcaagctgaaatttcaccacgttatgcttacaaaaacttgcttgatagattagggaaaaaatataaaatttatacggttgaaccgctcggttatgggcttagtgatatgacagataagccacgtacgattgaaaatattaccaaagagattcatacagctcttgaaaaagtcggtgtcaaaaatttctatcttatggctcactcgttaggtggcatatacggtctaaattatgctaagacatattctaacgatgtcaaaggtttcattggcatggatacaagcacaccaaatatggaaggtgatggcacaactggagaatcttcagcttcaaccttaaaatgggcagaatccattccagaagttgataagaaaaccaatgaacaatacttatcaatcggtgctaaaaaatcaggtaataaaacagagcgcgataaagataggcgtgttagtgacaatcttcataaaatggaaaaagttaagttccctaaaggtatgccagctaagtatttcttagctaatgagtcagcagaagatataaaaatgcgtaaaaaaatattccctaagcttaaaagctgggaacaacaacatattgacttatctgaagatccaaaagacgtttctgttgagacactagatgctagccacttgatttatcatacgcaatataaacatatggcgaaggctattgacgagtggattcaatcgcatgaaaaa

SEQ ID NO: 8760 - protein, 339 aa, Streptococcus agalactiae
MNKITKLSTVALALMLCVGCSANKDNQKTKTEQPKQEKSIAKQKQEREAEKAMIAKGAIDLTKYKAKPIEDYGQKIDVGDGKKMNIYTMGQGKIPLVVFPGQAEISPRYAYKNLLDRLGKKYKIYTVEPLGYGLSDMTDKPRTIENITKEIHTALEKVGVKNFYLMAHSLGGIYGLNYAKTYSNDVKGFIGMDTSTPNMEGDGTTGESSASTLKWAESIPEVDKKTNEQYLSIGAKKSGNKTERDKDRRVSDNLHKMEKVKFPKGMPAKYFLANESAEDIKMRKKIFPKLKSWEQQHIDLSEDPKDVSVETLDASHLIYHTQYKHMAKAIDEWIQSHEK

SEQ ID NO: 8761 - DNA, 819 bp, Streptococcus agalactiae
atgaagaatataacaaagctatcaactgttgctttaagcctactactttgtacggcgtgtgctgcatcaaacacgtctacatctaaaacacagtctcatcatcctaaacaaactaaactcacagataagcaaaaagaagaacccaaaaacaaagaagctgctgatcaagagatgcatccccaaggcgctgttgatttgacaaaatataaggcaaaaccggtcaaagattatggtaaaaaaatcgatgttggtgatggcaagaaaatgaacatttatgaaactggtcagggaaaaattccaattgtttttattcctggtcaagctgagatttcgccacgctatgcttataagaatttaattgagcggttaagtaaaaaatataaaatttatacagtagaaccattaggctatggtctcagtgatattcctactaaaccacgtacgctagaaaacattacaaaagaaattcacacaggcctaaataaaattggagttaaaaatttctaccttgcagctcactcacttggcggtatgtattctttaaattatgctaaaaattatccagaagaagtcagaggatttattggtatggataccagtacaccttggatggaaggggaacaaaaaacaaagtatgaccctgaaagtgctaaatgggcaatgaaatwmccagatgttgatgataagactaacgaacagtatctgtcaattgcgaaaaaaattaacggcaataagtctcaacgagatgaagatgagcgcttaggtgataatcttggtaaattgaagaatgtaaaattccctaaaagggatgccaactaa

SEQ ID NO: 8762 - protein, 272 aa, Streptococcus agalactiae
  MISC_FEATURE (1)..(272): Xaa = Any Amino Acid
MKNITKLSTVALSLLLCTACAASNTSTSKTQSHHPKQTKLTDKQKEEPKNKEAADQEMHPQGAVDLTKYKAKPVKDYGKKIDVGDGKKMNIYETGQGKIPIVFIPGQAEISPRYAYKNLIERLSKKYKIYTVEPLGYGLSDIPTKPRTLENITKEIHTGLNKIGVKNFYLAAHSLGGMYSLNYAKNYPEEVRGFIGMDTSTPWMEGEQKTKYDPESAKWAMKXPDVDDKTNEQYLSIAKKINGNKSQRDEDERLGDNLGKLKNVKFPKRDAN

SEQ ID NO: 8763 - DNA, 1086 bp, Streptococcus agalactiae
atgcaaagaaaatcctatttaaaatccatgagtgttcttactttaacagcttgtcttatatcaggatatgtggttaaagatattgctatgttacatgcagtatctgccagtgagaagaaagcaaataatgtcagtccgagagaaaatctctacagggctgtcaatgataattggctagccaatacaaaactcaaacaagggcagactagtgttaatagtttttcagaaattgaggataaattaaagcaactgttagtgtctgatatggctaaaatggcctcaggaaagattgaaacaaccaatgatgaacagaaaaaaatggttgcatactataaacaaggtatggactttaaaacaagagataaaaatggtctcaaacctctaaaaccagttttacaaaaacttgaagcagtctcttcaatgaaagactttcaaagtttggcccatgattttgtgatgagtggttttgttttaccatttggtttgactgtggaaaccaatgctcgagataatagccaaaagcaattggtgcttcgtcaagcacccgcattacttgaatcacctgaccaatataagaagggcaataaagaaggtgaggctaaattatcagcttaccgtacttcagcaatggctttgcttaaacaagctggaaaaagtaacattgaagatagaaaactagttaaacaagctatagcatttgatagactcttatcagaaaaaacgcaagttgatcaaagtaaaatcacagctgaaagtgagacagctgcggggcgatataaccctgaaagtatggaaacggttcacaattacgccaaggaatttgactttaaagaattgattgaaaaactagttgggccaacgaataaggcagtcaatgtagaagataaaacttattttaaacaggttaatgatgttataaatagtaaacaattagccaatatgaaagcatggatgatgatttctatgctagttgatcaatcagattttctaggagaacaaaatcgtcaagcagcgagtgcttttaagaatgttgcgtctggtttgactcagattgaatcgaaagaaaaaatgcttacacccaattag

SEQ ID NO: 8764 - protein, 361 aa, Streptococcus agalactiae
MQRKSYLKSMSVLTLTACLISGYVVKDIAMLHAVSASEKKANNVSPRENLYRAVNDNWLANTKLKQGQTSVNSFSEIEDKLKQLLVSDMAKMASGKIETTNDEQKKMVAYYKQGMDFKTRDKNGLKPLKPVLQKLEAVSSMKDFQSLAHDFVMSGFVLPFGLTVETNARDNSQKQLVLRQAPALLESPDQYKKGNKEGEAKLSAYRTSAMALLKQAGKSNIEDRKLVKQAIAFDRLLSEKTQVDQSKITAESETAAGRYNPESMETVHNYAKEFDFKELIEKLVGPTNKAVNVEDKTYFKQVNDVINSKQLANMKAWMMISMLVDQSDFLGEQNRQAASAFKNVASGLTQIESKEKMLTPN

SEQ ID NO: 8765 - DNA, 750 bp, Streptococcus pyogenes
ttgttttatttatgtaaaggagacaaaatgattacaactaacaatctttgtgtgacctacgatggcaacagtaatgctttagaagcgattaatgtgacaattgaaggtccttctatcgttggtattattggtcctaatggagctggaaaatcaacctttatgaaagctatcttaaatcttattgattatcaaggtcacgtaacggttgatggcaaagatggtcgtaagcttgggcatacagtagcttacgtagaacaacgaagcatgattgactataattttcctattactgttaaagaatgtgttgcgctagggacttatagtaaattaggcctttttcgccgagtaggaaaaaaacaatttgagcaggttgataaggttctcaaacaagttggtttagaagactttggccatcgaccgataaaatccttatctggtggtcagtttcagcggatgttggttgcgcgttgcttgattcaagaatcagactatattttcttagatgaaccgtttgttggcattgactcggtcagcgaaaaaatcattgtagatcttttgaaagagctcaaaatggctggcaaaacgattttaattgtacatcatgatttgagcaaagtagagcattattttgacaaactcatgattttaaataaacatttggtggcttatggcaacgtttgtgaggtatttactgttgataccttgtcaaaagcttatggcaatcatttgattttaggaaaggagatggtg

SEQ ID NO: 8766 - protein, 250 aa, Streptococcus pyogenes
LFYLCKGDKMITTNNLCVTYDGNSNALEAINVTIEGPSIVGIIGPNGAGKSTFMKAILNLIDYQGHVTVDGKDGRKLGHTVAYVEQRSMIDYNFPITVKECVALGTYSKLGLFRRVGKKQFEQVDKVLKQVGLEDFGHRPIKSLSGGQFQRMLVARCLIQESDYIFLDEPFVGIDSVSEKIIVDLLKELKMAGKTILIVHHDLSKVEHYFDKLMILNKHLVAYGNVCEVFTVDTLSKAYGNHLILGKEMV

SEQ ID NO: 8767 - DNA, 2655 bp, Streptococcus agalactiae; identical to SEQ ID NO: 3839

SEQ ID NO: 8768 - protein, 885 aa, Streptococcus agalactiae
VTKPQGAVAEKATPAVPKPQKVRVIVEFNKESILDYATEQKKTVAQLNQADVEKKLQSIKQEQDKVLKNIEKSVHFDSSKVKRYDAIINGVALDIQAQEIEKLKTIADVRRVYVSQEYVQTKPLLSSSGQLIGLPEVWNNSQYKGEGTVVAVIDSGVDFKHQALKIKEPNRAKYNKTSIEKLIHEKNLKGKFYSEKVPYGYNYYDYNDNLKDSYGVMHGMHVTGIVGANDDNQKLYGVAPNAQILAMKVFSDDQQNPTTFTDVWLKALDDAILLKADVVNMSLGTPAGFVHEGKDYPELEVIARACKAGIVIAVAAGNEGNITDGNTYGVKPLAENYDTALIANPALDDNTLAVASMENLKKHAHVLKFKDKKSGTEVTEVINLHVAPNASKTIIGLAVDLGAGAPSELSKHFDLSGKIAMLEIPEDNKSNGFLEKVQAITKLNPAAILLYNNAKVKDDLGSQLLVESEAAKFNIARITRSTYNNIKNNSNKIITILTERQAIDNSLAGQLSSYSSWGPTPDLRLKPEITAPGGHIFSTVEDNQYADKSGTSMAAPQVAGAAAVLKQYITDKKIPVDNAADFIKLLLMNTAQPIINKQSKDGKTPYFVRQQGSGAMNLAKALVTTVVATVTGTNDNNADGKLELRELKEKKFKARILLRNFGKTNKTYIISSEAIADPVDEKGFRTQNSEHLVSKKADAVTRKVTVEAGKTLAVDLDVDYSDAEALTRNNFLEGYLNLKDTEGVADLHLPFLGFYGSWTEQKAIDAFEGISEIGNGDKKRRVQFYVNKETNKTSSTFTTNGMLSLPIYNNTVFFSPNSPFYDKAGVRIAALRNMEYVQYSIIDPDTNKEVRVLGRSHDVRKLYRLDYRNSFAMMPDSIWDGKIKD

SEQ ID NO: 8769 - DNA, 2193 bp, Streptococcus agalactiae
atgagcgtatatgttagtggaataggaattatttcttctttgggaaagaattatagcgagcataaacagcatctcttcgacttaaaagaaggaatttctaaacatttatataaaaatcacgactctattttagaatcttatacaggaagcataactagtgacccagaggttcctgagcaatacaaagatgagacacgtaattttaaatttgcttttaccgcttttgaagaggctcttgcttcttcaggtgttaatttaaaagcttatcataatattgctgtgtgtttagggacctcacttgggggaaagagtgctggtcaaaatgccttgtatcaatttgaagaaggagagcgtcaagtagatgctagtttattagaaaaagcatctgtttaccatattgctgatgaattgatggcttatcatgatattgtgggagcttcgtatgttatttcaaccgcctgttctgcaagtaataatgccgtaatattaggaacacaattacttcaagatggcgattgtgatttagctatttgtggtggctgtgatgagttaagtgatatttctttagcaggcttcacatcactaggagctattaatacagaaatggcatgtcagccctattcttctggaaaaggaatcaatttgggtgagggcgctggttttgttgttcttgtcaaagatcagtccttagctaaatatggaaaaattatcggtggtcttattacttcagatggttatcatataacagcacctaagccaacaggtgaaggggcggcacagattgcaaagcagctagtgactcaagcaggtattgactacagtgagattgactatattaacggtcacggtacaggtactcaagctaatgataaaatggaaaaaaatatgtatggtaagtttttcccgacaacgacattgatcagcagtaccaaggggcaaacgggtcatactctaggggctgcaggtattatcgaattgattaattgtttagcggcaatagaggaacagactgtaccagcaactaaaaatgagattgggatagaaggttttccagaaaattttgtctatcatcaaaagagagaatacccaataagaaatgctttaaatttttcgtttgcttttggtggaaataatagtggtgtcttattgtcatctttagattcacctctagaaacattacctgctagagaaaatcttaaaatggctatcttatcatctgttgcttccatttctaagaatgaatcactttctataacctatgaaaaagttgctagtaatttcaacgactttgaagcattacgctttaaaggggctagaccacccaaaactgtcaacccagcacaatttaggaaaatggatgatttttccaaaatggttgccgtaacaacagctcaagcactaatagaaagcaatattaatctaaaaaaacaagatacttcaaaagtaggaattgtatttacaacactttctggaccagttgaggttgttgaaggtattgaaaagcaaatcacaacagaaggatatgcacatgtttctgcttcacgattcccgtttacagtaatgaatgcagcagctggtatgctttctatcatttttaaaataacaggtcctttatctgtcatttcgacaaatagtggagcgcttgatggtatacaatatgccaaggaaatgatgcgtaacgataatctagactatgtgattcttgtttctgctaatcagtggacagacatgagttttatgtggtggcaacaattaaactatgatagtcaaatgtttgtcggttctgattattgttcagcacaagtcctctctcgtcaagcattggataattctcctataatattaggtagtaaacaattaaaatatagccataaaacattcacagatgtgatgactatttttgatgctgcgcttcaaaatttattatcagacttaggactaaccataaaagatatcaaaggtttcgtttggaatgagcggaagaaggcagttagttcagattatgatttcttagcgaacttgtctgagtattataatatgccaaaccttgcttctggtcagtttggattttcatctaatggtgctggtgaagaactggactatactgttaatgaaagtatagaaaagggctattatttagtcctatcttattcgatcttcggtggtatctcttttgctattattgaaaaaagg

SEQ ID NO: 8770 - protein, 731 aa, Streptococcus agalactiae
MSVYVSGIGIISSLGKNYSEHKQHLFDLKEGISKHLYKNHDSILESYTGSITSDPEVPEQYKDETRNFKFAFTAFEEALASSGVNLKAYHNIAVCLGTSLGGKSAGQNALYQFEEGERQVDASLLEKASVYHIADELMAYHDIVGASYVISTACSASNNAVILGTQLLQDGDCDLAICGGCDELSDISLAGFTSLGAINTEMACQPYSSGKGINLGEGAGFVVLVKDQSLAKYGKIIGGLITSDGYHITAPKPTGEGAAQIAKQLVTQAGIDYSEIDYINGHGTGTQANDKMEKNMYGKFFPTTTLISSTKGQTGHTLGAAGIIELINCLAAIEEQTVPATKNEIGIEGFPENFVYHQKREYPIRNALNFSFAFGGNNSGVLLSSLDSPLETLPARENLKMAILSSVASISKNESLSITYEKVASNFNDFEALRFKGARPPKTVNPAQFRKMDDFSKMVAVTTAQALIESNINLKKQDTSKVGIVFTTLSGPVEVVEGIEKQITTEGYAHVSASRFPFTVMNAAAGMLSIIFKITGPLSVISTNSGALDGIQYAKEMMRNDNLDYVILVSANQWTDMSFMWWQQLNYDSQMFVGSDYCSAQVLSRQALDNSPIILGSKQLKYSHKTFTDVMTIFDAALQNLLSDLGLTIKDIKGFVWNERKKAVSSDYDFLANLSEYYNMPNLASGQFGFSSNGAGEELDYTVNESIEKGYYLVLSYSIFGGISFAIIEKR

SEQ ID NO: 8771 - DNA, 927 bp, Streptococcus agalactiae
atggaaattaaactcaaaaatattggaaaaaaatatggttcttttgaagcattgagagacattaatctcatctttgaagagggaaaattttatggccttcttggacctaatggagctggtaaaacaactttatttaaccttttaattcaaaattttaagcaaacgtcaggcgatattaagtgggaggtggatggaaaacctctatctattaaagatttttatcgtcacattggtattgtcttccaaagtaatcgcttagatgataatttaacggttgaggaaaatctaatttctagaggtgctttgtacggtttatctaaatcacaagtacgtaatcgccttaaagatcttcaaacgtatctagatatcacagcaataaaaaaacaaaaatatggcagtttatcaggaggtcaaaaacgaaaagttgatattgcacgcgccttgctgccacaaccttctctattattattagatgaaccaacgactggtttagaccctcaatctcgtcgcgatttatgggatgctatcgcacaactaaatcaacaatcgcagatgacagttgtactaattactcattatcttgaagaaatgtctgcttgtgatgttttaaatgttcttattgaaggaaacatttattattcgggagatattaaaagctttattgagcaacattccacaacaaacttgaatgtggtattgaaaccagaaaagtcattagaccaactttcgatagctgattttgttaataaatgtcaagtcctttcagaaagggagatagtatttaaggatatttctgttgaggaaatgatgcaggttatctcagacaatcaagataaatctattattgagacatttaatgttgaatattcgaacttagaggcggcgtatctcaacttgcttagagaaaaagaaaggaaaaacaatgtt

SEQ ID NO: 8772 - protein, 309 aa, Streptococcus agalactiae
MEIKLKNIGKKYGSFEALRDINLIFEEGKFYGLLGPNGAGKTTLFNLLIQNFKQTSGDIKWEVDGKPLSIKDFYRHIGIVFQSNRLDDNLTVEENLISRGALYGLSKSQVRNRLKDLQTYLDITAIKKQKYGSLSGGQKRKVDIARALLPQPSLLLLDEPTTGLDPQSRRDLWDAIAQLNQQSQMTVVLITHYLEEMSACDVLNVLIEGNIYYSGDIKSFIEQHSTTNLNVVLKPEKSLDQLSIADFVNKCQVLSEREIVFKDISVEEMMQVISDNQDKSIIETFNVEYSNLEAAYLNLLREKERKNNV

SEQ ID NO: 8773 - DNA, 1026 bp, Streptococcus agalactiae
atggtacgtaaatttttaaaatcgctcctatctctctttcttatagcagtaatcgccaccggtatttcagtggcatgtttcttttttattccagaaaataaagggaatattacaccgattttattgcatcgctttatgcgaaaaaataatgttaatggaatgatgattgttagcgataatactggtaaaccgattaccatctcgcatgggattaaccgtggggaagttgaaacggatattgaaaataataaattatttccaatggcttctctccaaaaactcatgacaggaattattatccaaagattaattgatcaagatgtcttgagtgaagacgaccgattgtctcagttctttccccaagtaaaaggtagtaatagtattaccatccaccaattgttgacccatacgagtgggttaagagaaaaaggtgttaaggtgtctccttatctaaaaaatgagagagaacaattacaattttgcttaaaacactataactttgttaataagaaatcgtggtattattctaatatcaactttagtttcctaacaggtatagccactcaagttacgggaaggacctacgctgaacttgttgatgatgtgataaaaaatcctttgcgattagatgatacccaaagttaccaatcagttgttaatcatgacttagttagcccaatgcgaaagaacggcaagttaaataaaattaatatctttaatcaagtatccacagcatatggagctggagattttttcacaactccgctgaacttttgggtgttgatgcggtctttttctaaagggtactttttcccaacggatgaatataccaaacatcaaaatgatgcgatatcacattattatggtgggctttacatgcatggtcgtatagttaattctaatgggacctttttccagtattcaagttttggttatgcagatctaaagacgcatgatacaatggtgctttttatgaataacaaagtctatagtgatgctagtcacgtggccaccaaaagcatttga

SEQ ID NO: 8774 - protein, 341 aa, Streptococcus agalactiae
MVRKFLKSLLSLFLIAVIATGISVACFFFIPENKGNITPILLHRFMRKNNVNGMMIVSDNTGKPITISHGINRGEVETDIENNKLFPMASLQKLMTGIIIQRLIDQDVLSEDDRLSQFFPQVKGSNSITIHQLLTHTSGLREKGVKVSPYLKNEREQLQFCLKHYNFVNKKSWYYSNINFSFLTGIATQVTGRTYAELVDDVIKNPLRLDDTQSYQSVVNHDLVSPMRKNGKLNKINIFNQVSTAYGAGDFFTTPLNFWVLMRSFSKGYFFPTDEYTKHQNDAISHYYGGLYMHGRIVNSNGTFFQYSSFGYADLKTHDTMVLFMNNKVYSDASHVATKSI

SEQ ID NO: 8775 - DNA, 1149 bp, Streptococcus agalactiae
atggtacgtaaatttttaaaatcgctcctatctctctttcttatagcagtaatcgccaccggtatttcagtggcatgtttcttttttattccagaaaataaagggaatattacaccgattttattgcatcgctttatgcgaaaaaataatgttaatggaatgatgattgttagcgataatactggtaaaccgattaccatctcgcatgggattaaccgtggggaagttgaaacggatattgaaaataataaattatttccaatggcttctctccaaaaactcatgacaggaattattatccaaagattaattgatcaagatgtcttgagtgaagacgaccgattgtctcagttctttccccaagtaaaaggtagtaatagtattaccatccaccaattgttgacccatacgagtgggttaagagaaaaaggtgttaaggtgtctccttatctaaaaaatgagagagaacaattacaattttgcttaaaacactataactttgttaataagaaatcgtggtattattctaatatcaactttagtttcctaacaggtatagccactcaagttacgggaaggacctacgctgaacttgttgatgatgtgataaaaaatcctttgcgattagatgatacccaaagttaccaatcagttgttaatcatgacttagttagcccaatgcgaaagaacggcaagttaaataaaattaatatctttaatcaagtatccacagcatatggagctggagattttttcacaactccgctgaacttttgggtgttgatgcggtctttttctaaagggtactttttcccaacggatgaatataccaaacatcaaaatgatgcgatatcacattattatggtgggctttacatgcatggtcgtatagttaattctaatgggacctttttccagtattcaagttttggttatgcagatctaaagacgcatgatacaatggtgctttttatgaataacaaagtctatagtgatgctagtcacgtggcaccaaaagcatttgaatattatcaaaaatttatgttccttaataagattttccacttagtcttttactttgtattttctttctttttaatgcttttaatacgtcattcgtttaggaaaagaaggtataagaaacgtctc

SEQ ID NO: 8776 - protein, 383 aa, Streptococcus agalactiae
MVRKFLKSLLSLFLIAVIATGISVACFFFIPENKGNITPILLHRFMRKNNVNGMMIVSDNTGKPITISHGINRGEVETDIENNKLFPMASLQKLMTGIIIQRLIDQDVLSEDDRLSQFFPQVKGSNSITIHQLLTHTSGLREKGVKVSPYLKNEREQLQFCLKHYNFVNKKSWYYSNINFSFLTGIATQVTGRTYAELVDDVIKNPLRLDDTQSYQSVVNHDLVSPMRKNGKLNKINIFNQVSTAYGAGDFFTTPLNFWVLMRSFSKGYFFPTDEYTKHQNDAISHYYGGLYMHGRIVNSNGTFFQYSSFGYADLKTHDTMVLFMNNKVYSDASHVAPKAFEYYQKFMFLNKIFHLVFYFVFSFFLMLLIRHSFRKRRYKKRL

SEQ ID NO: 8777 - DNA, 2670 bp, Streptococcus agalactiae
atgaaaaagagacaaaaaatatggagagggttatcagttactttactaatcctgtcccaaattccatttggtatattggtacaaggtgaaacccaagataccaatcaagcacttggaaaagtaattgttaaaaaaacgggagacaatgctacaccattaggcaaagcgacttttgtgttaaaaaatgacaatgataagtcagaaacaagtcacgaaacggtagagggttctggagaagcaacctttgaaaacataaaacctggagactacacattaagagaagaaacagcaccaattggttataaaaaaactgataaaacctggaaagttaaagttgcagataacggagcaacaataatcgagggtatggatgcagataaagcagagaaacgaaaagaagttttgaatgcccaatatccaaaatcagctatttatgaggatacaaaagaaaattacccattagttaatgtagagggttccaaagttggtgaacaatacaaagcattgaatccaataaatggaaaagatggtcgaagagagattgctgaaggttggttatcaaaaaaaattacaggggtcaatgatctcgataagaataaatataaaattgaattaactgttgagggtaaaaccactgttgaaacgaaagaacttaatcaaccactagatgtcgttgtgctattagataattcaaatagtatgaataatgaaagagccaataattctcaaagagcattaaaagctggggaagcagttgaaaagctgattgataaaattacatcaaataaagacaatagagtagctcttgtgacatatgcctcaaccatttttgatggtactgaagcgaccgtatcaaagggagttgccgatcaaaatggtaaagcgctgaatgatagtgtatcatgggattatcataaaactacttttacagcaactacacataattacagttatttaaatttaacaaatgatgctaacgaagttaatattctaaagtcaagaattccaaaggaagcggagcatataaatggggatcgcacgctctatcaatttggtgcgacatttactcaaaaagctctaatgaaagcaaatgaaattttagagacacaaagttctaatgctagaaaaaaacttatttttcacgtaactgatggtgtccctacgatgtcttatgccataaattttaatccttatatatcaacatcttaccaaaaccagtttaattcttttttaaataaaataccagatagaagtggtattctccaagaggattttataatcaatggtgatgattatcaaatagtaaaaggagatggagagagttttaaactgttttcggatagaaaagttcctgttactggaggaacgacacaagcagcttatcgagtaccgcaaaatcaactctctgtaatgagtaatgagggatatgcaattaatagtggatatatttatctctattggagagattacaactgggtctatccatttgatcctaagacaaagaaagtttctgcaacgaaacaaatcaaaactcatggtgagccaacaacattatactttaatggaaatataagacctaaaggttatgacatttttactgttgggattggtgtaaacggagatcctggtgcaactcctcttgaagctgagaaatttatgcaatcaatatcaagtaaaacagaaaattatactaatgttgatgatacaaataaaatttatgatgagctaaataaatactttaaaacaattgttgaggaaaaacattctattgttgatggaaatgtgactgatcctatgggagagatgattgaattccaattaaaaaatggtcaaagttttacacatgatgattacgttttggttggaaatgatggcagtcaattaaaaaatggtgtggctcttggtggaccaaacagtgatgggggaattttaaaagatgttacagtgacttatgataagacatctcaaaccatcaaaatcaatcatttgaacttaggaagtggacaaaaagtagttcttacctatgatgtacgtttaaaagataactatataagtaacaaattttacaatacaaataatcgtacaacgctaagtccgaagagtgaaaaagaaccaaatactattcgtgatttcccaattcccaaaattcgtgatgttcgtgagtttccggtactaaccatcagtaatcagaagaaaatgggtgaggttgaatttattaaagttaataaagacaaacattcagaatcgcttttgggagctaagtttcaacttcagatagaaaaagatttttctgggtataagcaatttgttccagagggaagtgatgttacaacaaagaatgatggtaaaatttattttaaagcacttcaagatggtaactataaattatatgaaatttcaagtccagatggctatatagaggttaaaacgaaacctgttgtgacatttacaattcaaaatggagaagttacgaacctgaaagcagatccaaatgctaataaaaatcaaatcgggtatcttgaaggaaatggtaaacatcttattaccaacactcccaaacgcccaccaggtgtttttcctaaaacagggggaattggtacaattgtctatatattagttggttctacttttatgatacttaccatttgttctttccgtcgtaaacaattg

SEQ ID NO: 8778 - protein, 890 aa, Streptococcus agalactiae
MKKRQKIWRGLSVTLLILSQIPFGILVQGETQDTNQALGKVIVKKTGDNATPLGKATFVLKNDNDKSETSHETVEGSGEATFENIKPGDYTLREETAPIGYKKTDKTWKVKVADNGATIIEGMDADKAEKRKEVLNAQYPKSAIYEDTKENYPLVNVEGSKVGEQYKALNPINGKDGRREIAEGWLSKKITGVNDLDKNKYKIELTVEGKTTVETKELNQPLDVVVLLDNSNSMNNERANNSQRALKAGEAVEKLIDKITSNKDNRVALVTYASTIFDGTEATVSKGVADQNGKALNDSVSWDYHKTTFTATTHNYSYLNLTNDANEVNILKSRIPKEAEHINGDRTLYQFGATFTQKALMKANEILETQSSNARKKLIFHVTDGVPTMSYAINFNPYISTSYQNQFNSFLNKIPDRSGILQEDFIINGDDYQIVKGDGESFKLFSDRKVPVTGGTTQAAYRVPQNQLSVMSNEGYAINSGYIYLYWRDYNWVYPFDPKTKKVSATKQIKTHGEPTTLYFNGNIRPKGYDIFTVGIGVNGDPGATPLEAEKFMQSISSKTENYTNVDDTNKIYDELNKYFKTIVEEKHSIVDGNVTDPMGEMIEFQLKNGQSFTHDDYVLVGNDGSQLKNGVALGGPNSDGGILKDVTVTYDKTSQTIKINHLNLGSGQKVVLTYDVRLKDNYISNKFYNTNNRTTLSPKSEKEPNTIRDFPIPKIRDVREFPVLTISNQKKMGEVEFIKVNKDKHSESLLGAKFQLQIEKDFSGYKQFVPEGSDVTTKNDGKIYFKALQDGNYKLYEISSPDGYIEVKTKPVVTFTIQNGEVTNLKADPNANKNQIGYLEGNGKHLITNTPKRPPGVFPKTGGIGTIVYILVGSTFMILTICSFRRKQL

SEQ ID NO: 8779 - DNA, 1662 bp, Streptococcus agalactiae
atgaaattatcgaagaagttattgttttcggctgctgttttaacaatggtggcggggtcaactgttgaaccagtagctcagtttgcgactggaatgagtattgtaagagctgcagaagtgtcacaagaacgcccagcgaaaacaacagtaaatatctataaattacaagctgatagttataaatcggaaattacttctaatggtggtatcgagaataaagacggcgaagtaatatctaactatgctaaacttggtgacaatgtaaaaggtttgcaaggtgtacagtttaaacgttataaagtcaagacggatatttctgttgatgaattgaaaaaattgacaacagttgaagcagcagatgcaaaagttggaacgattcttgaagaaggtgtcagtctacctcaaaaaactaatgctcaaggtttggtcgtcgatgctctggattcaaaaagtaatgtgagatacttgtatgtagaagatttaaagaattcaccttcaaacattaccaaagcttatgctgtaccgtttgtgttggaattaccagttgctaactctacaggtacaggtttcctttctgaaattaatatttaccctaaaaacgttgtaactgatgaaccaaaaacagataaagatgttaaaaaattaggtcaggacgatgcaggttatacgattggtgaagaattcaaatggttcttgaaatctacaatccctgccaatttaggtgactatgaaaaatttgaaattactgataaatttgcagatggcttgacttataaatctgttggaaaaatcaagattggttcgaaaacactgaatagagatgagcactacactattgatgaaccaacagttgataaccaaaatacattaaaaattacgtttaaaccagagaaatttaaagaaattgctgagctacttaaaggaatgacccttgttaaaaatcaagatgctcttgataaagctactgcaaatacagatgatgcggcatttttggaaattccagttgcatcaactattaatgaaaaagcagttttaggaaaagcaattgaaaatacttttgaacttcaatatgaccatactcctgataaagctgacaatccaaaaccatctaatcctccaagaaaaccagaagttcatactggtgggaaacgatttgtaaagaaagactcaacagaaacacaaacactaggtggtgctgagtttgatttgttggcttctgatgggacagcagtaaaatggacagatgctcttattaaagcgaatactaataaaaactatattgctggagaagctgttactgggcaaccaatcaaattgaaatcacatacagacggtacgtttgagattaaaggtttggcttatgcagttgatgcgaatgcagagggtacagcagtaacttacaaattaaaagaaacaaaagcaccagaaggttatgtaatccctgataaagaaatcgagtttacagtatcacaaacatcttataatacaaaaccaactgacatcacggttgatagtgctgatgcaacacctgatacaattaaaaacaacaaacgtccttcaatccctaatactggtggtattggtacggctatctttgtcgctatcggtgctgcggtgatggcttttgctgttaaggggatgaagcgtcgtacaaaagataac

SEQ ID NO: 8780 - protein, 554 aa, Streptococcus agalactiae
MKLSKKLLFSAAVLTMVAGSTVEPVAQFATGMSIVRAAEVSQERPAKTTVNIYKLQADSYKSEITSNGGIENKDGEVISNYAKLGDNVKGLQGVQFKRYKVKTDISVDELKKLTTVEAADAKVGTILEEGVSLPQKTNAQGLVVDALDSKSNVRYLYVEDLKNSPSNITKAYAVPFVLELPVANSTGTGFLSEINIYPKNVVTDEPKTDKDVKKLGQDDAGYTIGEEFKWFLKSTIPANLGDYEKFEITDKFADGLTYKSVGKIKIGSKTLNRDEHYTIDEPTVDNQNTLKITFKPEKFKEIAELLKGMTLVKNQDALDKATANTDDAAFLEIPVASTINEKAVLGKAIENTFELQYDHTPDKADNPKPSNPPRKPEVHTGGKRFVKKDSTETQTLGGAEFDLLASDGTAVKWTDALIKANTNKNYIAGEAVTGQPIKLKSHTDGTFEIKGLAYAVDANAEGTAVTYKLKETKAPEGYVIPDKEIEFTVSQTSYNTKPTDITVDSADATPDTIKNNKRPSIPNTGGIGTAIFVAIGAAVMAFAVKGMKRRTKDN

SEQ ID NO: 8781 - DNA, 735 bp, Streptococcus agalactiae
atgaagaaagtgttagtgagtagtcttttggttttagggattacgataacgttacaaacagtagttgaggctaaggggccaaaagtagcttatacacaagagggaatgactgctctttcggacacaaataaagataaagtcactactatttctattgacgagattcaaaaaagcttagaaggtaagaagccgattactgttagttttgatattgatgatacactgcttttcagtagtcaatattttcaatatggtaaagaatatgtaactcctggatcgtttgattttcttcataaacaaaaattctgggatcttgttgcaaaacgaggagatcaagattccattcccaaagaatatgctaaaaaattaattgctatgcatcaaaaacgaggagataaaattgtttttataacaggtaggacaagagggtcaatgtataaggagggcgaggttgataaaacagctaaagccttagctaaagattttaaattagacaaaccaattgctgtaaattatacaggcgataaacctaaaaagccatacaaatatgataaatcatattatattaagaaatatggttcagacattcattatggagatagtgatgacgatattcatgcagctagggaggccggtgctagaccaattagaattttaagagcacctaattctacaaatctacctttaccagaagctggaggctacggtgaagaggttctcgaaaattcagcttac

SEQ ID NO: 8782 - protein, 245 aa, Streptococcus agalactiae
MKKVLVSSLLVLGITITLQTVVEAKGPKVAYTQEGMTALSDTNKDKVTTISIDEIQKSLEGKKPITVSFDIDDTLLFSSQYFQYGKEYVTPGSFDFLHKQKFWDLVAKRGDQDSIPKEYAKKLIAMHQKRGDKIVFITGRTRGSMYKEGEVDKTAKALAKDFKLDKPIAVNYTGDKPKKPYKYDKSYYIKKYGSDIHYGDSDDDIHAAREAGARPIRILRAPNSTNLPLPEAGGYGEEVLENSAY

SEQ ID NO: 8783 - DNA, 1227 bp, Streptococcus agalactiae; identical to SEQ ID NO: 3985

SEQ ID NO: 8784 - protein, 409 aa, Streptococcus agalactiae
LKLLYIFEKNIILRKILITFSLIIIFLLGRYVPIPGVLISAYKGQDNNFATLYSTVTGGNLSQVGVFSLGIGPMMTTMILLRLFTIGKYSSGVSQKVQQFRQNVVMLVIAIIQGLAITISFQYHNGFSLTKLLLATMILVTGAYIISWIGNLNAEYGFGGMTILVVVGMLVGQFNNIPLIFELFQDGYQLAIILFLLWTLVAMYLMITFERSEYRIPVMRTSIHNRLVDDAYMPIKVNASGGMAFMYVYTLLMFPQYIIILLRSIFPTNPDITSYNDYFSLSSIQGVVIYMILMLVLSVAFTFVNIDPTKISEAMRESGDFIPNYRPGKETQSYLSKICYLFGTFSGFFMAFLGGVPLLFALGNDDLRTVSSMTGIFMMITGMSFMILDEFQVIRIRKQYTSVFENEEN

SEQ ID NO: 8785 - DNA, 579 bp, Streptococcus agalactiae
atgaaagtgaaaaataagattttaacgatggtagcacttactgtcttaacatgtgctacttattcatcaatcggttatgctgatacaagtgataagaatactgacacgagtgtcgtgactacgaccttatctgaggagaaaagatcagatgaactagaccagtctagtactggttcttcttctgaaaatgaatcgagttcatcaagtgaaccagaaacaaatccgtcaactaatccacctacaacagaaccatcgcaaccctcacctagtgaagagaacaagcctgatggtagaacgaagacagaaattggcaataataaggatatttctagtggaacaaaagtattaatttcagaagatagtattaagaattttagtaaagcaagtagtgatcaagaagaagtggatcgcgatgaatcatcatcttcaaaagcaaatgatgggaaaaaaggccacagtaagcctaaaaaggaacttcctaaaacaggagatagccactcagatactgtaatagcatctacgggagggattattctgttatcattaagtttttacaataagaaaatgaaactttattaa

SEQ ID NO: 8786 - protein, 192 aa, Streptococcus agalactiae; identical to SEQ ID NO: 2

SEQ ID NO: 8787 - DNA, 2040 bp, Streptococcus agalactiae
atgaaacgtaaatactttattcttaatacggtgacggttttaacgttagctgctgcaatgaatactagcagtatctatgctaatagtactgagacaagtgcttcagtagttcctactacaaatactatcgttcaaactaatgacagtaatcctaccgcaaaatttgtatcagaatcaggacaatctgtaataggtcaagtaaaaccagataattctgcggcgcttacaacagttgacacgcctcatcatatttcagctccagatgctttaaaaacaactcaatcaagtcctgtcgttgagagtacttctactaagttaactgaagagacttacaaacaaaaagatggtcaagatttagccaacatggtgagaagtggtcaagttactagtgaggaactcgttaatatggcatacgatattattgctaaagaaaacccatctttaaatgcagtcattactactagacgccaagaagctattgaagaggctagaaaacttaaagataccaatcagccgtttttaggtgttcccttgttagtcaaggggttagggcacagtattaaaggtggtgaaaccaataatggcttgatctatgcagatggaaaaattagcacatttgacagtagctatgtcaaaaaatataaagatttaggatttattattttaggacaaacgaactttccagagtatgggtggcgtaatataacagattctaaattatacggtctaacgcataatccttgggatcttgctcataatgctggtggctcttctggtggaagtgcagcagccattgctagcggaatgacgccaattgctagcggtagtgatgctggtggttctatccgtattccatcttcttggacgggcttggtaggtttaaaaccaacaagaggattggtgagtaatgaaaagccagattcgtatagtacagcagttcattttccattaactaagtcatctagagacgcagaaacattattaacttatctaaagaaaagcgatcaaacgctagtatcagttaatgatttaaaatctttaccaattgcttatactttgaaatcaccaatgggaacagaagttagtcaagatgctaaaaacgctattatggacaacgtcacattcttaagaaaacaaggattcaaagtaacagagatagacttaccaattgatggtagagcattaatgcgtgattattcaaccttggctattggcatgggaggagctttttcaacaattgaaaaagacttaaaaaaacatggttttactaaagaagacgttgatcctattacttgggcagttcatgttatttatcaaaattcagataaggctgaacttaagaaatctattatggaagcccaaaaacatatggatgattatcgtaaggcaatggagaagcttcacaagcaatttcctattttcttatcgccaacgaccgcaagtttagcccctctaaatacagatccatatgtaacagaggaagataaaagagcgatttataatatggaaaacttgagccaagaagaaagaattgctctctttaatcgccagtgggagcctatgttgcgtagaacaccttttacacaaattgctaatatgacaggactcccagctatcagtatcccgacttacttatctgagtctggtttacccatagggacgatgttaatggcaggtgcaaactatgatatggtattaattaaatttgcaactttctttgaaaaacatcatggttttaatgttaaatggcaaagaataatagataaagaagtgaaaccatctactggcctaatacagcctactaactccctctttaaagctcattcatcattagtaaatttagaagaaaattcacaagttactcaagtatctatctctaaaaaatggatgaaatcgtctgttaaaaataaaccatccgtaatggcatatcaaaaagcacttcctaaaacaggtgatacagaatcaagcctatctccagttttagtagtaacccttttattagcttgttttagctttgtaacaaaaaagaatcagaaaagt

SEQ ID NO: 8788 - protein, 680 aa, Streptococcus agalactiae
MKRKYFILNTVTVLTLAAAMNTSSIYANSTETSASVVPTTNTIVQTNDSNPTAKFVSESGQSVIGQVKPDNSAALTTVDTPHHISAPDALKTTQSSPVVESTSTKLTEETYKQKDGQDLANMVRSGQVTSEELVNMAYDIIAKENPSLNAVITTRRQEAIEEARKLKDTNQPFLGVPLLVKGLGHSIKGGETNNGLIYADGKISTFDSSYVKKYKDLGFIILGQTNFPEYGWRNITDSKLYGLTHNPWDLAHNAGGSSGGSAAAIASGMTPIASGSDAGGSIRIPSSWTGLVGLKPTRGLVSNEKPDSYSTAVHFPLTKSSRDAETLLTYLKKSDQTLVSVNDLKSLPIAYTLKSPMGTEVSQDAKNAIMDNVTFLRKQGFKVTEIDLPIDGRALMRDYSTLAIGMGGAFSTIEKDLKKHGFTKEDVDPITWAVHVIYQNSDKAELKKSIMEAQKHMDDYRKAMEKLHKQFPIFLSPTTASLAPLNTDPYVTEEDKRAIYNMENLSQEERIALFNRQWEPMLRRTPFTQIANMTGLPAISIPTYLSESGLPIGTMLMAGANYDMVLIKFATFFEKHHGFNVKWQRIIDKEVKPSTGLIQPTNSLFKAHSSLVNLEENSQVTQVSISKKWMKSSVKNKPSVMAYQKALPKTGDTESSLSPVLVVTLLLACFSFVTKKNQKS

SEQ ID NO: 8789 - DNA, 558 bp, Streptococcus agalactiae
atggttaaacgcgattttattagaaatattattttagcattgattgctgtattgattttgattctcttgagatattttgtttttgcaacctttaaagtacataaggatgctacaaattcttattttagcaacggagatgttgttgttgttaatcgtaataggacgcctaagtacaaagactttattgtctataaggttggaaagattttctatattagtcgtgttattggtgagccaaatcaaaaagtgagagtaatggatgatattttatatttgaatgatgttttcaaggatgagccttacattgaaaaaatgaaaaatgcttattctgaaaagaaagacggtcaaatgccctttacttccgacttctcagttgaaacattaacacgaaataaagaaagcagagttcctaagggttcttatcttgtgttaaatgataatcgacaaaataaaaatgatagtcgaaaatttggattaatcaaagagaaagatattcgtggtgttattacctttaaagtataccctctaagtgaatttggttttacagcttcagagtag

SEQ ID NO: 8790 - protein, 185 aa, Streptococcus agalactiae
MVKRDFIRNIILALIAVLILILLRYFVFATFKVHKDATNSYFSNGDVVVVNRNRTPKYKDFIVYKVGKIFYISRVIGEPNQKVRVMDDILYLNDVFKDEPYIEKMKNAYSEKKDGQMPFTSDFSVETLTRNKESRVPKGSYLVLNDNRQNKNDSRKFGLIKEKDIRGVITFKVYPLSEFGFTASE

SEQ ID NO: 8791 - DNA, 1500 bp, Streptococcus agalactiae
atgaataaacgcgtaaaaatcgttgcaacacttggtcctgcggttgaattccgtggtggtaagaagtttggtgagtctggatactggggtgaaagccttgacgtagaagcttcagcagaaaaaattgctcaattgattaaagaaggtgctaacgttttccgtttcaacttctcacatggagatcatgctgagcaaggagctcgtatggctactgttcgtaaagcagaagagattgcaggacaaaaagttggcttcctccttgatactaaaggacctgaaattcgtacagaactttttgaagatggtgcagatttccattcatatacaacaggtacaaaattacgtgttgctactaagcaaggtatcaaatcaactccagaagtgattgcattgaatgttgctggtggacttgacatctttgatgacgttgaagttggtaagcaaatccttgttgatgatggtaaactaggtcttactgtgtttgcaaaagataaagacactcgtgaatttgaagtagttgttgagaatgatggccttattggtaaacaaaaaggtgtaaacatcccttatactaaaattcctttcccagcacttgcagaacgcgataatgctgatatccgttttggacttgagcaaggacttaactttattgctatctcatttgtacgtactgctaaagatgttaatgaagttcgtgctatttgtgaagaaactggsmatggacacgttaagttgtttgctaaaattgaaaatcaacaaggtatcgataatattgatgagattatcgaagcagcagatggtattatgattgctcgtggtgatatgggtatcgaagttccatttgaaatggttccagtttaccaaaaaatgatcattactaaagttaatgcagctggtaaagcagttattacagcaacaaatatgcttgaaacaatgactgataaaccacgtgcgactcgttcagaagtatctgatgtcttcaatgctgttattgatggtactgatgctacaatgctttcaggtgagtcagctaatggtaaatacccagttgagtcagttcgtacaatggctactattgataaaaatgctcaaacattactcaatgagtatggtcgcttagactcatctgcattcccacgtaataacaaaactgatgttattgcatctgcggttaaagatgcaacacactcaatggatatcaaacttgttgtaacaattactgaaacaggtaatacagctcgtgccatttctaaattccgtccagatgcagacattttggctgttacatttgatgaaaaagtacaacgttcattgatgattaactggggtgttatccctgtccttgcagacaaaccagcatctacagatgatatgtttgaggttgcagaacgtgtagcacttgaagcaggatttgttgaatcaggcgataatatcgttatcgttgcaggtgttcctgtaggtacaggtggaactaacacaatgcgtgttcgtactgttaaa

SEQ ID NO: 8792 - protein, 500 aa, Streptococcus agalactiae
  MISC_FEATURE (1)..(500): Xaa = Any Amino Acid
MNKRVKIVATLGPAVEFRGGKKFGESGYWGESLDVEASAEKIAQLIKEGANVFRFNFSHGDHAEQGARMATVRKAEEIAGQKVGFLLDTKGPEIRTELFEDGADFHSYTTGTKLRVATKQGIKSTPEVIALNVAGGLDIFDDVEVGKQILVDDGKLGLTVFAKDKDTREFEVVVENDGLIGKQKGVNIPYTKIPFPALAERDNADIRFGLEQGLNFIAISFVRTAKDVNEVRAICEETGXGHVKLFAKIENQQGIDNIDEIIEAADGIMIARGDMGIEVPFEMVPVYQKMIITKVNAAGKAVITATNMLETMTDKPRATRSEVSDVFNAVIDGTDATMLSGESANGKYPVESVRTMATIDKNAQTLLNEYGRLDSSAFPRNNKTDVIASAVKDATHSMDIKLVVTITETGNTARAISKFRPDADILAVTFDEKVQRSLMINWGVIPVLADKPASTDDMFEVAERVALEAGFVESGDNIVIVAGVPVGTGGTNTMRVRTVK

SEQ ID NO: 8793 - DNA, 390 bp, Streptococcus agalactiae
atgaagaaaatacgaagctataccagtatctggtctgtggaaaaggtactgtattctatcaatgattttagacttccgtttcccataacctttacgcaaatgacatggtttgtcgtgtcactctttgcagtgatgatacttggcaacttgccccctctttccatgatagagggagcatttctcaaatactttgggattcctgtggctttcacatggtttatgtctacaaaaacttttgatggtaaaaagccttatggatttttgaagtctgtcattgcttatgcactgcgaccaaagctgacctatgcaggaaaaaaagtaacgcttggcagaaaccagccacaagaagccattacagcagttaggagtgaattttatggcatatccaat

SEQ ID NO: 8794 - protein, 130 aa, Streptococcus agalactiae
MKKIRSYTSIWSVEKVLYSINDFRLPFPITFTQMTWFVVSLFAVMILGNLPPLSMIEGAFLKYFGIPVAFTWFMSTKTFDGKKPYGFLKSVIAYALRPKLTYAGKKVTLGRNQPQEAITAVRSEFYGISN

SEQ ID NO: 8795 - DNA, 999 bp, Streptococcus agalactiae
atgaagttgaaaactttagtgattggtggttctggattattcttgatggtcttctcactgcttctgtttgttgccattttattttcagatgaacaggacagcggaatttccaatattcattatggaggtgtgaatgtttccgcagaagtgctggctcataagcctatggtagaaaaatatgccaaagaatatggcgttgaagaatatgtcaacatacttcttgcgattatacaggtggaatcgggcggtactgcggaagatgttatgcagtcctcggaatccctcggtcttccacctaattcattgagtacagaagaatccattaagcaaggtgtgaagtatttcagtgaattattagccagtagcgaaaggctcagtgtagatttagaatcggttatccagtcctacaattatggtggtggtttcttagggtatgtggctaatcgtggaaataaatatacctttgaactggctcaaagtttctcaaaagagtattcaggtggcgaaaaagtgtcttaccccaatcccatagccatacctatcaatgggggctggcgatacaactatggcaatatgttttatgtgcaactggtaacgcagtatcttgtcacaacagagtttgatgatgatacggtacaagccatcatggacgaagcactgaaatatgagggctggcgatacgtttacggtggagcttccccgactacttcttttgattgtagcggactgacacaatggacgtatggaaaagctggaattaacttaccacgaaccgcacaacagcaatatgatgtgacccagcatatcccactatcggaagcacaagctggcgatttggttttctttcattctacctataacgctggctcttatattactcatgttgggatataccttggcaataaccgtatgtttcatgcaggcgacccaatcggttatgccgacttaacaagcccctactggcaacagcatttagtgggagcaggacgaatcaaacaa

SEQ ID NO: 8796 - protein, 333 aa, Streptococcus agalactiae
MKLKTLVIGGSGLFLMVFSLLLFVAILFSDEQDSGISNIHYGGVNVSAEVLAHKPMVEKYAKEYGVEEYVNILLAIIQVESGGTAEDVMQSSESLGLPPNSLSTEESIKQGVKYFSELLASSERLSVDLESVIQSYNYGGGFLGYVANRGNKYTFELAQSFSKEYSGGEKVSYPNPIAIPINGGWRYNYGNMFYVQLVTQYLVTTEFDDDTVQAIMDEALKYEGWRYVYGGASPTTSFDCSGLTQWTYGKAGINLPRTAQQQYDVTQHIPLSEAQAGDLVFFHSTYNAGSYITHVGIYLGNNRMFHAGDPIGYADLTSPYWQQHLVGAGRIKQ

SEQ ID NO: 8797 - DNA, 978 bp, Streptococcus agalactiae; identical to SEQ ID NO: 4273

SEQ ID NO: 8798 - protein, 326 aa, Streptococcus agalactiae
LEVRMVTLSKEQHLDMFLKMQRIRDVDMKFNKLVRRGFVQGMTHFSVGEEAASVGAIQDLTDSDIIFSNHRGHGQTIAKGIDIGGMFAELAGKATGTSKGRGGSMHLANLEKGNYGTNGIVGGGYALAVGAALTQQYEGTDNIVIAFSGDSATNEGSFHESVNLAAVWNLPVIFFIINNRYGISTDITYSTKIPHLYMRADAYGIPGHYVEDGNDLMAVYEKMHEVINYVRSGNGPAIVEVESYRWFGHSTADAGVYRTKEEVDSWKAKDPVKRYRAYLIENEIATEEELAAIEAQVIKEVEEGVKFAEESPFPDMSVAFEDVFVD

SEQ ID NO: 8799 - DNA, 900 bp, Streptococcus agalactiae
atgaaaatagatgacctaagaaaaagcgacaatgttgaagatcgtcgctccagtagcggaggttcattctctagcggaggaagtggattaccgattcttcaacttttattgctgcgagggagttggaaaaccaagcttgtggttttaatcatcttactgctacttggcggagggggactaaccagcatttttaatgactcatcctcaccttctagttaccaatctcagaatgtctcacgttctgttgataatagcgcaacgagagaacaaatcgatttcgttaataaagtccttggctcaactgaggatttctggtcacaagaattccaaacccaaggttttggaaattataaggaaccaaaacttgttctttacaccaattcaattcaaacaggttgtggtataggtgaatctgcttcaggaccattttattgttcagcagataaaaaaatctatcttgatatttctttttacaatgaattatcacataaatatggtgctactggtgattttgctatggcctacgtcatcgcccacgaagttggtcaccacattcaaacagagttaggcattatggataagtataatagaatgcgacacggacttactaagaaagaagcaaatgctttaaatgttcggctagaacttcaagcagattattatgcaggggtatgggctcactacatcaggggaaaaaatctcttagaacaaggagactttgaagaggccatgaatgctgcccacgccgtcggagacgatacccttcagaaagaaacctacggaaaattagtgcctgatagctttacccatggaacagctgaacaacgccaacgttggtttaacaaaggctttcaatatggtgacatccaacacggtgatactttctccgtagaacatcta

SEQ ID NO: 8800 - protein, 300 aa, Streptococcus agalactiae
MKIDDLRKSDNVEDRRSSSGGSFSSGGSGLPILQLLLLRGSWKTKLVVLIILLLLGGGGLTSIFNDSSSPSSYQSQNVSRSVDNSATREQIDFVNKVLGSTEDFWSQEFQTQGFGNYKEPKLVLYTNSIQTGCGIGESASGPFYCSADKKIYLDISFYNELSHKYGATGDFAMAYVIAHEVGHHIQTELGIMDKYNRMRHGLTKKEANALNVRLELQADYYAGVWAHYIRGKNLLEQGDFEEAMNAAHAVGDDTLQKETYGKLVPDSFTHGTAEQRQRWFNKGFQYGDIQHGDTFSVEHL

SEQ ID NO: 8801 - DNA, 855 bp, Streptococcus agalactiae
atgacaaaaaaacaaaaacaaataacagcttcgattgtaactttgcttttttcattactggcaatagggttaggtgaaagcaaatctttgcctaatgatcacattttaaaacaggtgacagatttaattattagtaatgaatctggcaaaaatacttcccttaaaaatgtatcaggaactcctagtagagagttatctgaatctgttttgactagcaatgttaaaaaacaattgggaacaaatatagcttggaaccagtcaggtgcttttatcattaatcaaaataaaacagatttgaatgctaaagtgtcaagtgcaccatatgctattaatgaaataaagaaggttaataaccaaattgttccgactaaagcaaatgccttattaacaaaagcaactcgtcaatatcgaaatcgagaagaaacagggaatggtagaacttattggaaaccagctggatggcatcagataaatggattaaaagggagctataaccacgctgtggacagaggccatttaattggttatgctttagtagggagtttaagaggatttgatgcctccacaagtaatcctaaaaatattgccacacaagcagcttgggcaaaccaagctaatagcaaccaatcaacagggcaaaattattatgaaactttagttcgtaaagcattggatcgtcataaaactgttaggtatcgtgtgactttaatttatgacagagataatcttttatcttcgggatcacatattgaggctaaatcttcagatggaagtttagaatttaacgtttttattcctaatgtacaatcgggattattatttgattatgcaacaggaaaagtgaagcagacaaag

SEQ ID NO: 8802 - protein, 285 aa, Streptococcus agalactiae
MTKKQKQITASIVTLLFSLLAIGLGESKSLPNDHILKQVTDLIISNESGKNTSLKNVSGTPSRELSESVLTSNVKKQLGTNIAWNQSGAFIINQNKTDLNAKVSSAPYAINEIKKVNNQIVPTKANALLTKATRQYRNREETGNGRTYWKPAGWHQINGLKGSYNHAVDRGHLIGYALVGSLRGFDASTSNPKNIATQAAWANQANSNQSTGQNYYETLVRKALDRHKTVRYRVTLIYDRDNLLSSGSHIEAKSSDGSLEFNVFIPNVQSGLLFDYATGKVKQTK

SEQ ID NO: 8803 - DNA, 714 bp, Streptococcus agalactiae; identical to SEQ ID NO: 4349

SEQ ID NO: 8804 - protein, 238 aa, Streptococcus agalactiae
LESTSNPTVSFLGIDFDLTILAMSLLTITIIFILVFWASRKMTIKPKGKQNVLEYVYELVNNTISQNLGHYTKNYSLLMFILFSFVFIANNLGLMTSLKTHEHNFWTSPTANFGVDITLSLLVAFICHIEGIRKKGIGGYLKGFLSPTPAMLPMNLLEEVTNVASLALRLFGNIFSGEVVTGLLLQLAVLSPFTGPLAFALNIVWTAFSMFIGFIQAYVFIILSSSYIGHKVHGDEEE

SEQ ID NO: 8805 - DNA, 768 bp, Streptococcus agalactiae
atgtatttagaacaattaaaagaggtaaatcctttaaccatttgtatcactaataatgtggtcaaaaactttacagccaatggtttattagctttaggagcttctccggctatgagcgagtgcatagaggacttagaagacttgttaaaagttgcagatgcattattaattaatataggaacactaacaaaagaaagttggcaactttaccaagaagcaatcaaaatagcaaataaaaaccaagttccagttgtattagatcctgtagcggcaggagcaagtcgttttcgattagaagtgtcacttgatttattgaagaattattctattagtttacttacaggaaatggtagtgaaatcgctgctttgattggtgaaaaacaagcgtctaaaggggcagatggcggaaaagtggctgatttagaatcaattgctgtaaaagccaatcaagtttttgatgtgccagtggttgtcacaggagaaactgatgctatcgctgttagaggagaagttcgcttattacaaaatggtagtcctttaatgccacttgttacaggaactggatgtctattaggggcagtattggctgcttttattggtagttctgacagaagcgatgatcttgcttgtctgacagaggccatgactgtttataatgttgctggagaaattgcagagaaggtggcaaaaggtaagggggtgggaagtttccaagttgcatttttagatgccctttcccagatgaaatcagaaatgattatggacaaa

SEQ ID NO: 8806 - protein, 256 aa, Streptococcus agalactiae
MYLEQLKEVNPLTICITNNVVKNFTANGLLALGASPAMSECIEDLEDLLKVADALLINIGTLTKESWQLYQEAIKIANKNQVPVVLDPVAAGASRFRLEVSLDLLKNYSISLLTGNGSEIAALIGEKQASKGADGGKVADLESIAVKANQVFDVPVVVTGETDAIAVRGEVRLLQNGSPLMPLVTGTGCLLGAVLAAFIGSSDRSDDLACLTEAMTVYNVAGEIAEKVAKGKGVGSFQVAFLDALSQMKSEMIMDK

SEQ ID NO: 8807 - DNA, 699 bp, Streptococcus agalactiae; identical to SEQ ID NO: 4411

SEQ ID NO: 8808 - protein, 233 aa, Streptococcus agalactiae
VFCNTFLGGVILFNLKNYHPAITFLCLLIPTFSFSFTLRLRTSLLFLIIVVTLQCFVKVSLKTWAKVNLISFVMGLSLFLGTYFWGKLPHQFVLASLVACRPLIFMNVGLLFHASHSNYDFIESLYQTFKVPSHFAYGIFAVFNLLPLIKLQYQRNRLAFRLKNQVTWALSPRLILSVLLKTIYWVEQLELAMLSKGFEVGKERTHASTYPVRFRDYSLLGMSILLSIGMIFK

SEQ ID NO: 8809 - DNA, 639 bp, Streptococcus agalactiae; identical to SEQ ID NO: 4419

SEQ ID NO: 8810 - protein, 213 aa, Streptococcus agalactiae
LQMEFFVVKIFCRLLPLICHREGVMMTNHKTKKLTVLAIMIALDVFLTPIFRIEGMAFMSSVVNIIAGVIMGPIYALVMALVTAFIRILTQAGVASVAPLAILGAGPGAFLAGWFYRFYAKDWMSWVGEFIGTGIIGALLSAPIMVWFWTWTADGNHEVLAKASAAQSIFLFMPRFIGATIIGGVIALLLLQGLKRVPVFMTIQALFKGEKVK

SEQ ID NO: 8811 - DNA, 546 bp, Streptococcus agalactiae
atgaaaaaaataacaactttaatcttagctagtagcttattactagttgcaacgacatcggttaaagctgatgataactttgaaatgccaacgcgttatgttaaaatgagtgaaaaatcaaaagcattttatcaaagactacaagaaaaacaacgtaaggcacatactactgtgaagacttttaataattcagaaataaggcatcaactacctcttaaacaagaaaaggctagaaatgatatctacaatttaggcattcttatttctcaggagtctaaagggttcatccaacgtattgataatgcctattctttggaaaatgtctcagatattgttaatgaagctcaggctttgtataaacgtaactatgatttatttgaaaaaatcaaatctacacgtgataaggttcaagtcttacttgcatcgcatcaagataatacagacttaaaaaacttttatgctgagttggacgatatgtatgaacatgtttatctcaatgaaagtagagtggaggcgataaacagaaatatccaaaaatataattag

SEQ ID NO: 8812 - protein, 181 aa, Streptococcus agalactiae; identical to SEQ ID NO: 4422

SEQ ID NO: 8813 - DNA, 2259 bp, Streptococcus agalactiae
atgaaaaaacaatttttaaaatcagcagcgattctatcgctagcagtaacagcagtatctacaagtcagccggtaggggcgatagtgggaaaagatgaaacgaaattaagacagcaacttgggtatattgattcaaaaaaatctggaaagaaaattgatgagagatggggtgaaaaaatttataactatctaagttatgagctcattgaagcaaacgaatggattaaccgaagtgagtttcaggaacctgagtatagaactattttatcagaatttaaagataaaatagatagtattgaatactacttaattaacttaagtaatattgctaaagaagatgcgcatcaaagaaatattcttcaatcattagataaatatgaaaaaagtggaatatataatttagaccaaggtgtttataattatatatatcaagaaattagttcagcgaagcacaagttttcggatggggtagataaaatttatcgtttagatagtactttatttcctttctctgtatggtatgataaacatttagataataatgataactacaaggataataaagattttaaagagtacattgctttattaaatgaaattacacgaaaagcaaggttaggatatcaaattgtaaataaccataaagatggggagcataaagatgaagcagaaatactggatattttaatcagagatataacttttgtttcaaaagatgctcctggatataaatatattccaaataaaagaattgcagcgaaaataattgaagatttagatggaattatcaatgacttttttaagaatacaggaaaagataagccttctcttgaaaagttaaaggacacagaattccataaaaaatatcttaattcaactgaaccgtatagtattgaaactaacttaccttcaaattataaagaattgaaggaaaagcaaataaaaaaattggaatatggatacaaaaagtcttctaaaatttatacgtctgctcattatgcactatatagtgaagaaattgatgctgcaaaagaattgcttcaaaaagtgaagattgcaaaagataattataatgaaattaagtccatgaatctaagcccttcaatttttaatcagtatttacaacttcttcaaatagttataagttcagagataaatctaaaaaaggcactcgataacactgtggatttacccatagaaaataattttaatacattggacattcaatataataaattagacactgctattaagtcacttcgaaaatttgtaactaagtataaacaagaagtaagaaaagctactaagagttattctaaaaaagaattagtaaatgcagagttaacaaaagtaatttctaatgacaatattttattagacatgcaagcaattagttccaattatgggtctactaaaaagtttgtttattcagtcaaaagattaccttacgtcccgcaagtaattatgacaacaacgtctaatgtacttatgcctcaaaagcaagttgaaaaagtgaagctactcaccccatttacaatttctaataaagaagtattgaatcatgactcactagtagaaaatgatgctcaaaaacaaaaagtagaacaggaaaaaactaaatcgctagctcctcaaaaaggggctgtaaaagaacaaactgagcaaaaagtatctggaaatactcaagagatagaaaagaaatctgaaactgtggcaactccacaacaaagttcagttgcgcaaacttctgtccaacagccggctccggttcaatcagttgttcaagaatccaaagcttctcaagaggagattaatgcagcacacgatgctatttcggcgtataaatcaacagtcaatattgctaatacagccggtgtaacaactgcggaaatgaccacgctcattaatactcaaacttctaatctttctgatgttgagaaagctttaggaaataataaggttaataatggtgcagtcaatgtattgagagaagatacagctcgtcttgagaatatgatttggaatcgtgcttaccaagctattgaagaattcaacgtcgctcgtaatacttataataaccaaatcaagacagaaacagttccagttgataatgatattgaagctattttagcaggttctcaagctaaaattagccatttggacaatcgtatcggagcgcgccacatggatcaagcttttgtagctagtttattagaagttactgagatgagtaaatcaatctcatcgcgtataaaagag

SEQ ID NO: 8814 - protein, 753 aa, Streptococcus agalactiae
MKKQFLKSAAILSLAVTAVSTSQPVGAIVGKDETKLRQQLGYIDSKKSGKKIDERWGEKIYNYLSYELIEANEWINRSEFQEPEYRTILSEFKDKIDSIEYYLINLSNIAKEDAHQRNILQSLDKYEKSGIYNLDQGVYNYIYQEISSAKHKFSDGVDKIYRLDSTLFPFSVWYDKHLDNNDNYKDNKDFKEYIALLNEITRKARLGYQIVNNHKDGEHKDEAEILDILIRDITFVSKDAPGYKYIPNKRIAAKIIEDLDGIINDFFKNTGKDKPSLEKLKDTEFHKKYLNSTEPYSIETNLPSNYKELKEKQIKKLEYGYKKSSKIYTSAHYALYSEEIDAAKELLQKVKIAKDNYNEIKSMNLSPSIFNQYLQLLQIVISSEINLKKALDNTVDLPIENNFNTLDIQYNKLDTAIKSLRKFVTKYKQEVRKATKSYSKKELVNAELTKVISNDNILLDMQAISSNYGSTKKFVYSVKRLPYVPQVIMTTTSNVLMPQKQVEKVKLLTPFTISNKEVLNHDSLVENDAQKQKVEQEKTKSLAPQKGAVKEQTEQKVSGNTQEIEKKSETVATPQQSSVAQTSVQQPAPVQSVVQESKASQEEINAAHDAISAYKSTVNIANTAGVTTAEMTTLINTQTSNLSDVEKALGNNKVNNGAVNVLREDTARLENMIWNRAYQAIEEFNVARNTYNNQIKTETVPVDNDIEAILAGSQAKISHLDNRIGARHMDQAFVASLLEVTEMSKSISSRIKE

SEQ ID NO: 8815 - DNA, 1425 bp, Streptococcus agalactiae
ttgacaaaagaatatcaaaattatgtcaatggcgaatggaaatcatctgttaatcagattgagattttgtcaccaattgatgattcttcattgggattcgtgccagcgatgactcgagaagaagttgatcatgctatgaaagcgggtcgtgaggctttaccagcctgggctgctttgacagtatatgaacgtgcacaataccttcataaagccgcagacattattgaacgtgataaagaagaaattgctactgttttagcaaaagaaatttctaaagcttacaatgcttcagtaactgaggttgtaaggacagctgatcttattcgttatgcagcagaagaaggaattcgtttatcaacttcagctgacgaaggtggaaaaatggatgcttcaacaggtcataagttggctgttattcgtcgtcaaccagtaggtatcgttttagcaatcgcaccttataattaccctgttaacctctcaggatcaaaaattgcgccagctctaattggtggaaacgttgtgatgtttaaaccaccaacacaaggttcagtctcaggacttgttttagcaaaagcttttgcagaagcaggtcttccagcaggtgtctttaatactattacaggacgcggttctgagattggagattacattgttgagcatgaagaagttaattttattaactttacaggatcaacgccagttggaaaacgtattggtaagttagcaggaatgcgtccaattatgcttgagttgggtggtaaggatgcaggtgtcgtcttagctgatgctgaccttgacaacgctgctaaacaaatcgttgcaggtgcttatgattactccggacaacgctgtacggcaattaagcgtgtacttgtcgttgaagaagttgcagatgaattggcagaaaaaatatctgaaaatgtagcaaaattatcagtaggkkatccatttgataatgcaacggtgacaccggttattgatgataattcagccgactttattgaaagcttagtagtagatgcacgtcaaaaaggtgcgaaagaattgaatgaatttaaacgtgatggtcgtctattaactccaggattgtttgatcatgttactttagatatgaaactagcttgggaagagccttttggaccaattctcccaattattcgtgtcaaggatgcagaagaagctgttgctattgccaacaaatytgattttggattacaatcatcagtctttacacgtgatttccaaaaagcatttgatatagcaaataaacttgaagttggtacagttcacattaacaataagactggacgtggtcctgataatttcccattcttaggactcaaaggatctggtgcaggtgttcaaggtatcagatattcaattgaagcaatgacaaatgtaaaatcgatagtttttgatatgaaa

SEQ ID NO: 8816 - protein, 475 aa, Streptococcus agalactiae
  MISC_FEATURE (1)..(475): Xaa = Any Amino Acid
LTKEYQNYVNGEWKSSVNQIEILSPIDDSSLGFVPAMTREEVDHAMKAGREALPAWAALTVYERAQYLHKAADIIERDKEEIATVLAKEISKAYNASVTEVVRTADLIRYAAEEGIRLSTSADEGGKMDASTGHKLAVIRRQPVGIVLAIAPYNYPVNLSGSKIAPALIGGNVVMFKPPTQGSVSGLVLAKAFAEAGLPAGVFNTITGRGSEIGDYIVEHEEVNFINFTGSTPVGKRIGKLAGMRPIMLELGGKDAGVVLADADLDNAAKQIVAGAYDYSGQRCTAIKRVLVVEEVADELAEKISENVAKLSVGXPFDNATVTPVIDDNSADFIESLVVDARQKGAKELNEFKRDGRLLTPGLFDHVTLDMKLAWEEPFGPILPIIRVKDAEEAVAIANKXDFGLQSSVFTRDFQKAFDIANKLEVGTVHINNKTGRGPDNFPFLGLKGSGAGVQGIRYSIEAMTNVKSIVFDMK

SEQ ID NO: 8817 - DNA, 462 bp, Streptococcus agalactiae
atgaattacattattacatttttgatttcaatgattcccttagtggaactacgaggagctgtgccatttgcaatcgctaatggaatacctttgtgggaagcgctagctatcggtgttgttggaaacatgctacctgtacctatcatcttcttctttgctcgcaaagttctagaatggggagcagataaaccttatactggtaagtttttcacatggtgccttaaaaaaggacatagcggtggtcaaaaacttgaaaaagtagctggagaaaaaggattgtttattgccttgctattgtttgtaggcattcccttacccggaacaggagcctggactggcacgcttgcagctagcctyctagattgggaatttaaacatagtgttattgctgttatgctaggtgttatactagctggatgcatcatgggaacattatccattatcggcttcaacctattctag

SEQ ID NO: 8818 - protein, 153 aa, Streptococcus agalactiae; identical to SEQ ID NO: 4530

SEQ ID NO: 8819 - DNA, 2448 bp, Streptococcus agalactiae
atgagtcattattccataaaattacaagaagtattcagattggcgcaatttcaagcagcacgctatgaaagtcactatttagaaagctggcatcttcttttagcaatggttttagttcatgattcagtagctggtttgacatttgctgaatatgagtctgaagttgcaattgaagagtacgaagcagcaacaattttagctttaggtagagcaccgaaagaagagattaccaattatcaatttttagagcaatcaccagctttgaaaaagatcttaaagttagcagaaaatattagtatcgtagtaggagctgaagatgtgggtactgaacatgtcttgcttgctatgttggttaataaagatttattagccacacgtatcttaragttagttggctttagaggtcaagacgatggtgaatcagttcgtatggttgatttacgtaaggctctagaacgtcatgccggttttacaaaagatgatatcaaagcaatttatgaattacgtaatcctaaaaaagcaaagtcgggtgcttctttttctgatatgatgaaaccaccgagtactgctggtgatttagctgatttcacacgtgatttatcacagatggcggttgatggggaaattgaacctgttattgggcgtgataaagaaatttcacgtatggtccaagtcttaagtcgtaaaacaaagaataatcctgtcttagttggagatgcgggtgtcggtaaaacagctttggcgtacggtctagcacaacgtattgctaatggaaatattccttatgagcttagagatatgcgtgttctagagttagatatgatgagcgttgttgctggaactcgttttcgtggtgattttgaggaacgtatgaatcaaatcattgcagatattgaagaagacggtcatattattcttttcattgatgaactgcatactattatgggttctggctctggtattgatagcacacttgatgctgctaatattttaaaaccagctttggcccgaggcactttacgcactgttggagcaacaactcaagaggaatatcaaaagcatattgaaaaagatgctgctttatctcgtcgctttgcaaaagttttagtagaagaaccaaatcttgaagacgcatatgaaattctacttggattgaagccagcgtatgaagcctttcataatgttactatttcagatgaagcagttatgactgctgtaaaagtggctcatcgttatttgacaagtaagaatttaccagactcagctatagacttacttgatgaagcttctgccactgtgcaaatgatgattaagaaaaatgctccttcgcttttaacagaagttgaccaagctattttagatgatgatatgaaatctgcttctaaagctctaaaagcaagttataagggtaaaaagcgtaagcctattgccgtaacagaagatcatattatggcaactctcagtcgtctatctggtattcctgttgaaaaattgacacaagctgatagtaaaaaatacctcaatttagaaaaagaattgcataaacgtgttatcggtcaagatgatgcagttactgccattagtcgtgctatccgtcgcaatcaatctggcattcgtactggtaagcgtcctattggttcctttatgttcttgggaccaactggtgttggtaagacagagttagcaaaagccttggcagaagtgttgtttgatgatgaatcagccctaattcgttttgatatgtcggaatatatggaaaaattcgcagcttctcacctgaatggggcacctccaggttatgttggttatgatgaaggaggagagttgactgaaaaagtacgcaataaaccatattcagttttactttttgatgaagttgaaaaagctcatccagatatttttaatgtattattacaagtgcttgatgatggcgttttaacagatagtcgaggacgaaaagttgatttttcaaatactataatcattatgacttctaatttaggagcaactgcattacgtgacgataaaacagttggttttggagctaaggatatcagccatgattatactgctatgcaaaaacgtattatggaggagcttaaaaaagcttatcgaccagagtttatcaatcgtattgatgagaaagttgtattccatagtctcagtcaagataatatgcgtgaagttgtgaaaattatggttaaacctttaattttagcgcttaaagataaaggtatggatctgaaattccagccttcagccttgaaacacttggcagaggatggctatgatatagaaatgggtgctcgtccactgcgtagaactattcaaacgcaagtagaggatcatttatcagaactactattggcaaatcaagtgaaagaggggcaagtaattaagattggcgtatccaaaggcaaattgaaatttgatattgcaaaatcataa

SEQ ID NO: 8820 - protein, 815 aa, Streptococcus agalactiae
  MISC_FEATURE (1)..(815): Xaa = Any Amino Acid
MSHYSIKLQEVFRLAQFQAARYESHYLESWHLLLAMVLVHDSVAGLTFAEYESEVAIEEYEAATILALGRAPKEEITNYQFLEQSPALKKILKLAENISIVVGAEDVGTEHVLLAMLVNKDLLATRILXLVGFRGQDDGESVRMVDLRKALERHAGFTKDDIKAIYELRNPKKAKSGASFSDMMKPPSTAGDLADFTRDLSQMAVDGEIEPVIGRDKEISRMVQVLSRKTKNNPVLVGDAGVGKTALAYGLAQRIANGNIPYELRDMRVLELDMMSVVAGTRFRGDFEERMNQIIADIEEDGHIILFIDELHTIMGSGSGIDSTLDAANILKPALARGTLRTVGATTQEEYQKHIEKDAALSRRFAKVLVEEPNLEDAYEILLGLKPAYEAFHNVTISDEAVMTAVKVAHRYLTSKNLPDSAIDLLDEASATVQMMIKKNAPSLLTEVDQAILDDDMKSASKALKASYKGKKRKPIAVTEDHIMATLSRLSGIPVEKLTQADSKKYLNLEKELHKRVIGQDDAVTAISRAIRRNQSGIRTGKRPIGSFMFLGPTGVGKTELAKALAEVLFDDESALIRFDMSEYMEKFAASHLNGAPPGYVGYDEGGELTEKVRNKPYSVLLFDEVEKAHPDIFNVLLQVLDDGVLTDSRGRKVDFSNTIIIMTSNLGATALRDDKTVGFGAKDISHDYTAMQKRIMEELKKAYRPEFINRIDEKVVFHSLSQDNMREVVKIMVKPLILALKDKGMDLKFQPSALKHLAEDGYDIEMGARPLRRTIQTQVEDHLSELLLANQVKEGQVIKIGVSKGKLKFDIAKS

SEQ ID NO: 8821 - DNA, 642 bp, Streptococcus agalactiae
atgttgattgttttagctggaaccattggagcaggtaaaagctcccttgcagctgctctaggacaacacctagggacagatgttttctatgaggcggttgataataacccagttttagatctttactatcaagatccccaaaaatatgcttttttactacaaatattctttttaaataaacgattccaatctataaaagaagcctataaggctaacaacaatgttttggatcgttctatttttgaagatgaactattcctcactctaaattataagaatggaaatgtgactaaaacagagctagatatctataaagaacttcttgcaaatatgttggaagaattagaaggtatgcctaagaagagacctgatttgctagtctacattgatgtttcatttgataaaatgttagaacgtattgacaaacgaggacgcagctttgagcaagttgattctaacccagagttatacgactactacaaacaagtccattctgaatatccagaatggtatgaaaattacgacgtttcacctaaaattcggatcgatggtaacaaacttgatttcgtcaaaaatccagaggatcttcaacacgtccttgacactattgattccgaattgcaaaaacttgatttactataa

SEQ ID NO: 8822 - protein, 213 aa, Streptococcus agalactiae; identical to SEQ ID NO: 4540

SEQ ID NO: 8823 - DNA, 615 bp, Streptococcus agalactiae
atgcgtaaatttttccaagatgttattgtagaggtggcttattatttagagattgctttgtcagttattctggcaacagctattattttttttagtttagcactctttcatgatttgtttagcatgttgtctgttgatcaaaatgttgataagttgttccagactttccttgctcgcgccatgacaatagcagtcgggattgagttgatcaaaatgttttcaaaaccttccccagatactttaattgaagtgttattgtttgccttagctcgtcaacttgtaattgaacatggtagtgtttcagattaccttatggggattgcttcagttgctattttgtttgctgttcgtaaatatcttttcacccattttgatgggtcaagcaacattgttttacgtgctaataacaaagtcaaaaaagctaatattttagctagggttcaactaccttgtcaacccaatgaaactttaggagacttacttgttcgtcatttaaatgatgaggaaaaggacgttgctattggttcagtagtctatattaataacgttgcattgcgtgttgatagtatgcacgatggtcttgtgacgcgtgtagaaatcattaggagtctacat

SEQ ID NO: 8824 - protein, 205 aa, Streptococcus agalactiae
MRKFFQDVIVEVAYYLEIALSVILATAIIFFSLALFHDLFSMLSVDQNVDKLFQTFLARAMTIAVGIELIKMFSKPSPDTLIEVLLFALARQLVIEHGSVSDYLMGIASVAILFAVRKYLFTHFDGSSNIVLRANNKVKKANILARVQLPCQPNETLGDLLVRHLNDEEKDVAIGSVVYINNVALRVDSMHDGLVTRVEIIRSLH

SEQ ID NO: 8825 - DNA, 1449 bp, Streptococcus agalactiae
atgctagaagctttacataaattctttgaagtctttggtgcagcaactgttgtacccgctatgatttttattgtcagcctttttctaaaggtcaatccaaggcgagctttctttagcgccttacgagctggtgttggactcacaggctttggttggattatatcagcttttgctcctatggtgactaagtatatccagcagatggttaaaactactggtctccatttaccaattgtagatattggttggcaggctggttctctcaccgccttttcttctgagattggcctctctttctttgtttttggcttgctaattgaattggggcttttcttgcttgggattacccgagtatttgtcccatctaatctttggaataactttggctatatgatttggggtacaatggcctatgcagcaacaggtaattttatattgtctttcgcatttatggtttttgtcttactctattcattagtgatgtcagaagtattggcagatcgatggtcggagtattacggtgttaaaaatgcaacgatcaactcgattcataatattgaaacccttattccagctcttattcttgatcctctttggaacctacttggtgtcaataaggtaaagttgaacccagaatcattaaagactaagttagggatatttggtgagccaatgacacttggttttatacttggtgtgattattggtgtattaggtagtttacgtaaccttgcaagtattgatacttggggaggtatacttggttttgcagttgctcttgcagcggttatgactatttttcctttgattacgggggtatttgctagtgcttttgctcctcttgctgaagcagttgaacgcaataagaaaaaagaaagtcaagctgagcaaggagcactggataaaaaacgttggtttattgcagttgatgacggtgttggttttggtgaaccagcaactattatcgcaggtctcattttagtaccaataatggttgttatttccttgattttacctggaaatgaagctttaccagtcgttgaccttattgctatcccttttatgattgaagctatgatagctgtgtcaaaaggaaatattcttaaagctattttgaatggaatcatatggttttcactaggtctttatgctgctagtgccctaggtccaatctacacagaagctgttaagcattttggaactgctttaccagcaggggtaactttgattatgagctttaatctcctagctcatcctttgacagctctagtcttctttgcttggatatctgggaacccactctatattggtgtgacagttgttatctatcttgctttcttgttcttgcttcgtactcatcgtgaatctatttacgcataccttaaaactatggctgataagaatagcggatatgaaggtagttgtgaaaaaatctttattgctgaagat

SEQ ID NO: 8826 - protein, 483 aa, Streptococcus agalactiae
MLEALHKFFEVFGAATVVPAMIFIVSLFLKVNPRRAFFSALRAGVGLTGFGWIISAFAPMVTKYIQQMVKTTGLHLPIVDIGWQAGSLTAFSSEIGLSFFVFGLLIELGLFLLGITRVFVPSNLWNNFGYMIWGTMAYAATGNFILSFAFMVFVLLYSLVMSEVLADRWSEYYGVKNATINSIHNIETLIPALILDPLWNLLGVNKVKLNPESLKTKLGIFGEPMTLGFILGVIIGVLGSLRNLASIDTWGGILGFAVALAAVMTIFPLITGVFASAFAPLAEAVERNKKKESQAEQGALDKKRWFIAVDDGVGFGEPATIIAGLILVPIMVVISLILPGNEALPVVDLIAIPFMIEAMIAVSKGNILKAILNGIIWFSLGLYAASALGPIYTEAVKHFGTALPAGVTLIMSFNLLAHPLTALVFFAWISGNPLYIGVTVVIYLAFLFLLRTHRESIYAYLKTMADKNSGYEGSCEKIFIAED

SEQ ID NO: 8827 - DNA, 1725 bp, Streptococcus agalactiae; identical to SEQ ID NO: 4635

SEQ ID NO: 8828 - protein, 575 aa, Streptococcus agalactiae
LENLLQHKLPVAPFVESTTNWITKTFSGLFDFIQTIGNALMDWMTKTLLFINPLLFIVLITIAVFFLAKKKWQLPTFTFIGLLFIYNQGLWEQLINTFNLVLVASLISIIIGVPLGIWMAKSDKVKQVVNPILDFMQTMPAFVYLIPAVAFFGIGMVPGVFASVVFALPPTVRFTNLAIREIPLELIEASDSFGSTVKQKLFKVELPLAKNTIMAGINQTMMLALSMVVTGSMIGAPGLGREVLSALQHADIGTGFVSGLSLVILAIVLDRVSQFFNSKPGEKQAKTSKVKKWVGLGALALFILAALGRIVVNMTSGNEAKGQKVKIAYVQWDSEVASTNVIAEVLKSKGYDVELTPLDNAVMWQTVANGNADFTTSAWLPKTHGQYFNKYKNSLDDLGPHVENVKIGLVVPKYMNVNSIEELSNQADKQITGIEPGAGIMKSAKQSLKDYPNLSSWKLLSASTGAMTTTLGKAIKNKDQVVITGWSPHWMFAKYDLKYLKDPKKSFGGEEHINTIARKNLKKDMPKVYKIIDKFKWTKEDMESIMLDMDKGMEPAKAAQKWIKNHKKEVSEWTK

SEQ ID NO: 8829 - DNA, 966 bp, Streptococcus agalactiae; identical to SEQ ID NO: 4669

SEQ ID NO: 8830 - protein, 322 aa, Streptococcus agalactiae
VVSKLSLTTIFALLFSSMLIYATPLIFTSIGGTFSERGGIVNVGLEGIMVIGAFSGVVFNLEFASVFGDATPWISVLVGGLVGLIFSVIHAVATVNFRADHIISGTVLNLMAPSLAVFLIKVLYNKGQTDNIQESFGKFNFPILSDIPFVGDIFFKGTSLVGYIAILFSFLAWFILYKTRFGLRLRSVGEHPQAADTLGINVYLMRYSGVLISGFLGGIGGAVYAQSISVNFAATTILGPGFISLAAMIFGKWNPIGAMLASLFFGLSQSLAVIGSHLPLLSNIPTVYLQIAPYVLTIIVLAAFFGQAVAPKADGINYIKTK

SEQ ID NO: 8831 - DNA, 1059 bp, Streptococcus agalactiae
atgtctaagaaggcgcaaaaaattgcagttcctctgatttcagttgtactaggaatcattctaggagctattattatgctgatatttggttatgatccactttggggttatgagggattgttccaaacagcattcggtagtataaaaaatattggtgaaattttccgtgcaatgggaccattaattttaattgctctaggtttctcagttgccagtcgtgcaggtttctttaatattggacttccagggcaagccttatcaggatggattgccgcaggttggttcgctctttcacacccagatatgccacgtccagcaatgattctttgtactattattattggtatcgttgctgggggaatcactggagctattccaggtattctcagagcataccttggaacaagtgaagttattgtaactattatgatgaactatattgttctttattcaggaaatgctattgtacaacgtgttttcccaaaaagcattatgcgtacaagtgactcgagtgtatatgtttctgccaatgcatcataccagacagattggttatctagtttaacgaataattcacgtatcaatattggtatcttcattgctattattgcagttgtgttagtttggttcctattaaataaaacaacgcttggatttgaaattcgttcagttggtttaaatccaaatgctagtgagtacgctggtatgtctgcaaagcgtacaattattctatcaatgattatttctggagcttttgcaggacttggtggtgttgttgaaggactaggtacatttgagaatgtatttgtacagccatcctcgttagctattggctttgacggtatggcagtaagtctactcgcagcgaatagtccaataggtattttatttgcagcatttctatttggtgttctaagtgttggtgcgcctggtatgaacattgcaggtattccacctgagttaattaaagttgtaacagcttcaatcatcttcttcgtaggtgtccattacattattgagtatgttattaaacctaaaaaacaaatgaaaggtggtaag

SEQ ID NO: 8832 - protein, 353 aa, Streptococcus agalactiae
MSKKAQKIAVPLISVVLGIILGAIIMLIFGYDPLWGYEGLFQTAFGSIKNIGEIFRAMGPLILIALGFSVASRAGFFNIGLPGQALSGWIAAGWFALSHPDMPRPAMILCTIIIGIVAGGITGAIPGILRAYLGTSEVIVTIMMNYIVLYSGNAIVQRVFPKSIMRTSDSSVYVSANASYQTDWLSSLTNNSRINIGIFIAIIAVVLVWFLLNKTTLGFEIRSVGLNPNASEYAGMSAKRTIILSMIISGAFAGLGGVVEGLGTFENVFVQPSSLAIGFDGMAVSLLAANSPIGILFAAFLFGVLSVGAPGMNIAGIPPELIKVVTASIIFFVGVHYIIEYVIKPKKQMKGGK

SEQ ID NO: 8833 - DNA, 828 bp, Streptococcus agalactiae
ttgactcacaaaaatatattattaaccattatatttggattatttatgattatattatcagcatgtggtatgtctaataaggaaatggctggtattgataattgggaacattatcaaaaggaaaagaaaattactattggatttgataatacttttgttcctatgggatttgaaagtcgttctggtgactataccggctttgatattgatttagctaatgctgtttttaaagaatacggtatttcagtgaaatggcagcctattaactgggatatgaaagaaactgaacttaataatggtaatatagaccttatttggaatggttattcaaaaacggcagaacgtgctaaaaaagtcgcttttacaaacccatatatgaataatcatcaagtaattgttactaaaacttcatcacatattaatagtattaaggatatgaaggggaaaaaactaggagcccagtcgggttcatctggttttgatgcttttaacgctaaacctgatattttaaaaaagtttgtaaaaggaaaagaagcagttcaatacgatactttcactcaggctttgattgatttaaaaaataaccgtattgatggtcttttgattgatgaagtttatgctaactattatttaaagcaagaaggaaatataaaagcttattattttgttaaaactgcttatcaaggagaaaattttgtagtaggagctcgtaaagttgatcgtagactaattgaaaagattaacaaagctttcaaacagcttcataataaggggagatttcaaaaaatctcttacaaatggtttggtgaagatgtttatagtaaagaa

SEQ ID NO: 8834 - protein, 276 aa, Streptococcus agalactiae
LTHKNILLTIIFGLFMIILSACGMSNKEMAGIDNWEHYQKEKKITIGFDNTFVPMGFESRSGDYTGFDIDLANAVFKEYGISVKWQPINWDMKETELNNGNIDLIWNGYSKTAERAKKVAFTNPYMNNHQVIVTKTSSHINSIKDMKGKKLGAQSGSSGFDAFNAKPDILKKFVKGKEAVQYDTFTQALIDLKNNRIDGLLIDEVYANYYLKQEGNIKAYYFVKTAYQGENFVVGARKVDRRLIEKINKAFKQLHNKGRFQKISYKWFGEDVYSKE

SEQ ID NO: 8835 - DNA, 1347 bp, Streptococcus agalactiae
atgagaataattgttgtcggcggaggtaaagtcggaaccgcactttgtcgctcacttgttgctgaaaagcacgatgttgttttaattgagaaaaaagaaaacgtccttaaacgtgtcactaaacagcatgatattatgggaattgttgggaatggagcaaactataaaattttagaacaagccgaagtcaaaaattgtgatatttttatcgctatcactgatcgagatgaagttaatatgatttcagcagttcttgccaaaaaaatgggggcaaaagagactgttgttcgcatgcgtaatcctgagtattctaatccttacttcaaagataaaaactttcttggcttctcttcagttgtcaaccctgaattgttagcagcacaatatatcgctaataccatagaatttccaaatgcaacttcagttgaacacttcgccaacgggcgtgtgatgttaatggaatttaaaattttagaaggaaataaactctgtcatacttcaatgagtcaaattcgtaaaaaatttggtaatattgttatttgcgcaattgaacgcgatggcaaattgattattcctgatggcgatgcaactatccaagtcaaagataaaatctttgtaactggaaatcgtattgaaatgatacttttccataattacgttaaaaataaagttgtcaaaaacttgatggttatcggtgcaggacgcatcgcctactacctactcaatatccttaaaaataccaatacacacgtcaaactagttgaactcaaccaagagcaagctgaatattttagtcaagaatttcccaatgttcctgtcgttcatggggatggtactgctaaaaatattttgttagaagaaagcgttacaagttttgacgcagttgctactttgactggtgttgatgaagaaaatatcattacctcaatgttcttagaaagtatcggtatccctaaaaacattaccaaagttaatcgaactagcctactagaaatcattgacgataaacaactatcaagcattatcacacccaagcgtattgccgtagaccatgtgatgcactttgtacgcgggcgtgtaaatgctcaggattccaacctagaagctatgcatcatattgctaacgatcgcattgaaaccttacaatttgaaataaaagaaactagcaaattagcaaatcgtagccttgcatctttaaaattaaagcaaaatattttaattgcagcgattattcgcaataataaaacgattttcccaactggtgaggatgttttaacagtgggtgatcgtatcgttgttatcaccttattaaaaaatattactagaactagtgatatgttagcgagg

SEQ ID NO: 8836 - protein, 449 aa, Streptococcus agalactiae
MRIIVVGGGKVGTALCRSLVAEKHDVVLIEKKENVLKRVTKQHDIMGIVGNGANYKILEQAEVKNCDIFIAITDRDEVNMISAVLAKKMGAKETVVRMRNPEYSNPYFKDKNFLGFSSVVNPELLAAQYIANTIEFPNATSVEHFANGRVMLMEFKILEGNKLCHTSMSQIRKKFGNIVICAIERDGKLIIPDGDATIQVKDKIFVTGNRIEMILFHNYVKNKVVKNLMVIGAGRIAYYLLNILKNTNTHVKLVELNQEQAEYFSQEFPNVPVVHGDGTAKNILLEESVTSFDAVATLTGVDEENIITSMFLESIGIPKNITKVNRTSLLEIIDDKQLSSIITPKRIAVDHVMHFVRGRVNAQDSNLEAMHHIANDRIETLQFEIKETSKLANRSLASLKLKQNILIAAIIRNNKTIFPTGEDVLTVGDRIVVITLLKNITRTSDMLAR

SEQ ID NO: 8837 - DNA, 540 bp, Streptococcus agalactiae
atgtcaaaaaaaacaacacaaatggtttcttatacttctattttagtagcttttgcaatcatgattcctataatcatgcctgctaaaataattattgggcctgcttctttcaccttagcaagccatgtacctttatttttaagtatttttatatctgttccagttgcaatattggtagctttagggacaggacttggatttctactagctggttttccgattgtaatcgttcttagagctttatcacatatcggatttgcattaattgcggctttcttgattaagtcaaagccctctttattgatgagtaaatggcaaacattgttatttgctgtagctattaacataattcatggtctgctcgaatttattactgtttatataatcacaatgacttctaacagtagttcaacttatttatggtcactattttctttgataggactaggctctttgctacatggattggtagatttttacatagctctcttcatttggaaatggatgacacaaaagttggggaaaacacttaggataaga

SEQ ID NO: 8838 - protein, 180 aa, Streptococcus agalactiae
MSKKTTQMVSYTSILVAFAIMIPIIMPAKIIIGPASFTLASHVPLFLSIFISVPVAILVALGTGLGFLLAGFPIVIVLRALSHIGFALIAAFLIKSKPSLLMSKWQTLLFAVAINIIHGLLEFITVYIITMTSNSSSTYLWSLFSLIGLGSLLHGLVDFYIALFIWKWMTQKLGKTLRIR

SEQ ID NO: 8839 - DNA, 687 bp, Streptococcus agalactiae; identical to SEQ ID NO: 4779

SEQ ID NO: 8840 - protein, 229 aa, Streptococcus agalactiae
LLQKKYRKSSYLIEGWHLFEEAEKYGAQFLNIFVTETAIDRLRKPERAIVVTDDVLKELTDSQTPQGIVAEIAFQETRWTDIKKGRFLVLEDVQDPGNLGTMVRTADAANFDAVFLSQKSADLYNQKTLRSMQGSHFHLPVFRVEIEQFVNFCKAEGITMIATTLSEQSVNYKNLPKYDYFALIMGNEGQGISKTMTEEADVLAHIEMPGQAESLNVAVAAGVVIFSLI

SEQ ID NO: 8841 - DNA, 930 bp, Streptococcus agalactiae; identical to SEQ ID NO: 4787

SEQ ID NO: 8842 - protein, 310 aa, Streptococcus agalactiae
LKKTLKRILFSSLSLSMLLLLTGCVSVDKAGKPYGVIWNTLGVPMANLITYFAQHQGLGFGVAIIIVTVIVRVVILPLGLYQSWKASYQAEKMAYFKPLFEPINERLRNAKTQEEKLAAQTELMTAQRENGLSMFGGIGCLPLLIQMPFFSAIFFAARYTPGVSSATFLGLNLGQKSLTLTVIIAILYFVQSWLSMQGVPDEQRQQMKTMMYLMPIMMVFMSISLPASVALYWFIGGIFSIIQQLVTTYVLKPKLRRKVEEEYTKNPPKAYKANNARKDVTNSTKATESNQAIITSKKTNRNAGKQKRRG

SEQ ID NO: 8843 - DNA, 1800 bp, Streptococcus agalactiae; identical to SEQ ID NO: 4803

SEQ ID NO: 8844 - protein, 600 aa, Streptococcus agalactiae
LTEFNDDQHSNHDQKSFKEQILAELEEANRLRKLREEELYQKEQEAKEAARRTAQLMADYEAQRLKDEREARAKALETKQRLEEQEKARIEAKLLAEAAREEERRQAEQALASQEEQVINQGMEPSRELDSGSKSSEFRTTENVPDIDLKADKTDVATAVPNQETEEIFLVRATDIPTEGENVKLGEISELEPVAKEPIRVEDLSKEEEGIALSAKNKHNKRERRQKADNVAKRIARILISIIILVLLLTAFVGYRFVDSAIKPVDSNSNKFVQVEIPIGSGNKLIGQILEKAGVIKSATVFNYYSKFKNYSNFQSGYYNLKKSMTLDQIAAELEKGGTAEPTKPALGKILITEGYTIKQIAKAIESNKIDTKTTSTPYKADDFLKLVQDETFIKKMVAKYPNLLGSLPDKSKAIYQLEGYLFPATYNYYKDTTLEGLVEDMISTMNTKMAPYYNTIKAKNMSVNDVLTLSSLVEKEGSTDEDRRKIASVFYNRLSAGQALQSNIAILYAMGKLGDKTSLAEDAQINTSIKSPYNIYTNTGLMPGPVDSPSISAIEATIKPASTDYLYFVADVKTGNVYYAKDFETHKANVEKYINSQIN

SEQ ID NO: 8845 - DNA, 1503 bp, Streptococcus agalactiae; identical to SEQ ID NO: 4843

SEQ ID NO: 8846 - protein, 501 aa, Streptococcus agalactiae
VKNKKDQFIGVKQPLSKKLSQLVFILFFSLFTVFSVLVYTSATRYVLHREKINVGRSLEKTRVRLSQANSSLTSDDILEILYNQVFADDIYPHKRQNGIVRTGESIDSILYVNQEMTLYDVNRKPVFSTLRTGMPTIGKSMGKVIISKVADMEGFVGTKAIYSQKTGQLLGYVQIFYNLGRYYSMRQNIIVFLIMMEVLGTVLALVVINSATKRIVRPVKNLHDLMHQISENPSNLEIRSKVRSEDEIGELSRIFDGMLDQLEDYTRRQSQFISDVSHELRTPVAVVKGHIGLLQRWGKDDPEILEESLAAAYHEADRMSLMINDMLNMIRVQGSLELHQDEVTDLSSSISVVIENFRILREDFQFIFENNISDIVWGKIYKIHFEQALMILIDNAIKYSPSYKEVSVVLSVDNDFATVVVKDKGEGISDEDIEFIFDRFYRTDKSRNRESTQAGLGIGLSVFKQIMDAYHLKVDIKSELNQGTEFIVRIPIKKFEETKEI

SEQ ID NO: 8847 - DNA, 888 bp, Streptococcus agalactiae; identical to SEQ ID NO: 4851

SEQ ID NO: 8848 - protein, 296 aa, Streptococcus agalactiae
LLYQQIASNKRKTVVLLIVFFCLLAAIGAAVGYLVLGSYQFGLVLALIIGVIYAVSMIFQSTNVVMSMNNAREVTEDEAPNYFHIVEDMAMIAQIPMPRVFIVEDDSLNAFATGSKPENAAVAATTGLLAVMNREELEGVIGHEVSHIRNYDIRISTIAVALASAVTLISSIGSRMLFYGGGRRRDDDREDGGNILVLIFSILSLILAPLAASLVQLAISRQREYLADASSVELTRNPQGMISALEKLDRSEPMGHPVDDASAALYINDPTKKEGLKSLFYTHPPIADRIERLRHM

SEQ ID NO: 8849 - DNA, 555 bp, Streptococcus agalactiae
atgggaactatgattttaatagcaattattgctttgtttgttatttggttgattgttgcttataacagtttagttagaagtcgcatgcatactaaagaatcatggagtcaaatagacgttcaattgaaacgtcgtaacgatttaattccaaacctaatcgaaactgttaaaggctatgctgcgtacgaagggaaaacacttgagaagattgcagaactgcgtgctcaagttgctaaagctaacacacctgctgaagcaatgacagcaagtaatgagctaacaagacagctttcaagtattttagcggttgctgaaaattacccagatttaaaagccaacaatagctttgttaaacttcaagaagaactaactaatacggaaaataaaatttcttattcacgtcagttatataacacaacaacatccaattataatgtgaaattagaaactttcccaagtaatattgttggaaaactatttgggttcaaaccaagccaattcttagaaactcctgaagaagaaaaagaagtgccaaaagtttcctttgacttttaa

SEQ ID NO: 8850 - protein, 184 aa, Streptococcus agalactiae; identical to SEQ ID NO: 4856

SEQ ID NO: 8851 - DNA, 1389 bp, Streptococcus agalactiae; identical to SEQ ID NO: 4865

SEQ ID NO: 8852 - protein, 463 aa, Streptococcus agalactiae
LGASMKHFFDYKTMSVARKLSISFIAVILLGSILLSLPIFQYANAPKTHYIDHLFTTVSMVCVTGLSVFPISKVYNGWGQIVAILLMQTGGLGLVTLMSLSYYTLRRKMSLNDQTLLQSAITYNSSTDLKKYLYMIFKVTLTLEVLAASILAIDFIPRFGLGHGIFNSIFLAVSAFCNAGFDNLEATSLAQFKLNPLVNIIVCFLIISGGLGFAVWKDLIEATIQTSHKGPKLIKTFPKRLSNHSKLVLKTTTIILLTGTLLSWLLEFGNFRTIANLSLPKQLMVSFFQTVTMRTAGFSTIDYTQTDFATNLVYIIQMLIGGAPGGTAGGFKVTVIAILLLLFKAELSGQSQVTFHYRTIPSSIIKQTLSILTFFFIILISGYLLLLELNPHIDPFSLFFEASSALATVGVTMNTTNQLTLGGRIVIMFLMFIGRVGPITVLLSILQKKEKEIHYAETEIILG

SEQ ID NO: 8853 - DNA, 669 bp, Streptococcus agalactiae
atgaaaacaaaaattattggtgtacttggtctaggaatatttggacaaacactcgcacaagaactaagtaactttgaacaagatgttattgctattgacagcaatcctgaaaatgtacaagctgtcgccgaagttgttacaaaagcagctatcggagacattactgatttagctttcctaaaacacatcgggatcagtgactgtgatactgttattattgctacaggaaacagtttagagagctcagtattggccgtaatgcactgtaaaaagttaggcgtcccacaagttattgctaaagctcgaaaccttgtatmcgaagaagtactttatgaaattggtgctgatttggttatctctccggagcgagaatctgggcaaaatgttgctgcaaacctcatgagaaataaaattacagatgtcttccagattgaatctgatatttctgtcattgaatttaaaattcccaaatcatgggtagggaaaactgtcgaacaattaaatatccgtcacaagtttgatcttaacctcataggtatcagaaaagcaaaaaacaaacctgtcgataccgaagttccaatcaatagtccacttgaagaargtattattctagtggctatcgctaactcagatgccttccaacgctatgactatttaagatacttttac

SEQ ID NO: 8854 - protein, 223 aa, Streptococcus agalactiae
  MISC_FEATURE (1)..(223): Xaa = Any Amino Acid
MKTKIIGVLGLGIFGQTLAQELSNFEQDVIAIDSNPENVQAVAEVVTKAAIGDITDLAFLKHIGISDCDTVIIATGNSLESSVLAVMHCKKLGVPQVIAKARNLVXEEVLYEIGADLVISPERESGQNVAANLMRNKITDVFQIESDISVIEFKIPKSWVGKTVEQLNIRHKFDLNLIGIRKAKNKPVDTEVPINSPLEEXIILVAIANSDAFQRYDYLRYFY

SEQ ID NO: 8855 - DNA, 828 bp, Streptococcus agalactiae
atggctaaacaattaattggttatcaagagggttatggctttctatacaggctatcaggtgccagtaagttactattttttattttagtttctgttgcttgcatgaccacttatgatacaagatttttaattgttgtttcattgggatcgctagtcttatttagattagcaaaaatcaaatggcaacaggtgtcctttgttatgactttagttgttgtattcgctgttttaaatattataatggtctatctttttgctccccattatggtgataagatttatggtagttcttctttattgttaaaaggaattggcccatatgatgtgactagccaagagttgttttacctctttaatctgattttaaaatacttttgtacagtgcctttagctcttttgtttttgatgacaactaatcctagtcagttcgcatcaagtttaaatcaattaggtttatcatataaaatagcttatgctgttagtttgacccttagatatatacctgatgttcaagaagaattttatacaatacgtcgagcacaagaggcaagaggaatagaattatcaaaaaaatcgaacttagtagcacgcattaaggggaatttgcagattgtcacaccattaatttttagctctctagaacgtattgatacagtagcaactgctatggaacttcgacgatttggtaaaaataaaagacgtacttggtactctaagcaatctttggaaaaaagtgacattgtcttaatcatacttgctctagctagtctgtttgtaagcctttatttaattcaccttaatcatggacgtttctataacccatggcaa

SEQ ID NO: 8856 - protein, 276 aa, Streptococcus agalactiae
MAKQLIGYQEGYGFLYRLSGASKLLFFILVSVACMTTYDTRFLIVVSLGSLVLFRLAKIKWQQVSFVMTLVVVFAVLNIIMVYLFAPHYGDKIYGSSSLLLKGIGPYDVTSQELFYLFNLILKYFCTVPLALLFLMTTNPSQFASSLNQLGLSYKIAYAVSLTLRYIPDVQEEFYTIRRAQEARGIELSKKSNLVARIKGNLQIVTPLIFSSLERIDTVATAMELRRFGKNKRRTWYSKQSLEKSDIVLIILALASLFVSLYLIHLNHGRFYNPWQ

SEQ ID NO: 8857 - DNA, 612 bp, Streptococcus agalactiae
ttgaaatatgataaaatagaacagattgtaagtgactgtttaagcttgtttttcagagaggtttttatgaatacaaacacaataaaaaaggttgtagcgactggaattggagctgcactttttatcattataggtatgctagttaatataccaacaccaattccaaatactaatattcaattgcagtatgcagttttagcattatttgcagttatttatggaccaggagttggtttttttactggttttatcggacacgcattgaaagattcgattcaatatggttctccgtggtggacttgggttttagttagtggtcttttaggtttgatgataggcttttttgctaaaaaattagctattcaattatctggcatgactaagaaggatttgcttctatttaatgtagttcaagttattgctaaccttataggttggtctgtcgttgcaccgtatggtgatattttcttttatagcgaacctgcaagcaaagtttttgcacaaggtttcttatcaagccttgtgaattccattactattggagtaggtggtacgcttttgttgctagcatacgctaaatcacgaccacaaaaaggtagtttatccaaagat

SEQ ID NO: 8858 - protein, 204 aa, Streptococcus agalactiae
LKYDKIEQIVSDCLSLFFREVFMNTNTIKKVVATGIGAALFIIIGMLVNIPTPIPNTNIQLQYAVLALFAVIYGPGVGFFTGFIGHALKDSIQYGSPWWTWVLVSGLLGLMIGFFAKKLAIQLSGMTKKDLLLFNVVQVIANLIGWSVVAPYGDIFFYSEPASKVFAQGFLSSLVNSITIGVGGTLLLLAYAKSRPQKGSLSKD

SEQ ID NO: 8859 - DNA, 498 bp, Streptococcus agalactiae
atgaacataaaacaattaaagtctaaaacaatgcttggaacagtggctttggtgtccgctttttcatttgcttcaacaaatgcagatgcgaatacatataactatgcagtagatgtagactacctagcaagtgcggaggaaattgctcaagcacatccagctagtaatacgtttccactaggtcaatgcacatggggtgtaaaggagatggcaacatgggcaggtaactggtggggaaacggtggtgattgggctgcgagcgccgcatcagctgattatacagtagggacacaaccgcgcgtgggttctatcgtatgttggactgatggtagttatggacatgtggcttatgttacagctgtagatcctgtcactaataaaattcaggttttagaatctaattatgcaggtcatcaatggattgataattatcgtggttggtttgatccacaaaatacagtaacaccaggggtagttagctacatttatccgaattaa

SEQ ID NO: 8860 - protein, 165 aa, Streptococcus agalactiae
MNIKQLKSKTMLGTVALVSAFSFASTNADANTYNYAVDVDYLASAEEIAQAHPASNTFPLGQCTWGVKEMATWAGNWWGNGGDWAASAASADYTVGTQPRVGSIVCWTDGSYGHVAYVTAVDPVTNKIQVLESNYAGHQWIDNYRGWFDPQNTVTPGVVSYIYPN

SEQ ID NO: 8861 - DNA, 1764 bp, Streptococcus agalactiae
  misc_feature (1)..(1764): n = a, c, g, or t
atgctatgggaggaaatgatgtttaaaatccctttgtttaaagaattaaagacagatcaatggataaaaccatttttcaaacaatataaagtttccttagtaattgctcttttccttggttttatgactttcttttctgccagtgctcttatgtttaattcgggctatctgattagtaagtcagcttcactaccgagtaatattcttctagtatatgttccaattgtactaacacgtgcttttggcattggacgtcctgtttttcgttatatagaacgcctaacgagtcacaattgggtattacgaatgacttcacagctgcgcttgaagctttaccattccttagaaagcaatgctatctttatgaagcgtgattttcgtttaggagatgttatggggcttttagcggaggatattaattatttgcaaaatttgtatcttaggacaatatttccaacgattatagcgtggatattatatagctttattattattgcaacaggcttcttttctctatggtttgctttaatgatgttgctttatttagctattatgatttttctttttccactttggtcgattttagctaatggtgctcgtcagactcgtgaaaaagaattaaaaaatcatctttatactgatttgacggataatgtcttaggtatttcagactggatttttagtcaacgtggtcaagagtacgtcgccttgcatgagcgttcggaaagtgaactcatggctgttcagaaaaaaattcgttcctttgataatcgtagagctcttattgtggaattagtttttggctttctagctattttggttattatttgggctagtaatcagtttattggtcacagaggtggcgaagctaactggattgcagcatttgttctaacagtatttcccttgtcagaggcatttgctggtttgtctgctgctgctcaagaaacaaataaatattctgattcaattcatcgtcttaatgaattatcagaaacgtattttgaaacaactcaaaatcagttgcctaataagccatacgatttttccgtcaagaatttaagtttccagtataagccacaagagaaatgggttttgcatcatttagatttggatattaaagaaggagaaaaaattgctattttagggcgtagtggttctggcaagagtaccttagccagtctacttcgtggcgacttgaaagcaagtcaaggggagattaccctaggcgatgctgatgtttcaatagttggtgattgcatttctaactatattggagtgatacaacaagcgccctacntttttaatacaaccctgctaaatacatttcgcattggaaaccaagatgctagtgaagaagatgtatggaaagttcttgaacgagttggattgaaagagatggtcactgatttatcagatggtctctatacaatggttgatgaagctggacttaggttttcaggtggcgaaaggcatagaattgctttggctagaatcttactaaaagatgtcccaattgttatcttagatgagccaactgttggacttgatcctattactgaacaagccttactaagggtatttatgaaagaattggaaggtaagaccttagtttggattacacatcacttaaaaggtattgaacatgctgatcgtatcttatttatagaaaatgggcaattagagttggaaggttctcctcaagaattgtctcaaagtagccaacgttaccgtcagctgaaagcctctgatgatggtgatcta

SEQ ID NO: 8862 - protein, 588 aa, Streptococcus agalactiae
  MISC_FEATURE (1)..(588): Xaa = Any Amino Acid
MLWEEMMFKIPLFKELKTDQWIKPFFKQYKVSLVIALFLGFMTFFSASALMFNSGYLISKSASLPSNILLVYVPIVLTRAFGIGRPVFRYIERLTSHNWVLRMTSQLRLKLYHSLESNAIFMKRDFRLGDVMGLLAEDINYLQNLYLRTIFPTIIAWILYSFIIIATGFFSLWFALMMLLYLAIMIFLFPLWSILANGARQTREKELKNHLYTDLTDNVLGISDWIFSQRGQEYVALHERSESELMAVQKKIRSFDNRRALIVELVFGFLAILVIIWASNQFIGHRGGEANWIAAFVLTVFPLSEAFAGLSAAAQETNKYSDSIHRLNELSETYFETTQNQLPNKPYDFSVKNLSFQYKPQEKWVLHHLDLDIKEGEKIAILGRSGSGKSTLASLLRGDLKASQGEITLGDADVSIVGDCISNYIGVIQQAPYXFNTTLLNTFRIGNQDASEEDVWKVLERVGLKEMVTDLSDGLYTMVDEAGLRFSGGERHRIALARILLKDVPIVILDEPTVGLDPITEQALLRVFMKELEGKTLVWITHHLKGIEHADRILFIENGQLELEGSPQELSQSSQRYRQLKASDDGDL

SEQ ID NO: 8863 - DNA, 1200 bp, Streptococcus agalactiae; identical to SEQ ID NO: 4997

SEQ ID NO: 8864 - protein, 400 aa, Streptococcus agalactiae
LEDKLFNKHFIGITILNFIVYMVYYLFTVIIAFIATKELGVSTSQAGLATGIYIVGTLIARLIFGKQLEVLGRKLVLRGGAIFYLLTTLAYFYMPSIGVMYLVRFLNGFGYGVVSTATNTIVTAYIPADKRGEGINFYGLSTSLAAAIGPFVGTFMLDNLHINFKMVIVLCSILIAIVVLGAFVFPVKNITLNPEQLAKSKSWTIDSFIEKKAIFITIIAFLMGISYASVLGFQKLYTTEINLMTVGAYFFIVYALVITLTRPSMGRLMDAKGDKWVLYPSYLFLTLGLALLGSAMGSVTYLLSGALIGFGYGTFMSCGQAASIKGVEEHRFNTAMSTYMIGLDLGLGAGPYILGLVKDGFLGAGVQSFRELFWIAAIIPVVCGILYFLKSSRQVETKTI

SEQ ID NO: 8865 - DNA, 846 bp, Streptococcus agalactiae; identical to SEQ ID NO: 5003

SEQ ID NO: 8866 - protein, 282 aa, Streptococcus agalactiae
LIEITWTVKYITEFIATAFLIILGNGAVANVDLKGTKGNNSGWIIIAIGYGLGVMMPALMFGNVSGNHINPAFTLGLAFSGLFPWAHVGQYILAQILGAMFGQLVVVMVYQPYFVKTENPNHVLGSFSTISALDDGQKSSRKAAYINGFLNEFVGSFVLFFGALALTKNYFGVELVGKLVQAGYDQTTAATRISPYVTGSLAVAHLGIGFLVMTLVASLGGPTGPALNPARDLGPRIVHRLLPKQILGQAKEDSKWWYAWVPVLAPIVASILAVALFKLLYL

SEQ ID NO: 8867 - DNA, 957 bp, Streptococcus agalactiae; identical to SEQ ID NO: 5007

SEQ ID NO: 8868 - protein, 319 aa, Streptococcus agalactiae
LCSQYHKVKLTVSLFFCRLDIMNETLLLHGIQLILIIAMIITFYQIVRHIRSQKINPFKRFFTGLWIGFVTDALDTLGIGSFATTTTFFKLTKLVEDDRKIPATMTAAHVLPVLLQSLCFIFVVKVEALTLITMAGAAFIGAFVGAKMTKNWHAPTVQRILGTLLITAAIIMLYRMITNPGAGISDSVHGLHGIWLFVGIGFNFIIGVLMTMGLGNYAPELIFFSLMGLSPAVAMPVMMLDAAMIMTASSTQFIKSGRVNWNGFAGLVTGGILGVIVAVLFLTNLDLNSLKTLVVGIVLFTGAMLIRSSFKKTMPKSHH

SEQ ID NO: 8869 - DNA, 1368 bp, Streptococcus agalactiae
atgaataaaaaactgatctcacttgatggtatgtccctaaaagaggtctttcaaaaaggtgatttagcaactaaactatcattcttaattatgggacttgctaacctcaaaaataaacaaattgtcaagggacttttatttttaatcagtgaaattctgtttttaattacctttgtttaccaagttatcccagctgtaaaaggtcttatttccttagggacccaagaacaaggtatgacaactaaaactgtggatggtattaaaatccaagttgcgacacaaggtgataactctatgttaatgctaatttttggattagcttcgcttatcttctgktgcgtatttgcctatatttactggtcaaacattwaaagcgcagcacatttattgaccttgaaagaagaaggaagagaaattccatccttcaaaaaagatattaaaagcttgacagatggacgcttccatatgactttaatgtctatycctttaataggggtgcttctatttacaatccttccgttagtttatatgatttgtttggcatttactaactatgatcataaccacttaccgccaaaaagtttatttgactgggttggttttgctaacttcggtaatatctttagcgggcgtatggccagtactttcttccctgttctatcttggacattaatttgggctgttttcgctactgtaacgaatttcttctttggtattattcttgccttactaattaatacaaaaggtttgaaattcaaaaagatgtggcgtactatttttgttattaccatggctgtccctcaatttatctctctcttaatcatgagaaacctcttaagtgacgctggaccggttaacgccttgttaataaaatggggacttatttcttcagcacatccccttccattcctttctgatccggtctgggcgaaattctcaatcatctttgttaatatgtgggttggtattcctgtaacaatgcttgttgctactggtatcatcatgaatttacctgcagaacaaattgaagctgctgaaattgatggggcgaataagttccaagtctttcaatcaattactttcccacaaattttgttgattatgactcctactttaattcaacaatttatcggaaatattaacaacttcaacgttatctacctactcactcaaggtggaccaacaaactcaacatactaccaagcaggtagcaccgatttacttgtcacttggctatacaatttgacagtaactgctgcagattataacttagcatctgttgttggtatcttaatctttattctttcagcagtatttagtttactagcttacacaagaacaaattcttacaaggaaggggcagctaaa

SEQ ID NO: 8870 - protein, 456 aa, Streptococcus agalactiae
  MISC_FEATURE (1)..(456): Xaa = Any Amino Acid
MNKKLISLDGMSLKEVFQKGDLATKLSFLIMGLANLKNKQIVKGLLFLISEILFLITFVYQVIPAVKGLISLGTQEQGMTTKTVDGIKIQVATQGDNSMLMLIFGLASLIFXCVFAYIYWSNIXSAAHLLTLKEEGREIPSFKKDIKSLTDGRFHMTLMSIPLIGVLLFTILPLVYMICLAFTNYDHNHLPPKSLFDWVGFANFGNIFSGRMASTFFPVLSWTLIWAVFATVTNFFFGIILALLINTKGLKFKKMWRTIFVITMAVPQFISLLIMRNLLSDAGPVNALLIKWGLISSAHPLPFLSDPVWAKFSIIFVNMWVGIPVTMLVATGIIMNLPAEQIEAAEIDGANKFQVFQSITFPQILLIMTPTLIQQFIGNINNFNVIYLLTQGGPTNSTYYQAGSTDLLVTWLYNLTVTAADYNLASVVGILIFILSAVFSLLAYTRTNSYKEGAAK

SEQ ID NO: 8871 - DNA, 756 bp, Streptococcus agalactiae
ttggcagttagttttyatgaagtatttggttgggattctgctttttttattatgattatcaatattccattgctccttctttgctactttggcttaggtaaacaaacctttttaaaaactgtctatggttcttggatttttcctgtttttattaagttaacacaaagtgtaccaactttgacccacaacccactcctcgcagcactttttggaggtgttattgtaggatgtggtttggggattgttttttggagcgactcttcaactggtggaacggggattatcattcaattcttaggaaaatatactcctataagccttggacaaggggttatattgattgatggacttgttacaattgttggtttcctagcttttgacagtgatacggttatgttttctattattgggttgataactattagttatattattaatgctatccaaactggatttacaaccttaagcactgtcttaatcgtttctcaagagcaccaaaaaattaagacatatatcaatactgtcgcagatagaggagtaacagaaattcccgttaaagggggatattctggaactaatcaaatcatgcttatgacaactattgctggttatgagtttgctaaattacaagaggcaatagcagaaattgacgaaacagccttcataacagtaactccaacatcacaagcttctggacgtggatttagtcttcaaaaaaatcatggacgtcttgatgaagacattcttatgccaatg

SEQ ID NO: 8872 - protein, 252 aa, Streptococcus agalactiae
  MISC_FEATURE (1)..(252): Xaa = Any Amino Acid
LAVSFXEVFGWDSAFFIMIINIPLLLLCYFGLGKQTFLKTVYGSWIFPVFIKLTQSVPTLTHNPLLAALFGGVIVGCGLGIVFWSDSSTGGTGIIIQFLGKYTPISLGQGVILIDGLVTIVGFLAFDSDTVMFSIIGLITISYIINAIQTGFTTLSTVLIVSQEHQKIKTYINTVADRGVTEIPVKGGYSGTNQIMLMTTIAGYEFAKLQEAIAEIDETAFITVTPTSQASGRGFSLQKNHGRLDEDILMPM

SEQ ID NO: 8873 - DNA, 1227 bp, Streptococcus agalactiae
gtgaaaaaaaaattagtctcatcacttctaaagtgttctctaatcattattgttagctttgctggtggagcatttgctagttttgtcatgaatcataatgacaatattccaaatggtggtgtcactaaaactagtaaagtaaattataataacataacgcctacaacaaaagctgttaaaaaggtacaaaatagtgttgtttctgttatcaattataaacaacaagagagtcgttctgacctatcagacttctatagtcatttttttggtaatcaggggggcaacactgataagggcttacaagtttacggtgaaggctctggagtcatctataaaaaagatggtaaaaatgcctatgttgtcactaataaccacgtcattgatggggctaaacaaattgaaattcaactagctgatggctcaaaagcagttgggaaacttgttgggtcagatacctactctgatttagccgtcgtcaaaattccatcagataaggtttcaaatattgcagaatttgctgattcatcaaaactcaacattggtgaaactgctatagcgatcggaagccctcttggaactgagtatgcaaattctgtaactcaaggtattgtatctagtttaaaaagaactgtaacaatgactaatgaagaaggacaaacagtttctacaaatgctatccagactgatgctgctatcaatcctggtaattcaggtggagcacttatcaatattgaaggacaggttattggaattaattctagtaaaatttcttctacatcaaatcaaacctcaggacaatcgtcaggaaatagcgttgaaggtatgggatttgccattccttcaaatgatgttgttaagattatcaatcaacttgagagtaacggacaagtagagagacctgctctaggtatttctatggctggattaagtaatttaccatccgatgttattagtaaactgaaaatcccaagtaatgttactaatggtattgtagtagcatctatccaatctggcatgccagctcaaggcaaactaaagaaatacgatgtcattactaaagttgacgataaagaagtagtatctccaagtgatttacaaagtttactctatggccaccaggtaggggattccataacagtaaccttttatcgtggtgaaaataaacaaacagtcactataaaacttactaaaactagtaaagatttagctaaacaacgagcaaataac

SEQ ID NO: 8874 - protein, 409 aa, Streptococcus agalactiae
VKKKLVSSLLKCSLIIIVSFAGGAFASFVMNHNDNIPNGGVTKTSKVNYNNITPTTKAVKKVQNSVVSVINYKQQESRSDLSDFYSHFFGNQGGNTDKGLQVYGEGSGVIYKKDGKNAYVVTNNHVIDGAKQIEIQLADGSKAVGKLVGSDTYSDLAVVKIPSDKVSNIAEFADSSKLNIGETAIAIGSPLGTEYANSVTQGIVSSLKRTVTMTNEEGQTVSTNAIQTDAAINPGNSGGALINIEGQVIGINSSKISSTSNQTSGQSSGNSVEGMGFAIPSNDVVKIINQLESNGQVERPALGISMAGLSNLPSDVISKLKIPSNVTNGIVVASIQSGMPAQGKLKKYDVITKVDDKEVVSPSDLQSLLYGHQVGDSITVTFYRGENKQTVTIKLTKTSKDLAKQRANN

SEQ ID NO: 8875 - DNA, 1113 bp, Streptococcus agalactiae
atggctttaacagcaggtattgtaggcttaccaaatgttggtaaatcaactttatttaacgcaattacaaaagcaggagcagaagctgctaattatccttttgcgactattgatcccaatgttggtatggtagaagtaccagatgagcgtctacaaaaattgacagaattgattacgcctaaaaaaacagttccgacaacctttgaatttactgatattgcaggtattgttaaaggtgcttcgaagggggaaggtctaggtaataaatttttagctaatattcgtgaagtggatgctattgttcatgtggtacgtgcgtttgatgatgaaaatgttatgcgtgaacaaggtcgtgaggatgctttcgttgatcctatagcagatattgatactattaatcttgaattaatcttagctgatttagagtcaatcaataaacgttatgcgcgtgttgaaaaaatggcacgaactcaaaaagataaagaatcagtagcagagttcaatgttttacaaaagattaaacctgttttggaagatgggaaatcagctcgtaccattgagtttacagaagaggaagcaaaagttgttaaaggtctttttttattaacaactaaacctgttttatatgttgctaatgttgatgaggacaaagtagctgatcctgatgatatcgactatgttaatcaaattcgtgcatttgcagaaacagagaatgcagaagtagtcgtgatttctgctcgagctgaagaagaaatatctgaacttgatgatgaagataagttagaatttttagaagctattggattaacagaatctggtgttgataaattaacacgagctgcttatcatcttttaggccttggaacttactttactgctggtgaaaaagaggttcgcgcttggacgtttaagcgtggtataaaagctccacaagctgctagtattatccattcagattttgaaagaggttttattcgtgcagtaacgatgtcatatgatgaccttattcaatatggatctgaaaaagcagtaaaagaagctggccggttacgtgaagaaggaaaagagtatattgttcaagatggcgatatcatggaattccgtttcaatgtc

SEQ ID NO: 8876 - protein, 371 aa, Streptococcus agalactiae
MALTAGIVGLPNVGKSTLFNAITKAGAEAANYPFATIDPNVGMVEVPDERLQKLTELITPKKTVPTTFEFTDIAGIVKGASKGEGLGNKFLANIREVDAIVHVVRAFDDENVMREQGREDAFVDPIADIDTINLELILADLESINKRYARVEKMARTQKDKESVAEFNVLQKIKPVLEDGKSARTIEFTEEEAKVVKGLFLLTTKPVLYVANVDEDKVADPDDIDYVNQIRAFAETENAEVVVISARAEEEISELDDEDKLEFLEAIGLTESGVDKLTRAAYHLLGLGTYFTAGEKEVRAWTFKRGIKAPQAASIIHSDFERGFIRAVTMSYDDLIQYGSEKAVKEAGRLREEGKEYIVQDGDIMEFRFNV

SEQ ID NO: 8877 - DNA, 789 bp, Streptococcus agalactiae
ttgaagttcgaaaatataatatatggtattgatggcaacgtggccactattatgcttaatcgaccagatatttcaaatggttttaacatcccaatgtgtcaagaaattattgatgcaataaggcttgtgtctgaaaataaagatgtcatgtttttagtgattgaagcacaaggaccaatcttttcaatcggaggagatttaaaagtgatgaaagctgctgttgagagcgatgatattagctcattaactaaaattgctgagttagttaatcagatatcgtatgatttactacagctagagaaacctgttgttatgtgtgtagatggggctgtagctggtgccgcagctaatattgcattagcagctgattttgttatcgcaagcaagaagagtaaatttatccaggcttttgtgggtgtcggtttagctccagatgcaggaggtttattgttacttagtaaatcaatcggtataactcgtgcagtgcaactagctttaactggagaaagcttatctgctgaaaaagctgaagctttgggaattgtttataaactttgtgaatcagataaaataggtaaaattaaggatcaactattaaagcgtttaagtagacattctataaactcatatcaagccataaaatcattagcttgggaagctgcttttaaagattgggaacaatataaaaagcttgaattacaactgcaagaatcattagcctttaagcaagattttaaagaaggtgttcgggcacacgctgatagaaggcgtcctaattttttaggcaaa

SEQ ID NO: 8878 - protein, 263 aa, Streptococcus agalactiae
LKFENIIYGIDGNVATIMLNRPDISNGFNIPMCQEIIDAIRLVSENKDVMFLVIEAQGPIFSIGGDLKVMKAAVESDDISSLTKIAELVNQISYDLLQLEKPVVMCVDGAVAGAAANIALAADFVIASKKSKFIQAFVGVGLAPDAGGLLLLSKSIGITRAVQLALTGESLSAEKAEALGIVYKLCESDKIGKIKDQLLKRLSRHSINSYQAIKSLAWEAAFKDWEQYKKLELQLQESLAFKQDFKEGVRAHADRRRPNFLGK

SEQ ID NO: 8879 - DNA, 837 bp, Streptococcus agalactiae; identical to SEQ ID NO: 5249

SEQ ID NO: 8880 - protein, 279 aa, Streptococcus agalactiae
VMTQMNFTDRATRVAIIANGKYQSKRVASKLFAAFKHDPDFYLSKKDPDIVISIGGDGMLLSAFHMYEKQLDKVRFVGVHTGHLGFYTDYRDFEVDTLINNLKNDKGEQISYPILKVTITLEDGRVIRARALNESTIKRIEKTMVADVVINQVVFERFRGDGILVSTPTGSTAYNKSLGGAVLHPTIEALQLTEISSLNNRVYRTLGSSVIIPKKDAIEIVPKRVGVYTISIDNKTVHYKNVTKIEYSIDEKSINFVSTPSHTSFWERVNDAFIGEPEH

SEQ ID NO: 8881 - DNA, 1071 bp, Streptococcus agalactiae
atgcgtagagtttattcctttttaggcggtattgttcttgttatcctgatcctctttggtttaaccacttacttagaaaaaaagagtagttcaacacctaactcagataagttagttatttataactggggagactatattgatccagccttattaaaaaaatttacaaaagaaactggaattgaagtacaatacgaaacgtttgactctaatgaggctatgcacaccaaaattaagcagggtgggacgacatatgatattgctgtacctagtgattatatgattgacaaaatgataaaagaaaaccttctggttaaacttgatcattcaaagatagctaattgggatgctattggagccaggtttaaaaatttgagtttcgatcctaaaaataaatattcgattccttatttctggggaactgttgggattgtttataatgatcaattagttaaaactcctcctaaacattgggatgatttatggcgtccagagtttcgaaataaaatcatgctagttgatagtgcacgtgaggttattggagttggtttaaattccttgggatatggattgaatacaaagaacatatcagaattaaaagccgcttctaaaaagttagatgctctaacaccaaacgttaaggctattgttgctgatgagatgaaaggctatatgattcagggagatgcagcgattggtgttacattctctggagaagcacgagaaatgcttgatgggaacaagcatttgcattacgttgttcctagtgaaggatcgaacctttggtttgataatattgtaatccccaaaacagtaaagcatcgcaaagaagcctatgcctttattaatttcatgatggaacctaaaaatgcggcacaaaatgcagaatatattggttatgcgacccctaatctcaaagcaaaagcgctgttaccagcagatatcaaaaatgataaagcattttatcctcctgataaaacaattgatcatttagaagtttataataacttgggtcaaaaatggcttggtatttacaatgatttgtacttacaatttaaaatgtatcgtaag

SEQ ID NO: 8882 - protein, 357 aa, Streptococcus agalactiae
MRRVYSFLGGIVLVILILFGLTTYLEKKSSSTPNSDKLVIYNWGDYIDPALLKKFTKETGIEVQYETFDSNEAMHTKIKQGGTTYDIAVPSDYMIDKMIKENLLVKLDHSKIANWDAIGARFKNLSFDPKNKYSIPYFWGTVGIVYNDQLVKTPPKHWDDLWRPEFRNKIMLVDSAREVIGVGLNSLGYGLNTKNISELKAASKKLDALTPNVKAIVADEMKGYMIQGDAAIGVTFSGEAREMLDGNKHLHYVVPSEGSNLWFDNIVIPKTVKHRKEAYAFINFMMEPKNAAQNAEYIGYATPNLKAKALLPADIKNDKAFYPPDKTIDHLEVYNNLGQKWLGIYNDLYLQFKMYRK

SEQ ID NO: 8883 - DNA, 774 bp, Streptococcus agalactiae
atgaaaaaattcgcaaatatctatttagcacttgtttttattatcctttatattcctattatttatttgattttttattctttcaataaaggtggggatatgaattcttttactggattcacctttagtcactatggagaactgtttcaggatagccgcttaatgctaattttagtgcaaacattctttttggcttttcttagcgccttattagctacaattattggtacctttggagctatttggatttatcaggtaagacgtagacatcaaacctctattttatcgcttaataatatccttttagtagcaccagatgttatgattggtgcaagttttctcttagtatttactgttattggtttacagttaggtttcacttctgtattattgagccatgttgcattctctattcctattgttgttttaatggtcttacctcgtttaaaagaaatgaatgatgatatgattaatgcttcctatgatttaggagcttcaacttggcaaatgcttaaagaagttatgttaccctatttgtcgtcgggtattatttcaggtttctttatggctttcacttactcgctagatgattttgcggttactttctttgttacaggtaatggcttttcaacgctttcagtagaaatctattcacgcgcacgtcgcggtatatcattggaaattaacgccttgtcaactattgtctttttatttagtattttattggtaattggttattactatatttcgaaagagaagggagaaaagaatgcg

SEQ ID NO: 8884 - protein, 258 aa, Streptococcus agalactiae
MKKFANIYLALVFIILYIPIIYLIFYSFNKGGDMNSFTGFTFSHYGELFQDSRLMLILVQTFFLAFLSALLATIIGTFGAIWIYQVRRRHQTSILSLNNILLVAPDVMIGASFLLVFTVIGLQLGFTSVLLSHVAFSIPIVVLMVLPRLKEMNDDMINASYDLGASTWQMLKEVMLPYLSSGIISGFFMAFTYSLDDFAVTFFVTGNGFSTLSVEIYSRARRGISLEINALSTIVFLFSILLVIGYYYISKEKGEKNA

SEQ ID NO: 8885 - DNA, 885 bp, Streptococcus agalactiae; identical to SEQ ID NO: 5343

SEQ ID NO: 8886 - protein, 295 aa, Streptococcus agalactiae
LRKDNLGIILGLSAYVLWGLLSLYWKLLSGIEAYSTFAYRIIFTVLTMLIYMLVSGRKTVYLKDLKGLVNNKKSFWTMFVASILISINWLVYIFAVTHGHATEASLGYYMMPIISILLSVLVLREHLARVVSLAILIAIMGVGILVYQTGHFPLISLTLALSFGFYGLLKKSISLSSDFSMLVESSFIAPFALIYIVFFAKDFLTDYNILQLVLLSLSGIITAVPLLLFAEAIKRAPLNIIGFIQYINPTIQLLLALFIFKETIVSGEVIGFIFIWLAILVFSIGQVHTMLKKGK

SEQ ID NO: 8887 - DNA, 1545 bp, Streptococcus agalactiae; identical to SEQ ID NO: 5361

SEQ ID NO: 8888 - protein, 515 aa, Streptococcus agalactiae
LSKKHITPVFTGSLIVSLILVLLGIIVPRGFQSWTQILREQVSTNFGWLYLLLVTSILALCVFFIMSPLGQIRLGQPHSRPEYSTVSWIAMMFSAGMGIGLVFYGAAEPLSHFAISTPGAPKESQTALADAFRFTFFHWGIHAWAVYALVALALAYFGFRKQEKYLLSVTLKPLFGDKTDGWLGKIVDITTVVATVIGVATTLGFGAAQINGGLSFLLGVPNNAFVQIVIILITTALFVMSALSGLGKGVKILSNLNLILAVALLALVIVLGPTVRIFDTLTESLGSYLQNFFGMSFRAAAFDNTKRSWIDNWTIFYWAWWISWSPFVGVFIARISKGRSIREFLTVVLLIPTLLSFVWFAAFGTLSTQVQQLGTNLTKFATEEVLFATFNHYTLGWLLSIIAIILIFSFFITSADSATYVLAMLTEDGNLNPKNRTKVIWGLVLAVIAIVLLLSGGLLALQNVLIIVALPFSFVMILMMLALLVELFHEKKEMGLSISPDRYPRKNEPFKSYEE

SEQ ID NO: 8889 - DNA, 1020 bp, Streptococcus agalactiae; identical to SEQ ID NO: 5369

SEQ ID NO: 8890 - protein, 340 aa, Streptococcus agalactiae
VRRTIMLFKEKIPGLILCFIIAIPSWLLGLYLPLIGAPVFAILIGIIVGSFYQNRQLFNKGIAFTSKYILQTAVVLLGFGLNLMQVMKVGISSLPIIIMTISISLIIAYVLQKLFKLDKTIATLIGVGSSICGGSAIAATAPVINAKDDEVAQAISVIFLFNILAALIFPTLGNFIGLSDHGFALFAGTAVNDTSSVTATATAWDAINHSNTLGGATIVKLTRTLAIIPITIVLSIYHMKQTQKEQSVSVTKIFPKFVLYFILASLLTTIVASLGFSLRIFEPLKVLSKFFIVMAMGAIGINTNVSKLIKTGGKSILLGAACWLGIIIVSLTMQAILGTW

SEQ ID NO: 8891 - DNA, 195 bp, Streptococcus agalactiae
atgtcagaattcgtgaggaaatacagatatccactaggaggtgcagttattgggctcgttttagctgcaatgattgtaaccattggattctttaaaacaattcttgctcttgttatcattgtgctaggtgcttatgctggactttatgtgcaaagaacaggtatgcttgaccaattctttaataagagaaaataa

SEQ ID NO: 8892 - protein, 64 aa, Streptococcus agalactiae; identical to SEQ ID NO: 5406

SEQ ID NO: 8893 - DNA, 693 bp, Streptococcus agalactiae
atggcaactttaacgaataaccctatctttggtattatgttaaccgtatgggcgtattacattggcataaggatttttagaaaatatccttcccctgcaacaactccacttcttttggcgactattttattaattgcttttttaaaattaacacatatctcctataaagattactacaatggcggttcatttctaacgatgttaattacgccttcaacggttgtattggctattcctctctatagaacctttcatttaatgaagcatcacattaaaagcattagcattagcatcatcttagcttctgttatcaacacagtttttaccgcaatagttgctaagttttttggtatgaaatatttcttagcaatctcacttttcccaaagtccgtaactacagctatggccgttggaattacaagtaaagcaggtggattagctactatcactctggtcgtagttgttattacaggcatcttaacaagcgttttgggtcctatttttctaaaattattaaggatagaagatcctgttgctatagggctcgcgctaggaggaactgggcatgctataggaactggacaagccttaaaatatggccaagttcaaggcgccatggctggactagcaattggtatcacagggatttgctatgttattgtcagtcctttagttgcaggcttaatattgaaa

SEQ ID NO: 8894 - protein, 231 aa, Streptococcus agalactiae
MATLTNNPIFGIMLTVWAYYIGIRIFRKYPSPATTPLLLATILLIAFLKLTHISYKDYYNGGSFLTMLITPSTVVLAIPLYRTFHLMKHHIKSISISIILASVINTVFTAIVAKFFGMKYFLAISLFPKSVTTAMAVGITSKAGGLATITLVVVVITGILTSVLGPIFLKLLRIEDPVAIGLALGGTGHAIGTGQALKYGQVQGAMAGLAIGITGICYVIVSPLVAGLILK

SEQ ID NO: 8895 - DNA, 1233 bp, Streptococcus agalactiae
  misc_feature (1)..(1233): n = a, c, g, or t
atggcgcttaaagaattaacagctaaagagttcgaaagttattcaggaaattacgatttacaatcgtttatgcaaacccctgagatggcaaagcttctaaaaaaacgtgggtatgacattacctacatgggctaccaaatcgatgggaaaatggaaatcatcagtattgtttataccatcccaatgactggtggacttcatatggaagtcaattctggtccagcccattccaattctaaatatctgaaacatttttataaagaactacagaactatgccaaatctcagggcgctttagaattattaattaaaccttatgatacctaccaagagtttactggtgaaggtaagcctaaaggtgcaccgaacacctatcttattgatgacctgactagtataggttatcaccacgatgggcttcatattggttatcctggcggtgaacctgattggcattatgttaaaaatctagaaggtatcactcctcaaaatcttcttaaatctttctctaaaaaaggacgccccttggttaaaaaagccatgtcttttggtataaaaatacgtgtcctcaagcgggaagaactacatatctttaaggatattacttcttctacttctgatcgccgggactatatggataaatctctagattattatcaagatttttatgatagtttcggagataaggcggaatttgtcattgcaactctaaactttagggaatatgatcataacctacaattaaatgcaaagaaattggaagaacagattacagtccttgataatcgccatcaaaataatacagattctgccaaataccatcgtcaacgtactgagcttgtcaatcaactagctagtttagataaacgtcgcaaagaagtcgaaccttttattcaaaaatttggaaatcaagatgttgttttagctggtagcctctttatttatagcccgaaagaaactgtctatcttttctctggctcatacacagaatttaataaattttatgcgcctgcagttcttcaagaatatgttatgcaagaggctttaaagcgtcaatcaactttctatanttttttaggtattcaaggaaattttgatggttcaratggcgtacttcrctttaaacagaattttaatggttacattgttcgtaaaatgggtactttccgctactatccaaatccattaaaatataagagtattcaattactaaagaaaatcttacgccgaaca

SEQ ID NO: 8896 - protein, 411 aa, Streptococcus agalactiae
  MISC_FEATURE (1)..(411): Xaa = Any Amino Acid
MALKELTAKEFESYSGNYDLQSFMQTPEMAKLLKKRGYDITYMGYQIDGKMEIISIVYTIPMTGGLHMEVNSGPAHSNSKYLKHFYKELQNYAKSQGALELLIKPYDTYQEFTGEGKPKGAPNTYLIDDLTSIGYHHDGLHIGYPGGEPDWHYVKNLEGITPQNLLKSFSKKGRPLVKKAMSFGIKIRVLKREELHIFKDITSSTSDRRDYMDKSLDYYQDFYDSFGDKAEFVIATLNFREYDHNLQLNAKKLEEQITVLDNRHQNNTDSAKYHRQRTELVNQLASLDKRRKEVEPFIQKFGNQDVVLAGSLFIYSPKETVYLFSGSYTEFNKFYAPAVLQEYVMQEALKRQSTFYXFLGIQGNFDGSBGVLXFKQNFNGYIVRKMGTFRYYPNPLKYKSIQLLKKILRRT

SEQ ID NO: 8897 - DNA, 2682 bp, Streptococcus agalactiae; identical to SEQ ID NO: 5481

SEQ ID NO: 8898 - protein, 894 aa, Streptococcus agalactiae
LLKEQKKSLFYTQGQEEVLTSLESSREGLSTTEAKNRLEMYGRNELEEGKKRSLIAKFFDQFKDLMIIILLVAAALSVITEGMHGLTDALIILAVVILNAAFGVYQEGQAEAAIEALKDMSSPIARVRRDGHTIEVDSKELVPGDLVMLEAGDVVPADLRLLEAASLKIEEAALTGESVPVEKDISQVVAEDAGIGDRVNMAYQNSNVTYGRGYGVVTNTGMYTEVGKIADMLANADESETPLKQSLVQLSKLLTYLIVIIAVITFLVGIFVRKEGWIEGLMTSVALAVAAIPEGLPAIVTIVLSMGTKTLAKRNSIVRKLPAVETLGSTEIIASDKTGTLTMNQMTVEKVYTNGVLQSSSEEISVDNNTLRIMNFSNDTKIDPSGKLIGDPTETALVQFGLDKNFDVREVLKNEPRVAELPFDSDRKLMSTIHKESDGRYFIAVKGAPDQLLKRVTKIEDNGLVRDITAEDKEAILNTNKELAKQALRVLMMAYKYETQIPSLETDIVESDLVFSGLVGMIDPERPEAAEAVRVAKEAGIRPIMITGDHQDTAEAIAKRLGIIDANDTEDHVFTGAELNELSDEEFQKVFKQYSVYARVSPEHKVRIVKAWQNDGKVVAMTGDGVNDAPSLKTADIGIGMGITGTEVSKGASDMVLADDNFATIIVAVEEGRKVFSNIQKSIQYLLSANMAEVFTIFFATLLGWDVLAPVHLLWINLVTDTLPAIALGVEPAEPGVMTHKPRGRQSNFFDGGVMGAIIYQGILQTILVLGVYGWALMYPEHAGYRMIHADALTMAFATLGLIQLVHAFNVKSVYQSIFTVGAFKNRTFNWSIPVAFILLMVTIVVPGFNKLFHVTHLSSTQWLTVVIGSLLMVVLTEIVKFIQRKLGQDEKAI

SEQ ID NO: 8899 - DNA, 1518 bp, Streptococcus agalactiae
atgagaaagaaatttcttttattgatgagctttgtagctatgtttgcagcttggcaacttgttcaagttaaacaagtttgggctgatagtaaacttaaagtggtaacaactttttacccagtttatgagtttacaaaaaatgtcgttggtgataaagctgatgtatctatgttaattaaagcaggtacagaaccgcatgattttgaaccatcaactaaaaacatcgctgccatccaagattcaaatgcttttgtttacatggatgataacatggaaacttgggctccaaaagtagctaagtcagttaaatccaaaaaagtaacaactattaaaggtactggcgatatgttacttactaaaggcgtcgaagaagaaggtgaagaacatgaaggacatggtcatgaagggcatcatcatgaacttgacccacacgtatggttgtctccagaacgtgcgatttctgttgtagaaaacatccgtaataaatttgtcaaagcttatccaaaagatgcagcttcatttaacaaaaatgcagatgcttacattgcaaaattaaaagagcttgacaaagaatacaaaaatggtttgtcaaatgctaaacaaaagagttttgtgactcaacacgcagcgtttggttacatggcgcttgattacggtttaaatcaagttccaattgctggtcttactccagatgcagaaccttcatcaaaacgtttaggcgaattagctaaatacatcaagaaatataacatcaactacatttattttgaagaaaatgcttcaaataaagttgctaaaactttagcagatgaagttggcgtgaaaacagctgtgcttagtccacttgaaggactttctaaaaaagaaatggcagctggcgaagattacttctcagttatgagacgtaatttgaaagttcttaaaaagacaacagatgttgcaggtaaagaagtagctcctgaagaagataaaactaaaacagttgaaacaggttactttaaaactaaagatgttaaagaccgtaaattgacagattactctggtaattggcaatcagtatatcctcttcttcaagatgggacacttgatccagtttgggattacaaagctaaatctaaaaaagatatgactgctgcagagtacaaaaaatattatacagcaggttacaagactgacgtagaatcaatcaagattgatggtaaaaamcatcaaatgacctttgtacgtaatggtaaatcacaaacatttacatacaaatatgcaggttacaaaatcttaacttataaaaaaggtaatcgtggagtacgttatctctttgaagctaaagaaaaagatgctggtcaattcaaatatatccaatttagtgaccatggtattaaaccgaataaagctgaacacttccatatcttctggggttcagaaagccaagaaaaattatttgaggaaatggaaaactggccaacatacttcccagctaaaatgtctggacgtgaagttgcccaagaccttatgtctcat

SEQ ID NO: 8900 - protein, 506 aa, Streptococcus agalactiae
  MISC_FEATURE (1)..(506): Xaa = Any Amino Acid
MRKKFLLLMSFVAMFAAWQLVQVKQVWADSKLKVVTTFYPVYEFTKNVVGDKADVSMLIKAGTEPHDFEPSTKNIAAIQDSNAFVYMDDNMETWAPKVAKSVKSKKVTTIKGTGDMLLTKGVEEEGEEHEGHGHEGHHHELDPHVWLSPERAISVVENIRNKFVKAYPKDAASFNKNADAYIAKLKELDKEYKNGLSNAKQKSFVTQHAAFGYMALDYGLNQVPIAGLTPDAEPSSKRLGELAKYIKKYNINYIYFEENASNKVAKTLADEVGVKTAVLSPLEGLSKKEMAAGEDYFSVMRRNLKVLKKTTDVAGKEVAPEEDKTKTVETGYFKTKDVKDRKLTDYSGNWQSVYPLLQDGTLDPVWDYKAKSKKDMTAAEYKKYYTAGYKTDVESIKIDGKXHQMTFVRNGKSQTFTYKYAGYKILTYKKGNRGVRYLFEAKEKDAGQFKYIQFSDHGIKPNKAEHFHIFWGSESQEKLFEEMENWPTYFPAKMSGREVAQDLMSH

SEQ ID NO: 8901 - DNA, 693 bp, Streptococcus agalactiae
atggcggctcaattagctgatattattgactgtaacgcatgtattattaatggtggtggtaacttacttggctatgccatgaaatataaaacaaacactgaccgtgtggaagaattttttgaaacaaaacaattcccagattactatgttaaatctgctagtcgtgtttatgatacagaagctaacttatcagtagataatgatttgtcaattttcccagttgagacaaaggaaaacttccaagatggtattacaacaatcgctccaatttatggtggtggaatgcgcttgggaacatttattatctggcgtaatgataaagaatttagcgacgatgatttgattttagttgaaattgcaagcaccgttgttggtattcaattacttaaccttcaaacagaaaatctagaagaaaatattcgtaaacaaacagcggtgacaatggctatcaacactctatcttattcagaaatgaaagctgtagctgctatcttaggagaattagatggacttgaaggacgcctaacggcatctgttattgcagaccgtattggaattacacgttccgttattgtaaatgctcttcgtaaattggagtctgcgggaatcattgagagccgctcactcggtatgaagggaacatacctcaaagttattaacgaaggtatttttgacaaattaaaagaatataat

SEQ ID NO: 8902 - protein, 231 aa, Streptococcus agalactiae
MAAQLADIIDCNACIINGGGNLLGYAMKYKTNTDRVEEFFETKQFPDYYVKSASRVYDTEANLSVDNDLSIFPVETKENFQDGITTIAPIYGGGMRLGTFIIWRNDKEFSDDDLILVEIASTVVGIQLLNLQTENLEENIRKQTAVTMAINTLSYSEMKAVAAILGELDGLEGRLTASVIADRIGITRSVIVNALRKLESAGIIESRSLGMKGTYLKVINEGIFDKLKEYN

SEQ ID NO: 8903 - DNA, 963 bp, Streptococcus agalactiae
atgacaattaaaaatctcactgttgcaggaagtggcgttctaggtagtcaaatcgcctttcaagcagcttacaaaggaatgtctgtcaccatatatgacattaacgatgaagctttaaataagggaaaagaacgcatcaaaaaattagctaaagtctatcaatcagaaattgaaacagcaaaagaagcatatagtgataaagctaaaagtatcaagtataataaaaacttattgcctagcttagaccatatttttctttcaaaagttgccgattcattagacttgattgctgatttaccaaaccaaattactttttcaaaaaacttagaccaagctgtaagtgacgccgatttagtaatcgaagctgtcccagaaacagttagtataaaagaagatttttataaacaattagctaaagtggcaccttcaaagacaatctttgcaacaaattcttcaacacttgttccaagtcagtttgctgatataacaggacggcctgacaaatttttagcaatgcatttcgctaacaatatttggcaaaataatattgttgaaattatgggacataagggaactgacgacgaggttatcaaagaagctttggcattctcaaaagatattggtatggtgcctttacatattcataaagaacaacctggctatattcttaattcaatactagttccattcttagagagtgcactagcattgtactatgataaggtttctgattctgaaactattgataaaacctggaagttaggaacaggagcaccgatgggacctttagaaattttagatattattggcatcgataccgcttataatatcatgaagaattattcagataccaacagcgatcctaatagtcttcatgctcaccttgcaaaaatgcttaaagaagaattcattgataaaggacgtaccggtaaagctgctggacacggcttttatgattacgac

SEQ ID NO: 8904 - protein, 321 aa, Streptococcus agalactiae
MTIKNLTVAGSGVLGSQIAFQAAYKGMSVTIYDINDEALNKGKERIKKLAKVYQSEIETAKEAYSDKAKSIKYNKNLLPSLDHIFLSKVADSLDLIADLPNQITFSKNLDQAVSDADLVIEAVPETVSIKEDFYKQLAKVAPSKTIFATNSSTLVPSQFADITGRPDKFLAMHFANNIWQNNIVEIMGHKGTDDEVIKEALAFSKDIGMVPLHIHKEQPGYILNSILVPFLESALALYYDKVSDSETIDKTWKLGTGAPMGPLEILDIIGIDTAYNIMKNYSDTNSDPNSLHAHLAKMLKEEFIDKGRTGKAAGHGFYDYD

SEQ ID NO: 8905 - DNA, 831 bp, Streptococcus agalactiae
atgacaataaaaaaagtgttaagtgtaacaggaattattttagtgacagtagcgtctctagctgcttgtagctcaaaatctcatactactaagacgggcaaaaaagaagttaattttgcaactgttggaacaacggcacctttttcttatgtgaaggatgggaaactgactggctttgatattgaagtagccaaagctgtttttaaaggttcagataactataaagtcacttttaaaaaaacagaatggtcatcggtatttaccggcattgattcaggaaagtttcaaatgggtggaaataatatttcttattcatcagagagatctcaaaaatatttattttcatacccaataggctctactccttcagttttagcagttcctaagaatagtaatatcaaagcttataatgatattagtggtcataaaacacaggttgtccaaggaacgacaactgccaagcaattagaaaatttcaataaagagcatcagaaaaatcctgttactctaaaatatactaatgaaaatattacacagattctaacgaatttgagtgatggaaaagctgattttaaactttttgacggaccaactgttaacgctatcataaagaatcaaggtctcacgaatttaaaaaccatccctttgactatgagagatcagccttatatttatttcatctttggtcaggatcaaaaagacttgcaaaagtatgtgaataatcgccttaaacaattacgtaaagatgggacactttcaaaaatagctaaagaataccttggaggtgattacgtaccaaatgagaaagatctcgttactcctaaggagaag

SEQ ID NO: 8906 - protein, 277 aa, Streptococcus agalactiae
MTIKKVLSVTGIILVTVASLAACSSKSHTTKTGKKEVNFATVGTTAPFSYVKDGKLTGFDIEVAKAVFKGSDNYKVTFKKTEWSSVFTGIDSGKFQMGGNNISYSSERSQKYLFSYPIGSTPSVLAVPKNSNIKAYNDISGHKTQVVQGTTTAKQLENFNKEHQKNPVTLKYTNENITQILTNLSDGKADFKLFDGPTVNAIIKNQGLTNLKTIPLTMRDQPYIYFIFGQDQKDLQKYVNNRLKQLRKDGTLSKIAKEYLGGDYVPNEKDLVTPKEK

SEQ ID NO: 8907 - DNA, 825 bp, Streptococcus agalactiae
atgaagttaaaacatattgtcttaggattagccttaacaacacttttaggagtcacatttagtaatcaagaagtttcagcaagctcaacttcaagtaaagttgttaaagttggtgttatgaccttttctgacactgaaaaagcacgttgggataaaattgaaaagctagtaggtgataaagctaaaatcaaatttacagaatttacagattatacacaaccaaatcaagcgacagccaataaggatgtggatattaatgcctttcaacattacaatttcttagaaaactggaataaggaaaataagaaaaacttaattccacttgaaaagacttacttagctccaattcgtatctattctgagaaggtaaaatctcttaaaaaattgaaaaaaggagccactattgcaattccaaatgatgcaacaaatggtagccgtgcattgtatgtccttcagtcagcaggtttaatcaaattgaatgtttctggtaagaaggttgcaacagttgctaatatcacatctaataaaaaggatattaatattcaggagttagatgcgagtcaaacaccacgtgcactcaaagatgtagatgcagctattattaataatacatacattgagcaagctaatttaaaaccttcagatgctatctttgttgagaaatcagataaaaattcaaaacaatggattaatatcattgcgggacgtaaaaattggaaaaagcaaaagaacgctaaagctatccaagctatcttggatgcttatcacacagatgaagtgaaaaaagttatcaaagatacttcagctgatattccacaatggtaa

SEQ ID NO: 8908 - protein, 274 aa, Streptococcus agalactiae
MKLKHIVLGLALTTLLGVTFSNQEVSASSTSSKVVKVGVMTFSDTEKARWDKIEKLVGDKAKIKFTEFTDYTQPNQATANKDVDINAFQHYNFLENWNKENKKNLIPLEKTYLAPIRIYSEKVKSLKKLKKGATIAIPNDATNGSRALYVLQSAGLIKLNVSGKKVATVANITSNKKDINIQELDASQTPRALKDVDAAIINNTYIEQANLKPSDAIFVEKSDKNSKQWINIIAGRKNWKKQKNAKAIQAILDAYHTDEVKKVIKDTSADIPQW

SEQ ID NO: 8909 - DNA, 393 bp, Streptococcus agalactiae
atgaagtcaataaaattacttagttttattgtaataatccttttagggcttggtttcactgtaggaggtttaaaagtgactgaaaacaataaacaacaagaattatgggaaatagctaatagcaaagacgctaaaaatgcttatcaaaagtggatttatgcagaagatgaagatgctttcaaagagaatgctgttattaagtcgtatgatattgacaaagaaagtatcaaaaaaaatcctatgggagggatttcggtaaggttaatcattaataaagatcctaacttatatattacttgtaatttggatagggataatcaagggcatttggtcagtcaaagtagccatcaatctccccagttaactcatttattggaaagtagaggtcattaa

SEQ ID NO: 8910 - protein, 130 aa, Streptococcus agalactiae
MKSIKLLSFIVIILLGLGFTVGGLKVTENNKQQELWEIANSKDAKNAYQKWIYAEDEDAFKENAVIKSYDIDKESIKKNPMGGISVRLIINKDPNLYITCNLDRDNQGHLVSQSSHQSPQLTHLLESRGH

SEQ ID NO: 8911 - DNA, 1263 bp, Streptococcus agalactiae
atgcttaaacgtctaggtaaagtatttggacctctagtttgtgctttactattgttggtaggattatattttgtttttcctgtttctcagcctcatcatttaggtaaggaaaaaaacagtgcagtagcgttgacgaaggcaggttttaaaagcagagttcaaaaagttagagctttcagtgatcctaaagccaattttgtccctttctttggttcaagtgagtggctaagatttgacgcaatgcatccatcagttttagcagaggcttacaataggtcttatatcccatatcttttaggtcaaaaaggggcggcttctctgacacaatactatggcattcaacagattaaaggacaaatcaaaaataaaaaagctatctatgttatttctccgcaatggtttgttcgcaagggagccaacaaaggtgcttttcaaaactatttcagcaacgatcaaaccattcgatttttgcaaaatcaaacagggacaacctacgataggtatgctgctcgtcgattgttaaaattatatcctgaagcttctatgtcagatttgatagaaaaagttgcagatggccaaaaactatcaaataaagacaaacaaagactaaagtttaatgattgggtatttgagaagacagatgctatttttagctatctaccactaggaaaaacttataatcaggcaataatgcctcatgttggtaaattaccgaaagcattctcatataatcatttatcgcgtattgcatcacaagatgctaaagtagcaacgagatcaaatcaatttggtattgatgatcgcttttaccaaacaagaattaaaaagcacttaaaaaaattgaaagggtcacaacgacatttcaattatactaagtcaccagaatttaatgatttacagttggttcttaatgaattctcaaaacaaaatacagatgtcctttttgtcataccaccagtaaataaaaagtggacagactacacagggcttgatcaaaaaatgtatcaaaaatctgtagaaaaaataaaacaccaacttcaaagtcaaggtttcaatcatatcgctgacctttctcgagatggaggtaagccatactttatgcaagatacaatccatttaggttggaatggttggttagagctagataagcatatcaatccatttttaacagaggaaaacagcaagccgaattatcacattaataataaatttttgaagaaatcttgggcaaaatatacaggacgtccaagtgattacaagtaa

SEQ ID NO: 8912 - protein, 420 aa, Streptococcus agalactiae; identical to SEQ ID NO: 5734

SEQ ID NO: 8913 - DNA, 1263 bp, Streptococcus agalactiae; identical to SEQ ID NO: 5741

SEQ ID NO: 8914 - protein, 421 aa, Streptococcus agalactiae
VIQAFLEKLPHLDVYGNPQYFFYLILAVLPIYIGLFFKKRFALYEIIFSLSFIVMMLTGSTFNQLKSLLAYVVGQSLLVFIYKAYRKRFNHTLVFYVTVCLSIFPLFLVKLIPAISEDGHQSLFGFLGISYLTFRAVAMIIEMRDGVLKEFTLWEFLRFLLFFPTFSSGPIDRFKRFNEDYINIPDRNELLDMLGQAIHYLMLGFLYKFILAYIFGSLIMPPLKELALEQGGVFNWPTLGVMYAFGFDLFFDFAGYTMFALAISNLMGIKSPINFDKPFKSRDLKEFWNRWHMSLSFWFRDFVFMRLVKLLVKNKVFKNRNVTSSVAYIINMLLMGFWHGLTWYYIAYGLFHGIGLVINDAWVRKKKNINKERRLAKKPLLPENKWTYALGVFITFNVVMFSFLIFSGFLDLLWFPQPHNK

SEQ ID NO: 8915 - DNA, 1188 bp, Streptococcus agalactiae
atgtttagtgatttacgcaaaaaatttgtctttttgaccatgtcaatccttattgtcgttgttctctttctatttgcagttagtaatcgctacaatcaatattgggatgaatatgatgcatataggattgttaaattagttgccaaaaatgattatttaggaataccaggcgatgaaccgattgctttggtgactatagataaccaaaagatggttaagattcaaagcaataatactgatttgacaaatgatgttatcgaaaaatctagtttgaagctccttgagcaaggaaagaagtcacgaaaatggaagtcttttatatattccataaaagaatataaagataaaacctacaccatagctattatggatttggctagttatgaagtcccttatgcaaggcgttttctaattcttgtttttactatttttggattttgtttattagcagctgtaagtctttatctttctcgatttattgtaggacctgtagagacagaaatgactcgcgaaaaacagttcgtttcagatgcgagtcatgagctgaagacccctattgcagctatacgagccaacgttcaggttctggaacagcaaattccagggaatcgttatctggatcatgttgtttcggagactaagcgaatggagtttttaattgaagatttgcttaatttgtctagacttgatgaaaaacgctccaaggtaaatttcaaaaagttaaacttatctgtcttatgtcaagaagtacttctaacatatgaaagtttggcatatgaagaagaaaagtgtttaaatgatacgattgaagatgatgtctggattgttggagaagagagtcagattaagcaaattttaataattcttttggataatgctattaggcattctttgtcaaaatcagcaatccagtttagtcttaaacaagctcgaagaaaagctattctgacaatatcaaatccaagtgctatctattccaaagaggttatggataatctctttgagcgtttttatcaagctaaagatgatcatgcagattctctcagttttggtctaggcttatctattgctaaagcaatcgtggaacgccataaggggagaattagagcatatcaagaaaaagaccaattacgtcttgaagtccagttaccaattgatggattttggaccaataccatgattaattaa

SEQ ID NO: 8916 - protein, 395 aa, Streptococcus agalactiae; identical to SEQ ID NO: 5750

SEQ ID NO: 8917 - DNA, 1098 bp, Streptococcus agalactiae
atgcaaattacccgagaagccggatatgatgttaaagatattaataaacctaaagcgtctatcgttattgacaataaaggtcatattttgtgggaagataacgctgatttagaacgtgatcccgctagcatgtctaaaatgtttactttatatttactatttgaagacttagctaaaggaaaaacaagcctcaacaccacagtgactgcaacagaaacagaccaagccataagtaagatttatgaaattagtaataataatattcatgctggggttgcttatcctattcgtgaactgattactatgacagctgtcccgtcatctaatgtagcaactattatgattgctaaccacttatcacaaaacaatcctgacgccttcattaaacgaatcaatgaaaccgccaagaaactcggtatgacaaaaactcacttttataaccccagtggggcggtagcgagtgcttttaatggactttactccccaaaagaatacgataacaatgctactaacgttacgactgcacgtgatctatcaattttaacctatcatttccttaaaaaataccctgatatactgaactatacaaaatatcctgaagtcaaggccatggtcggaactccttatgaagaaacatttacaacttataactactctacccccggcgctaaatttggattagaaggagtagatggcttaaaaactggttctagccctagcgctgcttttaatgccttagttacagctaaacgccagaatactcgcttgataactgtggttttaggagttggtgattggtcagaccaagacggagagtactatcgtcatccgtttgtcaacgctcttgtagaaaaaggttttaaagacgctaaaaatatttcttctaaaactcctgtattaaaagccgttaaacctaaaaaagaagttactaaaaccaaaaccaaatctattcaagaacagcctcaaacaaaagaacagtggtggacaaaaacagatcaatttattcaatcacattttgtatctattttaattgttctgggcaccatcgctatcctttgtcttttagctgggatagtattacttataaagcgctctaga

SEQ ID NO: 8918 - protein, 366 aa, Streptococcus agalactiae
MQITREAGYDVKDINKPKASIVIDNKGHILWEDNADLERDPASMSKMFTLYLLFEDLAKGKTSLNTTVTATETDQAISKIYEISNNNIHAGVAYPIRELITMTAVPSSNVATIMIANHLSQNNPDAFIKRINETAKKLGMTKTHFYNPSGAVASAFNGLYSPKEYDNNATNVTTARDLSILTYHFLKKYPDILNYTKYPEVKAMVGTPYEETFTTYNYSTPGAKFGLEGVDGLKTGSSPSAAFNALVTAKRQNTRLITVVLGVGDWSDQDGEYYRHPFVNALVEKGFKDAKNISSKTPVLKAVKPKKEVTKTKTKSIQEQPQTKEQWWTKTDQFIQSHFVSILIVLGTIAILCLLAGIVLLIKRSR

SEQ ID NO: 8919 - DNA, 954 bp, Streptococcus agalactiae
atgccaatggcggccagtagacactttatagaagtctcttattttcactacattttgcctgtaattattggcggtctcgtagttacaacaacaggattcatagatgacatctttgaattaagacctcgttataaaatgttgggaattattattgcagctattatcatatggaaatttacacattttagatttgatagttttaagattccaataggtggtccactcttggagtttggtcctattttaactttctttttgacagttttatggattatttcaatcactaatgctatcaatctgattgatggtctagatggtctagttagtggtgtttcaattatcagtctagcaacgatggcagtggtttcttatttctttttacctaaaatagatttttttctcacgctaactattgttattttaatcgcctcaatagttggttttttcccttataattatcatccagccattatctacctaggtgatgctggtgccttgtttataggatttatgattggtgtattatcgcttcaaggtttaaaaaactccacagctgttgcagtgataacacctgtcattattttaggagttcctattttggatacagctgttgctattgtgaggcgtaaattatcagggaaaaagatttctgaagctgataagatgcacctgcatcaccgattgctatctatgggatttacacatagaggagcagttttagttgtttatggtattgcaattatcttttcgcttatcgctttgcttttaaatgtttctagtcgtattgggggaatttttcttctattggcgctactattagcgatggaaatttttatagaaggtttaaatatttggggtgagaatcggacaccactatttaatctcttaaagttcattggcaacagtgattacagacaaagtgttattgctaaatatagcgataagcatcaaaaa

SEQ ID NO: 8920 - protein, 318 aa, Streptococcus agalactiae
MPMAASRHFIEVSYFHYILPVIIGGLVVTTTGFIDDIFELRPRYKMLGIIIAAIIIWKFTHFRFDSFKIPIGGPLLEFGPILTFFLTVLWIISITNAINLIDGLDGLVSGVSIISLATMAVVSYFFLPKIDFFLTLTIVILIASIVGFFPYNYHPAIIYLGDAGALFIGFMIGVLSLQGLKNSTAVAVITPVIILGVPILDTAVAIVRRKLSGKKISEADKMHLHHRLLSMGFTHRGAVLVVYGIAIIFSLIALLLNVSSRIGGIFLLLALLLAMEIFIEGLNIWGENRTPLFNLLKFIGNSDYRQSVIAKYSDKHQK

SEQ ID NO: 8921 - DNA, 1887 bp, Streptococcus agalactiae
atgataatgaagaaatgttttttggctatttgtttagctcttagtttttttatggtttcagttcaagcagatgaggtggactataacattcctcattatgagggtaatctaactattcacaatgataatagtgctgattttacagagaaggttacttaccaatttgattcgtcctataatggacagtatgtcacattaggtacggcgggtaagttacctgacaattttgatattaataataagccacaggttgaagtttcaattaatggtaaagtaaggaaagttagttaccagatagaagatttggaggatggctaccgtttgaaagtgtttaatggtggtgaagcaggtgatactgttaaagtcaatgttcagtggaaactaaaaaatgttctatttatgcataaggatgttggtgaacttaactggattcctattagcgactgggataaaacgttagagaaagtagatttttggatatcaactgacaaaaaggttgctctttctcgtctttgggggcacttgggttatcttaaaactcctcctaaaataagacaaaataataatcgttaccatttgacagcttttaatgtaaacaaacgattagaatttcatggttattgggatagatcttattttaatctacctacaaacagtaaaaataattacaagaaaaaaattgaatatcaagagaagatgatagagcgtcatggttttatcctaagtttcttgttaaggatattattaccttcattctttattattgtgacactattcatctcaattagggtgttcctgtttagaaaaaaagttaataaatacgggcaattccctaaggaacatcatttatatgaagcacctgaggacctttcaccactagagttaactcaaagcatttatagtatgagttttaaaaattttcaagatgaggagaagaaaactcaccttatcagtcaagaacaactcattcagtcaattctattagacttgattgatagaaaagtattgaattatgatgataacttgttatctctagctaacttagatagagcttctgatgcagaaatagattttatagagtttgcttttgcggattctacgagtttgaagccagatcaactcttttctaattaccaatttagttataaagaaacactacgtgaactgaaaaagcagcacaaggcttcagatctgcaaactcaaatgagacgccgaggaagtaatgccttatcaagaattacgcgtctcacaaggttgatttctaaagacaatataaactctcttagaagaaagggaatttcatccccttatcgtaaaatgtcttcagaagagtctaaagaattatctaggttgaaaagattcagttacctatcacctcttatttcttttgttgttataatttatacgctttttttaaattattttacctatttctgtatctatctcttattgtttggtgttatcctgttgttgaataaaatcatttttatgatgacaagaaaaataagtaacggttatattgtaactgaagatggagcaagtcgtgtctaccaatggactagttttaggaacatgctaagggatatcaaatcgtttgatcgttcagagttagaaagtatcgtattatggaatcgaatattggtttacgctactttattcggctacgctgaccgtgttgagaaagcactcagagtgaaccaaatagatattccagaaagatttgcaaacattgatagtcatcaatttgcgatttcagtcaatcaatctagtaatcatttttcaacgataactgaagatgttagtcacgcttctaattttagtgttaattcaggcggttcttcaggtggtttctcaggcggcggaggcggcggaggtggtggtgccttc

SEQ ID NO: 8922 - protein, 629 aa, Streptococcus agalactiae
MIMKKCFLAICLALSFFMVSVQADEVDYNIPHYEGNLTIHNDNSADFTEKVTYQFDSSYNGQYVTLGTAGKLPDNFDINNKPQVEVSINGKVRKVSYQIEDLEDGYRLKVFNGGEAGDTVKVNVQWKLKNVLFMHKDVGELNWIPISDWDKTLEKVDFWISTDKKVALSRLWGHLGYLKTPPKIRQNNNRYHLTAFNVNKRLEFHGYWDRSYFNLPTNSKNNYKKKIEYQEKMIERHGFILSFLLRILLPSFFIIVTLFISIRVFLFRKKVNKYGQFPKEHHLYEAPEDLSPLELTQSIYSMSFKNFQDEEKKTHLISQEQLIQSILLDLIDRKVLNYDDNLLSLANLDRASDAEIDFIEFAFADSTSLKPDQLFSNYQFSYKETLRELKKQHKASDLQTQMRRRGSNALSRITRLTRLISKDNINSLRRKGISSPYRKMSSEESKELSRLKRFSYLSPLISFVVIIYTLFLNYFTYFCIYLLLFGVILLLNKIIFMMTRKISNGYIVTEDGASRVYQWTSFRNMLRDIKSFDRSELESIVLWNRILVYATLFGYADRVEKALRVNQIDIPERFANIDSHQFAISVNQSSNHFSTITEDVSHASNFSVNSGGSSGGFSGGGGGGGGGAF

SEQ ID NO: 8923 - DNA, 1548 bp, Streptococcus agalactiae
atgaaaaaaatattactaagtttattcactgctttgcttatcaccyttggaggtatgacaagtatacaagcagatgaatatctacgtgtcggtatggaggcagcctatgctcctttcaactggacacaaaatgataacacaaatggtgcagttcctattgaaggaactgatcaatatgctaatggttatgatgtacaagtcgctaaaaagttagctaaaaagttaaataaaaaagttgttgttgtcaaaacaaaatgggaaggccttgttccagcactaacttctggaaaactcgatatgattattgcaggaatgagtcctaccgaagaacgtaaaaaagaaattaatttttcaaagccttactacatttcagaacctactctagttgttaatgctgaaggaaaatatactaatgctaaaaatattagtgatttcaaaaatgctaaagtaactgcccaacaaggagtctacttatacaacctcattgatcaaatcaatggtgtcaaaaaagaagttgccatgggggacttcaatcaattaagacaagctgtagaatctggtgttgtagacgcctatgtttcagaacgtccagatgcaacttccgctcaaactgctaatcctaaattaaaaatgattgaactgcaccaagggtttaaaacatctgatgccgatacaaatatttctgttgggatgcgtaaaggtgacaatcgtattaatcaagttaatcaagttctcgaaagcatttctagagataaacaaatcgccttgatggataagatgattaaagaacagccatccgttaaaaaagaaaaaaatgggaaaccaaacttctttgaacagatggcaactattttaaaaaacaatggttctcaattcctcagaggaacagctacaaccctcctaatttctatggtaggaacaatcgtcggattatttatcggccttctcatcggtgttttccgtacagcaccaaaatctgacaataagttaaaggctgccttacaaaaattattaggttggttacttaacatctatattgaggtcttccgcgggacacctatgattgtacaatcgatggttatctactacggaacagcacaagcttttggagtttcgctggaccgtacactagcagctatatttattgtttcaatcaatactggtgcttatatgagcgaaattgtacgtggtggtattttctctgttgataaaggacaatttgaagccgcaactgcacttggtttcacccacggacaaaccatgcgaaaaattgttctaccacaagttgtacgtaacatactcccagctactggtaatgagtttgttatcaatatcaaagatacctctgtactgaacgttatctctgttgtcgaactctacttctctggtaatactgttgcaacacaaacctaccaatatttccaaacattcaccattattgcgattatttacttcatcttaaccttcaccgtaacacgtatcttacgttacattgaaaaacgttttgattcagataattacacaaccggtgcgaatcaattacaagtc

SEQ ID NO: 8924 - protein, 516 aa, Streptococcus agalactiae
  MISC_FEATURE (1)..(516): Xaa = Any Amino Acid
MKKILLSLFTALLITXGGMTSIQADEYLRVGMEAAYAPFNWTQNDNTNGAVPIEGTDQYANGYDVQVAKKLAKKLNKKVVVVKTKWEGLVPALTSGKLDMIIAGMSPTEERKKEINFSKPYYISEPTLVVNAEGKYTNAKNISDFKNAKVTAQQGVYLYNLIDQINGVKKEVAMGDFNQLRQAVESGVVDAYVSERPDATSAQTANPKLKMIELHQGFKTSDADTNISVGMRKGDNRINQVNQVLESISRDKQIALMDKMIKEQPSVKKEKNGKPNFFEQMATILKNNGSQFLRGTATTLLISMVGTIVGLFIGLLIGVFRTAPKSDNKLKAALQKLLGWLLNIYIEVFRGTPMIVQSMVIYYGTAQAFGVSLDRTLAAIFIVSINTGAYMSEIVRGGIFSVDKGQFEAATALGFTHGQTMRKIVLPQVVRNILPATGNEFVINIKDTSVLNVISVVELYFSGNTVATQTYQYFQTFTIIAIIYFILTFTVTRILRYIEKRFDSDNYTTGANQLQV

SEQ ID NO: 8925 - DNA, 2349 bp, Streptococcus agalactiae; identical to SEQ ID NO: 5873

SEQ ID NO: 8926 - protein, 783 aa, Streptococcus agalactiae
VKKLKHSMKSKTSSNDKKQKTKTQKQEISPSTVNTLAYQGLFQNGLMQVSPSYFSQTYLLGDVNYQTVGLDDKGAIVEKYSDLINSLDDKTNFQLTIFNQKVNLEKFRKSILYPLQEDGFDTYRDELNRMMDANLEAGENNFSAVKFLSFGKSDQTPKLAFRSLSQIGEYFKSGFSEIDVSLGLLGGEERVNVLADMLRGENHLPFSYKDLTLSGQSTKHFIAPTYLSFKHKNHIELDDRLLQIVYVRDYGMELGDKFIRDLMQSDLEVMISLHAKGSTKSETMTKLRTKKTLMESQKIGEQQKMARTGIYLEKVGHVLENNIDEAEALLQTMTQTGDKLFDTVFLIGVLADTEDQLKQSLDIIKQVAGSNDMIIDNLTYMQEAAFNSLLPFGKNYLEGVSRSLLTSNIAVNAPWTSVDIHDKGGKFYGINQISSNIISIDRGKLNTPSGLILGTSGAGKGMATKHEIISTKLKEADSDTEIIIVDPENEYSIIGQAFGGESIDIAPDSTTFLNVLELSDENMDEDPVKVKSEFLLSWIGKLLDRKMDGREKSLIDRVTRLTYKHFDTPSLVEWVFVLSQQPEQEAKDLALDMELYVEGSLDIFSHRTNIKTDSHFLIYNVKKLGDELKQIALMVIFDQIWNRVVKNQKLGKKTWIYFDEMQLLLLDKYASDFFFKLWSRVRKYGAIPTGITQNVETLLLDANGRRIIANSEFMILLKQAKSDREELVHMLGLSKELEKYLVNPEKGAGLIKAGSTVVPFKNKIPQHTKLFDIMSTDPEKMRT

SEQ ID NO: 8927 - DNA, 2328 bp, Streptococcus agalactiae
atgaaatcaaagacctcttctaatgacaaaaagcaaaagacgaaaacacagaaacaggaaatcagcccttctaccgtaaatacgttagcctatcaaggactttttcagaatggccttatgcaggtcagtccaagctatttctcacaaacctatctcttaggagatgttaattaccaaacagttggcttagatgataagggagctatcgtggagaaatattccgatttaatcaattcactggatgataagaccaatttccaactgactattttcaatcaaaaagttaatttggaaaaatttcgtaagagtattctctatcccttgcaggaagatgggtttgatacttatcgtgatgaattgaatcgcatgatggatgccaacttagaggcgggtgagaacaacttttcagctgtcaagtttctttcatttggcaagagcgaccaaacaccaaaactagcttttcgttctctgtcacagattggggaatatttcaagagtggcttttcagagattgatgtatctcttggtttacttggtggagaggagcgagtgaatgtccttgcggatatgttacgaggtgaaaatcatttaccgttttcttataaggatttgactctctcaggtcaatccaccaaacactttattgccccaacctacctttcctttaaacacaagaatcatattgaattggacgatcgattattacagattgtttatgttcgcgactatggcatggagttaggggataaatttattcgagacctcatgcagtcagatttggaagtgatgattagcctacatgccaaaggctctactaagtctgaaaccatgaccaagctacgaaccaagaagaccttgatggaatcacaaaagattggtgaacaacaaaaaatggctcggactggaatctatttggagaaggtcggccatgttcttgagaacaacatcgatgaagctgaagctcttcttcaaaccatgacccaaacaggagataaactgtttgacaccgtatttctaattggcgtgctagcggatactgaagaccaactcaaacaatctcttgatattatcaagcaagtggcagggtctaatgatatgattattgataacttgacctatatgcaagaagctgcctttaatagtctcttgccatttgggaagaactatctcgaaggtgtttctcggtctctattgacttcaaatattgccgtgaatgcaccttggacttccgtagatattcatgacaagggtgggaaattttatggcatcaatcaaatctcaagtaatatcatcagtattgaccgtggcaagttaaatactccatcaggtttgattttagggacttctggagctggcaaagggatggcgacaaaacacgaaatcatctcaactaagctcaaggaagcagatagtgatactgaaattattattgttgacccagaaaatgagtacagtattatcggtcaagcctttggtggggagagtattgatattgccccagactctaccaccttcttaaatgtcttagaactatctgatgagaatatggatgaggacccagttaaggtcaaatccgaatttctcttgtcttggattggaaagctcttggaccgcaaaatggatggtcgtgaaaaatccttgatagatcgtgtgacacgcttgacatataagcattttgacacaccgtccttggtcgaatgggtctttgtcttatctcaacaacctgaacaggaagctaaggacttggcactggatatggaactctatgtggaagggtcgctggacatattttcacatcggaccaatattaaaacagacagtcatttcctgatttacaatgtcaaaaagctaggcgatgagttaaaacaaattgccctcatggttatctttgaccaaatttggaatcgggtggtcaaaaaccaaaagctagggaagaagacctggatttactttgatgaaatgcagctactcttattggacaagtatgcctctgatttctttttcaaactttggagtcgtgtccgtaagtatggggcgataccgacaggtattactcagaatgtagaaacgcttcttttggatgccaatggcagacgcattattgccaatagcgagttcatgattcttttaaaacaggctaagagcgatcgcgaagaattggtgcatatgcttgggctttctaaagagctggagaagtacttggtcaatcctgaaaaaggggcaggcttaattaaggccggttccaccgttgttccgttcaagaataagattccgcaacacaccaagctctttgacatcatgagtacggaccctgaaaaaatgaggaca

SEQ ID NO: 8928 - protein, 776 aa, Streptococcus agalactiae
MKSKTSSNDKKQKTKTQKQEISPSTVNTLAYQGLFQNGLMQVSPSYFSQTYLLGDVNYQTVGLDDKGAIVEKYSDLINSLDDKTNFQLTIFNQKVNLEKFRKSILYPLQEDGFDTYRDELNRMMDANLEAGENNFSAVKFLSFGKSDQTPKLAFRSLSQIGEYFKSGFSEIDVSLGLLGGEERVNVLADMLRGENHLPFSYKDLTLSGQSTKHFIAPTYLSFKHKNHIELDDRLLQIVYVRDYGMELGDKFIRDLMQSDLEVMISLHAKGSTKSETMTKLRTKKTLMESQKIGEQQKMARTGIYLEKVGHVLENNIDEAEALLQTMTQTGDKLFDTVFLIGVLADTEDQLKQSLDIIKQVAGSNDMIIDNLTYMQEAAFNSLLPFGKNYLEGVSRSLLTSNIAVNAPWTSVDIHDKGGKFYGINQISSNIISIDRGKLNTPSGLILGTSGAGKGMATKHEIISTKLKEADSDTEIIIVDPENEYSIIGQAFGGESIDIAPDSTTFLNVLELSDENMDEDPVKVKSEFLLSWIGKLLDRKMDGREKSLIDRVTRLTYKHFDTPSLVEWVFVLSQQPEQEAKDLALDMELYVEGSLDIFSHRTNIKTDSHFLIYNVKKLGDELKQIALMVIFDQIWNRVVKNQKLGKKTWIYFDEMQLLLLDKYASDFFFKLWSRVRKYGAIPTGITQNVETLLLDANGRRIIANSEFMILLKQAKSDREELVHMLGLSKELEKYLVNPEKGAGLIKAGSTVVPFKNKIPQHTKLFDIMSTDPEKMRT

SEQ ID NO: 8929 - DNA, 1818 bp, Streptococcus agalactiae
atgtattccaggcaaaaagcatttgtctttggactcttgggtctcgcctttggctatttctgccatcgtctaaccctactctatgatagtttaactaatgccccacctatggaacgtattgcctacctcttaggagaggggttaaatcaggttttcaatcctttatggctattttcctttactcaaaaatcttttcttgcctttatccttggggttctaatgatgacgctagtctatctttatgtatcgacaggacagaaagtctatcgggaaggggaagaatatggttctgcacgatttggaaccagtaaggaaaagcggaacttttacagtaagaatcctttcaatgacacgattttggctcgtgatgttcgtctaaccttgttggaaaagaagaaaccccagtttgaccgaaataaaaatttgattgtcattgggggttctggggcaggtaagacctttcgctttgtgaaacccaaccttatccaacttaactgttccaatattgtcgtagatccgaaagaccatttggctgagaagacaggtaaactctttttagaaaacggttatcaggttaaggttttagacttggttaatatgaccaattcagacggttttaatccctttcgttatgtagaaacagagaatgatttgaaccgtatgttaacggtctattttaataataccaaaggaaatggttctcgcagtgatccgttttgggatgaggcttccatgacattggtgagagctattgcctcttacttggtggatttttacaatcctccaggaagttctaagcaagagcaggaagcaagacgtaagcgtggccgttatccagccttttctgagattgggaaactcatcaaactcttatcaaagggagacaatcaggacaaaagtatacttgaagtcctgtttgaagactatgctaagaaatatggtcatgagaactttaccatgagaaactgggcagattttcaaaactataaggataagaccttggattcggtgattgcggtcacaacagctaaatttgccctctttaatattcaatcggtgattgatttgacgcaaagagacactatggatttgaaaacgtggggcactcaaaagaccatggtctatcttgttattccagacaatgatacgacctttcgtttcctatctgctttatttttctctacggttttctccactttgaccagacaggctgatgttgactttaaagggcaactgcctattcatgttagaagctatctggatgagtttgcgaatgtcggagaaatcccagacttcgctgaacaaacctcaacagtccgctctaggaatatgagtcttgtgcctattctccaaaatatcgctcaactccaaggactttataaggaaaaagaagcttggaaaactatactggggaactgtgacagtctcctctatttgggtgggaatgacgaggaaactttcaaattcatgagtggacttttaggcaaacaaaccgttgatgtcagaagcaccagtcgttcttttgggcagacgggttcaagttctacctctcatcagaaaattgctcgtgacttgatgacggctgatgaagttggaactatgaaacgagatgagtgcctcgtacgcattgcaggggttcctgtttttcgaaccaagaaatattttcctctcaaacataaacattggaagttgctcgctgataaggaaaccgatgaccgttggtggaactatcacatcaatcccttggctaaagaggaagaattggacttgtcagactatcaaataagggatttaagcacagaaacgtcactacattaa

SEQ ID NO: 8930 - protein, 605 aa, Streptococcus agalactiae; identical to SEQ ID NO: 5884

SEQ ID NO: 8931 - DNA, 588 bp, Streptococcus agalactiae; identical to SEQ ID NO: 5889

SEQ ID NO: 8932 - protein, 196 aa, Streptococcus agalactiae
VTMIRIVLFYLAIQLNGLLVSLFLKEYLTIEGIVLLQLVLLSVTCLEIARHKTVPLKIVGVQNRLSWLLLGFVAMVAFAVFISFLFPVQTRNQAVLVQVGKQVPPIIFLLFLVNASILEEIVYRQLLWEKLTFPFEQIGVTSFLFVLSHGPNQLGSWLIYSCLGLTLAVVRLKTDCMTAIALHLLWNSLAYVVTFL

SEQ ID NO: 8933 - DNA, 1044 bp, Streptococcus agalactiae; identical to SEQ ID NO: 5925

SEQ ID NO: 8934 - protein, 348 aa, Streptococcus agalactiae
LLGIAHNVLGFTSVFHLLFSAIFITNYVTRNGDLMGRFKELLESKKTLILHGALGTELESRGCDVSGKLWSAKYLIEDPAAIQTIHEDYIRAGADIVTTSTYQATLQGLAQVGVSESQTEDLIRLTVQLAKAAREQVWKSLTKEEKSERIYPLISGDVGPYAAFLADGSEYTGLYDIDKQGLKNFHRHRIELLLDEGVDILALETIPNAQEAEALIELLAEDFPQVEAYMSFTSQDGKTISDGSAVADLAKAIDVSPQVVALGINCSSPSLVADFLQAIAEQTNKPLVTYPNSGEVYDGASQSWQSSPDHSHTLLENTSDWQKLGAQVVGGCCRTRPADIADLSAHLK

SEQ ID NO: 8935 - DNA, 2937 bp, Streptococcus agalactiae
atgtttcgtaaatataattttgaaaaaggtttaaagttttccattcgtaaattttcggttggagtagcttcagttgctataggatcattattattcatttctcctcaggtacttgcagatgagacaactagtgttacatctgcaacaactccaacaggtgtaacggccacagatgcaaacttggtcacttctaacaattcaactcctacttccactaataggagtgcaactagcactcaaggaagtaatttgagtaatacttcagaaatcattaagcctgcaactttagcagcaacatcaccaacaactgataatgtagccccatcagtagacaagaggacgtatgctactagtggcgattggacgttacaaaatccatatgctgacagtgttcgaaataaaaatatttctccaagtgttcgtgatgaatcatttaaaagtgctgaaacaacggtggttcgtgacgataactcaaccgtcaaagtgactgcgacaattactcctgtaccagggaatgatgaaggttctggtgttttaacaaatggtggtaatcagtcagaatataaagcaacatcagaaatgtttgttggaaatgtagatcctgcaaaaatacctgctttaggtgtctatacacaaccaggacgtactgaaggaggtagtaaactatctgataagctcaattttaatgggaaggcgccatcaactattttaacattgaaatttgacaaggcagttacagaccctattattgacttatctggtgttggaggtaatgcacatctatcatttacagaaactaccaatgaaaatggtaggattgttgaaaaaattgactatgcacgtggttcatataattcaacgttctttgagttaataactccaggtataagccttgaaaaagcaagttcaggagttaatttaacagttacagcgaatacggttgatgtaacagacaaaaacacctttaatgagtcagttgttaatccatctgacgcagactttgtcaatggtctagatagaacgcctgatgcagtcccagcgggaacaggttcaattcgtttaaaaggaacctttacagaggtttcatttaaattatatcatcaagctgttccatttacagcattttctaaagagaaatatcatacaggagatggatattataatagtactgcgaatattcgaccaactgtagttaaaccagatagtattaatggtttaaataagcacgcaagcgatgttattgatgataaaatttccgataataatgatatttcgaacgatgacttacttcgtttatctgttcgcttacaaaatccgcgtggatcagttgttgtaaattatattgatacagaaggcaatattattggtactgaatacaaagataccaccgatgcaattctaggaacacattacaatacggcagaatcatcaggagaccttagttcagacgcgacagttgagcgtcctttcactattactaaagatggtaaggtgtatgaattagtagcagaaaatattacagtaccagttggtaaggttaattcggatggtacgttggctacaaatggaggctcatttaattatggtactgatgcagcatctggagaagttgcagaaggtactaagtcagtaacttatgtttatagcattaaacaagaatcaaagggcaatgttcatgcccgctatgttattttagggacagagactgagcttgcaagtgttaaaacagttaaatcagaagctccaattgatgaagcatattcagatagagcacctgcaactcttgaaaaagatggtaagttgtatgaatttgtacatgtgcgtgataataagggcgatgctccagcagatggtaaggtgactgaacaagatcagaccattacatatgaatatgttgaagttcctaagggtcgtgtggttgtagattatgttatcgagggtactgctacaaaacttaaagatacctatgtcgataccccaacagcttatattcgtgataaagaaggccaagctactccttataatacagctgagaatgattctgagaaaccattgttacttgacaaagatggaataaaatatgaactagtttcaattcaagagggatcagcagcggagaaaggaacacttcgagaaggggaacaacatgttgtctatcaatatcgtaaagtggtagaggttccaagcgttaaagttggaaatgttcatgcccgctatgttattttagggacagagactgagcttgcaagtgttaaaacagttaaatcagaagctccaattgatgaagcatattcagatagagcacctgcaactcttgaaaaagatggtaagttgtatgaatttgtacatgtgcgtgataataagggcgatgctccagcagatggtaaggtgactgaacaagatcagaccattacatatgaatataagcttaagaaagatgaatcagaggctgtagggaatgtagtgattaactatgtggacgaaacaggtaatgttatcaaaaaaccaatactagatacacacgaatcaaaggttgggacaccatatgataccacagattataaattcgctgaaattaaatttaatggtaagatttataaactcgtttctgcaaaaactatgggaaatgaattcggaaaggtcactgaaggcacaacagaagtgacttatgtgtatcgagaatcagtaaaatctaccctaccaaaggaaatgggaatttctattccaagcgaatcagagtctcctaagtttatatctacccaaactacagaaaatagacctaacaaaggagtattaacttcatctaaaaaaccaaccaataaatctgttcttccaactacaggcgaggaaagtaatagaactctcggagttgttgggattactctagtagcaacaacagctactttggcagctagcagtttaaaacgacgtaaaaat

SEQ ID NO: 8936 - protein, 979 aa, Streptococcus agalactiae
MFRKYNFEKGLKFSIRKFSVGVASVAIGSLLFISPQVLADETTSVTSATTPTGVTATDANLVTSNNSTPTSTNRSATSTQGSNLSNTSEIIKPATLAATSPTTDNVAPSVDKRTYATSGDWTLQNPYADSVRNKNISPSVRDESFKSAETTVVRDDNSTVKVTATITPVPGNDEGSGVLTNGGNQSEYKATSEMFVGNVDPAKIPALGVYTQPGRTEGGSKLSDKLNFNGKAPSTILTLKFDKAVTDPIIDLSGVGGNAHLSFTETTNENGRIVEKIDYARGSYNSTFFELITPGISLEKASSGVNLTVTANTVDVTDKNTFNESVVNPSDADFVNGLDRTPDAVPAGTGSIRLKGTFTEVSFKLYHQAVPFTAFSKEKYHTGDGYYNSTANIRPTVVKPDSINGLNKHASDVIDDKISDNNDISNDDLLRLSVRLQNPRGSVVVNYIDTEGNIIGTEYKDTTDAILGTHYNTAESSGDLSSDATVERPFTITKDGKVYELVAENITVPVGKVNSDGTLATNGGSFNYGTDAASGEVAEGTKSVTYVYSIKQESKGNVHARYVILGTETELASVKTVKSEAPIDEAYSDRAPATLEKDGKLYEFVHVRDNKGDAPADGKVTEQDQTITYEYVEVPKGRVVVDYVIEGTATKLKDTYVDTPTAYIRDKEGQATPYNTAENDSEKPLLLDKDGIKYELVSIQEGSAAEKGTLREGEQHVVYQYRKVVEVPSVKVGNVHARYVILGTETELASVKTVKSEAPIDEAYSDRAPATLEKDGKLYEFVHVRDNKGDAPADGKVTEQDQTITYEYKLKKDESEAVGNVVINYVDETGNVIKKPILDTHESKVGTPYDTTDYKFAEIKFNGKIYKLVSAKTMGNEFGKVTEGTTEVTYVYRESVKSTLPKEMGISIPSESESPKFISTQTTENRPNKGVLTSSKKPTNKSVLPTTGEESNRTLGVVGITLVATTATLAASSLKRRKN

SEQ ID NO: 8937 - DNA, 1629 bp, Streptococcus agalactiae
atgaaaaaaggacaagtaaatgatactaagcaatcttactctctacgtaaatataaatttggtttagcatcagtaattttagggtcattcataatggtcacaagtcctgtttttgcggatcaaactacatcggttcaagttaataatcagacaggcactagtgtggatgctaataattcttccaatgagacaagtgcgtcaagtgtgattacttccaataatgatagtgttcaagcgtctgataaagttgtaaatagtcaaaatacggcaacaaaggacattactactcctttagtagagacaaagccaatggtggaaaaaacattacctgaacaagggaattatgtttatagcaaagaaaccgaggtgaaaaatacaccttcaaaatcagccccagtagctttctatgcaaagaaaggtgataaagttttctatgaccaagtatttaataaagataatgtgaaatggatttcatataagtctttttgtggcgtacgtcgatacgcagctattgagtcactagatccatcaggaggttcagagactaaagcacctactcctgtaacaaattcaggaagcaataatcaagagaaaatagcaacgcaaggaaattatacattttcacataaagtagaagtaaaaaatgaagctaaggtagcgagtccaactcaatttacattggacaaaggagacagaattttttacgaccaaatactaactattgaaggaaatcagtggttatcttataaatcattcaatggtgttcgtcgttttgttttgctaggtaaagcatcttcagtagaaaaaactgaagataaagaaaaagtgtctcctcaaccacaagcccgtattactaaaactggtagactgactatttctaacgaaacaactacaggttttgatattttaattacgaatattaaagatgataacggtatcgctgctgttaaggtaccggtttggactgaacaaggagggcaagatgatattaaatggtatacagctgtaactactggggatggcaactacaaagtagctgtatcatttgctgaccataagaatgagaagggtctttataatattcatttatactaccaagaagctagtgggacacttgtaggtgtaacaggaactaaagtgacagtagctggaactaattcttctcaagaacctattgaaaatggtttagcaaagactggtgtttataatattatcggaagtactgaagtaaaaaatgaagctaaaatatcaagtcagacccaatttactttagaaaaaggtgacaaaataaattatgatcaagtattgacagcagatggttaccagtggatttcttacaaatcttatagtggtgttcgtcgctatattcctgtgaaaaagctaactacaagtagtgaaaaagcgaaagatgaggcgactaaaccgactagttatcccaacttacctaaaacaggtacctatacatttactaaaactgtagatgtgaaaagtcaacctaaagtatcaagtccagtggaatttaattttcaaaagggtgaaaaaatacattatgatcaagtgttagtagtagatggtcatcagtggatttcatacaagagttattccggtattcgtcgctatattgaaatt

SEQ ID NO: 8938 - protein, 543 aa, Streptococcus agalactiae
MKKGQVNDTKQSYSLRKYKFGLASVILGSFIMVTSPVFADQTTSVQVNNQTGTSVDANNSSNETSASSVITSNNDSVQASDKVVNSQNTATKDITTPLVETKPMVEKTLPEQGNYVYSKETEVKNTPSKSAPVAFYAKKGDKVFYDQVFNKDNVKWISYKSFCGVRRYAAIESLDPSGGSETKAPTPVTNSGSNNQEKIATQGNYTFSHKVEVKNEAKVASPTQFTLDKGDRIFYDQILTIEGNQWLSYKSFNGVRRFVLLGKASSVEKTEDKEKVSPQPQARITKTGRLTISNETTTGFDILITNIKDDNGIAAVKVPVWTEQGGQDDIKWYTAVTTGDGNYKVAVSFADHKNEKGLYNIHLYYQEASGTLVGVTGTKVTVAGTNSSQEPIENGLAKTGVYNIIGSTEVKNEAKISSQTQFTLEKGDKINYDQVLTADGYQWISYKSYSGVRRYIPVKKLTTSSEKAKDEATKPTSYPNLPKTGTYTFTKTVDVKSQPKVSSPVEFNFQKGEKIHYDQVLVVDGHQWISYKSYSGIRRYIEI

SEQ ID NO: 8939 - DNA, 1068 bp, Streptococcus agalactiae
atgacaaatacggtaacaccaaaagagacggctggttcttttatcaataaagtgttaggtgggacagcaactgcaatcgttgtagcactcatcccaaatgctatcctagccacttttttgaaaccatttttatcttacggacttgctgcagagttcttacacatcgtgcaggtattccaatttttcacaccaattatggcaggatttttgattggtcaacagtttaaattcaccccaatgcaacagcttgctgttggaggtgctgcatatattggttctggtgcgtgggcttacacagaagttattcaaaaaggagttgctactggtagtttccaattgcgtgggattggtgatctcatcaatatgatgctaacagcagctttagcagttttagcagttaagtggtttggtaataaatttggktccctamccattatcttgttacctattatcataggtacaggcgtaggctatttaggatggaaattactcccttacgtttcatatgtgacaacacttattggtcaaggaattaattcttttactactttacaaccaattgcgatgtcaattctaattgcgatggctttttcaatgcttattgtaagtcctatttcaacagtagcgattggtctagcgattggtcttaatggtatgtcagcaagtgcagcttcaatgggagttgcttcaacaacagcagtgctagtttgggcaacgatgaaggctaataagtctggagttccaattgctattgctttaggtgcaatgaagatgatgatgccaaatttcctaaagcatccagtaatggcgattccaatgcttatgactgctacagtaagttctctaacagtcccattgtttaaattggtggggacaccagcttcgtctggttttgggcttgttggtgcagtaggtccgattgcttcatttgaagcaggagcaagtatgttgattgttatcttatcttggctcgttattccttttgcagtaggttttgtatcacacaaaatttgtaaagacattctgaaactttataaagacgatattttcgtttttgaaggtcaaaat

SEQ ID NO: 8940 - protein, 356 aa, Streptococcus agalactiae
  MISC_FEATURE (1)..(356): Xaa = Any Amino Acid
MTNTVTPKETAGSFINKVLGGTATAIVVALIPNAILATFLKPFLSYGLAAEFLHIVQVFQFFTPIMAGFLIGQQFKFTPMQQLAVGGAAYIGSGAWAYTEVIQKGVATGSFQLRGIGDLINMMLTAALAVLAVKWFGNKFGSLXIILLPIIIGTGVGYLGWKLLPYVSYVTTLIGQGINSFTTLQPIAMSILIAMAFSMLIVSPISTVAIGLAIGLNGMSASAASMGVASTTAVLVWATMKANKSGVPIAIALGAMKMMMPNFLKHPVMAIPMLMTATVSSLTVPLFKLVGTPASSGFGLVGAVGPIASFEAGASMLIVILSWLVIPFAVGFVSHKICKDILKLYKDDIFVFEGQN

SEQ ID NO: 8941 - DNA, 3402 bp, Streptococcus agalactiae
ttgcgtaaaaaacaaaaactaccatttgataaacttgccattgcgcttatatctacgagcatcttgctcaatgcacaatcagacattaaagcaaatactgtgacagaagacactcctgctaccgaacaagccgtagaacccccacaaccaatagcagtttctgaggaatcacgatcatcaaaggaaactaaaacctcacaaactcctagtgatgtaggagaaacagtagcagatgacgctaatgatctagcccctcaagctcctgctaaaactgctgatacaccagcaacctcaaaagcgactattagggatttgaacgacccttctcatgtcaaaaccctgcaggaaaaagcaggcaagggagctgggaccgttgttgcagtgattgatgctggttttgataaaaatcatgaagcgtggcgcttaacagacaaaactaaagcacgttaccaatcaaaagaaaatcttgaaaaagctaaaaaagagcacggtattacctatggcgagtgggtcaatgataaggttgcttattaccacgactatagtaaagatggtaaaaacgctgttgatcaagaacacggcacacacgtgtcagggatcttgtcaggaaatgctccatctgaaatgaaagaaccttaccgcctagaaggtgcgatgcctgaggctcaattgcttttgatgcgtgtcgaaattgtaaatggactagcagactatgctcgtaactacgctcaagctatcagagatgctgtcaacttgggagctaaggtgattaatatgagctttggtaatgctgcactagcttacgccaaccttccagacgaaaccaaaaaagcctttgactatgccaaatcaaaaggtgttagcattgtgacctcagctggtaatgatagtagctttgggggcaagccccgtctacctctagcagatcatcctgattatggggtggttgggacacctgcagcggcagattcaacattgacagttgcttcttacagcccagataaacagctcactgaaactgctacggtcaaaacagacgatcatcaagataaagaaatgcctgttatttcaacaaaccgttttgagccaaacaaggcttacgactatgcttatgctaatcgtggtacgaaagaggatgattttaaggatgtcgaaggtaagattgcccttattgaacgtggcgatattgatttcaaagataagattgcaaacgctaaaaaagctggtgctgtaggggtcttgatctatgacaatcaagacaagggcttcccgattgaattgccaaatgttgaccagatgcctgcggcctttatcagtcgaagagacggtctcttattaaaagacaatcccccaaaaaccattaccttcaatgcgacacctaaggtattgccaacagcaagtggcaccaaactaagccgcttctcaagctggggtctgacagctgacggcaatattaaaccggatattgcagcacccggccaagatattttgtcatcagtggctaacaacaagtatgccaaactttctggaactagtatgtctgcaccattggtagcgggtatcatgggactgttgcaaaagcaatatgagacacagtatcctgatatgacaccatcagagcgtcttgatttagctaagaaagtattgatgagctcagcaactgccctatatgatgaagatgaaaaagcttatttttctcctcgccaacagggagcaggagcagtcgatgctaaaaaagcttcagcagcaacgatgtatgtaacagataaggacaatacctcaagcaaggttcacctgaacaatgtttctgataaatttgaagtaacagtaacagttcacaacaaatctgataaacctcaagagttgtattaccaagtaactgttcaaacagataaagtagatggaaaacactttgccttggctcctaaagcattgtatgagacatcatggcaaaaaatcacaattccagccaatagcagcaaacaagtcaccgttccaatcgatgctagtcgatttagcaaggacttgcttgcccaaatgaaaaatggctatttcttagaaggttttgttcgtttcaaacaagatcctacaaaagaagagcttatgagcattccatatattggtttccgaggtgattttggcaatctgtcagccttagaaaaaccaatctatgatagcaaagacggtagcagctactatcatgaagcaaatagtgatgccaaagaccaattagatggtgatggattacagttttacgctctgaaaaataactttacagcacttaccacagagtctaacccatggacgattattaaagctgtcaaagaaggggttgaaaacatagaggatatcgaatcttcagagatcacagaaaccatttttgcaggtacttttgcaaaacaagacgatgatagccactactatatccaccgtcacgctaatggcaaaccatatgctgcgatctctccaaatggggacggtaacagagattatgtccaattccaaggtactttcttgcgtaatgctaaaaaccttgtggctgaagtcttggacaaagaaggaaatgttgtttggacaagtgaggtaaccgagcaagttgttaaaaactacaacaatgacttggcaagcacacttggttcaacccgttttgaaaaaacgcgttgggacggtaaagataaagacggcaaagttgttgctaacggaacctacacctatcgtgttcgctacacgccgattagctcaggtgcaaaagaacaacacactgattttgatgtgattgtagacaatacgacacctgaagtcgcaacatcggcaacattctcaacagaagatagtcgtttgacacttgcatctaaaccaaaaaccagccaaccggtttaccgtgagcgtattgcttacacttatatggatgaggatctgccaacaacagagtatatttctccaaatgaagatggtacctttactcttcctgaagaggctgaaacaatggaaggcgctactgttccattgaaaatgtcagactttacttatgttgttgaagatatggctggtaacatcacttatacaccagtgactaagctattggagggccactctaataagccagaacaagacggttcagatcaagcaccagacaagaaaccagaagctaaaccagaacaagacggttcaggtcaaacaccagataaaaaaaaagaaactaaaccagaaaaagatagttcaggtcaaacaccaggtaaaactcctcaaaaaggtcaatcttctcgtactctagagaaacgatcttctaagcgtgctttagctacaaaagcatcaacaagagatcagttaccaacgactaatgacaaggatacaaatcgtttacatctccttaagttagttatgaccactttcttcttggga

SEQ ID NO: 8942 - protein, 1134 aa, Streptococcus agalactiae
MRKKQKLPFDKLAIALISTSILLNAQSDIKANTVTEDTPATEQAVEPPQPIAVSEESRSSKETKTSQTPSDVGETVADDANDLAPQAPAKTADTPATSKATIRDLNDPSHVKTLQEKAGKGAGTVVAVIDAGFDKNHEAWRLTDKTKARYQSKENLEKAKKEHGITYGEWVNDKVAYYHDYSKDGKNAVDQEHGTHVSGILSGNAPSEMKEPYRLEGAMPEAQLLLMRVEIVNGLADYARNYAQAIRDAVNLGAKVINMSFGNAALAYANLPDETKKAFDYAKSKGVSIVTSAGNDSSFGGKPRLPLADHPDYGVVGTPAAADSTLTVASYSPDKQLTETATVKTDDHQDKEMPVISTNRFEPNKAYDYAYANRGTKEDDFKDVEGKIALIERGDIDFKDKIANAKKAGAVGVLIYDNQDKGFPIELPNVDQMPAAFISRRDGLLLKDNPPKTITFNATPKVLPTASGTKLSRFSSWGLTADGNIKPDIAAPGQDILSSVANNKYAKLSGTSMSAPLVAGIMGLLQKQYETQYPDMTPSERLDLAKKVLMSSATALYDEDEKAYFSPRQQGAGAVDAKKASAATMYVTDKDNTSSKVHLNNVSDKFEVTVTVHNKSDKPQELYYQVTVQTDKVDGKHFALAPKALYETSWQKITIPANSSKQVTVPIDASRFSKDLLAQMKNGYFLEGFVRFKQDPTKEELMSIPYIGFRGDFGNLSALEKPIYDSKDGSSYYHEANSDAKDQLDGDGLQFYALKNNFTALTTESNPWTIIKAVKEGVENIEDIESSEITETIFAGTFAKQDDDSHYYIHRHANGKPYAAISPNGDGNRDYVQFQGTFLRNAKNLVAEVLDKEGNVVWTSEVTEQVVKNYNNDLASTLGSTRFEKTRWDGKDKDGKVVANGTYTYRVRYTPISSGAKEQHTDFDVIVDNTTPEVATSATFSTEDSRLTLASKPKTSQPVYRERIAYTYMDEDLPTTEYISPNEDGTFTLPEEAETMEGATVPLKMSDFTYVVEDMAGNITYTPVTKLLEGHSNKPEQDGSDQAPDKKPEAKPEQDGSGQTPDKKKETKPEKDSSGQTPGKTPQKGQSSRTLEKRSSKRALATKASTRDQLPTTNDKDTNRLHLLKLVMTTFFLG

SEQ ID NO: 8943 - DNA, 480 bp, Streptococcus agalactiae; identical to SEQ ID NO: 6127

SEQ ID NO: 8944 - protein, 160 aa, Streptococcus agalactiae
LERIPVQFKGCDDYYNENVGYPLSRINLEHYLTEGGVLYFVVYSKDVSPTVTYASLTPKVIKNVLPASDKKKRIKKKEDIFLLFWMAIIAKLLILPYPALQTSYKSRPCLRRSSLRKLTQIPFSIVTKVGNTNMKSITAFLQVKAYILPCLAKGPARIMV

SEQ ID NO: 8945 - DNA, 597 bp, Streptococcus agalactiae; identical to SEQ ID NO: 6135

SEQ ID NO: 8946 - protein, 199 aa, Streptococcus agalactiae
LMLNQYFLHFEESKIVTPLYAFDIDYLNIPKYVGLSKEQILENYRILLTYLNIPWFLALDMPDFPSSASGLFHFFEVKKLFMLDYLILIFSGMGTLWFVRHLNRRRESWRLLPYFRQGTLIPLAILLALLVSFDTLFVLFHKVFFNNDAWLFNATTDPIILALPAEFFMHSFLLAFGLIEVFLILGYFTTKYRISAPSR

SEQ ID NO: 8947 - DNA, 2004 bp, Streptococcus agalactiae
atggaacatagtcagatggatcacagcaatatggatcacagtgaaatggatcatggcgcaatgggagggcatgcccaccaccatcacggtagctttaaggagattttcttgaagtcactcccattaggaattgcaatcttactcattacgcctatgatggatattcagttgcctttccaaattatctttccttatgcagacgttgtagcagctgtattggcaacaattctatacatttttggcggaaaaccattctacatgggtgcgaaagatgagtttaattcaaaagctccaggcatgatgtccttgattactttgggaataacggtttcttatgcctatagtgtttacgcagtggccgctcgttatgtgaccggagagcatgtcatggacttcttctttgagtttacaaccttaattttaatcatgttattaggacactggattgaaatgaaggcattgggtgaagcaggggacgcgcaaaaagcattggctgagttggtgccgaaagatgctcatgttgttttagaagacgattcgattgagactcgccctgtgtctgaacttcagattggagatgttatccgtgttcaagcaggagaaaatgttccagctgatggtatcattatccgcggagaatctcgtgtaaacgaagcgcttgtgactggggaatcgaaaccaattgaaaaaaaaaccggagatgaggtcatcggtggatcaaccaatggtggcggagtcctctatgtggaaataaagcagacgggcgatcagtccttcatttctcaggttcagacattaatcagccaagcgcaaagccaaccttctcgagcagagaatgtggctcaaaaagtagctagctggttgttctacattgcggttgtagtagctttaatcgccctactaatctggacgatcattgcggatctgcctacagccgttatctttactgtgactgcgttagttattgcctgcccacatgctttgggtcttgctattcccttggtagtatcacgtagtactagtttgggtgcaagccgaggattactggttaaaaatagagaagctttggaattaactactaaagcggatgttatggtattggataaaacaggtactttaacaactggtgaatttaaagtgttggacgtcactgttttgagtgataaatattctgaagaagaaattacaggcttgttggcgggtatagaggcgggctccagtcacccgattgcccaatcgattgtgaaccacgctgaagcgaaaggcattaagtcagtttcctttgactccattgaaatcgtttcgggagcaggaatagaaggggaggcgaacggccaccactatcaattaatcagccaaaaggcatacggaaaagcattgcgtatggatattccgaaaggcgctactttaagtatccttgtagaaaataatgaagcaatcggcgctgtcgcattgggagatgaactgaaagaaaccagcagaaacttgatcgaggtgctgaaaaaatacggaattgaaccactcatggctactggtgataacgaggaagctgcacaaggagttgcagaagttctaggtattcaataccaagccaatcaatctccggaagataagtacaagctggtcgagtccatgaaaaaccaaaacaagacggttatcatggtaggagacggggtcaatgacgcaccttcccttgccttggcagacgtaggtattgcaatcggagctggaacgcaagtagctttggattctgcggatattatccttactcagtctgatccaggggatattgaatcctttatcgagttagcaaacaagacgacacgtaaaatgaaacaaaacttggtatggggagcaggctacaattttatcgcgattccaattgctgctggcctccttgctcctatcggcattaccttgggtccggccttcggcgccgtcctcatgtccttatcgaccgttattgttgccatcaatgctatgacattgaaattagagccgaaa

SEQ ID NO: 8948 - protein, 668 aa, Streptococcus agalactiae
MEHSQMDHSNMDHSEMDHGAMGGHAHHHHGSFKEIFLKSLPLGIAILLITPMMDIQLPFQIIFPYADVVAAVLATILYIFGGKPFYMGAKDEFNSKAPGMMSLITLGITVSYAYSVYAVAARYVTGEHVMDFFFEFTTLILIMLLGHWIEMKALGEAGDAQKALAELVPKDAHVVLEDDSIETRPVSELQIGDVIRVQAGENVPADGIIIRGESRVNEALVTGESKPIEKKTGDEVIGGSTNGGGVLYVEIKQTGDQSFISQVQTLISQAQSQPSRAENVAQKVASWLFYIAVVVALIALLIWTIIADLPTAVIFTVTALVIACPHALGLAIPLVVSRSTSLGASRGLLVKNREALELTTKADVMVLDKTGTLTTGEFKVLDVTVLSDKYSEEEITGLLAGIEAGSSHPIAQSIVNHAEAKGIKSVSFDSIEIVSGAGIEGEANGHHYQLISQKAYGKALRMDIPKGATLSILVENNEAIGAVALGDELKETSRNLIEVLKKYGIEPLMATGDNEEAAQGVAEVLGIQYQANQSPEDKYKLVESMKNQNKTVIMVGDGVNDAPSLALADVGIAIGAGTQVALDSADIILTQSDPGDIESFIELANKTTRKMKQNLVWGAGYNFIAIPIAAGLLAPIGITLGPAFGAVLMSLSTVIVAINAMTLKLEPK

SEQ ID NO: 8949 - DNA, 417 bp, Streptococcus agalactiae
atgaaaaagaaaaacaaatcctctaacattgctataattgcaatcttttttgctattatgcttgtcattcattttttgtcatcatttatttttagtttttggttagtccctattaaacctactttgatgcatatcccagttattattgcatctatagcctatggacctcgtattggtgcaactctaggcgccttaatgggggggatcagcgtagctaacagcagcattgttctattaccaacgagttacctcttctcaccttttgttgaaaatggtaatttttattcgctaattattgcacttgtaccacgtattctaatcgggattattccttatttcgtttacaaattactacacaaccgctttggtttggctatctcaggtgctataggctctctaacaaacacagtatttgtt

SEQ ID NO: 8950 - protein, 139 aa, Streptococcus agalactiae
MKKKNKSSNIAIIAIFFAIMLVIHFLSSFIFSFWLVPIKPTLMHIPVIIASIAYGPRIGATLGALMGGISVANSSIVLLPTSYLFSPFVENGNFYSLIIALVPRILIGIIPYFVYKLLHNRFGLAISGAIGSLTNTVFV

SEQ ID NO: 8951 - DNA, 918 bp, Streptococcus agalactiae; identical to SEQ ID NO: 6169

SEQ ID NO: 8952 - protein, 306 aa, Streptococcus agalactiae
LRETYWKISSDCDKINLAEFSRERMSDLLEWQDLAQLPVSIFKDYVTDAQDAEKPFIWTEVFLREINRSNQEIILHIWPMTKTVILGMLDRELPHLELAKKEIISRGYEPVVRNFGGLAVVADEGILNFSLVIPDVFERKLSISDGYLIMVDFIRSIFSDFYQPIEHFEVETSYCPGKFDLSINGKKFAGLAQRRIKNGIAVSIYLSVCGDQKGRSQMISDFYKIGLGDTGSPIAYPNVDPEIMANLSDLLDCPMTVEDVIDRMLISLKQVGFNDRLLMIRPDLVAEFNRFQAKSMANKGMVSRDE

SEQ ID NO: 8953 - DNA, 1593 bp, Streptococcus agalactiae; identical to SEQ ID NO: 6201

SEQ ID NO: 8954 - protein, 531 aa, Streptococcus agalactiae
LIWRGEKLISNKVKIVRLLNKSKKSLLRGIFSRTTVIAILLILQLLFLLASYSWLEQYRVWLATVEHILTIGAVLYLVNSEMDALSRVTWLILVMIAPLLGAMFLMYTKFDWGYRGLKQRLETLIDESQIYLEDDPETLNQLKSSTSTTYHLVQYFEKAHGNFPVYRNTDVTFLPTGEAFFEKMKEELLKAKKYIFLEFFIIDEGIMWGEILSILEQKVEEGVEVRILYDGMIEITKLSFDYTKRLEKIGIKAKAFSPISPFISTYYNYRDHRKIVVIDGVVGMTGGVNLADEYINHIELFGHWKDSGIMLKGKAVDSFLLLFLQMWSITEEKMLVAPYLGVHDDLVENEGYVIPYGDSPLDTDKVGENVYIDILNHAREYVYIMTPYLILDSELEHAIQFAAERGVDVRIIMPGIPDKPIPYALAKTYYQALTKSGVKIYEYTLGFVHSKIFLSDNTKAVVGTINLDYRSLYHHFECAVYLYKVDAIQDIYRDYMDTLNKSRLVSLKDINNIPKFQKVIGIVTKTIAPLL

SEQ ID NO: 8955 - DNA, 1212 bp, Streptococcus agalactiae; identical to SEQ ID NO: 6243

SEQ ID NO: 8956 - protein, 404 aa, Streptococcus agalactiae
LEVIMQFIYSIIGILLVLGIVYAISFNRKSVSLSLIGKALIVQFIIALILVRIPLGQQVVSVVSTGVTKVINCGQAGLNFVFGSLADSGAKTGFIFAIQTLGNIVFLSALVSLLYYVGILGFVVKWIGKGVGKIMKSSEVESFVAVANMFLGQTDSPILVSKYLGRMTDSEIMVVLVSGMGSMSVSILGGYIALGIPMEYLLIASTMVPIGSILIAKILLPQTEPVQKIDDIKMDNKGNNANVIDAIAEGASTGAQMAFSIGASLIAFVGLVSLINMMLSGLGIRLEQIFSYVFAPFGFLMGFDHKNILLEGNLLGSKLILNEFVSFQQLGDLIKSLDYRTALVATISLCGFANLSSLGICVSGIAVLCPEKRGTLARLVFRAMIGGIAVSMLSAFIVGIVTLF

SEQ ID NO: 8957 - DNA, 1893 bp, Streptococcus agalactiae
atgaataataacgaaaaaaaagtaaaatactttttaagaaaaacagcttatggtttggcctcaatgtcagcagcgtttgctgtatgtagtggtattgtacacgcggatactagttcaggaatatcggcttcaattcctcataagaaacaagttaatttaggggcggttactctgaagaatttgatttctaaatatcgtggtaatgacaaagctattgctatacttttaagtagagtaaatgattttaatagagcatcacaggatacacttccacaattaattaatagtactgaagcagaaattagaaatattttatatcaaggacaaattggtaagcaaaataaaccaagtgtaactacacatgctaaagttagtgatcaagaactaggtaagcagtcaagacgttctcaagatatcattaagtcattaggtttcctttcatcagaccaaaaagatattttagttaaatctattagctcttcaaaagattcgcaacttattcttaaatttgtaactcaagccacgcaactgaataatgctgaatcaacaaaagctaagcaaatggctcaaaatgacgtggccttaataaaaaatataagccccgaagtcttagaagaatataaagaaaaaattcaaagagctagcactaagagtcaagttgatgagtttgtagcagaagctaaaaaagttgttaattccaataaagaaacgttggtaaatcaggccaatggtaaaaagcaagaaattgctaagttagaaaatttatctaacgatgaaatgttgagatataatactgcaattgataatgtagtgaaacagtataatgaaggtaagctcaatattactgctgcaatgaatgctttaaatagtattaagcaagcagcacaggaagttgcccagaaaaacttacaaaagcagtatgctaaaaaaattgaaagaataagttcaaaaggattagcgttatctaaaaaggctaaagaaatttatgaaaagcataaaagtattttgcctacacctggatattatgcagactctgtgggaacttatttgaataggtttagagataaacaaactttcggaaataggagtgtttggactggtcaaagtggacttgatgaagcaaaaaaaatgcttgatgaagtcaaaaagcttttaaaagaacttcaagaccttaccagaggtactaaagaagataaaaaaccagacgttaagccagaagccaaaccagaggccaaaccagacgttaagccagaggccaaaccagacgttaagccagaagctaagccagacgttaaaccagaagctaagccagacgttaaaccagaagctaagccagacgttaaaccagaagctaagccagacgttaaaccaaaggccaaaccagacgttaagccagaagctaagccagacgttaaaccagacgttaaaccagacgttaagccagaggccaaaccagaggataagccagacgttaaaccagacgttaagccagaagctaaaccagacgttaagccagaggccaaaccagaagctaagccagaagctaagccagaagctaagccagaggccaaaccagaagctaagccagacgttaagccagaagctaaaccagacgttaaaccagaggctaagccagaagctaaaccagaggctaagtcagaagctaaaccagaggctaagctagaagctaaaccagaggccaaaccagcaaccaaaaaatcggttaatactagcggaaacttggcggctaaaaaagctattgaaaacaaaaagtatagtaaaaaattaccatcaacgggtgaagccgcaagtccactcttagcaattgtatcactaattgttatgttaagtgcaggtcttattacgatagttttaaagcataaaaaaaattaa

SEQ ID NO: 8958 - protein, 630 aa, Streptococcus agalactiae; identical to SEQ ID NO: 6266

SEQ ID NO: 8959 - DNA, 849 bp, Streptococcus agalactiae; identical to SEQ ID NO: 6279

SEQ ID NO: 8960 - protein, 283 aa, Streptococcus agalactiae
LPMLSVGLVLEGGGMRGLYTAGVLDAFLDAGIKIDGIVSVSAGALFGVNFVSRQRERALRYNKKYLSHPKYMSLRSWFRTGNFVNKDFTYYEVPMKLDVFDDEAFKKSSIDFYVVATEMTSGKPEYFKIDSVFEQMEILRASSALPVVSKMVDWQGKKYLDGGLSDSIPVDFARGLGFDKLIVVMTRPLNYQKKPSSGRLYKTLYRKYPNFVKTASNRYQQYNNSLEKVMSLEKTGDLFAIRPSKSLVIGRLEKNPDKLDSIYQLGMKDAKSVMPELNSYLMK

SEQ ID NO: 8961 - DNA, 606 bp, Streptococcus agalactiae
atgttacattctaaaaaaatacattccttatcgcttattgccgttctctctttagcaacatatacgagtttacaaccaaatcatgtaacggctgaacaatcacaaaaaacatcaactgttcatatgagtcaaaaaactattgaacataagttaaaagttgcagataaagaagctgctcctctctacgctaaaatcgaccatatccaacgacatattgaagtcaaaaaagcaaaagatttaaaagttattgaattgtatattaacaaagatatcaaccaactagagaagcaaaataaacgtctactaactaaattctatacttctattgataatcaaacatgggatagcacaagtgaagtcaaaaaattgattgataagacaaacctatccactaacgaaaaagatagattaaaattatattttgaacaacgtgcttaccttgagacaaggttgaacgaccgctatcaaaaatttgataactctattgaaaaccaaaataaagaactaaaaatattaacgtcaaaaatagaaaaaatctatcaaaaacatggtattacaaaagaggtattaaaaacttactatgctaaaaaaacagtacgagctgac

SEQ ID NO: 8962 - protein, 202 aa, Streptococcus agalactiae
MLHSKKIHSLSLIAVLSLATYTSLQPNHVTAEQSQKTSTVHMSQKTIEHKLKVADKEAAPLYAKIDHIQRHIEVKKAKDLKVIELYINKDINQLEKQNKRLLTKFYTSIDNQTWDSTSEVKKLIDKTNLSTNEKDRLKLYFEQRAYLETRLNDRYQKFDNSIENQNKELKILTSKIEKIYQKHGITKEVLKTYYAKKTVRAD

SEQ ID NO: 8963 - DNA, 4734 bp, Streptococcus agalactiae
atgttacaagaaaaggagatttttatgaacacaaaacagcgtttttcaatccggaaatataagttaggtgccgtatctgtacttttgggaaccctattttttttaggtggtatcacaaatgtagctgctgattctgtcataaataagccatctgatattgcagttgaacagcaagtaaaagacagtccaacgagcatagcaaatgagacacctactaacaacacgtcatcagcccttgcgtcgacagctcaagacaatcttgttacaaaggctaataatagtccaacagaaacacaaccagtagctgagtctcactctcaagccaccgagacattttccccagtcgcaaatcaaccggttgaaagcactcaagaagtttctaaaactcctttaaccaaacaaaatttagcagtcaaatctacaccagctatttctaaagaaacccctcaaaacattgatagtaataaaattatcactgtccccaaagtatggaacacaggctacaaaggagagggaactgttgtagcaattattgactcaggactagatatcaatcacgatgctctccaattaaatgattcgacaaaagcaaaataccaaaacgaacagcaaatgaatgctgctaaagcaaaagctggtataaactatggaaaatggtataacaacaaagtaatctttggtcacaactatgttgatgtcaatacagagctaaaagaggtgaaaagcacttctcatggtatgcacgtaaccagtatcgcaacagctaatcctagcaagaaagatacaaatgaattaatctatggtgttgctcctgaagcacaagtaatgtttatgagagtcttctctgatgaaaaaagaggaactggaccagccctttatgttaaagctattgaagatgccgttaaactcggtgctgacagcattaatttaagtttaggtggagctaatgggtctttagttaatgccgatgaccgacttataaaagctttagagatggctagactcgctggcgtttctgttgttatagcagcaggtaacgacggtacatttgggagtggagcatcaaagccttctgctctttatcctgattatggtttagttggtagtccatcaacagctcgtgaggccatttctgtagcatcatataataatacaacactggttaataaagtcttcaacattatcggattagaaaacaacagaaatctcaacaacggattagctgcttatgcagatcctaaagttagtgataagacctttgaagtagggaaacaatatgattatgttttcgtaggaaaaggaaacgacaatgattataaggacaaaactttaaatggtaaaatcgccttaattgaacgtggagatattacttttacaaaaaaagtcgtcaatgctattaatcacggtgctgtgggagctattatctttaataacaaagctggggaagctaatctaacaatgagtttagatcctgaagcaagtgctattcctgctatttttacccaaaaagagtttggagatgttttagctaaaaacaactataaaattgtatttaacaatatcaaaaataaacaagccaaccctaatgcaggtgtcctatctgacttttcaagctgggggttaacagcagacggacaattaaaacctgacttatctgctcctggaggctctatttacgccgctatcaatgataatgaatatgatatgatgagtgggacaagtatggcttctccccatgtcgctggtgctactgctctagttaaacaatacttattgaaagaacatccagaacttaaaaaaggtgacattgaaagaactgtcaaataccttcttatgagtactgctaaagcacacctaaacaaagatacaggcgcttacacctcaccacgccaacaaggagcaggtattatcgatgtcgcagcagcagttcagacaggattatacctaactggtggggaaaacaactatggcagcgttacattaggaaatattaaagataaaatttcctttgatgttactgttcataatatcaataaagttgcaaaagatttacactatacaacctatttaaatactgatcaagttaaagatggctttgtcacattggctcctcaacaacttggtacatttacagggaaaacgatacggattgaaccagggcaaacccaaacgattacaattgatatagatgtttcgaaataccatgacatgttaaaaaaagtaatgccaaacggctatttcctagaaggctacgtacgttttacagaccctgttgatggtggggaagttcttagtattccttatgttggatttaagggagaattccaaaacttagaagttttagaaaaatccatttataagcttgttgctaacaaagaaaagggattttatttccaaccaaaacaaacaaacgaagttcctggttcagaagattatactgccttaatgactacaagttcagagcctatctactcaacagacggtactagtcctatccaattgaaagccttgggaagctataagtctatagatggaaaatggatcttacaactagatcaaaaaggccagcctcatctagccatttcacctaatgatgaccaaaatcaagatgccgttgcagtgaaaggtgttttcttacgtaatttcaataatttaagagccaaagtctatcgtgcagatgatgttaatttacaaaaaccactatgggtaagtgctccccaagcaggagataaaaattactacagcggaaatactgaaaatccaaaatctacatttttatatgacacagaatggaaaggaaccactactgatggtattcctttagaagatggaaaatacaaatacgttttaacttattactctgatgtccctggctctaagccacaacaaatggtgtttgatatcactttggatagacaagctcctacactaacaacagcaacttatgacaaagatagacgtatcttcaaagctcgtcctgcagtagaacacggggaatctggtatctttagagaacaagttttttacttaaaaaaagataaagatggtcattataatagcgtcttacgtcaacaaggagaagacggtatccttgttgaagataacaaagtatttatcaaacaagaaaaggatggtagctttattctacctaaagaggttaacgatttctctcatgtctactatactgttgaagattatgcaggcaatctagtatcagcaaaactcgaagatttgatcaatattggcaataaaaatggtttagtaaacgtcaaagtgtttagccctgagcttaacagtaatgtcgatattgatttctcttactctgtcaaagatgacaaaggtaatatcatcaaaaagcaacatcacgggaaagacctcaatttattgaaattgccttttggtacctatacgtttgatctattcttatacgatgaggaacgagcaaatctaatcagtcccaaaagtgtcactgtaactatttctgaaaaagatagccttaaagacgtcttatttaaagttaacttactcaagaaagcagccttactcgttgaatttgacaagcttttaccaaaaggagcaacagtccagttggttactaagacaaatactgttgttgatctaccaaaagcaacttattctcctactgactatggtaaaaacatacctgtaggagactatcgtttaaacgtaacgctgcctagtgggtatagcactttagagaacttagatgatttacttgtatccgtaaaagaagatcaggtaaacctaacaaaattgacgctgattaataaagctcctctgattaatgccctagcagaacaaactgatattattacccagcctgtgttttataatgctggaactcacttaaaaaataattacctagctaatcttgaaaaggcacaaactttaattaaaaatagagtggaacaaacaagtattgataatgctattgctgctttgagagaaagtcgccaagctcttaacggtaaagaaacagatacttctttactggcaaaagctattttagctgaaacagaaatcaagggaaactatcaatttgttaatgctagtccattaagccaatcaacttatatcaatcaagtccaattggcgaaaaaccttctacaaaaacctaacgtcactcaatcagaagtagacaaagccttagaaaatcttgatattgctaaaaatcaattaaatggtcatgaaactgattactctggtttacaccatatgataattaaagcaaacgttctgaaacaaacatcatctaaatatcagaacgccagtcaatttgctaaagaaaattataataaccttatcaagaaagcagaattgctgctttccaatagacaagctacacaagctcaagttgaagagttattaaaccaaataaaagcaaccgaacaagagcttgatggccgtgatagagtttcttccgcagagaattatagtcaatcactcaatgataatgactctctcaataccacacctatcaatccgccaaatcagccccaggcgttgatattcaaaaaaggcatgactaaagaaagtgaggttgctcagaagcgtgtcttaggggtgactagccaaaccgataatcaaaaggtaaagacaaacaagcttcctaaaacaggcgaaagcactcctaaaataacctatacaatattgctatttagtctctctatgctaggtctggcaacaatcaaactaaagtctatcaaaagagaa

SEQ ID NO: 8964 - protein, 1570 aa, Streptococcus agalactiae
MNTKQRFSIRKYKLGAVSVLLGTLFFLGGITNVAADSVINKPSDIAVEQQVKDSPTSIANETPTNNTSSALASTAQDNLVTKANNSPTETQPVAESHSQATETFSPVANQPVESTQEVSKTPLTKQNLAVKSTPAISKETPQNIDSNKIITVPKVWNTGYKGEGTVVAIIDSGLDINHDALQLNDSTKAKYQNEQQMNAAKAKAGINYGKWYNNKVIFGHNYVDVNTELKEVKSTSHGMHVTSIATANPSKKDTNELIYGVAPEAQVMFMRVFSDEKRGTGPALYVKAIEDAVKLGADSINLSLGGANGSLVNADDRLIKALEMARLAGVSVVIAAGNDGTFGSGASKPSALYPDYGLVGSPSTAREAISVASYNNTTLVNKVFNIIGLENNRNLNNGLAAYADPKVSDKTFEVGKQYDYVFVGKGNDNDYKDKTLNGKIALIERGDITFTKKVVNAINHGAVGAIIFNNKAGEANLTMSLDPEASAIPAIFTQKEFGDVLAKNNYKIVFNNIKNKQANPNAGVLSDFSSWGLTADGQLKPDLSAPGGSIYAAINDNEYDMMSGTSMASPHVAGATALVKQYLLKEHPELKKGDIERTVKYLLMSTAKAHLNKDTGAYTSPRQQGAGIIDVAAAVQTGLYLTGGENNYGSVTLGNIKDKISFDVTVHNINKVAKDLHYTTYLNTDQVKDGFVTLAPQQLGTFTGKTIRIEPGQTQTITIDIDVSKYHDMLKKVMPNGYFLEGYVRFTDPVDGGEVLSIPYVGFKGEFQNLEVLEKSIYKLVANKEKGFYFQPKQTNEVPGSEDYTALMTTSSEPIYSTDGTSPIQLKALGSYKSIDGKWILQLDQKGQPHLAISPNDDQNQDAVAVKGVFLRNFNNLRAKVYRADDVNLQKPLWVSAPQAGDKNYYSGNTENPKSTFLYDTEWKGTTTDGIPLEDGKYKYVLTYYSDVPGSKPQQMVFDITLDRQAPTLTTATYDKDRRIFKARPAVEHGESGIFREQVFYLKKDKDGHYNSVLRQQGEDGILVEDNKVFIKQEKDGSFILPKEVNDFSHVYYTVEDYAGNLVSAKLEDLINIGNKNGLVNVKVFSPELNSNVDIDFSYSVKDDKGNIIKKQHHGKDLNLLKLPFGTYTFDLFLYDEERANLISPKSVTVTISEKDSLKDVLFKVNLLKKAALLVEFDKLLPKGATVQLVTKTNTVVDLPKATYSPTDYGKNIPVGDYRLNVTLPSGYSTLENLDDLLVSVKEDQVNLTKLTLINKAPLINALAEQTDIITQPVFYNAGTHLKNNYLANLEKAQTLIKNRVEQTSIDNAIAALRESRQALNGKETDTSLLAKAILAETEIKGNYQFVNASPLSQSTYINQVQLAKNLLQKPNVTQSEVDKALENLDIAKNQLNGHETDYSGLHHMIIKANVLKQTSSKYQNASQFAKENYNNLIKKAELLLSNRQATQAQVEELLNQIKATEQELDGRDRVSSAENYSQSLNDNDSLNTTPINPPNQPQALIFKKGMTKESEVAQKRVLGVTSQTDNQKVKTNKLPKTGESTPKITYTILLFSLSMLGLATIKLKSIKRE

SEQ ID NO: 8965 - DNA, 741 bp, Streptococcus agalactiae; identical to SEQ ID NO: 6307

SEQ ID NO: 8966 - protein, 247 aa, Streptococcus agalactiae
LNKSWLRKGGIKMVCVDFIDQKVYSEAEGLFVSDLDLGIKGLIRARYPFALDSDFISYGNLSHYCMNYLDEIVQRANQKNEKIKYNVTTLMKEEEKPFNVEERLNKQATIGQRIADDVARFGGSWTFIIVFVSIMAIWMLVNIMKPFGIQFDPYPFILLNLALSTIAAIQAPLIMMSQNRAADYDRLQARNDFNVNKTSELEIRLLHEKIDHMVQQDQFELLEIQKLQTEMLVSLGNQLAQLKQLQK

SEQ ID NO: 8967 - DNA, 636 bp, Streptococcus agalactiae
atgaatcttttaattatgggtttgcctggtgctggtaaaggtactcaagcagctaagatcgttgaagaatttggtgttgctcacatctcaacaggggatatgttccgcgccgcaatggctaatcaaaccgaaatgggacgtttagctaaaagttatattgataaaggtgaattggttcctgatgaagtaacaaacgggattgtaaaagagcgcttagctgaggatgatatcgcagaaaaaggttttttacttgatggatatccacgtactattgaacaagcacacgccttagatgctacgcttgaagaactaggactacgcttagatggtgttattaatattaaagtggatccatcatgtcttatagagcgtttgagtgktcgtattatcaatcgtaaaactggtgaaactttccacaaagtgttcaacccaccagtagattataaagaagaagattactatcaacgtgaagatgataagcctgaaactgtcaaacgtcgcttggacgttaatattgctcaaggagaacctattcttgaacactatcgtaagcttggtcttgttacagatattgaaggtaatcaagaaataacagaagtttttgcagatgttgaaaaagcgttgctagaactcaaa

SEQ ID NO: 8968 - protein, 212 aa, Streptococcus agalactiae
  MISC_FEATURE (1)..(212): Xaa = Any Amino Acid
MNLLIMGLPGAGKGTQAAKIVEEFGVAHISTGDMFRAAMANQTEMGRLAKSYIDKGELVPDEVTNGIVKERLAEDDIAEKGFLLDGYPRTIEQAHALDATLEELGLRLDGVINIKVDPSCLIERLSXRIINRKTGETFHKVFNPPVDYKEEDYYQREDDKPETVKRRLDVNIAQGEPILEHYRKLGLVTDIEGNQEITEVFADVEKALLELK

SEQ ID NO: 8969 - DNA, 1302 bp, Streptococcus agalactiae
atgtttttaaaattacttagagatgcactcaaagtaaagatggtaagaaataaaattttatttactatctttatccttcttgtatttcgtatcggaacgcatatcacagtaccgggcatcaatgttaagagtttagaacaaatgggtgaacttccatttctaaatatgcttaacttagttagtggtaatgcaatgagaaacttttcggtattctctatgggagttagcccttacattactgcgtctattgttgttcagttacttcaaatggatattcttccgaagtttgttgaatggggaaaacaaggagaggtaggtcgtcgtaagcttaaccaagctacacgttatatttctttgttccttgcattcgtacaatcaattggtattactgctggttttaacactctatcaagtgttgctttagttaaaactccgaatgtacaaacatatttgcttattggtgcaatccttacaacaggtagtatggtggttacttggctaggtgaacaaattactgataagggattcggaaatggagtgtctatgattatctttgcgggtatcatttcttccattccaagtgcaattacaactatctacgaagatttctttgtaaatgtacgctcttcagcaattacaaattcttacatctttgtcgggatccttatcgtagcagtattagcaattgtattttttacaacatttattcaacaagctgaatacaaaattccaatccaatatacaaaacttgttcaaggagctcctacaagttcatatcttcctctaaaagtaaatccagctggtgttattcccgttatctttgctagctcgattacaacaattccaagtacgattattcctttctttcaaaatggcaaagaaattccttggcttactaaactccaagaattacttaattatcaaaccccagtcggtatgattatctatgctatcttgattattctgttctctttcttctawacttttgkacaagtaaaccctgaaaagacagcagagaatcttcaaaaaaattcgtcctacattccaagtattcgaccaggacgagaaacagaagaatatatgtcatcgctattgaaaaaattagcaacaattggttcagtatttctagcatttatttccttgttaccaattattgctcaacaagcgttgcatttgtcatcaagtattgcgttaggtgggacaagcttactcattttgattgcaacgggtattgaaggtatgaaacaactcgagggctatcttttgaagagacgctatgttggattcatgaatacaacagaa

SEQ ID NO: 8970 - protein, 434 aa, Streptococcus agalactiae
  MISC_FEATURE (1)..(434): Xaa = Any Amino Acid
MFLKLLRDALKVKMVRNKILFTIFILLVFRIGTHITVPGINVKSLEQMGELPFLNMLNLVSGNAMRNFSVFSMGVSPYITASIVVQLLQMDILPKFVEWGKQGEVGRRKLNQATRYISLFLAFVQSIGITAGFNTLSSVALVKTPNVQTYLLIGAILTTGSMVVTWLGEQITDKGFGNGVSMIIFAGIISSIPSAITTIYEDFFVNVRSSAITNSYIFVGILIVAVLAIVFFTTFIQQAEYKIPIQYTKLVQGAPTSSYLPLKVNPAGVIPVIFASSITTIPSTIIPFFQNGKEIPWLTKLQELLNYQTPVGMIIYAILIILFSFFXTFXQVNPEKTAENLQKNSSYIPSIRPGRETEEYMSSLLKKLATIGSVFLAFISLLPIIAQQALHLSSSIALGGTSLLILIATGIEGMKQLEGYLLKRRYVGFMNTTE

SEQ ID NO: 8971 - DNA, 1278 bp, Streptococcus agalactiae; identical to SEQ ID NO: 6413

SEQ ID NO: 8972 - protein, 426 aa, Streptococcus agalactiae
VRYSKEIIQLAIPAMIENILQMLMGVVDNYLVAQLGVVAVSGVSVANNIITIYQAIFIALGASIASLLAKSLAGSKKDDAISVCSQAIFLTLLIGAVLGIISIVFGQTFFKLLGTTKSVAQVGGLYLAIVGGGVVTLGMLTTLGSFLRVQGQPRLPMYVSIFVNFLNAVLSGFAIFEWRYGLVGVAVSTLIARLIGICILAKYLPIKKIIKRMTWKISAQIWNLALPSAGERLMMRAGDVVIVAIVVQLGTNVVAGNAIGETLTQFNYMPGLGIATATIILTAKYVGQKNRESIEETIQSSYYIGLVLMILISSFMLLAGKPLTQLFTNNPSAIKGSLIVILLSFVGVPATIGTLVYTAAWQGLGNAKLPFYTTTIGMWLIRVVLGYLLGIVFELGLLGVWMATIADNIFRWLFLKVHYHRYIQKM

SEQ ID NO: 8973 - DNA, 1125 bp, Streptococcus agalactiae
atgaaacattatcaaaccataattatcggtgcaggcgctgcaggaatcggttttggttctgccatgcaacgattaggacttacaaattttcttatcattgaaaaagggcacattggagaatcttttttaagatggcccagaacaacacaatttatcacaccttcyttcactacmaatggctttggttttccagatctaaacgctgttattccagatacttctcctgctttctcatttgaaaaagaacatctttctggagtggaatatgcacgctacttacaattagttgctgctcattataatctccctatccaaaacgaaacatctgttctatctattgataaacgagatagcctttttgttattaaaacttcaaagggagatttttctgctgattatcttattatggcaacaggagaatttcaaaatccaaataccattgatattaaaggtgcagatctaggaatgcactatggtcaagttgataatttccatatcaaatctgacaatccatttatcatcattggtggaaacgaaagtgcttgtgatgcactaacacatctagtatatttgggaaatcaagtcgaattatatacagatacgtttggtcgtaaagagagcaatcccgatccaagcatctctttatcccccctaactaaagaacgtttaaaacatatacaagaccacaaaaaagaatattatagtatctctgaaggcaagaaagccattgagattaaacaaattggaaaacaatatcaagttacttttgatgacggtagtactgcggagtctttccataaacctattctttccacaggttttctaaatacctgtcatctcattgacggaatcgctttatttgaatacgataaaaatcagttgccaatagttactgaagatgacgaatctactatcgttaataactgtttcttaattggtccaagcttacgacaaagagatactattttctgctatatttataaattcagacagcgctttgtccctgttattaatcatatcgcacaacgagaagggattatattagacgaagatacccttgaattctttaaagaaaatcaaatgtaccttgataacctagcttgttgcgatgtcaattgtgattgc

SEQ ID NO: 8974 - protein, 375 aa, Streptococcus agalactiae; identical to SEQ ID NO: 6456

SEQ ID NO: 8975 - DNA, 1041 bp, Streptococcus agalactiae
gtgtttgtaaagaaaggactatttgtgtttttactattatgtattttatcgatgtggctcatgatttttggggttgcattctattactttgggtcgctacatcaatcattgacttcaaggattatttatcagtttgtacttactgttttgctaacgacaacagcttggttcatgggtgcctattttttagcatttgaaggtcattttaaaactgtctttcaattccaagaagcagatggtaaacaaattgtaaattgtttatttcaactttgtttcgccctttacgcagtagtaatgcttattgggtcaattattgatagagttcagacgaagcgacttttattagctgttgtttcttggcttttcttggtgtatacgcccttagcttatttaatttggaattcagagggtgtttttgcaaagatgggagtacttgatttttcaggcggaatgatcgttcatttatctgcagggctttcttcgtatattttagctcatgttattggcaagagtgaacatcagcacaataaggttaaaaatgatagtctctttttaggaatgatacttattacatttggttggtttggatttaatatgggtccagttggtgagtggaattcacaagccattatgatacttttaaatactatatttgctattataggtggtggtttggcgtggacattggctgctaagtggaatggtgaggaagagaaaacaggaagcttattgaatggcattattgttggtcttgtgacgagtacagcaggagttgggtatctcttaacttggcaattattagctgtaacattctttgcatccctcttcacctactttgtaacggattacgwwgcgaaagcttttgccattgatgatgtcgtttcctcctttggaatgaatggtattgggggattgttgggaagtttaggagttggtctctttaaattatcacatatgccagttcaactgttagcattagctaccacaattcttttgtcaattataatgacctatatcatatctaaagcgatttttagaaaa

SEQ ID NO: 8976 - protein, 347 aa, Streptococcus agalactiae
  MISC_FEATURE (1)..(347): Xaa = Any Amino Acid
VFVKKGLFVFLLLCILSMWLMIFGVAFYYFGSLHQSLTSRIIYQFVLTVLLTTTAWFMGAYFLAFEGHFKTVFQFQEADGKQIVNCLFQLCFALYAVVMLIGSIIDRVQTKRLLLAVVSWLFLVYTPLAYLIWNSEGVFAKMGVLDFSGGMIVHLSAGLSSYILAHVIGKSEHQHNKVKNDSLFLGMILITFGWFGFNMGPVGEWNSQAIMILLNTIFAIIGGGLAWTLAAKWNGEEEKTGSLLNGIIVGLVTSTAGVGYLLTWQLLAVTFFASLFTYFVTDYXAKAFAIDDVVSSFGMNGIGGLLGSLGVGLFKLSHMPVQLLALATTILLSIIMTYIISKAIFRK

SEQ ID NO: 8977 - DNA, 939 bp, Streptococcus agalactiae
gtgaaaaatatgatgaaatatatatcagagttaacaaccctgattgcgttagctggtttaatggttattatcacactcattaatcctaatttcctcacaaccaataatctactcaatttattattacaagtaactgcaaatggttttatcgctttcgggatgaccttcgttattttgactggcggtattgatttatcagtcgggtccatattagccctatctagtgcattaacagctggattaatcggccacggagtacccgttggtattgctatcgttttatctgttgccttaggtggcatcttgggaatgctaaacggactcttcatttcttacggaaaattagcaccatttatcgttacactggcaacaatgactatctttagaggagcaacgctagtttattcaaacggcaacccaattaccgctggcttatccgatagttttctattccaatttttgggacaaggctatattgttggtatcccattcccagtcattctcatgtttcttacttttattattttgtatattttgttacataaaacagccttcgggaaatctgtttacgctttaggaggtaatgaaaaagcagcgtatatctcgggtattaagttaaacaaagttaaaattatcatctacactatctcaggtatcatggcttccatttctgggttaattatcacatcacgccttagctcagcacaaccaacagctggagcaagttatgagatggatgctattgccgccgttgtcttaggtggaacgtctttatctggtgggaaaggacgtatcattggaacattgattggtgctcttattattggtgtcctgaacaatggattaaacatcattggtgtctctgcattttggcaacaagttgtgaaaggtatcgttattttaatggctgttttacttgatcgctttaaagtagcaaaa

SEQ ID NO: 8978 - protein, 313 aa, Streptococcus agalactiae
VKNMMKYISELTTLIALAGLMVIITLINPNFLTTNNLLNLLLQVTANGFIAFGMTFVILTGGIDLSVGSILALSSALTAGLIGHGVPVGIAIVLSVALGGILGMLNGLFISYGKLAPFIVTLATMTIFRGATLVYSNGNPITAGLSDSFLFQFLGQGYIVGIPFPVILMFLTFIILYILLHKTAFGKSVYALGGNEKAAYISGIKLNKVKIIIYTISGIMASISGLIITSRLSSAQPTAGASYEMDAIAAVVLGGTSLSGGKGRIIGTLIGALIIGVLNNGLNIIGVSAFWQQVVKGIVILMAVLLDRFKVAK

SEQ ID NO: 8979 - DNA, 1086 bp, Streptococcus agalactiae
atgtcacatgcttggaaagaattaaccttttataagaaaaaatacctcctgattgaattgctaatcattgttatgatgttcatggtagtttttttatcaggtttagcaaacggtttaggtagagctgttagtgctgctattgaaaataacccagctcaaacctatattttgaatgaaggtgctgaacaagtgattacatcatctgtattgacaactaaagatcagacagatttaaacagtttgaatttaaaagatagtaccactttaaatattcaacgttcgagtttaactcgacaaggacacgaaaagaaaattgatatttcttattttgctattgataaagattcttttatggcacctacactttctgagggaaaacaactgacaagttacaaaaaagctattattttaaatgatagtttaaaagctgaagggataaagttaggtgataaagtgattgataagtcatcatctatatcactaacagtcgttggatttgtccataatagtatgtatggtcacggacctgtggcatttattgataaagacatttataccgaaattaataaaaagattaatcctcaataccagttcttacctcaggcattagttatgaaaaatgataaaagtatatctcatttaccaactcaattagaagctgttagtaaaaaagatgtcattcaacatattcctggttatagtgccgaacaatccactttgaatatgattttatgggtccttgtcgtagcttcagctggtattttaggtgtctttttctacatcatcacacttcaaaaacgtcatgaatttagcgtcatgaaagctattgggacaaaaatgtcagagattgccctatttcaattgagtcaagtcattatattggcactgtttggtatcattgttggagatggattggcggttgctctctcttatgtattaccagctcaaatgccatttgttattaattggcaaaatattattctagtatcgtttgtatttttagtcattgcaatgattagtagtgctttgtcaattgtaaaagttgctaaaatcgacccagtcgaagttattaatgggggaggagaa

SEQ ID NO: 8980 - protein, 362 aa, Streptococcus agalactiae
MSHAWKELTFYKKKYLLIELLIIVMMFMVVFLSGLANGLGRAVSAAIENNPAQTYILNEGAEQVITSSVLTTKDQTDLNSLNLKDSTTLNIQRSSLTRQGHEKKIDISYFAIDKDSFMAPTLSEGKQLTSYKKAIILNDSLKAEGIKLGDKVIDKSSSISLTVVGFVHNSMYGHGPVAFIDKDIYTEINKKINPQYQFLPQALVMKNDKSISHLPTQLEAVSKKDVIQHIPGYSAEQSTLNMILWVLVVASAGILGVFFYIITLQKRHEFSVMKAIGTKMSEIALFQLSQVIILALFGIIVGDGLAVALSYVLPAQMPFVINWQNIILVSFVFLVIAMISSALSIVKVAKIDPVEVINGGGE

SEQ ID NO: 8981 - DNA, 1068 bp, Streptococcus agalactiae
atgactaagctaaggcgatttcggtttccgttaagattttatttcacattaatgtttgtgttaacgatgcttttctcagtcctagcttctcttttactagttgcagcaatagtttttactttttttcaaggagtcttaactactcatgtattacaagttagtgctctcgctgttgtttttttaagccttgtgatagctagtattagtatgtggtacggttcttatcatttaacaaaaccaattttagatattagccatattgtgtccaatgttgcagacggtgactttgaagggcatatttatcgaaacagtaatcgtcgtaaatcctatgagtattataatgaattggatgagctatctgaaagtattaatcagatgattgtttctttatctcatatggatcatatgcgaaaagactttatcactaatgtttctcatgagctaaagactccgattgctgcagtagctaatattgtagaactattacaagatccagaattagatgaagaaacacaaagtgagttattaggtcttgttaaaacagagagcctaaggttaacaagattatgtgatacgatgttgcaaatgtcgcgcgtggataatcaggagactattggggagctatcctctgttcgtgtagatgaacaaattcgtcaagcaatgattagtttaacagaacgttggcaagctaaaaggataaattttcaactggattcaaaaccatatactgtttactcaaactctgacttgctgatgcaagtttggataaaccttttagataatgcaataaaatattccgaggatattgtagacttaagtgtacgaatggaagaaactaataatcattatctgagagttattatttctgataaaggtaggggaatttctcaatatgatgttcagcatatatttgataaattttaccaagcggatcagtcgcataatcaacaaggaaatggattaggactagcaatagttaaacgtataattgttctttgtaagggacgtattagtgtctccagtcagttggaaattggaacagaattttgtgtagaactacctttatca

SEQ ID NO: 8982 - protein, 356 aa, Streptococcus agalactiae
MTKLRRFRFPLRFYFTLMFVLTMLFSVLASLLLVAAIVFTFFQGVLTTHVLQVSALAVVFLSLVIASISMWYGSYHLTKPILDISHIVSNVADGDFEGHIYRNSNRRKSYEYYNELDELSESINQMIVSLSHMDHMRKDFITNVSHELKTPIAAVANIVELLQDPELDEETQSELLGLVKTESLRLTRLCDTMLQMSRVDNQETIGELSSVRVDEQIRQAMISLTERWQAKRINFQLDSKPYTVYSNSDLLMQVWINLLDNAIKYSEDIVDLSVRMEETNNHYLRVIISDKGRGISQYDVQHIFDKFYQADQSHNQQGNGLGLAIVKRIIVLCKGRISVSSQLEIGTEFCVELPLS

SEQ ID NO: 8983 - DNA, 2007 bp, Streptococcus agalactiae; identical to SEQ ID NO: 6623

SEQ ID NO: 8984 - protein, 669 aa, Streptococcus agalactiae
LAEMQHVNHSSFDKASKAGFIIALGIVYGDIGTSPLYTMQSLVENQGGISSVTESFILGSISLIIWTLTLITTIKYVLVALKADNHHEGGIFSLYTLVRKMTPWLIVPAVIGGATLLSDGALTPAVTVTSAVEGLKVVPSLQHIFQNQSNVIFATLFILLLLFAIQRFGTGVIGKLFGPIMFIWFAFLGISGLLNSFAHPEVFKAINPYYGLKLLFSPENHKGIFILGSIFLATTGAEALYSDLGHVGRGNIHVSWPFVKVAIILSYCGQGAWILANKNAGNELNPFFASIPSQFTMHVVILATLAAIIASQALISGSFTLVSEAMRLKIFPQFRSTYPGDNIGQTYIPVINWFLFAITTSIVLLFKTSAHMEAAYGLAITITMLMTTILLSFFLIQKGVKRGLVLLMMIFFGILEGIFFLASAVKFMHGGYVVVIIAVAIIFIMTIWYKGSKIVSRYVKLLDLKDYIGQLDKLRHDHRYPIYHTNVVYLTNRMEEDMIDKSIMYSILDKRPKKAQVYWFVNIKVTDEPYTAEYKVDMMGTDFIVKVELYLGFKMRQTVSRYLRTIVEELLESGRLPKQGKTYSVRPDSNVGDFRFIVLDERFSSSQNLKPGERFVMLMKSSIKHWTATPIRWFGLQFSEVTTEVVPLIFTANRGLPIKEKSELTTTGD

SEQ ID NO: 8985 - DNA, 624 bp, Streptococcus agalactiae
atgaagaagcttacttttatttgggatttagatgggacattaatagattcgtatgtaccaattatggaagctcttgaagaaacctatcgtcattttggtttaatatttgataaagaattaatccatgaatatattttacaggaatcagtggggaaattattggtaaacctttcagaggaagagcaaatacctcatgaaaaactgaaagcatattttacaaaagaacaagaaagtcgagattctaaaatacatttaatgccatatgcaaaagagattttagaatggaccaaagaacaagatatccccaattttatgtatacacataaaggagcaagtacgcattcagtgttggaaaccttgcagatctctcattattttgatgaaattttaactggtgtttcgggattcgagcgaaaaccacatccacaagggattaattatttagttaaacgatattctttagataaatcaatgacttattacataggagatcgtccactagatttggaggttgctcaaaatgctggtataaaatccataaacttaaggttagagaattccaaagaaaactataatatttcaagtctcaaagatataatatcacttgatttcactcgtttggat

SEQ ID NO: 8986 - protein, 208 aa, Streptococcus agalactiae
MKKLTFIWDLDGTLIDSYVPIMEALEETYRHFGLIFDKELIHEYILQESVGKLLVNLSEEEQIPHEKLKAYFTKEQESRDSKIHLMPYAKEILEWTKEQDIPNFMYTHKGASTHSVLETLQISHYFDEILTGVSGFERKPHPQGINYLVKRYSLDKSMTYYIGDRPLDLEVAQNAGIKSINLRLENSKENYNISSLKDIISLDFTRLD

SEQ ID NO: 8987 - DNA, 1149 bp, Streptococcus agalactiae; identical to SEQ ID NO: 6649

SEQ ID NO: 8988 - protein, 383 aa, Streptococcus agalactiae
LNSKLSLKLTILSISIFLMSHLAIAPAIPKLYAFYHTQNPHIGLASVESLVTIPAMMITIFVILSNFVVTKLGKKNTVLLGLCLILMSGFISFFTSNFSLAMASRLLLGIGIGLYNSLSISIITDLYEADERASMIGLRTASLNIGKALTTFIVGLVLAIGVNYIYLVYLLVIPVFFFFWKNVPEVENQTHTLKASTTFDTKAALLMLITFLVGIAYIGATVKIPTLLVTKYHYATSFSSNMLTLLAFSGILVGSVFGKLVKVFQEKTLLIMILAMGIGNVLFALANNQIIFIVASILIGASFVGTMSSVFFYISKNYAKEHNNFITSLALTAGNIGVILTPLILTKLPSQLHLEPFMTPFLITSGLMVINVFVYLVLMSKNK

SEQ ID NO: 8989 - DNA, 414 bp, Streptococcus agalactiae
atgtttgaaatagtattggaaaaaattaaatcgcataaatgggagacaacaggaattattgtaggactcttattatttggaattttgggtttaaatcattttggcactcatcataaagaagacaatttaaatatcaatttagagaaaaaagtatcaactataacagaaaaaaaggtaccaatgattagtcacgtcaaagataaagtatctaatcaagtaacggttgacgtaaaaggggcagtcaatcatccaggtgtttatagtttgccttctcaaagtcgtgtaacagatgcgattaagcgtgcaggtggactaagcaatctcgctgatagtaaatccgttaatctagcacagaaattacaagatgagacggttatctatgttgctcaaaaaggtgaaaaaataactgttgtg

SEQ ID NO: 8990 - protein, 138 aa, Streptococcus agalactiae
MFEIVLEKIKSHKWETTGIIVGLLLFGILGLNHFGTHHKEDNLNINLEKKVSTITEKKVPMISHVKDKVSNQVTVDVKGAVNHPGVYSLPSQSRVTDAIKRAGGLSNLADSKSVNLAQKLQDETVIYVAQKGEKITVV

SEQ ID NO: 8991 - DNA, 1584 bp, Streptococcus agalactiae; identical to SEQ ID NO: 6731

SEQ ID NO: 8992 - protein, 528 aa, Streptococcus agalactiae
LKFTELNLSQDILSAVEKAGFVEPSPIQEMTIPLALEGKDVIGQAQTGTGKTAAFGLPTLNKIHTEDNTIQALIIAPTRELAVQSQEELFRFGRDKGVKVRSVYGGSSIEKQIKALRSGAHVVVGTPGRLLDLIKRKALKLNHIETLILDEADEMLNMGFLEDIEAIISRVPETRQTLLFSATMPDPIKRIGVKFMKDPEHVKIKATELTNVNVDQYYVRVKENEKFDTMTRLMDVDQPELSIVFGRTKRRVDELTRGLKLRGFRAEGIHGDLDQNKRLRVIRDFKNDHIDILVATDVAARGLDISGVTHVYNYDIPQDPESYVHRIGRTGRAGKSGQSITFVSPNEMGYLTIIENLTKKRMTGMKPATASEAFQAKKKVALKRIARDFEDQELVSKFDKFKADALELATQYTPEELALYVLSLTVQDPESLPEVEITREKPLPFKPSGGGFKGKGGRGNGRGGDRRRNDRGDRRGNRDRDDRGSRCDFKRRDDKFKKDNRRQENKKPHKNTSSEKQTGFVIRNKGDK

SEQ ID NO: 8993 - DNA, 591 bp, Streptococcus agalactiae
atgcttatgacaaaaataataggactgacaggagggatagcttctggaaagtcaacggtaacaaaaataatacgagaatcaggttttaaagtcatagatgcggatcaagtggttcataaattgcaagctaagggtgggaaactttaccaagctttattagaatggttgggtcccgagatacttgatgctgatggtgagttggatagaccaaagctttctcaaatgatttttgctaatccagacaatatgaagacatcagctaggctacaaaatagtatcattcgtcaagagttagcatgtcagcgcgaccaattaaaacaaacagaagagatatttttcatggatattcctttattgattgaagaaaagtatataaaatggtttgatgagatttggttggtatttgttgataaagaaaaacaattacaacgattaatggcccgtaacaactacagtcgagaagaagcagaattacgactttcacaccaaatgcctttaacagataaaaaaagtttcgctagtcttattattgacaataatggtgatttaataactttaaaagagcaaatattggatgctcttcaacgttta

SEQ ID NO: 8994 - protein, 197 aa, Streptococcus agalactiae
MLMTKIIGLTGGIASGKSTVTKIIRESGFKVIDADQVVHKLQAKGGKLYQALLEWLGPEILDADGELDRPKLSQMIFANPDNMKTSARLQNSIIRQELACQRDQLKQTEEIFFMDIPLLIEEKYIKWFDEIWLVFVDKEKQLQRLMARNNYSREEAELRLSHQMPLTDKKSFASLIIDNNGDLITLKEQILDALQRL

SEQ ID NO: 8995 - DNA, 1218 bp, Streptococcus agalactiae; identical to SEQ ID NO: 6813

SEQ ID NO: 8996 - protein, 406 aa, Streptococcus agalactiae
LKNLNRYVVAVSGVVLHLMLGSTYAWSVFRNPIISETGWDISSVSFAFSLAIFCLGMSAAFMGHLVERFGPRIMGMISAILYGAGNVLTGLAIETQQLWLLYVAYGILGGIGLGSGYITPVSTIIKWFPDRRGLATGFAIMGFGFASLVTSPLAQSLMIRIGVGKTFYILGLVYFFVMMIASQFIKQPPQEKITILTHDGKKNAMNSQIITGLKANAAIKSKTFYIIWLTLFINISCGLGLISAASPMAQDLAGYSAESAALLVGVLGIFNGFGRLLWASLSDYIGRPLTFIILFIVNFIMTSSLFLSFNAIVFAIAMSILMTCYGAGFSLLPAYLSDIFGTKELATLHGYSLTAWAIAGLFGPLLLSKTYSWGNSYQLTLMVFGFLFLFGLLLSLYLRKLTTKVV

SEQ ID NO: 8997 - DNA, 2043 bp, Streptococcus agalactiae
atgttgaatcgtaaaaaaaggtatcgtctcactgtaaaaaagcaaaatgctagcatacctagacgattaaatcttctattttttattattgktttattatttactgttctaattcttcgtttagagcaaatgcagattgggcaacaatcattttacatgaaaaaactgacagctcttacgagttatacagtgaaagaatcaaaagcgagaggtcagatttttgatgctaagggagttgtcttagttgaaaatgatgaacgtcctactgtggcgttttctagaggaaacaatatttcatctcagtctatcaaagagttagcgaataaattatcacattacattaccttaaccgaagttgcttcaagcgatagagcaaagagagattattatttagcagataaagccaactacaaaaaagttgttgaaagtttaccagattctaaacgttacgataaatttggtaaccatctagccgaatcaaccgtatatgcaaatgcagttgctgcagttccagtgagcgctattaactattctgaagatgagttaaaagtggttgccttatttaaccaaatgaatgcgacaccaacgtttggttcagtgaaattaagtacaggcgaattaagtgatgatcaaatcaagaaactggatgctgataagaaggaactgttaggaatttctgtaacaagtaattggcatcgtcgtaaaaaaggaacttctttatcggatatattaggtactatttctacagaaaaggcaggtttaccaagagaagaagttaaaaaatatttgaaaaaaggctattcactgaatgaccgagtgggaacttcttaccttgaaaaacaatatgaagatgacttacaaggaatcagacaaattcgcaaagtagttgttaataaaaaaggtaaagttgtttcagataatattacgcaagaaggtaagtcaggaagaaatcttaaattaacgattgatcttaattaccaaaacaaagtagaaagtatcttgaaacaatactatggcagtgaattatctagtggacgcgctagtttttccgaagggatgtatgcagttgctatagaaccttcaactggtaaagtgttagcaatggctggtctgaaaaatgatcatgggaatttagttgatgacagcctaggcactattgctaagaatttcacgccaggatctgttgtgaaaggtgcgacgctatcatcaggatgggaaaataaagttcttagaggaaatgaagtgctttatgaccaagaaattgctaatatacggtcatggtttacacgaggtttgactccaatatctgcggcacaagcgctagagtattcatctaatacttatatggttcaagtagcacttcgtttaatgggacaagactataatacaggagatgctttaactgatcgaggctatcaagaagcaatggctaaactaaggaaaacttacggcgaatatggtttaggggtttctacaggattagatttacctgaatcagaaggttatgtacctggaaaatacagcttaggaacaactctaatggaatcgttcggtcagtatgatgcctatacaccaatgcaacttggtcagtatatctcaactattgcgaataatgggaatcgtttagcacctcacgtggtttcagatatctatgaagggaatgattctaataagttcgctcaattggttcgttcaatcactcctaaaacactaaataagatagctatctcagatcaagagttagccattattcaagaaggtttttataacgttgtcaatagtggaagtggctatgcaactggtacgtcaatgagggggaatgtgacaaccattagtggtaaaactggtaccgctgaaacatttgctaaaaatgtaaatggacaaacagtttctacctacaacttaaacgctattgcctacgatactaatcgtaaaatagcagtagcggtaatgtatccgcatgttacaactgatacaacaaaatcccatcaattagttgcacgagatatgattgatcaatatatttcacagttcacaggacaa

SEQ ID NO: 8998 - protein, 681 aa, Streptococcus agalactiae
  MISC_FEATURE (1)..(681): Xaa = Any Amino Acid
MLNRKKRYRLTVKKQNASIPRRLNLLFFIIXLLFTVLILRLEQMQIGQQSFYMKKLTALTSYTVKESKARGQIFDAKGVVLVENDERPTVAFSRGNNISSQSIKELANKLSHYITLTEVASSDRAKRDYYLADKANYKKVVESLPDSKRYDKFGNHLAESTVYANAVAAVPVSAINYSEDELKVVALFNQMNATPTFGSVKLSTGELSDDQIKKLDADKKELLGISVTSNWHRRKKGTSLSDILGTISTEKAGLPREEVKKYLKKGYSLNDRVGTSYLEKQYEDDLQGIRQIRKVVVNKKGKVVSDNITQEGKSGRNLKLTIDLNYQNKVESILKQYYGSELSSGRASFSEGMYAVAIEPSTGKVLAMAGLKNDHGNLVDDSLGTIAKNFTPGSVVKGATLSSGWENKVLRGNEVLYDQEIANIRSWFTRGLTPISAAQALEYSSNTYMVQVALRLMGQDYNTGDALTDRGYQEAMAKLRKTYGEYGLGVSTGLDLPESEGYVPGKYSLGTTLMESFGQYDAYTPMQLGQYISTIANNGNRLAPHVVSDIYEGNDSNKFAQLVRSITPKTLNKIAISDQELAIIQEGFYNVVNSGSGYATGTSMRGNVTTISGKTGTAETFAKNVNGQTVSTYNLNAIAYDTNRKIAVAVMYPHVTTDTTKSHQLVARDMIDQYISQFTGQ

SEQ ID NO: 8999 - DNA, 651 bp, Streptococcus agalactiae
atgtttaatacaattggtcgcgctcaggggtggagtgatactcctttaactacttttggagaactcgggattaaagagcttggtttgggactaaaggcttcaaatattagttttaaagaggctttttctagtgatagtgracgtactttacaaactatggaaattattctcagggaagtgcaacaagaaaatattccctatacgagagataaacgaatccgcgagtggtgctttggtagtttggatggaggatatgatggcgacctttttaatggcgttctgcctcgagtttcaaacggagatatgagccatttgacacacgaagaaattgctaatttgatttgtcaagttgatacggctggctgggcagaaccgtgggcaatattgagtaaccgtattctgtcaggcttcactgctatagctaaaaaaatagaggatattgggggaggtaatgcgattgttgtcagtcatgggatgactattgcgacttttttatggttaatcgaccatagtacccctcgtagtttaggcttagataatggtagtgtctcagtcgttgattttgaagatggaacattttctattcaatctattggggatatgtcctatcgagaaaaaggaagagaaattttagaaaaaacattgcaatga

SEQ ID NO: 9000 - protein, 216 aa, Streptococcus agalactiae
  MISC_FEATURE (1)..(216): Xaa = Any Amino Acid
MFNTIGRAQGWSDTPLTTFGELGIKELGLGLKASNISFKEAFSSDSXRTLQTMEIILREVQQENIPYTRDKRIREWCFGSLDGGYDGDLFNGVLPRVSNGDMSHLTHEEIANLICQVDTAGWAEPWAILSNRILSGFTAIAKKIEDIGGGNAIVVSHGMTIATFLWLIDHSTPRSLGLDNGSVSVVDFEDGTFSIQSIGDMSYREKGREILEKTLQ

SEQ ID NO: 9001 - DNA, 753 bp, Streptococcus agalactiae
atgaaaaaaaataaaattatccgattcagtttagttggtgttctacttgcgatactatgctttagtctttttgctttattgaagcctaacagtcaacaatcatcatctcaaaagttgaggaatgaggatataaaaaagatatcctctcaaaaaagaaataagaaattacaattaccagctgtatcatcaaaagattggaacttgattttggtcaatcgtgaccataaacatgaagaattaagtccagatgtggttcctgttgaaaatatttatttggataaacgtattacgaagcaagctactcagtttttagaggctgctagagcaattgattcacgagaacatttaatttcgggttatcgtagtgttgcctatcaggagaagttgttcaattcttatgttactcaagagatgactagtaaccctaatttgacgaggggacaagcagaaaagttggtaaaaacttactctcagcctgcaggtgctagtgaacaccagactggattagcgatggatatgagtactgtagattctttgaatgagagcgatcctagagtagtcagtcagttgaaaaagatagctccacaatatggttttgtcttacggtttccggatggtaaaacagcagaaacaggggtaggttatgaagattggcattaccgctatgttggggtagagtctgcaaaatatatggccaaacatcatttaacattagaagaatacataactttattaaaggagaataaccaatga

SEQ ID NO: 9002 - protein, 250 aa, Streptococcus agalactiae; identical to SEQ ID NO: 6860

SEQ ID NO: 9003 - DNA, 1524 bp, Streptococcus agalactiae
atgaaaaaaaaactatctctttgggcatttctatcattgattttagtcactatgaccatttgtatattttctattttttattatgtcactatacatcagtcctatcgtatggtaagggtacaggaagaaaaaatcttaaaaaatactggttatgctttatcgagaaatccacaagttatacaaacactcaaagataatcactatgatcaaagtctccaaaaacaaatgttattccttagcaaaaaatcaaatttagactatattgtccttataaatttaaaagggatccgttttacccaccctgactccactaagattggtaaaccatttcaagggggtgatgaacaagctgtttttaagggaaaagctattatgtctactgcagaaggttctttaggaaaatctttacgatacttaattccagtatatgatcaccaaaaacaggttggggcaattgcagttggcttaaaattaacgacacttggagacttatctcaaagtagcataaaagagtttagtaagcctctcttgattagtattttgattagcttagtcgtcacaagtataatttcttatggcttaaaaaaacaacttcacaacctccatccaagtgatatttttcaacatttagaagagcgcaatgcaacactggaccaaattcaagccgctgtatttgttattgaccagaggcatatcatcaaaagaaataatcctgcagctagtttattattcaaaaaagaggggcaacgagacctattttcaggtaaattattagaatctttaattcctcaactcaagcaggatcatttttcaaaaaaaactgaacaagtattacattttcaaggacaagactatttactatctatctcgccaattacggttaaaacacaaaatagaggctatgttgtcttcttaaggaatgttactgaaacacttttcactttggatcaattagcacacactacagcttatgcttctgcgctacaggcccaaacacatcaatttatgaatcaacttcatgttatttatggacttgcagacattgaatactacgacgagttgaaaatttatttaaaagaattattggagccacaaaatgaatttttagcacgcttatcaatgttagttagagagcctcgactggctagtttcattattggcgaaagagaaaaattcgcagaaaaacacatcaatctatccacagaaattttagtagaaatccctaccaagtcaactgttgaggatgttaataactatctcttgctccacagatatattaatacgaagatactcacgctattaaattcaacgactttagtttctttacgtttaaattatcaaaataacctcattgaaacagattatcaatgggagaatgagaagtggttactcaatgactaccatcagtatttcaacgacgcttattttcaacagttacttgtagattcaagagctacttataagatctctttaaaacaaaataaggttattataagaacaaatattatctactcagaagggcct

SEQ ID NO: 9004 - protein, 508 aa, Streptococcus agalactiae
MKKKLSLWAFLSLILVTMTICIFSIFYYVTIHQSYRMVRVQEEKILKNTGYALSRNPQVIQTLKDNHYDQSLQKQMLFLSKKSNLDYIVLINLKGIRFTHPDSTKIGKPFQGGDEQAVFKGKAIMSTAEGSLGKSLRYLIPVYDHQKQVGAIAVGLKLTTLGDLSQSSIKEFSKPLLISILISLVVTSIISYGLKKQLHNLHPSDIFQHLEERNATLDQIQAAVFVIDQRHIIKRNNPAASLLFKKEGQRDLFSGKLLESLIPQLKQDHFSKKTEQVLHFQGQDYLLSISPITVKTQNRGYVVFLRNVTETLFTLDQLAHTTAYASALQAQTHQFMNQLHVIYGLADIEYYDELKIYLKELLEPQNEFLARLSMLVREPRLASFIIGEREKFAEKHINLSTEILVEIPTKSTVEDVNNYLLLHRYINTKILTLLNSTTLVSLRLNYQNNLIETDYQWENEKWLLNDYHQYFNDAYFQQLLVDSRATYKISLKQNKVIIRTNIIYSEGP

SEQ ID NO: 9005 - DNA, 594 bp, Streptococcus agalactiae
atgaccaaaaagatattcttatttatctgcgctactcttttagtaggaatagccttatatacaccaacaacttctatttttaatcataacaacgtttatgctgccaccaagaaagcaaaaattaaatttaataaaactcaaaaaaaaattgtcaaaaaagcaagagaatatgctaagtctggccatatgtctaaagatagtatcattgaaaaattaaaaaaggattctaagaaatatcgtcaagaagacatcaactttgtgattaataacctcaaggttgattacaaaaaaaatgccttgatttctgccaaaatttattcaaagaccatgaatttatctaaacaatctatctttgaacagctctattcggagtctccagataaggcaacccactctgataaatttacaaaagaagaatcccaatatgctatagaccatctcaaagtagatttcaaagaaaatgctcttgagactgctaaaagttatcaaagtagttcttctttatccaaagaagaaatctataaacaattgacatctacgctgggcgataaattcacaaatgatgaagcccaatatgctgtagatcatttgaaa

SEQ ID NO: 9006 - protein, 198 aa, Streptococcus agalactiae
MTKKIFLFICATLLVGIALYTPTTSIFNHNNVYAATKKAKIKFNKTQKKIVKKAREYAKSGHMSKDSIIEKLKKDSKKYRQEDINFVINNLKVDYKKNALISAKIYSKTMNLSKQSIFEQLYSESPDKATHSDKFTKEESQYAIDHLKVDFKENALETAKSYQSSSSLSKEEIYKQLTSTLGDKFTNDEAQYAVDHLK

SEQ ID NO: 9007 - DNA, 366 bp, Streptococcus agalactiae
atgactatttctcaacaacaataccaacacatgataacaaatagtgacttaatcgccatcacagataaggcgttagtaagcaaaagtcaacaatctgaagcgactatttttataggacgtccaacttgccaatattgtagagctttcttaccaaaattattaaaatctcaagccacacttcattcaaaaatttactaccttgatagtcaaaaatacaaagggaaacgattgaagagttttttcaaaaagcatcatattaccactgttccaaatttagcacattatcaacaaggaaaaatgactaaatatcttgttcaaggaagccaagctacacctcaacaaatccaaactttcttaagccaaaaa

SEQ ID NO: 9008 - protein, 122 aa, Streptococcus agalactiae
MTISQQQYQHMITNSDLIAITDKALVSKSQQSEATIFIGRPTCQYCRAFLPKLLKSQATLHSKIYYLDSQKYKGKRLKSFFKKHHITTVPNLAHYQQGKMTKYLVQGSQATPQQIQTFLSQK

SEQ ID NO: 9009 - DNA, 540 bp, Streptococcus agalactiae
atgtcaattattattgggttaatggccgctatgtttattattcgtttagcttatttaaagctatctatagctaatgaaaaggccttaagaaaaaatggtgctaaagaatatggtgtaggtgtttcaaaagcaatcacagttcttcatattatcatttatttttcatctgtaactgaggctattctaacaaaagcaagttttaattttgttagcgtaatcgggcttagcttgatgattttttctgtgtttatgttacatacagtaacacgtttacttggtcgtatttggacagtgaaattaatggtagataaaaatcatcaatttgtagatcactggttatttagggttgttaagcatcctaactatttcttaaatattgctcctgaacttttaggtgtaactttattgtgtcatgctaaatacacagcattatttgtcttgccaatttatgcttttgttatttatttaagaattcgtgaagaaaacttattattaaaaacgatcattattccaaatggaatcaaaaagtctagggtatat

SEQ ID NO: 9010 - protein, 180 aa, Streptococcus agalactiae
MSIIIGLMAAMFIIRLAYLKLSIANEKALRKNGAKEYGVGVSKAITVLHIIIYFSSVTEAILTKASFNFVSVIGLSLMIFSVFMLHTVTRLLGRIWTVKLMVDKNHQFVDHWLFRVVKHPNYFLNIAPELLGVTLLCHAKYTALFVLPIYAFVIYLRIREENLLLKTIIIPNGIKKSRVY

SEQ ID NO: 9011 - DNA, 498 bp, Streptococcus agalactiae
atggaatcatatgaacaattttatgccaaactatctcaaccttttagaaaatccccacagttaataattcttttaaattttttactaaaaatagtcacaggaatgatgtacatactctatccatcttttctgatatttactctttggcaagggatgacatttcaattatggttaaggctattaattatccctgctgttggctttatagctttgtcttacattaggaaacgccttgattttccacgaccatatgaaaaatggaatattaaacctttaatttataaggatactgagggaaggtcaatgcctagcagacatgttttttcagctacgatgattagtatgtgtttgttacgatattatgtttactttggaatagtttgtttaatattatcggttctattggcaatttgccgtgtgatagcaggtattcactatcctaaggatgttattgtaggttaccttattggcttgattttagggctttgtttatttatt

SEQ ID NO: 9012 - protein, 166 aa, Streptococcus agalactiae
MESYEQFYAKLSQPFRKSPQLIILLNFLLKIVTGMMYILYPSFLIFTLWQGMTFQLWLRLLIIPAVGFIALSYIRKRLDFPRPYEKWNIKPLIYKDTEGRSMPSRHVFSATMISMCLLRYYVYFGIVCLILSVLLAICRVIAGIHYPKDVIVGYLIGLILGLCLFI

SEQ ID NO: 9013 - DNA, 351 bp, Streptococcus agalactiae
atgatatacaaaattattgcttctttatttcttgttttaatccctatattttcacaggttcttgtcaaaatatttaaacttaaaaaatttaacattatgtttccagatgttgcttttcctatttttgtttttttaattccattaatatcatctagtctgttaaaacaaaatcttttaccttactatctgattctcatttcattactggcaatcggaattacaataaagcttctacgaacaaagactcttttttcttataaacgttttttaaaattattttggagatctggctttattctaactttccttttttacctaggattattggttatcatctttatcaaagtacaa

SEQ ID NO: 9014 - protein, 117 aa, Streptococcus agalactiae
MIYKIIASLFLVLIPIFSQVLVKIFKLKKFNIMFPDVAFPIFVFLIPLISSSLLKQNLLPYYLILISLLAIGITIKLLRTKTLFSYKRFLKLFWRSGFILTFLFYLGLLVIIFIKVQ

SEQ ID NO: 9015 - DNA, 201 bp, Streptococcus agalactiae
gtgaggcgtaatatggcatctagtggttggaaatatgtattaaaacaaatcggtctaatagtattagtcatactattagccttgctgtttttagcggttggattgatgttgggttatagtgtttttggtgacggagagcatgcttactctattttatcgctggataaatggcaaaatattattggaaaatttttaggaaaa

SEQ ID NO: 9016 - protein, 67 aa, Streptococcus agalactiae
VRRNMASSGWKYVLKQIGLIVLVILLALLFLAVGLMLGYSVFGDGEHAYSILSLDKWQNIIGKFLGK

SEQ ID NO: 9017 - DNA, 411 bp, Streptococcus agalactiae
atgatggaaaaaattaggatttaccataacccaaattgtgggacatcaaggaacgtacttgccattattcgtcattgtggtattgaaccagaaattatttattatctgaaaacaccacctagcaggatggaactggttgaactgttgttagaaatgaaactttctgcgagggaacttctaagaacagatgttcctgcttatgagaaattcaatttggaatcttctagcgttacagatgaagaaatgattgatgcgatgatacaagatcctattcttatcaatcgtcccatagttgttacgagtaaaggtgcaaaactctgccgaccctgtgaagcaattttaaccattttacctgtaaagatggaaaaagattttgttaaagaagatggacagattatccaaagtttatga

SEQ ID NO: 9018 - protein, 136 aa, Streptococcus agalactiae
MMEKIRIYHNPNCGTSRNVLAIIRHCGIEPEIIYYLKTPPSRMELVELLLEMKLSARELLRTDVPAYEKFNLESSSVTDEEMIDAMIQDPILINRPIVVTSKGAKLCRPCEAILTILPVKMEKDFVKEDGQIIQSL

SEQ ID NO: 9019 - DNA, 291 bp, Streptococcus agalactiae
atgaaacttaaaatcagtgttttaacagcagcttcagctgtcactctattattagctactttagcaagtcttgcgaaggcagacacagtgtcttatccttcacgtgatgccggatttgtctactctcgtgggtatgcgccttctgaatcaagctatccttcacgcgatgccgggtttatctactctcgtgggtatgcgccttctgaatcaagctatccttcacgcgatgccggatttatctactctcgtgggtatgctccaaaacacttcctaagtgcttacgataaataa

SEQ ID NO: 9020 - protein, 96 aa, Streptococcus agalactiae
MKLKISVLTAASAVTLLLATLASLAKADTVSYPSRDAGFVYSRGYAPSESSYPSRDAGFIYSRGYAPSESSYPSRDAGFIYSRGYAPKHFLSAYDK

SEQ ID NO: 9021 - DNA, 453 bp, Streptococcus agalactiae
atgttaataaaaggattattgtcacccaatagtaaagtatctccgaaggattacaaagtatatatgagagttttgtcttttgtttttagtgtatgtagtttgattatgatagtatcatcatttctacatacctttgaatctaattttactaaaggtttttcctttggttcaggtattgccttatttgcaggaagtttttattttttggtgataacatttagtgaaaagcgatttcaacattactataccaaagtttttgatgagcgtaatcaatttattgctaatatgtcttgtcgacttcttttccttttatctgtccttgttttagtggtattgtgtctgattaatgtctggtttggtataactttttcctatgcaaagttcttgctattgatactctcttttattttatatggttatttattaatttactttattttacagaagttattg

SEQ ID NO: 9022 - protein, 151 aa, Streptococcus agalactiae
MLIKGLLSPNSKVSPKDYKVYMRVLSFVFSVCSLIMIVSSFLHTFESNFTKGFSFGSGIALFAGSFYFLVITFSEKRFQHYYTKVFDERNQFIANMSCRLLFLLSVLVLVVLCLINVWFGITFSYAKFLLLILSFILYGYLLIYFILQKLL

SEQ ID NO: 9023 - DNA, 204 bp, Streptococcus agalactiae
atgaacactaacatccctagccaatttttacctttctttatccctcttatcctcttacaggttatccttatcatcattgcactcttaaaattacgaaaaataacaaagacaaactacctttctaaaccagtttgggttctaattatcctttttgttaatctccttggacctattgcttttcttagcttagaagggaaaaatgca

SEQ ID NO: 9024 - protein, 68 aa, Streptococcus agalactiae
MNTNIPSQFLPFFIPLILLQVILIIIALLKLRKITKTNYLSKPVWVLIILFVNLLGPIAFLSLEGKNA

SEQ ID NO: 9025 - DNA, 471 bp, Streptococcus agalactiae
gtgggaggaaatgaaatattaattaataaacggttaagaacaatctccttactacattatctgttagcgctactacttcttatagacattatctttacgattgattttataattcacacgtcaacaatttccaaaaatagtctatcatatataagttatggtcaaggatttggttggtctatgattcttattaatttgatagctctacctatttgtttcctagtagaattgtcagctggtctactattaaaattagaaatgcataagcaacatggctactatcctctggaacgcttattgatgactggtaatattctaacagttgtatcgctagtattattacatactttgattcacaatatcaattcacttctttttttatcaattacagtagttttattgatttctgggaagtccttaagtcttattagtatctatctattaaaaagaaaaagtaaacatcaaaaagtc

SEQ ID NO: 9026 - protein, 157 aa, Streptococcus agalactiae
VGGNEILINKRLRTISLLHYLLALLLLIDIIFTIDFIIHTSTISKNSLSYISYGQGFGWSMILINLIALPICFLVELSAGLLLKLEMHKQHGYYPLERLLMTGNILTVVSLVLLHTLIHNINSLLFLSITVVLLISGKSLSLISIYLLKRKSKHQKV

SEQ ID NO: 9027 - DNA, 351 bp, Streptococcus agalactiae
atgagtttagcattgcaaattgaaatgtttattttagccattgtcctactttatatgattataagaatggttaataaaaacacattttctgttaaacgttctttaccttggctattagttggtttaattctagtctttattagtgtatttcctggggtggtctcatttatcgctcatcaccttggattcgctttaacgatgaatttcttgttatttggtgctattttatttctgttttgtttagaattatttgatactagtagcaataccaaaagagatgagcaaattaaacgcctgattcaagaggtttctttgttgaaaaaagagatagaggatagcactttagatgag

SEQ ID NO: 9028 - protein, 117 aa, Streptococcus agalactiae
MSLALQIEMFILAIVLLYMIIRMVNKNTFSVKRSLPWLLVGLILVFISVFPGVVSFIAHHLGFALTMNFLLFGAILFLFCLELFDTSSNTKRDEQIKRLIQEVSLLKKEIEDSTLDE

SEQ ID NO: 9029 - DNA, 450 bp, Streptococcus agalactiae
atgtcaaaaggatattcaagacaacagaaaaagtctactaagactaatactgattcaactcaatcacccgctaagcatataaaaacaggtttttctgcacttcaaaaaacaattgcattagtcggtagtgttttaagtattattgttgcctctattactattactaatgcgattaataatcacaaagactctagtaagactgattcttctacttcaaaaaccgtcattataagagaaagtggacaaaattctagtaaccaagtttctactgaaaaagatgagacaagggcatcatccagccaaacactagaaaattcctctgctagtagtactccgagtagcagttcaaattctgctgccaataacgatcaaacatcatctagtactaacaatgatcaaacaaataatactactaccgatacctcaactattgaaaatacaacaacacct

SEQ ID NO: 9030 - protein, 150 aa, Streptococcus agalactiae
MSKGYSRQQKKSTKTNTDSTQSPAKHIKTGFSALQKTIALVGSVLSIIVASITITNAINNHKDSSKTDSSTSKTVIIRESGQNSSNQVSTEKDETRASSSQTLENSSASSTPSSSSNSAANNDQTSSSTNNDQTNNTTTDTSTIENTTTP

SEQ ID NO: 9031 - DNA, 399 bp, Streptococcus agalactiae
atgcataatatattaagatttttaggcattgttattatttctgcagtgattctatttagtataggtagtttctacgatttaacattaatgaaaaatatactacttatctgttggagttttctctttgatctattggtttttgtcttcaaacaaagacaaacgacagaagtactcacatggtatcaagttgttaagcaattttggttatttattaagtgtactattcttattcctatcttagttgcttttattataatgaaaggatgtttgacaagtatatcagatatattaatttacttttatttacaccttgtcgttgtttattatacgataggaatgattttatcattaggtcgtatcatttctcctgaacactctatgtttaataaacttagaaag

SEQ ID NO: 9032 - protein, 133 aa, Streptococcus agalactiae
MHNILRFLGIVIISAVILFSIGSFYDLTLMKNILLICWSFLFDLLVFVFKQRQTTEVLTWYQVVKQFWLFIKCTILIPILVAFIIMKGCLTSISDILIYFYLHLVVVYYTIGMILSLGRIISPEHSMFNKLRK

SEQ ID NO: 9033 - DNA, 453 bp, Streptococcus agalactiae
atggttaaattaaaatcgttactgaaaaaaagtattcaaaatgaagtcagcttatatttactgttcggactattaacatcccttctttatttagttattcgacaagggatttttaatttctcgcaggacgctccattctctgcaatagttgctaacataatagctatactttttgctttttttacaaatgatcgatttgtttttaaacaaactaaaattgaacagcttcaacgcttacaaacatttgtcatcgctagattaggcacattaggattagatttgatattagctgttatttttgttgatcaatttccttctattatcggacaattcgttcagcacaatttaaataaaatcaacaccattgaaagccttgtatctcaaatattaattattttactcaactacatcttgagcaaatttgttatttttaaagacaaaaaaagacaactc

SEQ ID NO: 9034 - protein, 151 aa, Streptococcus agalactiae
MVKLKSLLKKSIQNEVSLYLLFGLLTSLLYLVIRQGIFNFSQDAPFSAIVANIIAILFAFFTNDRFVFKQTKIEQLQRLQTFVIARLGTLGLDLILAVIFVDQFPSIIGQFVQHNLNKINTIESLVSQILIILLNYILSKFVIFKDKKRQL

SEQ ID NO: 9035 - DNA, 405 bp, Streptococcus agalactiae
atgaaaaagagtacccaaataatactactaatagttgcattattcatacttgtttttagcggaggattttatatgaaagaacaacaaagaaaagaagaactaaaacggaatcgagaatatgaagttagtctagtcaaagcattgaaaaattcctatgagaatatagaagaaataaaaatcacacatcctgtttcaactgaaattcctggagattggcattgtactgtaaagatttcatttaatgataaaaaatctattgtttataatattacacataatttggaatcgaaaaaaaattatagcggaaaatttaatgaaaaaaatatgaatttttttgattcaagaattggtaaaacaaaaaaaactataaaaattattttttcagatggtcaggagaagatacaa

SEQ ID NO: 9036 - protein, 135 aa, Streptococcus agalactiae
MKKSTQIILLIVALFILVFSGGFYMKEQQRKEELKRNREYEVSLVKALKNSYENIEEIKITHPVSTEIPGDWHCTVKISFNDKKSIVYNITHNLESKKNYSGKFNEKNMNFFDSRIGKTKKTIKIIFSDGQEKIQ

SEQ ID NO: 9037 - DNA, 297 bp, Streptococcus agalactiae
atgctagtatcaaaggagaaagctatgtcatcaccacttaagcaagagcaaactcacgaaagcaaaacagagcaagctcaaccaaaatttcaagtatttcaagaatttgatcacagtgctaagttgcgtgagctagtcttttttgctcgtatcgctctcttcagtataaccactgtgctaatctctttcttattactagcactaagtttaacacctgtctggagtttcttactagcgatgctggcaagtctagcagttacatctgcagtctcttcattcatttggtcactcagacaa

SEQ ID NO: 9038 - protein, 99 aa, Streptococcus agalactiae
MLVSKEKAMSSPLKQEQTHESKTEQAQPKFQVFQEFDHSAKLRELVFFARIALFSITTVLISFLLLALSLTPVWSFLLAMLASLAVTSAVSSFIWSLRQ

SEQ ID NO: 9039 - DNA, 465 bp, Streptococcus agalactiae
atgcttatgataataaattcattcgataatagtagaaaagcgattattaatcctgaagatattaattcaccaataaaaggttttccaaagactgttattacctgtttcgcgcgggagactttcaatcgtattttagaagaattgcctcatcgtgaaattgctagaactagtgtagcaaacttagaaattcccatttatgaattagaatttaaaggacaaaagattggctttttcaatgcttatgttggtgcttcagcttgcgtagcaatcttggaagatattatagtatttggaatggaaagtttaattgtttttggaacatgtggcgtccttgattcgtcaattgaggagacatccattattattccaagaagtgctattagggatgaagggacatcatttcattattcggaagcaagttctgaaattgcagtaaacacaaattcaatttttttactctgcgga

SEQ ID NO: 9040 - protein, 155 aa, Streptococcus agalactiae
MLMIINSFDNSRKAIINPEDINSPIKGFPKTVITCFARETFNRILEELPHREIARTSVANLEIPIYELEFKGQKIGFFNAYVGASACVAILEDIIVFGMESLIVFGTCGVLDSSIEETSIIIPRSAIRDEGTSFHYSEASSEIAVNTNSIFLLCG

SEQ ID NO: 9041 - DNA, 456 bp, Streptococcus agalactiae
gtgaaccacttacttaacctcagtaaagaaaatatagctaaaatagattttgactttcttaatgaggcacttaatgcaaatattcgtttgaaagaattagtagatgaactaaaaatttcaaaagaactggacagtaaaggttggtccaaaaaagactctcgaacgataaaaatcttgtacgatggccttatcaataaacatatagtttccctagatcgtgcagattataacattatccaagtcattccatttgctaatgtacatgtactactgtttttaataccagaaagggagaattctaaaaattatagaatatacaactacagtgattatgaaatggagttaatcaatgaggataggcaacaattttcaaaatatgaaacagttgatttagaccaattgatacttgttgatatttttaatattgatgactacatttcatcatatttaacaata

SEQ ID NO: 9042 - protein, 152 aa, Streptococcus agalactiae
VNHLLNLSKENIAKIDFDFLNEALNANIRLKELVDELKISKELDSKGWSKKDSRTIKILYDGLINKHIVSLDRADYNIIQVIPFANVHVLLFLIPERENSKNYRIYNYSDYEMELINEDRQQFSKYETVDLDQLILVDIFNIDDYISSYLTI

SEQ ID NO: 9043 - DNA, 348 bp, Streptococcus agalactiae
atgaaagactatattaacagaatattgcactttattaaagaacatatgacttatcatgtcaactttatagatgactttttagatattaaatgggaaaaggtgagtaacatccatttaaggttttggacaactattattgcttatttagttatttttatcttaagtatctctaccgtaattcttaaccttgtacttctttttcaaggattcttaacgcaaaaccctattatttacttactattttttataactttagtttgtgctttttattttgcttataaatttattacttatactccaaccattgtaaaaaatgctcttcagtatatcaaaaagctcaaaaacgtt

SEQ ID NO: 9044 - protein, 116 aa, Streptococcus agalactiae
MKDYINRILHFIKEHMTYHVNFIDDFLDIKWEKVSNIHLRFWTTIIAYLVIFILSISTVILNLVLLFQGFLTQNPIIYLLFFITLVCAFYFAYKFITYTPTIVKNALQYIKKLKNV

SEQ ID NO: 9045 - DNA, 201 bp, Streptococcus agalactiae
atgggattttttgcacagcgttgtccttactgccaaagtacaaaagtacaatttatgaaccaagaccgtaaaggttttaatggttgtgtcggttgtatcggatttttaattgcttggccgttcttattgctaggtttggttgggaaaaagggtaaaaacaactggcattgcacaaattgtggaagaacgtttaagacaaaa

SEQ ID NO: 9046 - protein, 67 aa, Streptococcus agalactiae
MGFFAQRCPYCQSTKVQFMNQDRKGFNGCVGCIGFLIAWPFLLLGLVGKKGKNNWHCTNCGRTFKTK

SEQ ID NO: 9047 - DNA, 393 bp, Streptococcus agalactiae
atgattatgtctaccatctattttatttctttatgcatgagttttatcttaagttattatgatataaaataccaagagtatcctatttttctatggatattattcaccatttcaacgataattctcacaccgattacaaaagtttctattgttttgtgtttatttgggattttagctgaagtggttgatattaatatcggaagtggagatttcctttatttagccacaattggcttatctttacctcttcatcaaatgctttttattattcaaataggtgcttggttaggaattatttattgtttagttatgagaaaaatgaaaaaaacgatagcttttctaccgtttttaagtatcgcttatataatcgtcaccagttactctcttttattc

SEQ ID NO: 9048 - protein, 131 aa, Streptococcus agalactiae
MIMSTIYFISLCMSFILSYYDIKYQEYPIFLWILFTISTIILTPITKVSIVLCLFGILAEVVDINIGSGDFLYLATIGLSLPLHQMLFIIQIGAWLGIIYCLVMRKMKKTIAFLPFLSIAYIIVTSYSLLF

SEQ ID NO: 9049 - DNA, 462 bp, Streptococcus agalactiae
atgagaaagattattataccaataataactattttgttgattgctttagatcaactatctaagttatggattgttaaacatattgaactaaaccaaattaaggaattcattccaaatatcgttagtctaacttatctgagaaattatggtgctgcattttctattttgcaaaatcaacaatggctttttaccttaattacaatcttcgttgttggtgttgctattatttatttgatgaaacatattaatggaagttattggttattaatttctctaaccttaatcatctctggtggattaggaaactttatagatcgcttaagattaggttatgtcgttgatatggtgcatttagattttattaattttgctatctttaatgtagcagactcatatctgacaatcggtattatttgcttaatgattgcactttggaaagaggaaagtaatggaaatcacaat

SEQ ID NO: 9050 - protein, 154 aa, Streptococcus agalactiae
MRKIIIPIITILLIALDQLSKLWIVKHIELNQIKEFIPNIVSLTYLRNYGAAFSILQNQQWLFTLITIFVVGVAIIYLMKHINGSYWLLISLTLIISGGLGNFIDRLRLGYVVDMVHLDFINFAIFNVADSYLTIGIICLMIALWKEESNGNHN

SEQ ID NO: 9051 - DNA, 369 bp, Streptococcus agalactiae
atgattttaaagaagaaacttaaagctggcatccttttgcaagctattgtattggctgctgtatttacactcgtcttacagttttatctagcaagaatattggcaacagaaagacagtatcatagccaaattgaagcaagtaaagcttatttaacagcgcagttagcttataaaacaatagaaggtgactccatatcaggaaaatgttattttacaggaggatatgcttcatacctccaagaagggaactatttacaagttaaggttacattggataagggaggaaactataaccataagttttatcgtaaaacagacactctccaagtacctctcaagtctaatgataataaagcaagccataaacat

SEQ ID NO: 9052 - protein, 123 aa, Streptococcus agalactiae
MILKKKLKAGILLQAIVLAAVFTLVLQFYLARILATERQYHSQIEASKAYLTAQLAYKTIEGDSISGKCYFTGGYASYLQEGNYLQVKVTLDKGGNYNHKFYRKTDTLQVPLKSNDNKASHKH

SEQ ID NO: 9053 - DNA, 201 bp, Streptococcus agalactiae
atggcattattttttaccttcctaaaggtatctcaagtcattttcttagtattattgattgcctatgccagctttttagtgatttcattagtcattggaggtgttcatctctatgaaaaaaatgagcgcaaaaaaagtttaactagaaataaagaaaaaattccaatttcaattattagacttcctgcgaaactaaaatcc

SEQ ID NO: 9054 - protein, 67 aa, Streptococcus agalactiae
MALFFTFLKVSQVIFLVLLIAYASFLVISLVIGGVHLYEKNERKKSLTRNKEKIPISIIRLPAKLKS

SEQ ID NO: 9055 - DNA, 249 bp, Streptococcus agalactiae
atgataatattcttatacgcttgtctgatgatatttgggatactttatattattgaacgtcgggtaagtcagaaaaagtctaaagttattttggaattattgatgaaccctaaacttcatttggatttattatcggcattaaaaccatttgaaaaagaaacagatcgtctcatataccttcgtaaaacttatcacctagatattattgatgctgttactttaaataatcaattgaaagagaaagaagta

SEQ ID NO: 9056 - protein, 83 aa, Streptococcus agalactiae
MIIFLYACLMIFGILYIIERRVSQKKSKVILELLMNPKLHLDLLSALKPFEKETDRLIYLRKTYHLDIIDAVTLNNQLKEKEV

SEQ ID NO: 9057 - DNA, 1671 bp, Streptococcus pyogenes
atggttttatcagatattgaaatagccaactctgtcactatggaacctatcagtaaggttgccgatcaattagggattgacaaggaggcgctctgtctctatggtaagtacaaggcaaaaattgatgcccgtcaactggtcgccttaaaaaacaaacctgatggcaaactcattcttgtcactgctatctcaccaacaccagctggtgaaggcaaaaccaccacttctgttggattggtagatgctctttctgccattggaaaaaaagcagttattgcccttcgtgaaccttctcttggtcctgtttttggggttaagggaggagctgctggcggtggccacgcgcaagttgtcccaatggaagacatcaaccttcactttacaggggactttcatgccatcggtgtcgccaacaacttattagctgccttgattgataaccacattcaccatggcaatagcctaggcattgattccagacgtatcacttggaaacgtgtggtggatatgaatgaccgccagcttcgtcatattgttgacggcttgcaaggcaaggtcaacgggattcctcgtgaagatggttatgacattaccgtcgcctctgaaatcatggcaatcctgtgcctatccgaaaatatttctgacctcaaagcccgccttgaaaaaatcatcatcggttacaactaccaaggtgaacctgtaacagctaaagacttgaaagctggtggtgccctagccgctctgctcaaggatgcgattcatcctaatctcgtgcaaaccctggaacacacaccagccctcattcacggtggcccatttgctaatatcgcccatggctgtaatagtgtcctcgccaccaaactagccttgaaatatggtgattatgccgttaccgaagctggatttggcgctgaccttggagctgaaaaattcattgacatcaaatgccgcatgtcaggccttcgcccagcagccgttgtcctagtagccactatacgtgcccttaaaatgcatgggggtgtgccaaaagcagacctggctactgaaaatgttcaggccgttgtggatggtttacctaaccttgacaaacatttggctaatatccaagacgtctatggccttccagttgtcgtggcgatcaataaattcccgcttgataccgatgccgaattacaagctgtctatgatgcctgcgacaaacgtggcgttgacgttgtgatttctgatgtttgggcaaatggcggagctggtggccgtgaactggctgaaaaagtcgtgacactagccgagcaagacaatcaattccgctttgtttatgaggaagacgatagcattgaaaccaaactgactaaaatcgttaccaaagtttacggtggtaaaggcatcaacttgagctcagcagccaaacgtgaactggctgacttagaacgcctcggctttggcaactacccaatttgcatggccaaaacccaatattccttctcagacgatgccaaaaaacttggcgcaccaactgactttacagtgactattagcaaccttaaagtgtccgcaggagcaggatttatcgttgccctaacaggtgctatcatgaccatgcctggccttccaaaagtacctgccagcgaaacaattgatattgacgaggagggcaacatcacaggactattc

SEQ ID NO: 9058 - protein, 557 aa, Streptococcus pyogenes
MVLSDIEIANSVTMEPISKVADQLGIDKEALCLYGKYKAKIDARQLVALKNKPDGKLILVTAISPTPAGEGKTTTSVGLVDALSAIGKKAVIALREPSLGPVFGVKGGAAGGGHAQVVPMEDINLHFTGDFHAIGVANNLLAALIDNHIHHGNSLGIDSRRITWKRVVDMNDRQLRHIVDGLQGKVNGIPREDGYDITVASEIMAILCLSENISDLKARLEKIIIGYNYQGEPVTAKDLKAGGALAALLKDAIHPNLVQTLEHTPALIHGGPFANIAHGCNSVLATKLALKYGDYAVTEAGFGADLGAEKFIDIKCRMSGLRPAAVVLVATIRALKMHGGVPKADLATENVQAVVDGLPNLDKHLANIQDVYGLPVVVAINKFPLDTDAELQAVYDACDKRGVDVVISDVWANGGAGGRELAEKVVTLAEQDNQFRFVYEEDDSIETKLTKIVTKVYGGKGINLSSAAKRELADLERLGFGNYPICMAKTQYSFSDDAKKLGAPTDFTVTISNLKVSAGAGFIVALTGAIMTMPGLPKVPASETIDIDEEGNITGLF

SEQ ID NO: 9059 - DNA, 1908 bp, Streptococcus pyogenes
atgagtagagatccaacgttgacattagacgagtcaaatctcgttattggtaaggatggacgtgtgcattatacatttactgctagtcaagacaaccaaacagttagactagccagcaactgcttaggcacagcgcactttaatcagctcatgattgagcgaggggataaagcgactggctatgtggcgcctgtggttgttgagggtagcggtgagttgacaggtgtgtttaaaagtcttgaggagatgcttagtagcttgagatctattaatttagagctgacagacaccaaagactctaagctttggtcaaaaatcaagttgactaaccgtggcatgttgcaggagtactatgacggtaagatcaagactgagatagtcaactccgcacaaggtgtggctactcgtatcacagaggagactggcaaaaagctagcacttatcaatgagtctatcaacggtataaggcgagagtatcaaaacgctgataaaaagctatcagctagctatcagctgggcatagatggtctcaaagccaccatgcgtagtgataaaatcggcttacaagctgagatacaaacaaccgctcaaggcttgtatcaaaggtatgataacgagatacgcaagctgtccgctaaaataaccactacctcgtcaggcactacagaggcctatgaaagcaagctcgatggcttacgagctgagtttactcatagtaatcaaggtatgcgcgtagagctggagtcaaaaatcagtgggttgcaatcaacgcaacaagcaactgccaggcaaatctcacaagagataagtaaccgcgaaggtgctgtcagtcgtgtacaacagggcctagacagttaccaacgacgattacagtccgcagagggtaattacaatagtttgagagagactgtagcgggttatgagcgcaggatatccaatcaggataacactatctcctctaactttacacagctaaaaagcttgataaatcagtctgtgaccttaggaaaaatacagtccctcttgcggcaatctggcgacagtatcatgcttgcgattaaagacaaaatcccgcaaagtaaaatgtctggcagcgatattatctcagcgattaacttgaattcccgcggtgtgcaaatagctggtaaaaacatcgctcttgatggcaatacgacggttaatggagcttttggggctaagttaggggagtttatcaagctaagagccgaccagattatcggtgggacaatcgatgcaaacaaaatcaatgtgattaatctcaaagctagcagtattgttggtttagacgctaattttatcaaggcaagaattagctatgctatcactgatttgcttgagggtaaagttattaaggctcgtaatggtgcgatgacaatagacttgcaaagcggtcaaatcaaccattacacaaatgagtcagccatgagacgtatcgatagcagtacagctagtcagtttataaagatgacaaagtcaggctttatatctgagataggtaacatgcaagctgcaatgacggttataggctctaatagcgatgggtcagaaaaccatgaaaataaaaccttcggaggcataagaatttggaacgggaagtcatcttatcaatcgacaagttttgttgaattagttggtaaccgtgtagcaatctatggaaataaaaatcgtagtccatggctctttgactcaacaacgtcaggatatgcttaccttatccctcaaaatgacagaggtataaagcatgtcatagggagagctgatcgtaagatagaccaaatccacgttggagatatctatgtgcaaggcgaacgtgtagccatgatgttaaaagatttagcacttaaaattggctatataggtacaggtggttgggctaaccgcatagga

SEQ ID NO: 9060 - protein, 636 aa, Streptococcus pyogenes
MSRDPTLTLDESNLVIGKDGRVHYTFTASQDNQTVRLASNCLGTAHFNQLMIERGDKATGYVAPVVVEGSGELTGVFKSLEEMLSSLRSINLELTDTKDSKLWSKIKLTNRGMLQEYYDGKIKTEIVNSAQGVATRITEETGKKLALINESINGIRREYQNADKKLSASYQLGIDGLKATMRSDKIGLQAEIQTTAQGLYQRYDNEIRKLSAKITTTSSGTTEAYESKLDGLRAEFTHSNQGMRVELESKISGLQSTQQATARQISQEISNREGAVSRVQQGLDSYQRRLQSAEGNYNSLRETVAGYERRISNQDNTISSNFTQLKSLINQSVTLGKIQSLLRQSGDSIMLAIKDKIPQSKMSGSDIISAINLNSRGVQIAGKNIALDGNTTVNGAFGAKLGEFIKLRADQIIGGTIDANKINVINLKASSIVGLDANFIKARISYAITDLLEGKVIKARNGAMTIDLQSGQINHYTNESAMRRIDSSTASQFIKMTKSGFISEIGNMQAAMTVIGSNSDGSENHENKTFGGIRIWNGKSSYQSTSFVELVGNRVAIYGNKNRSPWLFDSTTSGYAYLIPQNDRGIKHVIGRADRKIDQIHVGDIYVQGERVAMMLKDLALKIGYIGTGGWANRIG

SEQ ID NO: 9061 - DNA, 1041 bp, Streptococcus pyogenes
atgaacaaaaaagtaatgtcacttggtcttgtttcgactgccctattcacattaggaggctgtaccaataactccgctaaacaaacaactgacaattcattaaaaatcgctatgattactaatcagacgggtattgatgacaagtcatttaaccagtcagcctgggaaggcttacaagcttggggaaaagaaaataaacttgaaaaaggaaaaggctatgattatttccaatcagccaatgaatcagagtttaccacaaaccttgagtcagcagtaaccaatggttataatcttgtttttgggattggatttccattacatgacgctgtagaaaaagtagccgcaaacaatcctgacaaccattttgcaattgtggatgatgtgattaaaggtcaaaaaaatgttgcaagtatcaccttttcagaccatgaagcggcatacctagccggtgttgcagcagctaaaacgacaaaaaccaagcaagttggttttgtaggtggtatggaaggagatgttgtcaagcgctttgaaaaaggttttgaagctggtgtgaaatcagtagatgataccatcaaagtaagagttgcttatgcaggctcttttgcagatgctgccaaaggcaagacgattgcagctgctcaatacgctgaaggcgcagatgttatttatcatgcagcaggaggcacaggggcgggtgtctttagcgaagctaagtctatcaacgaaaaacgtaaagaagaagataaggtttgggttattggtgttgaccgtgaccaaagtgaagatggaaaatacactacaaaagatggcaagtcagctaattttgttttgacctcaagtatcaaggaagtcggaaaagctttagtaaaagtagccgtaaaaacctcagaagaccaattcccaggtggtcaaataaccacttttggtttaaaagaaggtggtgttagccttacaacggatgctctgacacaagacactaaaaaagctattgaggctgctaaaaaagcgattatcgaaggaaccatcacagttcctgaaaac

SEQ ID NO: 9062 - protein, 347 aa, Streptococcus pyogenes
MNKKVMSLGLVSTALFTLGGCTNNSAKQTTDNSLKIAMITNQTGIDDKSFNQSAWEGLQAWGKENKLEKGKGYDYFQSANESEFTTNLESAVTNGYNLVFGIGFPLHDAVEKVAANNPDNHFAIVDDVIKGQKNVASITFSDHEAAYLAGVAAAKTTKTKQVGFVGGMEGDVVKRFEKGFEAGVKSVDDTIKVRVAYAGSFADAAKGKTIAAAQYAEGADVIYHAAGGTGAGVFSEAKSINEKRKEEDKVWVIGVDRDQSEDGKYTTKDGKSANFVLTSSIKEVGKALVKVAVKTSEDQFPGGQITTFGLKEGGVSLTTDALTQDTKKAIEAAKKAIIEGTITVPEN

SEQ ID NO: 9063 - DNA, 777 bp, Streptococcus pyogenes
atgacacatactaaagaagttgcatttatcactggtgctgcaagcggaattggaaaacaaatcggggaaaccttattaaaagaaggtaaaacggttgttttttccgacattaatcaagaaaaactggatcaggttgttgctgactatactaaagaaggctatgacgcttttagtgttgtgtgcgatgtcaccaaagaagaagccatcaatgctgctattgatacggttgttgaaaaatatggtcgtattgatattttggttaacaacgcaggtcttcaacatgttgccatgattgaagattttccaactgaaaaatttgaattcatgattaaaatcatgttgacagcaccatttattgccattaaacgtgcttttcctacaatgaaagctcaaaaacacggtcgtattattaatatggcttctatcaatggtgtcattggttttgctggcaaatccgcctacaattcagctaagcacggcttgatcggtctgaccaaagtaactgccttagaagctgctgattcaggcattacggtcaatgccatttgtcctggatatgttgacacaccactggttcgtggccagtttgaagacctttccaaaacaagaggtattccccttgaaaatgttcttgaagaagtgctatacccacttgttcctcaaaaacgcctcattgacgttcaagaaattgcagactatgtgtctttccttgccagtgataaggcaaaaggtgttacaggtcaagcctgtatcttagacggtggctacactgctcaa

SEQ ID NO: 9064 - protein, 259 aa, Streptococcus pyogenes
MTHTKEVAFITGAASGIGKQIGETLLKEGKTVVFSDINQEKLDQVVADYTKEGYDAFSVVCDVTKEEAINAAIDTVVEKYGRIDILVNNAGLQHVAMIEDFPTEKFEFMIKIMLTAPFIAIKRAFPTMKAQKHGRIINMASINGVIGFAGKSAYNSAKHGLIGLTKVTALEAADSGITVNAICPGYVDTPLVRGQFEDLSKTRGIPLENVLEEVLYPLVPQKRLIDVQEIADYVSFLASDKAKGVTGQACILDGGYTAQ

SEQ ID NO: 9065 - DNA, 1359 bp, Streptococcus pyogenes
ttggttataaatgggatgtttaaaaaatattcaataaaaaatcgtgtttggcgcgccgtcgttgaaattgtctttggagtttgtatcactgttttaatgattgcgataatatcgctttctttttcaaagttaaatatagtgacatctcataatgtgggagaagaattttatattaaagataaacagtcaatcaaacagttgaacaattatatgaagacattgggattagattatgttgtttttgatagaaaaacagataaagctatggaaggaaaatatttatctaaagaattttctttatttaacgaagttgcagaagaaaaaaataatctgacttttaattctgtacattatgatttatatactaatatcaattataatattgttataagatataatgagataccggagttctctaaccattaccttagaaatgtttcatataacatgttgacattttatattctgggaataggaacgagtatcagcattgtagttgctttaacacggtttgtaaaagaaatttctttgaatttcaaggaaatcaagaagttagcaaataaaatggggatagaagtcctttctgaaaatgaaaattattctcaaataatcgagtttgatgatatacttagaactttacatattaaaggtgataatttgaaaagtttgattgagcgagaaatattggaaaagcaagatctatcctttcaaattgcagcactttcgcatgatattaaaacacctttaacggttttaaaaggaaatcttgagttattagaattgactactttaaataaaaatcaggaaggttatattgtatctatgaacaatagtatttctgtttttgaaggctatttcaattctttaatatcttatacacgcatgctttcagaggatagatcagtgaaactaattttagttgaggagctattaagtgagttacattttgaagtcgatgacttattgaatatcaataatattgaattttctatttgtaatagacttattatcacttctttttatggagatgaggaaaatctgataagagctctttctaaccttttagttaatgcaataagatttatgcccgtattagataaaaaaatcgaagttatactgtctgagtcaggagagcaaattcattttgaaatatggaataatggtgagcgtttcagtgatagtacactgaaaaagggagataaattattttacacggaagattatagcagaggtaacaaacattatggaatcggtttggcatttgttaaaggcgttgctatcaaacacggtgggaatcttcaattgaataatccagctagaggaggtgctagcgccataatctcgataaaaaagaaaatt

SEQ ID NO: 9066 - protein, 453 aa, Streptococcus pyogenes
LVINGMFKKYSIKNRVWRAVVEIVFGVCITVLMIAIISLSFSKLNIVTSHNVGEEFYIKDKQSIKQLNNYMKTLGLDYVVFDRKTDKAMEGKYLSKEFSLFNEVAEEKNNLTFNSVHYDLYTNINYNIVIRYNEIPEFSNHYLRNVSYNMLTFYILGIGTSISIVVALTRFVKEISLNFKEIKKLANKMGIEVLSENENYSQIIEFDDILRTLHIKGDNLKSLIEREILEKQDLSFQIAALSHDIKTPLTVLKGNLELLELTTLNKNQEGYIVSMNNSISVFEGYFNSLISYTRMLSEDRSVKLILVEELLSELHFEVDDLLNINNIEFSICNRLIITSFYGDEENLIRALSNLLVNAIRFMPVLDKKIEVILSESGEQIHFEIWNNGERFSDSTLKKGDKLFYTEDYSRGNKHYGIGLAFVKGVAIKHGGNLQLNNPARGGASAIISIKKKI

SEQ ID NO: 9067 - DNA, 1140 bp, Streptococcus agalactiae
gtgactacgatgattgattttattatttctattgatgattgcgcagttgaattggatagtcgtcaatcttggaaaattcgctaccccttatcaaccattctatttcttggctttcgttggcaagtagctggcattgaaacctggaaggagatggaagattttattgaaatgaatgaaccattgtttgcgacctacgttgatttgagtgaaggttgtccgtctcatgataccttagagcgtgtgattagtcttgttaattcagaccgtttaaaagagcttaaagttcaatttgagcaatcattgacaagcttagatgccgttcatcaactgatttcagtggacggtaaaacgattcgaggcaatcgaggtaaaaatcagaagcctgttcatattgtaacggcttatgatgggggtcatcatcttagtttgggacaggtagcggttgaggagaaaagtaatgaaattgttgccatccctcagctattgcggacaattgatatccgtaaaagcattgtaacgatagacgcaatgggcacgcagacggctatcgttgatacgattataaaaggtaaagcagactattgcttagccgtcaaaggaaatcaagaaacactttatgatgatattgctctttattttagtgatgtcaacttattggaagaactccaagaaaatgcacagtattatcagactgttgaaaaatctaggggacagattgaagttagagaatactgggtgtcttccgatatcaaatggttgtgtcaaaattatcccaaatggcataagttacgtggtattgggatgactcgtaacacgattgataaggatggtcagctgagtcaagagaatcgttattttatctttagctttaagccggatgtcctcacatttgccaattgtgtacgaggtcattggcagatagagagtatgcactggttattggacgttgtttatcatgaagatcatcatcagacattggataaaagagccgcatttaacctaaatcttatccgaaaaatgtgcttatattttctcaaagtgatggtatttcctaaaaaagacctcagttatcgtcgcaaacaacggtatatttctgtccatttggaagattatttagtccaattatttggagaaagaggc

SEQ ID NO: 9068 - protein, 380 aa, Streptococcus agalactiae
VTTMIDFIISIDDCAVELDSRQSWKIRYPLSTILFLGFRWQVAGIETWKEMEDFIEMNEPLFATYVDLSEGCPSHDTLERVISLVNSDRLKELKVQFEQSLTSLDAVHQLISVDGKTIRGNRGKNQKPVHIVTAYDGGHHLSLGQVAVEEKSNEIVAIPQLLRTIDIRKSIVTIDAMGTQTAIVDTIIKGKADYCLAVKGNQETLYDDIALYFSDVNLLEELQENAQYYQTVEKSRGQIEVREYWVSSDIKWLCQNYPKWHKLRGIGMTRNTIDKDGQLSQENRYFIFSFKPDVLTFANCVRGHWQIESMHWLLDVVYHEDHHQTLDKRAAFNLNLIRKMCLYFLKVMVFPKKDLSYRRKQRYISVHLEDYLVQLFGERG

SEQ ID NO: 9069 - DNA, 1512 bp, Streptococcus pyogenes
ttgaggacaactatgaaaaaatatattttaaaccgtatcatgcgatcgttagtgtcggtagttctggtaacggctttaacatacaccatcgtatatactctagtacctaccagccttatctttaaacaagaccctaattataataaaatgacaacaacaccagataaaaaagtagcgtatgaaaatctaacttttcaacgtatgggttatgtcaattatttttcaagcaaagaattaaaagataatgcttctaaagtagatagtagtgtaacgacagaagcaactagtgctaacaaagctatctatgagaagtatattgattctcttggcaatggctggcagctaaaacgcttccccactagcaaacagttttatgcaattcgcaatattcctatttacgaacgtgtttggaactttttctcaaatctagttgttattgatcacccttggaagattcaggataaagataatccaaaattagctaggtatattcgtctagaaaaagataaatcagttggctggtcacttgttggttcggggacaaaacataagtatctcctctatactaacggaaaatttccttatcttcaccaaaactttgttaccttaaacttagggacatcttatccaacatacagcaatattcctgttcttcaggtcatttcacaagggcaaggacgaacagctcttcaagatgtgaccttcccatcaggtgtcactaagaaatcgtcagtggatatctatagccgtagctacaaaaatccaaaatcattggatgatatcaccaaggtaaactatggtaagggagattcctacactaaaaccatcaataattatgtcgacccatcaatgattcacaattcttttgtaattggtttttttggtgttatgttttcctatatcgttggtttgcctcttggtttatttatggctcggtttaaaaatacctattttgacagtttctcaacagcgaccatgaccttcatgcttgctttaccaagtattgctgttatctatgttgttcgcttcctaggtggcatggttggtttaccagatagtttcccaatgctgggggcatctgatcctaaatcttatattttaccagcccttattttaggaattttaaatattccaactacggttatctggttccgtcgctatcttgttgaccttcaggccagcgattgggtacgttttgcgcgttcaaaaggattatcagaatctgaaatttacagagggcatctcttcaaaaatgccatggtcccaattgtgtcaggggttcctgcaagtattatccttgctattggtggtgcaacattaacagagactgtctttgccttcccgggtatgggtaaaatgttaattgattctattaaatctgctaacaattctatgattgttggattaacctttatcttcactgtcttgtcaattgtttcacttttactaggagatattgtcatgacccttgtcgatccacgtattaaattgtcaacaaaaaaaggaggtaag

SEQ ID NO: 9070 - protein, 504 aa, Streptococcus pyogenes
LRTTMKKYILNRIMRSLVSVVLVTALTYTIVYTLVPTSLIFKQDPNYNKMTTTPDKKVAYENLTFQRMGYVNYFSSKELKDNASKVDSSVTTEATSANKAIYEKYIDSLGNGWQLKRFPTSKQFYAIRNIPIYERVWNFFSNLVVIDHPWKIQDKDNPKLARYIRLEKDKSVGWSLVGSGTKHKYLLYTNGKFPYLHQNFVTLNLGTSYPTYSNIPVLQVISQGQGRTALQDVTFPSGVTKKSSVDIYSRSYKNPKSLDDITKVNYGKGDSYTKTINNYVDPSMIHNSFVIGFFGVMFSYIVGLPLGLFMARFKNTYFDSFSTATMTFMLALPSIAVIYVVRFLGGMVGLPDSFPMLGASDPKSYILPALILGILNIPTTVIWFRRYLVDLQASDWVRFARSKGLSESEIYRGHLFKNAMVPIVSGVPASIILAIGGATLTETVFAFPGMGKMLIDSIKSANNSMIVGLTFIFTVLSIVSLLLGDIVMTLVDPRIKLSTKKGGK

SEQ ID NO: 9071 - DNA, 810 bp, Streptococcus pyogenes
atgaattttaaaaaaataagatttggttttttgctttgcctcctactttatcctttagcagcttgtaacaagtctgaacaacttaatcactacgaaagaattaaaaaaacaagaaaattagtcgttgctgtaagccctgattatgctccttttgaatttaaagctttagttaatggaaaagatactattgttggagcagatgttcaattagctcaggctattgctgatgaattagacgttgatcttgagctttcaccaatgagttttgataatgttttgtctagtttacagactggtaaagctgatcttgctatttcaggaatctcacatactaaagaaagagctaaagtatatgatttttcaattccttactatcaggcagaaaacgctatagtgatgagagcatctgatgctaaagtgaccaaaaatattagtgacctaaacggtaagaaagtagccgctcaaaaaggtagtatcgaggaaggtttagttaaaatacaattaccaaaggccaatctgatttctttgactgctatgggagaagccattaatgaactaaaagcaggacaagtctatgcagttaccttagaagcacctgtagctgctggttttttagcccaacataaggatctggctttagcaccctttagcttaaaaaccagtgatggagatgccaaagcagtggcccttcctaaaaatagtggagacttaaccaaagccgttaataaggttattgctaagttagatgagcaagaacggtacaagtcatttattgcagagacaatagcactaacgaaaaatactatgaag

SEQ ID NO: 9072 - protein, 270 aa, Streptococcus pyogenes
MNFKKIRFGFLLCLLLYPLAACNKSEQLNHYERIKKTRKLVVAVSPDYAPFEFKALVNGKDTIVGADVQLAQAIADELDVDLELSPMSFDNVLSSLQTGKADLAISGISHTKERAKVYDFSIPYYQAENAIVMRASDAKVTKNISDLNGKKVAAQKGSIEEGLVKIQLPKANLISLTAMGEAINELKAGQVYAVTLEAPVAAGFLAQHKDLALAPFSLKTSDGDAKAVALPKNSGDLTKAVNKVIAKLDEQERYKSFIAETIALTKNTMK

SEQ ID NO: 9073 - DNA, 597 bp, Streptococcus pyogenes
ttgaaggtgaaaaaaaggagaagaagggctaaatcatcagtaaatcgacttgtcttagggttagtattacttaatctgattgttagtatgtggacactaaaattgggaaaccagcgattagctccgtatgcggatcacgaaactctgacatttgtcaggaagattagtcatgctgctcaatcagtcgctcaaaagaaacagttatatagttcggtgatgatggctcaggccattttagaatccaataatggtaagtcacaactaagtcaaaaaccttattataattttttcgggattaaggggagctataaagaacggtcagtcatttttccaactttagaagacgatggacaagggaatctttatcaaattgatgctgcttttcgttcctatgggagcctgacagcttgttttttagattacgcaagagttttgaatgatccactttatgacaaaacccacaaaaagttttggtctcattatcaagatgctactgcaaccttaacaggcacttacgccactgatacaacttaccataccaaattaaatgaattgattgaatggtatcaactcactaattttgatggtctaatgaaa

SEQ ID NO: 9074 - protein, 199 aa, Streptococcus pyogenes
LKVKKRRRRAKSSVNRLVLGLVLLNLIVSMWTLKLGNQRLAPYADHETLTFVRKISHAAQSVAQKKQLYSSVMMAQAILESNNGKSQLSQKPYYNFFGIKGSYKERSVIFPTLEDDGQGNLYQIDAAFRSYGSLTACFLDYARVLNDPLYDKTHKKFWSHYQDATATLTGTYATDTTYHTKLNELIEWYQLTNFDGLMK

SEQ ID NO: 9075 - DNA, 1200 bp, Streptococcus pyogenes
atgacctttttagataaaattaaacaaggctgtttagatggctgggctaagtacaaaatcttgccatccttgaccgcagcacaagctatcttagagagcgggtggggcaaacatgccccacacaacgctctgtttggtattaaggcagatagctcttggactggtaaatcatttgataccaaaacccaagaggaatatcaagcaggtgttgtcacggatattgtggaccgatttagggcgtatgatagttgggatgagtcgatagctgatcacggacaatttttagttgataatccacgctatgaggcagttattggggagactgactataaaaaggcttgttacgctattaaagcagctggatacgctacggcaagtagctatgtcgaacttttaatccaactgattgaggaaaacgacttacaaagttgggatagagaagctcttaaaaataataaggaggaaacgatgacaaccgcaaacgaaattgtacaatactgtgttaaccttgctaattcaggcatgggtgttgacaaagacggtgctcacgggacgcaatgctgtgacttgccttgttttgtcgctaaaaattggtttggtgttgatctttggggcaatgcgattgatttattagacagcgcaagtgcgcaaggctgggaagtccatcgtatgccaacagaggcaaacccaaaagcaggcgctacatttgtccaatcagtgccgtatcatcaatttggacatacgggaattgttatcgaggatagtgacggttacaccatgcgcactgtcgagcaaaacattgatggcaatcctgatgctttgtatgtcggtgcaccagctcgttttaacactcgtgactttactggcgtgataggttggttttacccaccatatcaaggggatacagtcacgcaaccagtcagcaccgagccgcaaacttctgacactatcgtagagacagcaaaaacaggcacctttacccttgatgttgcagagatcaatatcagacgctggccaagtctagccagcgaggttgtaggtatctacaagcaaggtgatactgtcagctttgatagcgagggctacgctaatggctattattggattagctatgttggaggctcaggtatgcgtaactacctaggtattggacagactgataaagatgggaatcgcatcagcctttggggtaaattaaat

SEQ ID NO: 9076 - protein, 400 aa, Streptococcus pyogenes
MTFLDKIKQGCLDGWAKYKILPSLTAAQAILESGWGKHAPHNALFGIKADSSWTGKSFDTKTQEEYQAGVVTDIVDRFRAYDSWDESIADHGQFLVDNPRYEAVIGETDYKKACYAIKAAGYATASSYVELLIQLIEENDLQSWDREALKNNKEETMTTANEIVQYCVNLANSGMGVDKDGAHGTQCCDLPCFVAKNWFGVDLWGNAIDLLDSASAQGWEVHRMPTEANPKAGATFVQSVPYHQFGHTGIVIEDSDGYTMRTVEQNIDGNPDALYVGAPARFNTRDFTGVIGWFYPPYQGDTVTQPVSTEPQTSDTIVETAKTGTFTLDVAEINIRRWPSLASEVVGIYKQGDTVSFDSEGYANGYYWISYVGGSGMRNYLGIGQTDKDGNRISLWGKLN

SEQ ID NO: 9077 - DNA, 444 bp, Streptococcus pyogenes
ttgataatggaagaaatcacgatttatcataatccaaactgtggcacttcacgtaatgttcttgccatgattcgccatgcaggtattgagcctactattattgagtatttgcagacgccacctaatcgggagactttaattgagctcttacaatcgatgggaatctctgcaagagaactcttgcgaaccaatgttcctgaatttgaggcttatggattagcaaatcaagcagtagctgagaaagacattattaatgccatgttggcggatccaattttgatcaatcgtcctattgttgtgactcgcaaaggagtaaaactttgccgtccttctgagaccttactggatattcttcctgttcccctgcctagtccttatattaaagaggatggcgagagtgtgaaccctattgaggtaaaaggagaaaaagatgtcattgatgac

SEQ ID NO: 9078 - protein, 148 aa, Streptococcus pyogenes
LIMEEITIYHNPNCGTSRNVLAMIRHAGIEPTIIEYLQTPPNRETLIELLQSMGISARELLRTNVPEFEAYGLANQAVAEKDIINAMLADPILINRPIVVTRKGVKLCRPSETLLDILPVPLPSPYIKEDGESVNPIEVKGEKDVIDD

SEQ ID NO: 9079 - DNA, 1458 bp, Streptococcus pyogenes
atgaaatttacaatcattactaactatgatacacttagtagaaaatcatttactatagaaggtgataacatgactatttttcgtaaaaaaaagaaatattccaataaaacagaaatgcaaaggcacttcaaagttattgatttagtttttttaggcctaggttcaatggttggaacaggtatctttacagttactggcataggcgctgctaagtatgcaggtcctgctttaacaatatcgattatcatttccgcgattgctattggaattttagccttattttatgcagaatttgcgtctcgtatgccttctaacggtggtgcttatagttatgtttatgcaaccttgggagagtttccagcatggcttgttggctggtatattattatggaatttttaacagctatatctagtgttgctgttggctggggaagttatttaaaaggattacttgccaattataatatagtattaccaaacgctttaaatggcacgttcaatcttaagaatggaacttacatagatattcttcctgttttagtgatgtttttcgtgacagggattgtcctaatgaattcgaaattagccctgagattcaatagttttttagttattttaaaattttcagcactggctttatttatctttgtaggcattttttttattgatcacaataattggtctcattttgctccatatggtgtaggacaaattactggaggtaaaacaggtatctttgctggtgcttctgttatgttctttgcatttttaggatttgaatctatttcaatggcagttgatgaagtgaaagaaccacaaaaaacaatccctaaaggcatcattttatctttgattattgtaacagcactctatatagttgtcaccactattttaacgggaattgtacactacactaaattaaatgttccagacgcggtggcttttgctttaagaaatattagactttattgggcagctgactatgtgtcgatagttgctattttgactcttattacggtatgtatttctatgacctatgcattagctagaacaatttacagtattagtagagatggtttattacctaaatcactttatactctcactaaaaaaaataaagtgcctcaaaatgctactcttgtcactggactacttgctatgatttgtgcgggaatatttcctttatcgagtctagcagagtttgttaatatttgtactttagcatatttaattattctgtcgggtgcaattattaaactcagaagaatagaaggagaaccaaaagcaaatgaatttaaaactcctctagtaccattcctaccaatgttggcaattatcatttgtctatcatttatgagccaatataaagcttttacttggattgcttttgctattgccacaattattggaacattaatctacttagcttatggttatactcattcaatagaaaataaa

SEQ ID NO: 9080 - protein, 486 aa, Streptococcus pyogenes
MKFTIITNYDTLSRKSFTIEGDNMTIFRKKKKYSNKTEMQRHFKVIDLVFLGLGSMVGTGIFTVTGIGAAKYAGPALTISIIISAIAIGILALFYAEFASRMPSNGGAYSYVYATLGEFPAWLVGWYIIMEFLTAISSVAVGWGSYLKGLLANYNIVLPNALNGTFNLKNGTYIDILPVLVMFFVTGIVLMNSKLALRFNSFLVILKFSALALFIFVGIFFIDHNNWSHFAPYGVGQITGGKTGIFAGASVMFFAFLGFESISMAVDEVKEPQKTIPKGIILSLIIVTALYIVVTTILTGIVHYTKLNVPDAVAFALRNIRLYWAADYVSIVAILTLITVCISMTYALARTIYSISRDGLLPKSLYTLTKKNKVPQNATLVTGLLAMICAGIFPLSSLAEFVNICTLAYLIILSGAIIKLRRIEGEPKANEFKTPLVPFLPMLAIIICLSFMSQYKAFTWIAFAIATIIGTLIYLAYGYTHSIENK

SEQ ID NO: 9081 - DNA, 1125 bp, Streptococcus pyogenes
atggttttatttcatttaatcaaaaaagaaagtttacagatttttagaaaccgaacagccttattgatgatggtgatttttccaattttgatgatcgttattttaagttttgcctttaaatcaagttttaatactgcgacaacagtccctaaattgaccattcgttaccaattagagggtgaaaaaacggattaccagaaaaattttcttgcttttttaaaagttttaaaccaaaaacttcatttagagactaaacctagtaattctcttgaaaaagatcgacaaagggtcagtgaaggagccttaacggctgttttagaagtgaagaagaatcagaccattaaggttattactaataatattaatcagcaaaatgcagatttgatcaatatgctagtaaaaaattatgttgataatgctaaaacttatgactcgatagcagctctttatcctcaacaattaaatcatatcagaaagcgaagtgtggactatgttaaggtcagttcaatacagacaagtaaaggaatgacatcagctgattattatgctatttccatgtttaccatgattactttttatagtatgatgtctgcgatgaaccttgttttgtcagatcgtcaacaacggattacaaatcgtattcacttaacaggagtttctccaagttttttggtctttgggaaattaataggtgctatgttagcaacaactgttcaattgagtcttttatacatttttacaaggtttgttttacgagttaattggggcactaatgagtggatgcttattggtataacagcctccttagtctatctctctgtagctataggtatcgggctaggtataagcattaaaaatgaggcttttttaacggttgcatccaatactattattcctatattcgcctttttaggaggcagttacgttccattgacaacattacacagctctattattaatcaattgtcgaatatatctcctattaaatgggttaatgatagtttgttctatcttatttttggtggtcaatataatccgattcctgtaactttgatcgttaatattagtatcggaacaatttttataatattggcattgataggtatgagaaagcaggtgacgaca

SEQ ID NO: 9082 - protein, 375 aa, Streptococcus pyogenes
MVLFHLIKKESLQIFRNRTALLMMVIFPILMIVILSFAFKSSFNTATTVPKLTIRYQLEGEKTDYQKNFLAFLKVLNQKLHLETKPSNSLEKDRQRVSEGALTAVLEVKKNQTIKVITNNINQQNADLINMLVKNYVDNAKTYDSIAALYPQQLNHIRKRSVDYVKVSSIQTSKGMTSADYYAISMFTMITFYSMMSAMNLVLSDRQQRITNRIHLTGVSPSFLVFGKLIGAMLATTVQLSLLYIFTRFVLRVNWGTNEWMLIGITASLVYLSVAIGIGLGISIKNEAFLTVASNTIIPIFAFLGGSYVPLTTLHSSIINQLSNISPIKWVNDSLFYLIFGGQYNPIPVTLIVNISIGTIFIILALIGMRKQVTT

SEQ ID NO: 9083 - DNA, 339 bp, Streptococcus pyogenes
atgacacagttattaaaacgatatcctattactattttccttttagggttaacaggcttaatttttatagcaatgcaagtggtatatggacatttagcaactggtgctcaagctatttatcaagttggaggtatgtttggattactagtaaaagcaatgccagaccagttgtggcgattggtgactccgatatttattcatatcggctttggtcatttttttgtcaatggattaacactatattttgttggtcaaatcgtcgaagacctctggggctcacgccttttttattactttatgttttatcaggtgttatgggcaatgcctttactttttggt

SEQ ID NO: 9084 - protein, 113 aa, Streptococcus pyogenes
MTQLLKRYPITIFLLGLTGLIFIAMQVVYGHLATGAQAIYQVGGMFGLLVKAMPDQLWRLVTPIFIHIGFGHFFVNGLTLYFVGQIVEDLWGSRLFYYFMFYQVLWAMPLLFG

SEQ ID NO: 9085 - DNA, 1203 bp, Streptococcus pyogenes
atgattaatagagaaattgcagtaaaagtacagcatgttagtaaaacgtttaaactgcctacagaagcaactaaaagttttcgcacgactctggttaatcgcctaagagggattaaaggatttactgaacaacatgtgctaaaagatattaactttgatgtttataaaggcgatttttttggaattgttgggcgtaacggctcaggaaaatcaacgctccttaaaattatttcccagatctatgttccagaaaaagggcaggttacagtagatgggaagatggtttcttttatagagcttggagtgggattcaatccagaattaacaggacgagaaaacgtctatatgaacggcgccatgctgggatttaccaaagacgaagttgatgatatgtacaatgatattgttgattttgcagagttgcatcattttatgaatcaaaaattaaaaaattattcttctggcatgcaggtacgtttagcattttcagtggctattaaagcccaaggtgacgttcttattttagatgaggtgcttgctgtaggagatgaagcttttcagcgaaaatgtaatgattattttatggaaagaaaagacagtggtaagacgactattttagtgacacatgatatgggagctgttaagaagtattgtaaccgtgcagttcttattgaagatggtcttgttaaagcatatggagaaccatttgatgttgctaatcagtatagtgtagataatacagagacagctgaggatgcaatgaatgctgaaaaaatatctgtatctgatattgccaaagatttgaaagtgtcattaatctcaaatccaagaataacaccaaatgacacaatcacatttgaagtttcttatgaagttttaaaagatgattttacctacattgccttttctttaacggatattgatagaaacatttgggtttacaacgacaattctttagattatccaacacaaggtataggtagaaaatgcatttcctaccaatgtcaactatctcaacttaatgatataaaactaaaattagaagtaactgtccgagataagaacggtcagatgctactcttttcaacagcagaacaatcaccccagatagtgattcaaagaaacgatattgatcaagatgatctgtcagctctagattcagcaagtggcttgtatcaacgtaatgggaagtgggtttttcat

SEQ ID NO: 9086 - protein, 401 aa, Streptococcus pyogenes
MINREIAVKVQHVSKTFKLPTEATKSFRTTLVNRLRGIKGFTEQHVLKDINFDVYKGDFFGIVGRNGSGKSTLLKIISQIYVPEKGQVTVDGKMVSFIELGVGFNPELTGRENVYMNGAMLGFTKDEVDDMYNDIVDFAELHHFMNQKLKNYSSGMQVRLAFSVAIKAQGDVLILDEVLAVGDEAFQRKCNDYFMERKDSGKTTILVTHDMGAVKKYCNRAVLIEDGLVKAYGEPFDVANQYSVDNTETAEDAMNAEKISVSDIAKDLKVSLISNPRITPNDTITFEVSYEVLKDDFTYIAFSLTDIDRNIWVYNDNSLDYPTQGIGRKCISYQCQLSQLNDIKLKLEVTVRDKNGQMLLFSTAEQSPQIVIQRNDIDQDDLSALDSASGLYQRNGKWVFH

SEQ ID NO: 9087 - DNA, 456 bp, Streptococcus pyogenes
atgcgcagtattatcagactgttgaaaaatctagaagttagagaatactgggtgtcttccgatatcaaatggttgtgtcaaaaccatcccaaatggcataagttacgtggtattgggatgactcgtaacacgattgataaggatggtcagctgagtcaagagaatcgttattttatctttagctttaagccggatgtcctcacatttgccaattgtgtacgaggtcattggcagatagagagtatgcactggttattggacgttgtttatcatgaagatcatcatcagacattggataaaagagccgcatttaacctaaatcttatccgaaaaatgtgcttatattttctcaaagtgatggtatttcctaaaaaagacctcagttatcgtcgcaaacaacggtatatttctgtccatttggaagattatttagtccaattatttggagaaagaggt

SEQ ID NO: 9088 - protein, 152 aa, Streptococcus pyogenes
MRSIIRLLKNLEVREYWVSSDIKWLCQNHPKWHKLRGIGMTRNTIDKDGQLSQENRYFIFSFKPDVLTFANCVRGHWQIESMHWLLDVVYHEDHHQTLDKRAAFNLNLIRKMCLYFLKVMVFPKKDLSYRRKQRYISVHLEDYLVQLFGERG

SEQ ID NO: 9089 - DNA, 711 bp, Streptococcus pyogenes
gtgactacgatgattgattttattatttctattgatgattgcgcagttgaattggatagtcgtcaatcttggaaaattcgctaccccttatcaaccattctatttcttgtcttcgtttgtcagttagctggcattgaaacctggaaggagatggaagattttattgaaatgaatgaaccattgtttgcgacctacgttgatttgagtgaaggttgtccgtctcatgataccttagagcgtgtgattagtcttgttaattcagaccgtttaaaagagcttaaagttcaatttgagcaatcattgacaagcttagatgccgttcatcaactgatttcagtggacggtaaaacgattcgaggcaatcgaggtaaaaatcagaagcctgttcatattgtaacggcttatgatgggggtcatcatcttagtttgggacaggtagcggttgaggagaaaagtaatgaaattgttgccatccctcagctattgcggacaattgatatccgtaaaagcattgtaacgatagacgcaatgggcacgcagacggctatcgttgatacgattataaaaggtaaagcagactattgcttagccgtcaaaggaaatcaagaaacactttatgatgatattgctctttattttagtgatgtcaacttattggaagaactccaagaaaatgcgcagtattatcagactgttgaaaaatctagaagt

SEQ ID NO: 9090 - protein, 237 aa, Streptococcus pyogenes
VTTMIDFIISIDDCAVELDSRQSWKIRYPLSTILFLVFVCQLAGIETWKEMEDFIEMNEPLFATYVDLSEGCPSHDTLERVISLVNSDRLKELKVQFEQSLTSLDAVHQLISVDGKTIRGNRGKNQKPVHIVTAYDGGHHLSLGQVAVEEKSNEIVAIPQLLRTIDIRKSIVTIDAMGTQTAIVDTIIKGKADYCLAVKGNQETLYDDIALYFSDVNLLEELQENAQYYQTVEKSRS

SEQ ID NO: 9091 - DNA, 1341 bp, Streptococcus agalactiae
atgagaaacaaaaaagtaacattagctcatattgtcgcaaagacaagtgttgctattgctttggctggagcaatgggtagcagtttattagctaatagcacaacgtacgctgttagtggcaaagaaaataaaaaaagcgatgtcaaatatgaaacgaccaaagttatggaagctaacgcaacttcctctaaagaagacaatcatgtcatgcacacattagacggctcaatgagtactgtctgggaggaaaattcacctggtggtggtgttggtgaagtactttcctacaagtttgcgtccccgatgcatattgggagaattttaattgttaatggagatacatctagcaaggagaattactacaagaaaaatagaattgcaaaggctgatgttaaatactataacaggaataaattggtcctctttcaaaaaattgaattaggcgacacctacactaaaaaaccgcatcacattgagattgataaaaaattagatgttgatcgtattgatattgaggtaacagaggtccatcagggacaaaacaaggatattttagccttgtcagaggtcacttttggcaatatagaacgcgatatttttgaaaaaaagtttaaagaaattaaagataaatgggtaacagataaacaagcagatgagtttattgaaactgccgacaagtatgctgataaagctgttcagatgtctgctgttgcgtcacgtgctgagtattatcggatgtacgttagccgcaaataccactacaaaaaagagtttgttgaaaaactaaaacaagtctacaaagaaagcggagcttcccacgttacaagcaaaaaagatgtgatgttagcttttgacgatgctaaaaaaaagtcaacgattggtcgacaagaaaacggtctttttgtgacaagttttgctgaggatatggctttgctctttactgatcaaggtaagttaaaatcagctgaccaaattgaaaatataaaagatgtcgatagcggaaaatatagcgatggggtttatcaatatgagtacgattctgaactaacaaaaaacattgataagctaggctatatccgaacagctagcggagatactcctggagcaaattcgctcaacgttcctggttgccaaacgtggtcaggaaaacacattgaaaattcagaaagtgaattaattttcccatcgattagtgttaaagatctaaaatctaaagctgtcttagcagagattgatgccaaaggctattttgaaattattgatcctaccatcattgctccaaatggtgaccataaaaaagtaactggtcgcttcaaaattaagaaaatgcaagataggaag

SEQ ID NO: 9092 - protein, 447 aa, Streptococcus agalactiae
MRNKKVTLAHIVAKTSVAIALAGAMGSSLLANSTTYAVSGKENKKSDVKYETTKVMEANATSSKEDNHVMHTLDGSMSTVWEENSPGGGVGEVLSYKFASPMHIGRILIVNGDTSSKENYYKKNRIAKADVKYYNRNKLVLFQKIELGDTYTKKPHHIEIDKKLDVDRIDIEVTEVHQGQNKDILALSEVTFGNIERDIFEKKFKEIKDKWVTDKQADEFIETADKYADKAVQMSAVASRAEYYRMYVSRKYHYKKEFVEKLKQVYKESGASHVTSKKDVMLAFDDAKKKSTIGRQENGLFVTSFAEDMALLFTDQGKLKSADQIENIKDVDSGKYSDGVYQYEYDSELTKNIDKLGYIRTASGDTPGANSLNVPGCQTWSGKHIENSESELIFPSISVKDLKSKAVLAEIDAKGYFEIIDPTIIAPNGDHKKVTGRFKIKKMQDRK

SEQ ID NO: 9093 - DNA, 828 bp, Streptococcus agalactiae
atgcctaaaaaccaccgcctaattaccaaaatcgaagcatcattggaacatatgaccagtttagaaaaagggattgctcatttttttattacaaccgatctgacacctcaagagttgaccgcatccgagatagttaagcgactacacatctctcaagccgccttgactcgatttgcaaaaaaatgtggttttactggttatcgtgcttttgcctttgattaccttcacagtcttcaagaatcacaagagactttccaatctattcacttagaattgacaaagcgcgtgctgatggactacgacgctcttattaataaaacctatgagctcgttaatgaggaaaaattactgaacttagccaagctgatcgattcttctgagcgagtctatttctttggcaaaggatcttctggactagtagcaagagaaatgaagctacgctttatgcgacttggtttaatctgtgatgcttattcagacactgatggttttacttgggcaaatagcctcgtcaatgaaaattgccttgtttttggtttttctttatctggcaaaacaaactctgtcatcacagcacttcatcaagctagtcagcgaggagccaaaactgtcctcttaacaacagataatcaaaccgaatttgacgactccttagatattattcccgtatcatcaactcaccaactacattatgggaatcgtgtgtcaccacaatttcctcttcttattatgatggacattatttatgcttacgttttagcgattgacaaaccgcacaaagaaaaaatcttcaaaaacactattattgacaaagaaaataacgacctt

SEQ ID NO: 9094 - protein, 276 aa, Streptococcus agalactiae
MPKNHRLITKIEASLEHMTSLEKGIAHFFITTDLTPQELTASEIVKRLHISQAALTRFAKKCGFTGYRAFAFDYLHSLQESQETFQSIHLELTKRVLMDYDALINKTYELVNEEKLLNLAKLIDSSERVYFFGKGSSGLVAREMKLRFMRLGLICDAYSDTDGFTWANSLVNENCLVFGFSLSGKTNSVITALHQASQRGAKTVLLTTDNQTEFDDSLDIIPVSSTHQLHYGNRVSPQFPLLIMMDIIYAYVLAIDKPHKEKIFKNTIIDKENNDL

SEQ ID NO: 9095 - DNA, 1008 bp, Streptococcus pyogenes
atggtagttaaagttggtattaacggtttcggtcgtatcggacgtcttgcattccgccgtattcaaaacatcgaaggtgttgaagtaactcgtatcaatgaccttacagatccaaatatgcttgcacacttgttgaaatacgatacaactcaaggtcgttttgatggaacagttgaagttaaagaaggtggatttgaagtaaacggaaacttcatcaaagtttctgctgaacgtgatccagaaaacatcgactgggcaactgatggggttgaaatcgttcttgaagcaactggtttctttgctaaaaaagaagcagctgaaaaacacttacatgctaacggtgctaaaaaagttgttatcacagctcctggtggaaacgatgttaaaacagttgttttcaacactaaccacgacattcttgacggtactgaaacagttatctcaggtgcttcatgtactacaaactgtttagctcctatggctaaagctcttcacgatgcattcggtattcaaaaaggtcttatgactacaatccacgcttacactggtgaccaaatgatccttgacggaccacaccgtggtggtgaccttcgtcgtgcacgcgctggtgctgcaaatatcgttcctaactcaactggtgctgctaaagctatcggtcttgttatcccagaacttaacggtaaacttgacggtgctgcacaacgtgttcctgttccaactggatcagtaactgagttggttgtaactcttgacaaaaacgtttctgttgacgaaatcaacgctgctatgaaagctgcttcaaacgatagcttcggttacactgaagatccaatcgtttcttcagatatcgtaggcgtatcatacggttcattgtttgacgcaactcaaactaaagtaatggaagttgacggatcacaattggttaaagttgtatcatggtatgacaacgaaatgtcttacactgctcaacttgtacgtactcttgagtacttcgcaaaaattgctaaa

SEQ ID NO: 9096 - protein, 336 aa, Streptococcus pyogenes
MVVKVGINGFGRIGRLAFRRIQNIEGVEVTRINDLTDPNMLAHLLKYDTTQGRFDGTVEVKEGGFEVNGNFIKVSAERDPENIDWATDGVEIVLEATGFFAKKEAAEKHLHANGAKKVVITAPGGNDVKTVVFNTNHDILDGTETVISGASCTTNCLAPMAKALHDAFGIQKGLMTTIHAYTGDQMILDGPHRGGDLRRARAGAANIVPNSTGAAKAIGLVIPELNGKLDGAAQRVPVPTGSVTELVVTLDKNVSVDEINAAMKAASNDSFGYTEDPIVSSDIVGVSYGSLFDATQTKVMEVDGSQLVKVVSWYDNEMSYTAQLVRTLEYFAKIAK

SEQ ID NO: 9097 - DNA, 861 bp, Streptococcus pyogenes
atgaagaaatcagttacattactgtctatcggacttgccagccttttattggcagcatgtgcgccacatcaatctcaaaaatcaagttgggacactatcaaagaaaaaggggtgttaaaagtagctaccccaggaacctatcagccaacttctttttacaacgataataatgagttagtaggttacgaagtagatatggtcaaagaaatcggtaaacgacttaacattaaagtcaagtttgttgaaacaggatttgaccaagcctttacctcagttgatagtggtcgagtggatatttctttgaacaactttgacattaccccaaaacgtcagaaaaaatacaatatctctacgccttataaatacggggtaggaggcatgattgtccgtgctgatggcagctcaaacatagctaaaaaagatcttagcgactggaaaggaaaaaaagcagccggcgcttctggaacagaatacatgaaagtagcgcaaaaacagggagctgaactggtgacctacgataatgttacaggagatgtttatctaaacgatgtggctaacggtcgaacagatttcatcccaaatgattacccagctcaaaaattatttgtggattacatgttatctcaaaatccaaatctaaatgtcaaaatgagcgatgttcagtacaacccaaccgaacaaggaattgttatgaacaaaaaagacgatagcctcaagaaaaaaatagatgctgttattaaagacatgataaaagatggtagcttgaagaaaatctctgaaacctactatgctggtcaagatctgacaaaaccttttggcaaagacaaaaaaattcccgtcattgatacgaaagacgttaac

SEQ ID NO: 9098 - protein, 287 aa, Streptococcus pyogenes
MKKSVTLLSIGLASLLLAACAPHQSQKSSWDTIKEKGVLKVATPGTYQPTSFYNDNNELVGYEVDMVKEIGKRLNIKVKFVETGFDQAFTSVDSGRVDISLNNFDITPKRQKKYNISTPYKYGVGGMIVRADGSSNIAKKDLSDWKGKKAAGASGTEYMKVAQKQGAELVTYDNVTGDVYLNDVANGRTDFIPNDYPAQKLFVDYMLSQNPNLNVKMSDVQYNPTEQGIVMNKKDDSLKKKIDAVIKDMIKDGSLKKISETYYAGQDLTKPFGKDKKIPVIDTKDVN

SEQ ID NO: 9099 - DNA, 2415 bp, Streptococcus pyogenes
gtgaatacttatttttgcacacaccataaacaattactactttattcaaacctattccttagctttgctatgatgggccaaggaactgccatttatgccgatacactgacttcaaattcagaacctaataatacttactttcaaacgcaaacgctcactactacagatagcgaaaaaaaggtagtacagccacaacaaaaagactactatactgaattgttagaccaatggaacagtattatcgcaggcaacgatgcttatgataaaaccaatcctgacatggtcacttttcataataaagctgaaaaggatgctcaaaacattattaaaagctatcaagggcctgaccacgaaaatagaacttacctttgggaacatgcaaaggattattccgcttctgctaatatcacgaaaacttaccgcaatattgaaaaaatagcaaaacagatcactaatcctgaatcatgctattatcaagatagtaaagctattgctattgtaaaagacggtatggccttcatgtatgaacacgcttataatctagatcgtgaaaatcatcaaacaactggaaaagaaaacaaagaaaattggtgggtttatgaaattggaactcctcgtgctattaataataccttatccttgatgtatccttattttactcaagaagaaattcttaaatacacagctccaatcgaaaaatttgtgcctgaccctactcgttttagggttcgcgctgccaatttttcaccttttgaagccaatagcggaaatttaattgatatggggcgtgttaaactcatttccggtattcttcgtaaagatgatctcgaaattagtgatacaatcaaagcaattgagaaagttttcacgctagttgatgaaggaaatggtttttaccaagacggttctttaattgatcacgtggttactaacgctcaaagtccactttataaaaaaggcattgcttacactggagcttacggtaatgtgcttatagatggcttatcgcaattaattcctattattcaaaaaacaaagtctcctataaaagcggataaaatggctactatctatcattggattaaccattcttttttccctatcatcgttcgtggagaaatgatggatatgactcgagggcgttctatcagtcgttttaatgcccaatctcatgttgctggcattgaagcacttcgtgctattttacgtattgctgacatgtctgaagagcctcaccgtttggcacttaaaacacgtataaaaacactcgtcacacaagggaatgctttttacaatgtctatgataatttgaaaacctatcacgatatcaaacttatgaaagaactactaagtgatacttctgttccagtccaaaaacttgatagttacgtagctagtttcaatagtatggataaattggcactatataataataaacacgattttgcttttggcctatcaatgttttcgaatcgaactcaaaattatgaagctatgaataatgaaaatcttcatggctggtttacttctgatggaatgttttacctatacaataacgatttaggacactacagtgaaaactattgggcaacggtaaatccctaccgcttacctggaaccacagaaactgagcaaaaaccactagagggaactcctgagaatattaaaacgaactatcaacaagttggcatgactggtctctctgatgacgcttttgttgcaagtaaaaaacttaataacacaagtgctctagctgctatgaccttcactaattggaataaaagcctcaccctcaataaagggtggtttatcttaggaaacaaaataatctttgttggtagcaatatcaaaaaccaatcatctcacaaggcgtatacaactattgaacaacgaaaagaaaatcaaaagtacccttactgttcttatgttaacaatcaacccgttgacttgaataatcagctagttgattttacaaacactaaaagtattttccttgaaagtgatgatcccgctcaaaatattggttactacttcttcaagccaacaacacttagcataagtaaggcacttcaaacagggaaatggcaaaacataaaagctgatgacaaatcaccagaagccatcaaagaagtttcaaatacctttatcactatcatgcaaaaccatactcaagatggcgatcgttatgcctatatgatgcttccaaatatgactcgtcaagaatttgaaacctatattagcaagcttgatatcgacttattagaaaacaatgacaaactggccgctgtctacgatcatgatagtcaacagatgcacgtcattcactatggaaaaaaagcaacgatgttttcaaatcataatctttctcatcaaggcttttatagttttcctcatcctgtcaggcaaaatcaacaa

SEQ ID NO: 9100 - protein, 805 aa, Streptococcus pyogenes
VNTYFCTHHKQLLLYSNLFLSFAMMGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLWEHAKDYSASANITKTYRNIEKIAKQITNPESCYYQDSKAIAIVKDGMAFMYEHAYNLDRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIKADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTGLSDDAFVASKKLNNTSALAAMTFTNWNKSLTLNKGWFILGNKIIFVGSNIKNQSSHKAYTTIEQRKENQKYPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYGKKATMFSNHNLSHQGFYSFPHPVRQNQQ

SEQ ID NO: 9101 - DNA, 552 bp, Streptococcus pyogenes
atgctaaaacgccccattcatctctcgcatgattttttagcggaggttgtggataagtctagtgtggttgttgatgccacgatgggtaatggaaatgatactgcctttttggcacaattagctaaaaaggtttatgcttttgatgtgcaagaacaagctattagaaaaacaagtgagcggttagcgcagctaggattatcgaacgctgagctgattttagcgggtcatgaagcggttgatcagtatgtgacagagccggtgcgcgcagcgatttttaaccttggttatttgcccagcgcagataaatctattattaccttaccaaataccacactccaagctttatcaaaactactaacgttattaatggtaggtgggcgtattgctattatggtctattatgggcatgatggaggcagtttggaaaaagatgctttattagattttgtcaagcaattagaccaaagaaaggtttctgcaatgctttatcagcctcttaatcaggtgaataccccaccttttttaatcatgttggagaaattagcagacttt

SEQ ID NO: 9102 - protein, 184 aa, Streptococcus pyogenes
MLKRPIHLSHDFLAEVVDKSSVVVDATMGNGNDTAFLAQLAKKVYAFDVQEQAIRKTSERLAQLGLSNAELILAGHEAVDQYVTEPVRAAIFNLGYLPSADKSIITLPNTTLQALSKLLTLLMVGGRIAIMVYYGHDGGSLEKDALLDFVKQLDQRKVSAMLYQPLNQVNTPPFLIMLEKLADF

SEQ ID NO: 9103 - DNA, 933 bp, Streptococcus pyogenes
atgtcaaaaattttagtttttggtcatcaaaatcctgatacggatgctattgcatcatcttatgcttttgattacttatcccaaaaagcgtttggtttggatactgaagtcgtagctttaggaacacctaacgaagaaacagcttttgcccttgattattttggtgttgaggcaccacgtgtggtagagtctgctaaagcacaagggtctgaacaagtgattttgacagaccacaatgaattccaacaatccattgcagatatccgtgaggttgaggtatatggtgtggttgatcaccaccgtgtggctaattttgaaactgcaaatcctttatacatgcgtgtggaaccagtaggatcagcctcatctattgtttaccgtatgtttaaagaaaatggcatcgaggtgccaaaagcgattgcagggatgctcttgtctggtttgatttcagataccttgttgttgaaatctccaacaactcatgtgtctgatcaccttgtcgctgaagaattggcagagctggcagaagtgaacttggaagactatggaatggctcttttaaaagcaggtacaaaccttgcaagcaaatcagaagtagaattgattggtattgatgccaaaacatttgaattaaatggcaatgctgtgcgcgtggcacaagtgaacactgttgacattgcagaagtcttagaacgtcaagaagctattgaagcagccattaaagatgccatggctgcagaaggttattcagattttgttttgatgatcacggatattgttaactcaaactctgaaattctagctattggagcaaacatggacaaggttgaagcagcctttaacttcacccttgacaacaatcatgccttcttagcaggtgccgtttctcgtaaaaaacaagtggttccacaattgacagaaagttttggagct

SEQ ID NO: 9104 - protein, 311 aa, Streptococcus pyogenes
MSKILVFGHQNPDTDAIASSYAFDYLSQKAFGLDTEVVALGTPNEETAFALDYFGVEAPRVVESAKAQGSEQVILTDHNEFQQSIADIREVEVYGVVDHHRVANFETANPLYMRVEPVGSASSIVYRMFKENGIEVPKAIAGMLLSGLISDTLLLKSPTTHVSDHLVAEELAELAEVNLEDYGMALLKAGTNLASKSEVELIGIDAKTFELNGNAVRVAQVNTVDIAEVLERQEAIEAAIKDAMAAEGYSDFVLMITDIVNSNSEILAIGANMDKVEAAFNFTLDNNHAFLAGAVSRKKQVVPQLTESFGA

SEQ ID NO: 9105 - DNA, 750 bp, Streptococcus pyogenes
atgctaaaaaagcgctatcaactggctattgtccttcttcttagctgttttagtctgatctggcaaactgagggcttggtcgagctttttgtctgtgagcactatgagcgggcggtttgtgaggggacgcctgcttattttaccttttcggatcaaaagggcgctgagacactgattaaaaagcgatggggcaagggtctcatctacccaagggctgagcaagaggcgatggctgcttatacctgtcagcaggcaggccctatcaacaccagcctagacaaagccaaaggtgagctcagccaactcacgcctgagctaagggatcaggtggcccagctcgatgctgcgactcaccggctagtcatcccgtggaacattgtagtataccgctatgtatacgagacgtttttgcgtgatatcggtgtttcacatgctgatctcacgtcttactaccgtaaccatcagtttgaccctcatatcctttgtaagatcaagcttggtacacgctacaccaagcacagttttatgagcacgacagccttgaaaaacggcgccatgacccatcgaccggtggaggtgcgcatctgtgtcaaaaaaggggccaaggcagcctttgtcgagccttattcggctgtgccttcagaggttgagctcttgtttccaagaggctgtcagctggaggtcgttggagcttacgtgtcacaggaccaaaaaaagctccacatagaagcgtatttcaagggcagtttg

SEQ ID NO: 9106 - protein, 250 aa, Streptococcus pyogenes
MLKKRYQLAIVLLLSCFSLIWQTEGLVELFVCEHYERAVCEGTPAYFTFSDQKGAETLIKKRWGKGLIYPRAEQEAMAAYTCQQAGPINTSLDKAKGELSQLTPELRDQVAQLDAATHRLVIPWNIVVYRYVYETFLRDIGVSHADLTSYYRNHQFDPHILCKIKLGTRYTKHSFMSTTALKNGAMTHRPVEVRICVKKGAKAAFVEPYSAVPSEVELLFPRGCQLEVVGAYVSQDQKKLHIEAYFKGSL

SEQ ID NO: 9107 - DNA, 696 bp, Streptococcus pyogenes
atgactaaagttgttttagtgacgggctgtgctagtgggattggttatgcacaggcccgctattttttgaaacaagggcatcacgtatatggtgtggataagtcggataaaccggacttaagcggtaactttcactttatcaaattggatttatcctctgagttagccccactatttaaagtggtccccagtgttgatattttgtgtaatactgcagggattttagatgcctacaagccacttttagacgtcagtgatgaagaagtggaacacctatttgatattaatttttttgcgacggtgaagttaacacgtcattatcttagacgtatggtggaaaagcagtcaggtgttatcatcaatatgtgctcaatagcaagttttatagcgggtggcggtggtgttgcctatacgagttctaagcatgcccttgcgggattcacgcgccagctggctttggattacgccaaagatcagattcacatttttggtatagcaccaggtgctgtcaaaaccgctatgacggctaacgattttgagcctggtggcttagcagactgggtagctcgtgagacgccaattgggcgttggactaaaccagatgaagttgctgaattaacgggatttcttgcttcaggaaaagcgagatcaatgcaaggcgagattgtcaaaattgacggtggctggactttgaaa

SEQ ID NO: 9108 - protein, 232 aa, Streptococcus pyogenes
MTKVVLVTGCASGIGYAQARYFLKQGHHVYGVDKSDKPDLSGNFHFIKLDLSSELAPLFKVVPSVDILCNTAGILDAYKPLLDVSDEEVEHLFDINFFATVKLTRHYLRRMVEKQSGVIINMCSIASFIAGGGGVAYTSSKHALAGFTRQLALDYAKDQIHIFGIAPGAVKTAMTANDFEPGGLADWVARETPIGRWTKPDEVAELTGFLASGKARSMQGEIVKIDGGWTLK

SEQ ID NO: 9109 - DNA, 1770 bp, Streptococcus pyogenes
atgtattatactagtggtaattacgaagcttttgcaacacctcgaaaacccgaaggggtagatcagaaatcagcttatattgttggtactggtttagctggtttagcagcagctgttttccttattcgcgatgggcatatggctggggaacgcattcatctgtttgaggaattgcctttagcaggtggttctttagatggtattgaaaagcctcatcttggttttgtgacccgtggtggtcgtgagatggaaaatcattttgagtgtatgtgggacatgtatcggtctattccctcactggaaattcccggtgcgtcttatttagatgaattttattggttggataaggatgatcctaactcatccaactgtcgtttgattcacaagagaggaaatcgtgtggatgatgacggccagtatacgctcggtaaacagtcaaaagaattaatccatttaatcatgaagacagaagaatctctaggagaccaaaccattgaagagttcttctcagaagatttctttaagagtaatttttgggtgtattgggcaaccatgtttgcttttgaaaaatggcattctgctgtagaaatgcgacgctatgcgatgaggtttatccaccatattgatggtttgccagatttcacctccctcaagttcaacaaatataaccaatatgactctatggtcaaaccgattattgcttacctagaatcacacgacgttgacatccaatttgacacaaaagtcactgatattcaggtggagcaaacagctggtaaaaaggtagcaaaaaccatccatatgacggtgtctggggaggctaaggcgattgagctaacacctgatgatttggtttttgtgaccaatggttctattactgaaagcagcacatacggtagtcatcacgaagtggctaagccaaccaaagcgttaggtggttcttggaatttatgggaaaatctagctgctcaatcagatgattttggtcatcctaaagtgttttaccaggacttgcctgctgaaagctggtttgtgtctgctacagcaaccataaaacacccagctatcgagccttatatagaacgtttgacccaccgtgacttgcacgatggcaaagtgaacactggcggcatcatcactattacagattctaactggatgatgagctttgccattcaccgtcaacctcattttaaagaacaaaaagaaaatgagaccactgtctggatttacggtctttattccaatagtgagggcaattacgtccacaagaaaattgaggagtgtacaggtcaagaaatcacagaagaatggttgtaccaccttggggtacctgttgataaaatcaaggacttagcgagtcaggactatatcaatacagttcctgtttacatgccttatattacgagttactttatgccacgcgtcaaaggagaccgtccgaaagttatcccagatggttcagtcaacttggcctttattggtaactttgcggaatctccatctcgagatacggtctttacgactgagtattctattcgtactgccatggaagcagtgtatagcttcttgaatgtggaacgaggcatcccagaagtctttaattcagcctatgatattcgtgaattgctcaaagccttttattaccttaatgataaaaaggcaatcaaggatatggatttgccaattcctgcactgattgagaaaatcggacataaaaaaatcaaggatacctttatcgaagaattgctcaaagatgctaatcttatg

SEQ ID NO: 9110 - protein, 590 aa, Streptococcus pyogenes
MYYTSGNYEAFATPRKPEGVDQKSAYIVGTGLAGLAAAVFLIRDGHMAGERIHLFEELPLAGGSLDGIEKPHLGFVTRGGREMENHFECMWDMYRSIPSLEIPGASYLDEFYWLDKDDPNSSNCRLIHKRGNRVDDDGQYTLGKQSKELIHLIMKTEESLGDQTIEEFFSEDFFKSNFWVYWATMFAFEKWHSAVEMRRYAMRFIHHIDGLPDFTSLKFNKYNQYDSMVKPIIAYLESHDVDIQFDTKVTDIQVEQTAGKKVAKTIHMTVSGEAKAIELTPDDLVFVTNGSITESSTYGSHHEVAKPTKALGGSWNLWENLAAQSDDFGHPKVFYQDLPAESWFVSATATIKHPAIEPYIERLTHRDLHDGKVNTGGIITITDSNWMMSFAIHRQPHFKEQKENETTVWIYGLYSNSEGNYVHKKIEECTGQEITEEWLYHLGVPVDKIKDLASQDYINTVPVYMPYITSYFMPRVKGDRPKVIPDGSVNLAFIGNFAESPSRDTVFTTEYSIRTAMEAVYSFLNVERGIPEVFNSAYDIRELLKAFYYLNDKKAIKDMDLPIPALIEKIGHKKIKDTFIEELLKDANLM

SEQ ID NO: 9111 - DNA, 591 bp, Streptococcus pyogenes
atgattattggcatcacaggaggcattgcatcaggaaaatcgactgtggttaaggtcattagaaaagctggttatcaggtgattgatgcggatcaagtggtccatgacttgcaagaaaaaggcggtcgtctttacgaggctcttagagaagcttttgggaatcagattttaaaagcagatggtgagttagatcgcacaaagctgtcagaaatgcttttttcaaacccagataatatggcaacatcctcagccattcaaaatcaaatcattaaggaagaattggcggctaagcgtgaccacttagcacagagccaagccatttttttcatggatattccccttttaatggaattgggctaccaagactggtttgatgcgatttggctggtttatgtagatgctcagacacaattgcagcgcttaatggctagaaatcgtttagacaaaggaaaagcaaggcagcgaatagccagtcagttaccaatagaggaaaaaaagccctatgccagtctagtgattgataatagtggggatattgcagccttaataaagcaagtacaatctgcgttgttgttattagccaatccgagg

SEQ ID NO: 9112 - protein, 197 aa, Streptococcus pyogenes
MIIGITGGIASGKSTVVKVIRKAGYQVIDADQVVHDLQEKGGRLYEALREAFGNQILKADGELDRTKLSEMLFSNPDNMATSSAIQNQIIKEELAAKRDHLAQSQAIFFMDIPLLMELGYQDWFDAIWLVYVDAQTQLQRLMARNRLDKGKARQRIASQLPIEEKKPYASLVIDNSGDIAALIKQVQSALLLLANPR

SEQ ID NO: 9113 - DNA, 924 bp, Streptococcus pyogenes
atgacactactatctatcattgtcccctgctttaatgaagaagcaaacattctcccttattttgaagaaatgcatcaactagaaacgtccatgaccaaccaacttgcttttgaatacatttttattgatgatggttctaaggataacaccttgggtattttgcgtgagctagctgctcgctttccaaatgtgcattatctgtctttttcacgccattttggcaaggaagctgggctcttagctggactaaaagaagccaaaggcaattacattactgtgatggatgtggatctgcaagatccacccgaacttttgccaattatgtacgctaagctaaaagaaggttatgacatcgttggcaccaggcgccaaaatagacaaggagaaccactaattcgttcaatgtgttcgaatctattttatggactgatcaaacacttatcagatactgaaatggtcaatggagttcgggattatcggttaatgaccagacaagtcgttgatagcattcttgagttgggagaggttaatcgtttttcaaaagggatcttttcgtgggttggttatcgtatcacctatcttagttttgaaaaccaaaaacgcaaatatggaaaaagtcgttggcatttttgggagttgctccgatattctttagatggctttatcaacttttcagaaatgccgttaaccattgctacctggacagggactttcagctttttgatttctattttcgccatcttatttatcattatcagaaagatactctttggtgatcctgtctctggttgggccagcactgtctctattattttattcatgggaggcattcagctcttttgcatgggtattattggaaaatatatttcaaaaatattccttgaaactaaaaaaaggcctctctatattatcaaagaaaaacat

SEQ ID NO: 9114 - protein, 308 aa, Streptococcus pyogenes
MTLLSIIVPCFNEEANILPYFEEMHQLETSMTNQLAFEYIFIDDGSKDNTLGILRELAARFPNVHYLSFSRHFGKEAGLLAGLKEAKGNYITVMDVDLQDPPELLPIMYAKLKEGYDIVGTRRQNRQGEPLIRSMCSNLFYGLIKHLSDTEMVNGVRDYRLMTRQVVDSILELGEVNRFSKGIFSWVGYRITYLSFENQKRKYGKSRWHFWELLRYSLDGFINFSEMPLTIATWTGTFSFLISIFAILFIIIRKILFGDPVSGWASTVSIILFMGGIQLFCMGIIGKYISKIFLETKKRPLYIIKEKH

SEQ ID NO: 9115 - DNA, 813 bp, Streptococcus pyogenes
atgattcgctttttaattttagctggctattttgaactaaccatgtatctccagctgtctggcaaactggatcagtacatcaatgttcggtattcttaccttgcttatatttccatgattttatctttcattttagctcttgttcaactctatacctggatgaaaaacattaaggtacatagccatttaacaggaaaaatcgcaaggctgacgagtccttttatcttggtctttcctgttttgattggtctccttgtgccgaccgtgaccttagattccaccacggtttctgctaaaggctatactttcccattggctgcgggagcctctaaaacgggagtcagtgatgacggtaccaccattcaatacctcaaacctgataccagcctttactttacaaagtctgcctaccaaaaggagatgcgtcaagaactccataaatataaaggcaagaaaccggtcaccattaccactgaaaattatatggaagtgatggaattgatctatctctacccagatgagtttcttgatcgtgacatccaatacactggctttgtttataacgaaccgggccatgacaactaccaattccttttccgcttcggcattattcactgtattgccgactcaggagtgtacggacttttgaccacaggtaatcaaaccagctaccctaacaacacatggctaacagttaaaggtcgccttcatatggaatatgataaaaacttagaacaacatctacctgtccttcaacttgctgaggttcatcaaaccaaagaacctaataatccttatgtttaccgcgttttt

SEQ ID NO: 9116 - protein, 271 aa, Streptococcus pyogenes
MIRFLILAGYFELTMYLQLSGKLDQYINVRYSYLAYISMILSFILALVQLYTWMKNIKVHSHLTGKIARLTSPFILVFPVLIGLLVPTVTLDSTTVSAKGYTFPLAAGASKTGVSDDGTTIQYLKPDTSLYFTKSAYQKEMRQELHKYKGKKPVTITTENYMEVMELIYLYPDEFLDRDIQYTGFVYNEPGHDNYQFLFRFGIIHCIADSGVYGLLTTGNQTSYPNNTWLTVKGRLHMEYDKNLEQHLPVLQLAEVHQTKEPNNPYVYRVF

SEQ ID NO: 9117 - DNA, 426 bp, Streptococcus pyogenes
atgaataaaagtttcaaaaacttagtgattggagctgtttcaggagtagcggcagcttacttcttatcaacagaaaaaggcaaggctttgaaaaatcgtgctgaaaaagcttatcaagcctacaaagaaagtccagatgattaccaccaatttgctaaagaaaaaggtagtgaatacagccatttagcacgtgacactttctatgatgtgaaagataagttggcttctggtgacttaactaaagaggacatgttagacttgctcaaagataaaacaacagctttcgtgcaaaaaacaaaagaaacccttgccgaagttgaagcgaaagaaaagcaagatgatgttatcattgatttaaatgaagaagacatcatcattgactatactgaacaagatgagcctgttagtgatacactagataaacac

SEQ ID NO: 9118 - protein, 142 aa, Streptococcus pyogenes
MNKSFKNLVIGAVSGVAAAYFLSTEKGKALKNRAEKAYQAYKESPDDYHQFAKEKGSEYSHLARDTFYDVKDKLASGDLTKEDMLDLLKDKTTAFVQKTKETLAEVEAKEKQDDVIIDLNEEDIIIDYTEQDEPVSDTLDKH

SEQ ID NO: 9119 - DNA, 1248 bp, Streptococcus pyogenes
atgaaggaggaaaattttgaggcaagatgttataatagagaaaaaggagggtgtgtcttgattaaaactatgcaatacaaaaaaacgatggcaacagttgttgctcttatcgtcgcacttttgctatttggcttgatttatgatttacttggggttcaaaaaaatgagctagcagctcaaaaatctgctcagccaaaggtcaaaacagcgcgtgttgtagctaatggcgacattttaattcatgatattctctacatgagtgctagaaaagctgacgatacctatgatttcactccttattttgaatatgttaaggactggattagcggtgctgacttagctattggagattatgaagggaccattagcccagattatcccttagcaggctatcccttattcaatgctccagaagagattgcaggtgctctgaaaaatactggctatgatgtagtcgatttagcccataatcatatcttagattcccaattagacggtgcccttaacactaaaaaggtttttcatcaattaggtatagacagtattggcatctatgacaaggatcgttcaaaagaatccttcttaattaaaaatgtcaatggtatcaaaattgcaattttaggttattcttatggttataacggcatggaggccacacttagccaagaagactatgagaaacacatgtctgatttagatgaagctaagataaaaaaagaacttcagctagctgaaaaaaaggctgacgtgaccattgttatgccacaaatgggaacagaatatgccttagaaccgacagcagaacaaaaagaactttaccacaaaatgattgattggggagctgacgtcgtcctaggaggccatccgcatgttattgaaccttcagagacagttataaaaggtaggcaaaagaaattcattatttactctatgggaaattttatttcaaatcagcggcttgaaaccgtagatgatatctggactgagcgtggcctattgatggaccttacttttgagaaaaaagataacaaaacaaaaattaaaacagttgaggcccatccaaccatggttttagccaaaggtaaaggcattgtgggtaaagaaggttttgaactatacaattatcgaacaatggttttagaagattttatcaaaggtggaaaataccacgacaagattgatgaggaaaccaaagcaaaagtagcacttgcctatcaggaaattaatgatttagttaacctgaaatgg

SEQ ID NO: 9120 - protein, 416 aa, Streptococcus pyogenes
MKEENFEARCYNREKGGCVLIKTMQYKKTMATVVALIVALLLFGLIYDLLGVQKNELAAQKSAQPKVKTARVVANGDILIHDILYMSARKADDTYDFTPYFEYVKDWISGADLAIGDYEGTISPDYPLAGYPLFNAPEEIAGALKNTGYDVVDLAHNHILDSQLDGALNTKKVFHQLGIDSIGIYDKDRSKESFLIKNVNGIKIAILGYSYGYNGMEATLSQEDYEKHMSDLDEAKIKKELQLAEKKADVTIVMPQMGTEYALEPTAEQKELYHKMIDWGADVVLGGHPHVIEPSETVIKGRQKKFIIYSMGNFISNQRLETVDDIWTERGLLMDLTFEKKDNKTKIKTVEAHPTMVLAKGKGIVGKEGFELYNYRTMVLEDFIKGGKYHDKIDEETKAKVALAYQEINDLVNLKW

SEQ ID NO: 9121 - DNA, 619 bp, Streptococcus pyogenes
atgtatgggaaatattgccttagtaacaggggcttcagccggttttggcagagccattgtcgaacacttaattgcagatgggataaaggttattggtgcttctcgtcgtcttgagaaactcaaggccttagaaacgagctttgggtcggacaacttttaccctttgcagatggatgtcacagataccaaagcgattgatgatgctttgacaagtctaccaaatcagtggcaagatattactattttagtgaataatgcaggcttggcattaggacttgataaggcttatgaagccgattttgagaattggatgacgatgattaataccaatattgttgggttgatttatctcacacgtcaattattaccacatatggtctccaaagatgatggtattattattaatttagggtcaaccgcagggacaattccctatccgggagctaatatttatggggctagcaaggcttttgttaagcagttctcactcaatttacgagctgatttagcaggtagccatatacgtgtgaccaatattgaacccggtctatgtgaagggacagaattttcaaagggacagaattttcaaaggtccgctttaatggtgatgaggaacggg

SEQ ID NO: 9122 - protein, 205 aa, Streptococcus pyogenes
MGNIALVTGASAGFGRAIVEHLIADGIKVIGASRRLEKLKALETSFGSDNFYPLQMDVTDTKAIDDALTSLPNQWQDITILVNNAGLALGLDKAYEADFENWMTMINTNIVGLIYLTRQLLPHMVSKDDGIIINLGSTAGTIPYPGANIYGASKAFVKQFSLNLRADLAGSHIRVTNIEPGLCEGTEFSKGQNFQRSALMVMRNG

SEQ ID NO: 9123 - DNA, 840 bp, Streptococcus pyogenes
atgaataatcgtcatttatttagtgggatatttttctttgttattagtttatgtctggcctttttattgctaaatattattatccctaagtcaaattcacgtttgaaaaagagtgattttctgaaaaaagaacaagtagctatccaatatgttgctataggagattcattgacagaaggagtaggtgatctaactcatcaaggtggttttgttcctttgttaacgaatgatctcagtgaatattttaaggctaatgttaatcatcaaaattacggcgtatctggtgataccagtcaacaaattcttgataggatgataaaacaaaagcagatacagttatctttaaaaaaagcagatataatgacgttaaccgttggtggtaatgatgttatggcagttattcggaagaatttagcggatttgcaagtttctagttttagaaagccagctcgtcagtatcaaaaacgattaagacagattatcgagttagccagaaaagataataaagatcttcctatttttattttaggcatctataatccgttttatttgaattttccagaactaactgatatgcaaaaagtgattgatgactggaataccaaaactaaggaggttgttggagaatacgatcgtgtgtactttgtgccaataaatgacctcttgtataaagggataaatggacaagaaggaattgttcattcttcaggagatcaaactacaattgtcaatgatgccttgtttactggggaccattttcacccaaataatactggctatcaaatcatgtcaaatgcagtaatggagaaaattaaaaagcatgaaaaaaaaatcaaacct

SEQ ID NO: 9124 - protein, 280 aa, Streptococcus pyogenes
MNNRHLFSGIFFFVISLCLAFLLLNIIIPKSNSRLKKSDFLKKEQVAIQYVAIGDSLTEGVGDLTHQGGFVPLLTNDLSEYFKANVNHQNYGVSGDTSQQILDRMIKQKQIQLSLKKADIMTLTVGGNDVMAVIRKNLADLQVSSFRKPARQYQKRLRQIIELARKDNKDLPIFILGIYNPFYLNFPELTDMQKVIDDWNTKTKEVVGEYDRVYFVPINDLLYKGINGQEGIVHSSGDQTTIVNDALFTGDHFHPNNTGYQIMSNAVMEKIKKHEKKIKP

SEQ ID NO: 9125 - DNA, 3495 bp, Streptococcus pyogenes
atgaaaaagaaagtcaaccaaggatcaaagcgctatcaatatctgttaaaaaagtgggggataggttttgtaatcgctgcaactgggactgtcgtgttagggtgcacccctagtatcttaacacatcaagttgctgctaaaaccattgttggactagcccgcgatgaagctcaacaaggagatggcaatgctaaatctggtgatggtcttcaatcgtctagcaaggaggcaaaaccagttttagacagctcgtcagctaatcctgctagtattgctgagcatcatttgcgtatgcattttaaaacattgccagctggtgagtcgctaggaagcttgggactttgggtgtggggagatgtggatcaaccttcaaaggattggccaaatggtgctatcaccatgacaaaagcgaaaaaagatgactatggctattatctagatgtgccactagcagctaaacaccgccagcaagtgtcttatctcattaataataaagctggagagaatctttcaaaggaccagcacatctcgcttctcacgccaaaaatgaatgaagtttggatagacgagaattaccatgcgcacgcttatcgacctttgaaaaaaggttaccttcgaatcaactaccacaatcaatcgggacactacgataacttagctgtctggacctttaaagatgtcaaaaccccaacgaccgactggccaaatggacttgacttgtcacataaagggcattatggagcttatgttgatgtccccttaaaagaaggagctaacgaaatcggatttttaatccttgataaaagtaagacaggagatgctattaaagtgcaaccaaaagattatctatttaaagagttagacaatcatactcaggtttttgtcaaagacactgacccaaaagtttacaacaatccttattatattgatcaggttagtctcaaaggagctgaacaaaccacgccaaatgagattaaagccatttttacgaccttagatgggcttgatgaagatgcggtgaaacaaaacatcaagatcactgacaaagcagggaaaactgttgcaattgatgagttgacacttgacagggataagtctgtaatgacattaaagggtgattttaaggcgcaaggtgcagtctacacggttacatttggagaagttagccaagtcgctcgccaatcctggcaattaaaagataaactctatgcttacgatggtgaacttggagctaccctagctaaggatggttctgttgatttagcgctatggtctccaagtgctgatactgttaaggttgtcgtttatgataaacaagatcagacaagggtggttggtcaagctgatttgaccaagtcggacaagggtgtttggagagctcatctaacttctgacagtgtcaagggcattagtgattacacaggctactattacctttatgaaatcacgcgcggtcaggaaaaagtcatggttttggatccttacgccaaatctctcgctgcctggaatgatgcgactgctactgatgacatcaaaacagcaaaagctgcctttattgatccaagcaaactaggaccaacaggccttgattttgccaaaattaacaactttaaaaagcgtgaagacgctattatctatgaagcacatgtgcgagattttacgtcagataaggctctagaaggcaagttaacacacccttttgggactttttcagctttcgttgaacagctagactatctcaaagacttgggggttacccacgttcaattgctaccggttttgagttatttttatgccaatgagctggacaagagccgctcaacagcctacacgtcttcagacaataattacaactggggttatgacccacaacactactttgccctttctggcatgtattcggcaaatcctaatgaccctgctttacgtatcgcagagcttaaaaaccttgtcaatgagattcacaaacgtggtatgggtgttatttttgatgtggtttataaccacacggctagaacctatctctttgaagatttggaacccaactactatcattttatgaatgctgatggtacagctagagagagttttggcggaggtcgtctaggaacgacacatgccatgagtcgtcgtatcttggtggattcgattacttatctgactcgtgaattcaaggtagatggttttcgtttcgacatgatgggtgaccatgatgcggcagctattgagcaagcctttaaggcagccaaagccattaatccaaataccattatgattggcgaaggctggcgtacctaccaaggtgatgaggggaaaaaagaaattgcggcagatcaagattggatgaaagcaaccaatacggtcggtgttttctctgatgatatcagaaataccctcaagtcaggttttccaaatgaaggcacagcagcctttattactggtggcgcaaaaaatctagaaggtttattcaaaacgatcaaagcacagcctggtaactttgaagcagatgccccaggagatgtagtgcagtatattgcagcccatgacaacctgaccttacatgatgtcattgccaaatccatcaataaggatcctaaagtggctgaagaagagattcacaagcgtattcgtctaggaaataccatgattttaactgctcaagggactgcctttatccattctggtcaggaatatggacgaaccaagcagcttctaaatcccgactacaagacaaaggcgtctgatgacaaggtgccaaataaggcgactctgattgatgctgtagcgcaatacccttacttcatccacgattcttatgattcgtctgatgcggtcaatcattttgactgggcaaaggcaacagattccatagctcacccgattagcaaccaaacaaaagcctatacacagggactaattgcgttgcgtcgctcaacagatgcctttacaaaagcaaccaaagctgaggtagatcgggatgtgaccttgatcacccaagcaggacaagatggtattcaacaagaggacctcatcatgggttaccaaacagtggcatcaaatggagatcgctatgctgtctttgtcaatgcagacaacaagacccgcaaggtagttttacctcaagcctaccgctatttgctaggagcccaagtgcttgttgatgctgagcaagctggtgttactgccattgctaagcctaagggagtccagtttaccaaagaaggcttgactattgaaggcctaactgccctggtcctcaaagtatcctcaaaaacggctaatccctctcagcaaaagagtcagacagacaatcatcaaaccaaaacaccagatggctcaaaagacctagacaaatcattaatgactagaccaaaaagagctaaaacaaaccaaaagctcccaaaaacgggtgaagcctcctcaaaaggcttattagcagctggaatagctctgcttttattggctattagcctgttgatgaagcgccaaaaagat

SEQ ID NO: 9126 - protein, 1165 aa, Streptococcus pyogenes
MKKKVNQGSKRYQYLLKKWGIGFVIAATGTVVLGCTPSILTHQVAAKTIVGLARDEAQQGDGNAKSGDGLQSSSKEAKPVLDSSSANPASIAEHHLRMHFKTLPAGESLGSLGLWVWGDVDQPSKDWPNGAITMTKAKKDDYGYYLDVPLAAKHRQQVSYLINNKAGENLSKDQHISLLTPKMNEVWIDENYHAHAYRPLKKGYLRINYHNQSGHYDNLAVWTFKDVKTPTTDWPNGLDLSHKGHYGAYVDVPLKEGANEIGFLILDKSKTGDAIKVQPKDYLFKELDNHTQVFVKDTDPKVYNNPYYIDQVSLKGAEQTTPNEIKAIFTTLDGLDEDAVKQNIKITDKAGKTVAIDELTLDRDKSVMTLKGDFKAQGAVYTVTFGEVSQVARQSWQLKDKLYAYDGELGATLAKDGSVDLALWSPSADTVKVVVYDKQDQTRVVGQADLTKSDKGVWRAHLTSDSVKGISDYTGYYYLYEITRGQEKVMVLDPYAKSLAAWNDATATDDIKTAKAAFIDPSKLGPTGLDFAKINNFKKREDAIIYEAHVRDFTSDKALEGKLTHPFGTFSAFVEQLDYLKDLGVTHVQLLPVLSYFYANELDKSRSTAYTSSDNNYNWGYDPQHYFALSGMYSANPNDPALRIAELKNLVNEIHKRGMGVIFDVVYNHTARTYLFEDLEPNYYHFMNADGTARESFGGGRLGTTHAMSRRILVDSITYLTREFKVDGFRFDMMGDHDAAAIEQAFKAAKAINPNTIMIGEGWRTYQGDEGKKEIAADQDWMKATNTVGVFSDDIRNTLKSGFPNEGTAAFITGGAKNLEGLFKTIKAQPGNFEADAPGDVVQYIAAHDNLTLHDVIAKSINKDPKVAEEEIHKRIRLGNTMILTAQGTAFIHSGQEYGRTKQLLNPDYKTKASDDKVPNKATLIDAVAQYPYFIHDSYDSSDAVNHFDWAKATDSIAHPISNQTKAYTQGLIALRRSTDAFTKATKAEVDRDVTLITQAGQDGIQQEDLIMGYQTVASNGDRYAVFVNADNKTRKVVLPQAYRYLLGAQVLVDAEQAGVTAIAKPKGVQFTKEGLTIEGLTALVLKVSSKTANPSQQKSQTDNHQTKTPDGSKDLDKSLMTRPKRAKTNQKLPKTGEASSKGLLAAGIALLLLAISLLMKRQKD

SEQ ID NO: 9127 - DNA, 1005 bp, Streptococcus pyogenes
atgaagagaattgcaatagatgctatgggtggagataacgctcctaaagctattgttgagggtgttaatcaagcaatagaagcattttcagatatcgaaattcaactttacggtgatcagacaaagattaactcctatcttattcaatcagatcgtgttgctattattcatacagatgaaaaaattatgtcagatgatgaacctgcaaaagctgttcgccgtaaaaagaaggcttcaatggttttagcagctaaggcagtgaaagaaggaaaagcagatgccattatttcagcagggaatacaggtgctcttttagctgtaggtttgtttgttgtggggcgtatcaagggagttgatcgtccaggattattatcaactattcccacagtaaccggattaggatttgatatgttggatcttggagctaatgctgaaaatacggcaaaacatttacatcaatatgctattttaggctctttctatgctaagaatgtacgtgggattgctaatccacgtgttggtctattaaacaatggtacagaagaaacaaaaggagatccccttcgtaaggccacttatgaacttttaacagcagataatacaatatcttttgttggtaatgtcgaggcgcgagaacttatgtcaggtgttgcagatgttattgtatcagatggtttcacgggaaacgcagtgttgaaatcaatagaaggaacagctattagcattatggggcaactgaaacagataattaatagcggcggtattaagactaaaattggagctagtctacttaaaagtagtctttacgagatgaagaagactcttgactactctagtgctggaggtgcagttttatttggtttaaaggcacctgttgtaaagtctcatggttctagtgatgtaaaagctattttttcaacgataaaacaagtacgtacgatgctagacactaacgtggtcggacaattagtagaagaatttgctaaggagactcaagtaaatgac

SEQ ID NO: 9128 - protein, 335 aa, Streptococcus pyogenes
MKRIAIDAMGGDNAPKAIVEGVNQAIEAFSDIEIQLYGDQTKINSYLIQSDRVAIIHTDEKIMSDDEPAKAVRRKKKASMVLAAKAVKEGKADAIISAGNTGALLAVGLFVVGRIKGVDRPGLLSTIPTVTGLGFDMLDLGANAENTAKHLHQYAILGSFYAKNVRGIANPRVGLLNNGTEETKGDPLRKATYELLTADNTISFVGNVEARELMSGVADVIVSDGFTGNAVLKSIEGTAISIMGQLKQIINSGGIKTKIGASLLKSSLYEMKKTLDYSSAGGAVLFGLKAPVVKSHGSSDVKAIFSTIKQVRTMLDTNVVGQLVEEFAKETQVND

SEQ ID NO: 9129 - DNA, 2010 bp, Streptococcus pyogenes
atgaaaaaatattttattttaaaaagtagtgtattgagtatcctgactagttttactctattagttacagatgttcaagcagatcaagttgatgtgcaattccttggcgtcaatgattttcacggcgctcttgataataccggaacagcttacacaccaagtggtaaaataccaaatgctgggacggctgctcaattaggtgcttatatggatgacgctgagatagacttcaagcaagcaaatcaagacggaacaagtatacgtgttcaagctggagatatggtcggagccagtcctgctaactctgcacttttacaagatgagcctactgtcaaagtctttaacaaaatgaaatttgaatatggcactcttggtaatcatgaatttgacgaaggactagatgaatttaaccgtatcatgacaggtcaagcgcctgatcctgaatcaacaattaatgatatcaccaaacaatatgagcacgaagcttcgcatcaaaccatcgtcattgctaatgttattgataaaaaaaccaaggatatcccctatggttggaaaccttatgctataaaagacatagccattaatgacaaaatcgttaagattggcttcattggtgttgtgactacagagattccaaatctcgttttaaagcaaaactatgaacactatcaatttttagatgtagctgaaaccattgccaaatatgctaaagaactacaagaacaacatgttcatgctattgtggttttagctcatgttcctgcaacaagtaaagatggtgttgttgatcatgaaatggctacggttatggaaaaagtgaaccaaatctatcccgaacatagcattgatattatttttgcaggacataatcatcaatacactaatggaactatcggtaaaacacgtatcgttcaagccctctctcaaggaaaagcttatgcagatgtccgtggtacgctagatactgataccaatgattttattaaaactccatcagcaaatgttgttgctgtagcaccaggtatcaaaacagaaaattcagatatcaaagctataataaatcatgctaatgatattgttaaaacagttactgaacgaaaaatcggaactgcaactaattcttcaactatttctaaaacagaaaatattgataaagaatctcctgtcggtaacttagcaacaacggctcagcttactattgctaagaaaacttttccaactgttgactttgctatgaccaataatggtggtattcgaagtgacctagttgtcaaaaatgaccggaccatcacctggggagctgcacaggctgtacaaccatttggtaatatccttcaagtcattcaaatgactggtcaacacatttacgatgtcctaaatcagcaatacgatgaaaaccagacctattttcttcaaatgtcaggtttaacatacacttatacagataatgatcctaagaactctgatacccccttcaagatagttaaggtttataaagacaatggtgaagaaattaacttaacaactacttacaccgttgttgtcaacgactttctttatggtggtggtgatggcttttcagcatttaaaaaagctaaattaatcggagctattaacacagatactgaagctttcatcacatatatcacaaatttagaagcatcaggtaaaactgttaatgctactataaaaggggttaaaaattatgtaacttcaaaccttgaaagttcgacaaaagttaatagtgctggtaaacacagtatcattagtaaggtttttagaaatcgtgatggcaatacagtgtctagtgaagtcatttcagaccttttgacttctactgaaaacactaataacagccttggcaaaaaagaaacaacaacaaacaaaaatactatctctagttccactcttccaataacaggggacaattataaaatgtctcctattatgacaatccttgccttgataagcttaggtggactaaacgcttttattaaaaaaaggaaatcc

SEQ ID NO: 9130 - protein, 670 aa, Streptococcus pyogenes
MKKYFILKSSVLSILTSFTLLVTDVQADQVDVQFLGVNDFHGALDNTGTAYTPSGKIPNAGTAAQLGAYMDDAEIDFKQANQDGTSIRVQAGDMVGASPANSALLQDEPTVKVFNKMKFEYGTLGNHEFDEGLDEFNRIMTGQAPDPESTINDITKQYEHEASHQTIVIANVIDKKTKDIPYGWKPYAIKDIAINDKIVKIGFIGVVTTEIPNLVLKQNYEHYQFLDVAETIAKYAKELQEQHVHAIVVLAHVPATSKDGVVDHEMATVMEKVNQIYPEHSIDIIFAGHNHQYTNGTIGKTRIVQALSQGKAYADVRGTLDTDTNDFIKTPSANVVAVAPGIKTENSDIKAIINHANDIVKTVTERKIGTATNSSTISKTENIDKESPVGNLATTAQLTIAKKTFPTVDFAMTNNGGIRSDLVVKNDRTITWGAAQAVQPFGNILQVIQMTGQHIYDVLNQQYDENQTYFLQMSGLTYTYTDNDPKNSDTPFKIVKVYKDNGEEINLTTTYTVVVNDFLYGGGDGFSAFKKAKLIGAINTDTEAFITYITNLEASGKTVNATIKGVKNYVTSNLESSTKVNSAGKHSIISKVFRNRDGNTVSSEVISDLLTSTENTNNSLGKKETTTNKNTISSSTLPITGDNYKMSPIMTILALISLGGLNAFIKKRKS

SEQ ID NO: 9131 - DNA, 1230 bp, Streptococcus pyogenes
atgtttaatcgtatccgcattcgttttatcatgattgcttctattgccatttttattattttaagttcaattgttggtattattaacacggcacgctgttaccaaagtcaacaagaaattaaccgtattttacatttaatttcctcaaataaaggtaaattacctggcactacggaaagctctaaacgacttggaacgaaactgtctgaagatagcctaagccagtttcggtattatagtgtcatttttaatgctaatggacatctactttcttctaatactgctaatatttcagctttagatagagaagaagcccaatattttgctagactttttgctaagtctggggaagaaaaaggcagttaccgtcaccaagatagtgtttattcgtacttgattactcagctgccaaatgaagaaaaactggttgtaattttagatactaccttttattttcgtagtgtaggagatttattagctgtttcagtgatgttggcctttggaggatttatcttttttgttgttttagtgagtcttttttccggtatggtcatcaaaccttttgtccaaaattatgagaagcagcgtcgctttattactaatgcaggccacgagttaaaaacaccactagccattatctcagccaataatgaattggtcgaattaatgactggagaatcagaatggaccaagagtacaagtgatcaggtgaagcgattgacaggcttgattaatcaaatgattactttggctcgtttggaggaacagccagatgtggtattacatatggtagacttttcagctattgctcaagatgcagctgaagattttaagagtctggttttgaaagatggtaaacgttttgatttgacgattcaaccgaatattatgattaaagcggaggaaaagtcattgtttgaacttgtgacaattttagttgataatgccaataaatattgtgatcctaaaggcttggtcaaggtatctttaaccactattggaagaagacgaaaacgagcgaaattagaagtttctaatacctatttggaaggaaaatccattgattacagccgcttctttgaacgcttttatcgcgaagacgaatcccataatagcaaagaaaaaggttatggaattggtttatctatggcagaaagtatggttaagttatttaaaggaacgataactgtaaattataaaaacgatgctattgtttttacagtggtgatt

SEQ ID NO: 9132 - protein, 410 aa, Streptococcus pyogenes
MFNRIRIRFIMIASIAIFIILSSIVGIINTARCYQSQQEINRILHLISSNKGKLPGTTESSKRLGTKLSEDSLSQFRYYSVIFNANGHLLSSNTANISALDREEAQYFARLFAKSGEEKGSYRHQDSVYSYLITQLPNEEKLVVILDTTFYFRSVGDLLAVSVMLAFGGFIFFVVLVSLFSGMVIKPFVQNYEKQRRFITNAGHELKTPLAIISANNELVELMTGESEWTKSTSDQVKRLTGLINQMITLARLEEQPDVVLHMVDFSAIAQDAAEDFKSLVLKDGKRFDLTIQPNIMIKAEEKSLFELVTILVDNANKYCDPKGLVKVSLTTIGRRRKRAKLEVSNTYLEGKSIDYSRFFERFYREDESHNSKEKGYGIGLSMAESMVKLFKGTITVNYKNDAIVFTVVI

SEQ ID NO: 9133 - DNA, 630 bp, Streptococcus pyogenes
atggtagaaaacactaaattactatgtagctgggtatggttattagcgttagctattctcataacgatctattcaacgtggctgtggtatcctcttgaggtggaccatctaaagttagaacaagttgtttttatgagcaaggatgctatcttgcataactataacggactactcaattacctcaccaatccttttgtgacaaggttggaatttgctaattttcactcatcggcagacggactcaagcattttgcagatgtgaagtggctttttcacctaactcaagtcgtttttcttggccttctttacccaacccttaagactttcacacaaaggttaaaaaccaaacgtttctggctccttcaaaaacctttaatactagcagctttgtttcctcttatgattggtctaatggctagtttcattgggtttgaacatttttttactctttttcatcaggtgctttttgtaggagatagcagctggctctttgatcccttgaaagattctgtgatttggatccttccagaagtctttttcttgcactgtttccttttctttatgatagtttacgaaatcatcctgtggagcttagtaggtttagcaagatggcagcgcctaaatgtagaa

SEQ ID NO: 9134 - protein, 210 aa, Streptococcus pyogenes
MVENTKLLCSWVWLLALAILITIYSTWLWYPLEVDHLKLEQVVFMSKDAILHNYNGLLNYLTNPFVTRLEFANFHSSADGLKHFADVKWLFHLTQVVFLGLLYPTLKTFTQRLKTKRFWLLQKPLILAALFPLMIGLMASFIGFEHFFTLFHQVLFVGDSSWLFDPLKDSVIWILPEVFFLHCFLFFMIVYEIILWSLVGLARWQRLNVE

SEQ ID NO: 9135 - DNA, 1344 bp, Streptococcus pyogenes
atgtttaaaaaatattcaataaaaaatcgtgtttggcgcgccgtcgttgaaattgtctttggagtttgtatcactgttttaatgattgcgataatatcgctttctttttcaaagttaaatatagtgacatctcataatgtgggagaagaattttatattaaagataaacagtcaatcaaacagttgaacaattatatgaagacattgggattagattatgttgtttttgatagaaaaacagataaagctatggaaggaaaatatttatctaaagaattttctttatttaacgaagttgcagaagaaaaaaataatctgacttttaattctgtacattatgatttatatactaatatcaattataatattgttataagatataatgagataccggagttctctaaccattaccttagaaatgtttcatataacatgttgacattttatattctgggaataggaacgagtatcagcattgtagttgctttaacacggtttgtaaaagaaatttctttgaatttcaaggaaatcaagaagttagcaaataaaatggggatagaagtcctttctgaaaatgaaaattattctcaaataatcgagtttgatgatatacttagaactttacatattaaaggtgataatttgaaaagtttgattgagcgagaaatattggaaaagcaagatctatcctttcaaattgcagcactttcgcatgatattaaaacacctttaacggttttaaaaggaaatcttgagttattagaattgactactttaaataaaaatcaggaaggttatattgtatctatgaacaatagtatttctgtttttgaaggctatttcaattctttaatatcttatacacgcatgctttcagaggatagatcagtgaaactaattttagttgaggagctattaagtgagttacattttgaagtcgatgacttattgaatatcaataatattgaattttctatttgtaatagacttattatcacttctttttatggagatgaggaaaatctgataagagctctttctaaccttttagttaatgcaataagatttatgcccgtattagataaaaaaatcgaagttatactgtctgagtcaggagagcaaattcattttgaaatatggaataatggtgagcgtttcagtgatagtacactgaaaaagggagataaattattttacacggaagattatagcagaggtaacaaacattatggaatcggtttggcatttgttaaaggcgttgctatcaaacacggtgggaatcttcaattgaataatccagctagaggaggtgctagcgccataatctcgataaaaaagaaaatt

SEQ ID NO: 9136 - protein, 448 aa, Streptococcus pyogenes
MFKKYSIKNRVWRAVVEIVFGVCITVLMIAIISLSFSKLNIVTSHNVGEEFYIKDKQSIKQLNNYMKTLGLDYVVFDRKTDKAMEGKYLSKEFSLFNEVAEEKNNLTFNSVHYDLYTNINYNIVIRYNEIPEFSNHYLRNVSYNMLTFYILGIGTSISIVVALTRFVKEISLNFKEIKKLANKMGIEVLSENENYSQIIEFDDILRTLHIKGDNLKSLIEREILEKQDLSFQIAALSHDIKTPLTVLKGNLELLELTTLNKNQEGYIVSMNNSISVFEGYFNSLISYTRMLSEDRSVKLILVEELLSELHFEVDDLLNINNIEFSICNRLIITSFYGDEENLIRALSNLLVNAIRFMPVLDKKIEVILSESGEQIHFEIWNNGERFSDSTLKKGDKLFYTEDYSRGNKHYGIGLAFVKGVAIKHGGNLQLNNPARGGASAIISIKKKI

SEQ ID NO: 9137 - DNA, 825 bp, Streptococcus pyogenes
atgaattatacaggtaaggtaaaacgagttgctattattgcaaatggtaagtaccaaagtaaacgcgtcgcctccaaacttttctccgtatttaaagatgatcctgatttctatctttcaaagaaaaatccggatattgtgatttctattggcggagatgggatgctcttatctgcctttcacatgtatgaaaaagaattagataaggtacgttttgtaggaatccacaccggtcatcttggcttttataccgattatagggattttgaagttgataaattaattgataatttaagaaaagacaagggagaacaaatctcttatccgattttaaaagttgctattactttagatgatggtcgtgtggttaaagcgcgtgctttgaatgaagcgacggttaagcgtattgaaaaaacgatggtagcagatgttattattaaccatgtcaaatttgaaagcttccgaggtgatgggatttcagtatcgaccccgacagggagcacagcctacaataaatctttaggtggtgctgtcttgcatccgacgattgaagcgctgcaattgacggaaatttccagtcttaataaccgtgtctttagaaccttgggctcatcaatcattattcccaaaaaagataagattgagttagtgccaaaacgattaggaatttataccatttccattgataataaaacctatcagttaaaaaatgtgacgaaggtggagtattttatcgacgatgagaaaattcattttgtttcctctccgagtcatacgagcttttgggaaagggtcaaggatgcctttattggagagattgactca

SEQ ID NO: 9138 - protein, 275 aa, Streptococcus pyogenes
MNYTGKVKRVAIIANGKYQSKRVASKLFSVFKDDPDFYLSKKNPDIVISIGGDGMLLSAFHMYEKELDKVRFVGIHTGHLGFYTDYRDFEVDKLIDNLRKDKGEQISYPILKVAITLDDGRVVKARALNEATVKRIEKTMVADVIINHVKFESFRGDGISVSTPTGSTAYNKSLGGAVLHPTIEALQLTEISSLNNRVFRTLGSSIIIPKKDKIELVPKRLGIYTISIDNKTYQLKNVTKVEYFIDDEKIHFVSSPSHTSFWERVKDAFIGEIDS

SEQ ID NO: 9139 - DNA, 1068 bp, Streptococcus pyogenes
atgagacgcgaattattactagaaaaaattgaaacctacaaggctatcatgccctggtatgttttagattattaccaatccaaattagctgttccatacagctttaccaccttatatgagtatttaaaagaatacaaacgcttttttgattggctgatggatgctgatttaacgcaggcgccaaagattgctgatattgacttgagcacgcttgagcaccttaccaagaaggatttagaggcctttgtgctttatttgcgggaacgaccttctctcaacacctattccaccaaagaggggctttctcaaaccactattaatcggaccttgtctgccttatcaagcctttacaagtacttgactgaagaggttgaaaatgaccaaggggagccttatttttatcggaatgttatgaaaaaagtgtcaacaaaaaagaaaaaagaaaccctggcttccagagcggaaaatattaagcagaaactgtttttaggtgatgaaactctagctttcttggattatgtggataaggaatatgagcaaaaattgtctaatcgtgccaaatcttctttccgtaaaaataaggagagggatttggctattattgctctactacttgcttctggtgttcgtttgtctgaagcagtgaatcttgatttaaaagatgtcaatctaaatatgatgattatcgaagttattcgcaaaggcggaaaacgtgattcagtcaatgtagcaggttttgcgaaaggttatttggagtcttatttagctgttcgtcagagacgttacaaggctgaaaaacaggatcttgctttctttttaacagaataccgtggcgttccaaatcgaatggatgcttctagtatagaaaagatggttggcaagtactctgaggattttaaaattcgtgtgactcctcacaaattgcgtcatacgctagcgacaagactatatgatgctactaaatctcaggtgttagttagtcatcaattaggccattcctctactcaagtcacggatctttatacccatattgtcaatgatgagcaaaaaaatgctttagataacctt

SEQ ID NO: 9140 - protein, 356 aa, Streptococcus pyogenes
MRRELLLEKIETYKAIMPWYVLDYYQSKLAVPYSFTTLYEYLKEYKRFFDWLMDADLTQAPKIADIDLSTLEHLTKKDLEAFVLYLRERPSLNTYSTKEGLSQTTINRTLSALSSLYKYLTEEVENDQGEPYFYRNVMKKVSTKKKKETLASRAENIKQKLFLGDETLAFLDYVDKEYEQKLSNRAKSSFRKNKERDLAIIALLLASGVRLSEAVNLDLKDVNLNMMIIEVIRKGGKRDSVNVAGFAKGYLESYLAVRQRRYKAEKQDLAFFLTEYRGVPNRMDASSIEKMVGKYSEDFKIRVTPHKLRHTLATRLYDATKSQVLVSHQLGHSSTQVTDLYTHIVNDEQKNALDNL

SEQ ID NO: 9141 - DNA, 1080 bp, Streptococcus pyogenes
atgcctaagaagattttatttacaggtggtggaactgtaggtcatgtcaccttgaacctcattctcataccaaaatttatcaaggacggttgggaagtacattatattggtgataaaaatggcattgaacatacagaaattgaaaagtcaggccttgacgtgacctttcatgctatcgcgacaggcaagcttagacgctatttttcatggcaaaatctagctgatgtttttaaggttgcacttggcctcctacagtctctctttattgttgccaagcttcgccctcaagcccttttttccaaaggtggttttgtctcagtaccgccagttgtggctgctaaattgcttggtaaaccagtctttattcatgaatcagatcggtcaatgggactagcaaacaagattgcctacaaatttgcaactaccatgtataccacttttgagcaggaagaccagttgtctaaagttaaacaccttggagcggtgacaaaggttttcaaagatgccaaccaaatgcctgaatcaactcagttagaggcggtgaaagagtattttagtagagacctaaaaaccctcttgtttattggtggttcggcaggggcgcatgtgtttaatcagtttattagtgatcatccagaattgaagcaacgttataatatcatcaatattacaggagaccctcaccttaatgaattgagttctcatctgtatcgagtagattatgttaccgatctctaccaacctttgatggcgatggctgaccttgtagtgacaagagggggctctaatacactttttgagctactggcaatggctaagctacacctcatcgttcctcttggtaaagaagctagccgtggcgatcagttagaaaatgccacttattttgagaagaggggctacgctaaacaattacaggaacctgatttaactttgcataattttgatcaggcaatggctgatttgtttgaacatcaggctgattatgaggctactatgttggcaactaaggagattcagtcaccggacttcttttatgaccttttgagagctgatattagctccgcgattaaggagaag

SEQ ID NO: 9142 - protein, 360 aa, Streptococcus pyogenes
MPKKILFTGGGTVGHVTLNLILIPKFIKDGWEVHYIGDKNGIEHTEIEKSGLDVTFHAIATGKLRRYFSWQNLADVFKVALGLLQSLFIVAKLRPQALFSKGGFVSVPPVVAAKLLGKPVFIHESDRSMGLANKIAYKFATTMYTTFEQEDQLSKVKHLGAVTKVFKDANQMPESTQLEAVKEYFSRDLKTLLFIGGSAGAHVFNQFISDHPELKQRYNIINITGDPHLNELSSHLYRVDYVTDLYQPLMAMADLVVTRGGSNTLFELLAMAKLHLIVPLGKEASRGDQLENATYFEKRGYAKQLQEPDLTLHNFDQAMADLFEHQADYEATMLATKEIQSPDFFYDLLRADISSAIKEK

SEQ ID NO: 9143 - DNA, 1638 bp, Streptococcus pyogenes
atgaccaaaccatttcatcataagaaactaaaacaaataactataatagctgcaactagcctttttttattcctgatcggtggtgccttttactactctaaaaatcattgtattaatgcctatcttaaagctcgatcggcccaatcaggaccagtttttgagaatatcaaagcatatctagtctgggatgatactaatgagcagatcacaaatgacgaggcgatgtatactaagtttagaaggtatagtcagaaagaattgaggcaaaaaaagcaggatttaaaagccgctagtcaagatagtgccgttcaagtaaagtctgttggtcgtcgtttttggatttttcctgattatcggattgccataaaacccatggatttaacgataaaaacgaatgtgcctcaagcagacgttcttttaaatcaaaaaaaagttgctgtttctgattcagaacagttctcagtcaagcttgatcggctaccaacggcagaatataccgcaagtatcagaggcaaacacaacgggcgaaacattaaagtcaacaaatcatatgatggtgataatcccgtgctagatttgagtgtgtcttttagaacttttttggtaacaagcaatgctaagcaaggagatctttacttcgatgataaccatattggcacattaaaagatggtcaattacaagtagaagattaccctgttacagaaaacgcacaagcttatatgaaaacaacattcccagatggtgagttaagatcacaaaaatatgctctagctgatgttgaagaaggagcaaccctggagattttagttacagatcttttagaagaggacaaggcaggggagctattagtatcagcttttgatcagctgatgcactacctcagtacaggtcaagactcatctaacttacgtagcgtctttgaggcagggtctagcaacgcattttataggggattgaaagagtccataaaagcgaaatttcagacagatacaagaaaagccagccgtctcaatattccatctatccttttgacaacaatgactcaagtgggtaaaacaacttacgtgcttgatttcacagctacctacgaatttttgtatgacaagtcaacagatcctgagcagcatacctctggacatattaatcaagacttgactggaaaagtgactgtaaaaaaagttggacagcattaccttatcagccagtccggctccaaaaatattactgttgttaaagaggacaatcaactcaaagcgccatctgtctttcctgagtctattttgggaacgtggacaggccaagccaatggtttgagcatccatatgtctctagcatcagatggaacaattacgactaaagttgaagatcaaaaaggcaaccgttctaaagaaactcggacagctaaaattagtaaagttgaagacaaaggcaatggtttttatctttatacgccagatcctggaagtgacataagcgccttagttccagaaggaggattggggggtgcaaatgtcaaatatgcttatggtttcaaaatatctggtaaaacagcctctccagtggtgtggcaggcagcattaacacatgaatttgattataccaagccactttcgggagtaactttgcaaaagcaacca

SEQ ID NO: 9144 - protein, 546 aa, Streptococcus pyogenes
MTKPFHHKKLKQITIIAATSLFLFLIGGAFYYSKNHCINAYLKARSAQSGPVFENIKAYLVWDDTNEQITNDEAMYTKFRRYSQKELRQKKQDLKAASQDSAVQVKSVGRRFWIFPDYRIAIKPMDLTIKTNVPQADVLLNQKKVAVSDSEQFSVKLDRLPTAEYTASIRGKHNGRNIKVNKSYDGDNPVLDLSVSFRTFLVTSNAKQGDLYFDDNHIGTLKDGQLQVEDYPVTENAQAYMKTTFPDGELRSQKYALADVEEGATLEILVTDLLEEDKAGELLVSAFDQLMHYLSTGQDSSNLRSVFEAGSSNAFYRGLKESIKAKFQTDTRKASRLNIPSILLTTMTQVGKTTYVLDFTATYEFLYDKSTDPEQHTSGHINQDLTGKVTVKKVGQHYLISQSGSKNITVVKEDNQLKAPSVFPESILGTWTGQANGLSIHMSLASDGTITTKVEDQKGNRSKETRTAKISKVEDKGNGFYLYTPDPGSDISALVPEGGLGGANVKYAYGFKISGKTASPVVWQAALTHEFDYTKPLSGVTLQKQP

SEQ ID NO: 9145 - DNA, 1047 bp, Streptococcus pyogenes
atgaaagcagcaacttacctttcaaccggaaatctacagctcatagacaaaccaaaaccagtcattataaagcctacagatgctatcgtccagttggtaaaaaccactatttgtggaactgatttgcatatcttaggtggggatgttcccgcatgtaaagaaggaacaatccttggtcatgaaggaattggaattgttaaggaggtcggtgatgcggttactaactttaaaatcggagataaagtgattatttcttgcgtcacatcatgtcatacctgttattattgtaaacgaggcctttcgtcacattgtcaagatggcggttggattcttggccatttaattaatggaacacaagcagaatatgtccatatcccacatgcagatggtagtctctatcatgctcctgatacgattgatgatgaggcacttgtcatgctttctgatattttaccaacttcatatgaaattggtgtcttgccatcacatgtcaagcctggagataatgtttgtattgttggtgccggtccagtaggactcgcagccctactaaccgttcaatttttctctccagccaatattattatggtcgacttatctcaaaatcgccttgaagcagctaaaacatttggagccacacacacgatttgttcaggaagtagtgaagaagtcaaggctatcattgacgatataaccaatggacgtggtgtcgatatttccatggagtgtgttggttatcccgcgacatttgatatttgtcaaaaaattatatcagtaggtgggcatattgctaacgttggggttcatgggaaaccagttgatttcaacctggatgaattatggattaaaaatatcaccttaaacactggacttgttaatgccaatacaactgaaatgctactaaatgtcttgaaaactggaaagattgacgcaacaagacttattacacatcattttaaactttcagaagttgaaaaagcttatgaaacctttaaacatgctggtgcaaataacgccttgaaagttattattgataatgatattagc

SEQ ID NO: 9146 - protein, 349 aa, Streptococcus pyogenes
MKAATYLSTGNLQLIDKPKPVIIKPTDAIVQLVKTTICGTDLHILGGDVPACKEGTILGHEGIGIVKEVGDAVTNFKIGDKVIISCVTSCHTCYYCKRGLSSHCQDGGWILGHLINGTQAEYVHIPHADGSLYHAPDTIDDEALVMLSDILPTSYEIGVLPSHVKPGDNVCIVGAGPVGLAALLTVQFFSPANIIMVDLSQNRLEAAKTFGATHTICSGSSEEVKAIIDDITNGRGVDISMECVGYPATFDICQKIISVGGHIANVGVHGKPVDFNLDELWIKNITLNTGLVNANTTEMLLNVLKTGKIDATRLITHHFKLSEVEKAYETFKHAGANNALKVIIDNDIS

SEQ ID NO: 9147 - DNA, 207 bp, Streptococcus pyogenes
atggaatcaaaagaaatttatttgactaagtctccttatataagggggagtttagaaattcacagtaaaaataggaaacatgaaaaaatcaatttatatgacgcaaaacccaatagcaccagatctgatgtctttaaaaaatataaagacaataagactataaatatgaaagatttcagccattttgatatttatctttggactaaa

SEQ ID NO: 9148 - protein, 69 aa, Streptococcus pyogenes
MESKEIYLTKSPYIRGSLEIHSKNRKHEKINLYDAKPNSTRSDVFKKYKDNKTINMKDFSHFDIYLWTK

SEQ ID NO: 9149 - DNA, 375 bp, Streptococcus pyogenes
atgtatcaaacaaaaataacaggcaaccgcctttaccacacggtttcgaaaggctacggagatagtgtgaccttatttggaaaaactgatcaaggggaaacccctatgagtttactggttatcgccttgtcttcttgtgtgactatgtgtgtgcagggtttttaccatcgtcaatttcagcaagacacacttgctgtttctgttgaggctagttatgaggaagaagtttttgaactacttgttaggattgatgatgttttagatgacaaaaagaaagctgatttattggcttacattggaacttattgtcgtgtgaaacaactcctcaaacctgaagttacggtgaccattacgttggaaggactgtctcatgtc

SEQ ID NO: 9150 - protein, 125 aa, Streptococcus pyogenes
MYQTKITGNRLYHTVSKGYGDSVTLFGKTDQGETPMSLLVIALSSCVTMCVQGFYHRQFQQDTLAVSVEASYEEEVFELLVRIDDVLDDKKKADLLAYIGTYCRVKQLLKPEVTVTITLEGLSHV

SEQ ID NO: 9151 - DNA, 624 bp, Streptococcus pyogenes
atgcttaaaaaaccgattattattggtgtaactggtggttcaggtggcggtaaaacaagtgtgtcacgcgctattttggacagttttccaaatgctcgtattgcaatgattcaacacgattcttactataaagatcagtctcacatgagttttgaagaaagggtcaagaccaattatgaccatcctctagcttttgatacagattttatgattcagcaactaaaagaattattagctggtagacctgtagatattcctatctatgattacaaaaagcatacccgcagtaatacgacctttcgtcaggatcctcaggatgttattattgttgaaggtattcttgtcctagaagatgagcgtttgcgagatttgatggatatcaagctctttgtagacacagatgacgatattcgtattattcgtcgtattaagcgtgacatgatggaacgtggcagaagcttagaaagtattattgatcagtacacaagcgtggtaaagcctatgtatcatcagtttattgagccaagtaaacgctatgctgatattgttattccagagggagttagtaatgtcgttgctattgatgttattaatagtaaaattgcgagtattcttggagaagta

SEQ ID NO: 9152 - protein, 208 aa, Streptococcus pyogenes
MLKKPIIIGVTGGSGGGKTSVSRAILDSFPNARIAMIQHDSYYKDQSHMSFEERVKTNYDHPLAFDTDFMIQQLKELLAGRPVDIPIYDYKKHTRSNTTFRQDPQDVIIVEGILVLEDERLRDLMDIKLFVDTDDDIRIIRRIKRDMMERGRSLESIIDQYTSVVKPMYHQFIEPSKRYADIVIPEGVSNVVAIDVINSKIASILGEV

SEQ ID NO: 9153 - DNA, 630 bp, Streptococcus pyogenes
atggaacattttaagacaatcaaagccagtggttttttcgaagaaagtattaaaaaatctcgtttcatttgtcatatcaaacgagtgagcactgaagaagatggtaagaattttgttaatgctatcaaaaaagaacattacaaagctaatcattcctgctttgcgatgattatcggtaacaacagacagatcaagcgctcaagtgatgatggtgaaccttcaggaactgctggaatacctatcctttctgtgttagaaaagcagtgtttaacaaatgtagtagttgtggtaacgcgttactttggtggtattaaattaggaacaggtgggttaatcagagcatactctaacatgaccgcaacagctattaaacgatttggcatcattgaagttaaacagcagataggactagaaatcacactttcttatccccaatatcaactatactctaacttgctagatcaattggctttaaccgaaacagaaactaagttttcagacacgataaagacaacactttattgtgatactgaacgtgtggaaaatctcattgatactttaacaaattattatcatggtcagataagctgtgagaaaatcggatccaaagttattgaattcccctgtgat

SEQ ID NO: 9154 - protein, 210 aa, Streptococcus pyogenes
MEHFKTIKASGFFEESIKKSRFICHIKRVSTEEDGKNFVNAIKKEHYKANHSCFAMIIGNNRQIKRSSDDGEPSGTAGIPILSVLEKQCLTNVVVVVTRYFGGIKLGTGGLIRAYSNMTATAIKRFGIIEVKQQIGLEITLSYPQYQLYSNLLDQLALTETETKFSDTIKTTLYCDTERVENLIDTLTNYYHGQISCEKIGSKVIEFPCD

SEQ ID NO: 9155 - DNA, 2985 bp, Streptococcus pyogenes
atggataaacatttgttggtaaaaagaacactagggtgtgtttgtgctgcaacgttgatgggagctgccttagcgacccaccatgattcactcaatactgtaaaagcggaggagaagactgttcaggttcagaaaggattaccttctatcgatagcttgcattatctgtcagagaatagcaaaaaagaatttaaagaagaactctcaaaagcggggcaagaatctcaaaaggtcaaagagatattagcaaaagctcagcaggcagataaacaagctcaagaacttgccaaaatgaaaattcctgagaaaataccgatgaaaccgttacatggttctctctacggtggttactttagaacttggcatgacaaaacatcagatccaacagaaaaagacaaagttaactcgatgggagagcttcctaaagaagtagatctagcctttattttccacgattggacaaaagattatagccttttttggaaagaattggccaccaaacatgtgccaaagttaaacaagcaagggacacgtgtcattcgtaccattccatggcgtttcctagctgggggtgataacagtggtattgcagaagataccagtaaatacccaaatacaccagagggaaataaagctttagccaaagctattgttgatgaatatgtttataaatacaaccttgatggcttagatgtggatgttgaacatgatagtattccaaaagttgacaaaaaagaagatacagcaggcgtagaacgctctattcaagtgtttgaagaaattgggaaattaattggaccaaaaggtgttgataaatcgcggttatttattatggatagcacctacatggctgataaaaacccattgattgagcgaggagctccttatattaatttattactggtacaggtctatggttcacaaggagagaaaggtggttgggagcctgtttctaatcgacctgaaaaaacaatggaagaacgatggcaaggttatagcaagtatattcgtcctgaacaatacatgattggtttttctttctatgaggaaaatgctcaagaagggaatctttggtatgatattaattctcgcaaggacgaggacaaagcaaatggaattaacactgacataactggaacgcgtgccgaacggtatgcaaggtggcaacctaagacaggtggggttaagggaggtatcttctcctacgctattgaccgagatggtgtagctcatcaacctaaaaaatatgctaaacagaaagagtttaaggacgcaactgataacatcttccactcagattatagtgtctccaaggcattaaagacagttatgctaaaagataagtcgtatgatctgattgatgagaaagatttcccagataaggctttgcgagaagctgtgatggcgcaggttggaaccagaaaaggtgatttggaacgtttcaatggcacattacgattggataatccagcgattcaaagtttagaaggtctaaataaatttaaaaaattagctcaattagacttgattggcttatctcgcattacaaagctcgaccgttctgttttacccgctaatatgaagccaggcaaagataccttggaaacagttcttgaaacctataaaaaggataacaaagaagaacctgctactatcccaccagtatctttgaaggtttctggtttaactggtctgaaagaattagatttgtcaggttttgaccgtgaaaccttggctggtcttgatgccgctactctaacgtctttagaaaaagttgatatttctggcaacaaacttgatttggctccaggaacagaaaatcgacaaatttttgatactatgctatcaactatcagcaatcatgttggaagcaatgaacaaacagtgaaatttgacaagcaaaaaccaactgggcattacccagatacctatgggaaaactagtctgcgcttaccagtggcaaatgaaaaagttgatttgcaaagccagcttttgtttgggactgtgacaaatcaaggaaccctaatcaatagcgaagcagactataaggcttaccaaaatcataaaattgctggacgtagctttgttgattcaaactatcattacaataactttaaagtttcttatgagaactataccgttaaagtaactgattccacattgggaaccactactgacaaaacgctagcaactgataaagaagagacctataaggttgacttctttagcccagcagataagacaaaagctgttcatactgctaaagtgattgttggtgacgaaaaaaccatgatggttaatttggcagaaggcgcaacagttattggaggaagtgctgatcctgtaaatgcaagaaaggtatttgatgggcaactgggcagtgagactgataatatctctttaggatgggattctaagcaaagtattatatttaaattgaaagaagatggattaataaagcattggcgtttcttcaatgattcagcccgaaatcctgagacaaccaataaacctattcaggaagcaagtctacaaatttttaatatcaaagattataatctagataatttgttggaaaatcccaataaatttgatgatgaaaaatattggattactgtagatacttacagtgcacaaggagagagagctactgcattcagtaatacattaaataatattactagtaaatattggcgagttgtctttgatactaaaggagatagatatagttcgccagtagtccctgaactccaaattttaggttatccgttacctaacgccgacactatcatgaaaacagtaactactgctaaagagttatctcaacaaaaagataagttttctcaaaagatgcttgatgagttaaaaataaaagagatggctttagaaacttctttgaacagtaagatttttgatgtaactgctattaatgctaatgctggagttttgaaagattgtattgagaaaaggcagctgctaaaaaaa

SEQ ID NO: 9156 - protein, 995 aa, Streptococcus pyogenes
MDKHLLVKRTLGCVCAATLMGAALATHHDSLNTVKAEEKTVQVQKGLPSIDSLHYLSENSKKEFKEELSKAGQESQKVKEILAKAQQADKQAQELAKMKIPEKIPMKPLHGSLYGGYFRTWHDKTSDPTEKDKVNSMGELPKEVDLAFIFHDWTKDYSLFWKELATKHVPKLNKQGTRVIRTIPWRFLAGGDNSGIAEDTSKYPNTPEGNKALAKAIVDEYVYKYNLDGLDVDVEHDSIPKVDKKEDTAGVERSIQVFEEIGKLIGPKGVDKSRLFIMDSTYMADKNPLIERGAPYINLLLVQVYGSQGEKGGWEPVSNRPEKTMEERWQGYSKYIRPEQYMIGFSFYEENAQEGNLWYDINSRKDEDKANGINTDITGTRAERYARWQPKTGGVKGGIFSYAIDRDGVAHQPKKYAKQKEFKDATDNIFHSDYSVSKALKTVMLKDKSYDLIDEKDFPDKALREAVMAQVGTRKGDLERFNGTLRLDNPAIQSLEGLNKFKKLAQLDLIGLSRITKLDRSVLPANMKPGKDTLETVLETYKKDNKEEPATIPPVSLKVSGLTGLKELDLSGFDRETLAGLDAATLTSLEKVDISGNKLDLAPGTENRQIFDTMLSTISNHVGSNEQTVKFDKQKPTGHYPDTYGKTSLRLPVANEKVDLQSQLLFGTVTNQGTLINSEADYKAYQNHKIAGRSFVDSNYHYNNFKVSYENYTVKVTDSTLGTTTDKTLATDKEETYKVDFFSPADKTKAVHTAKVIVGDEKTMMVNLAEGATVIGGSADPVNARKVFDGQLGSETDNISLGWDSKQSIIFKLKEDGLIKHWRFFNDSARNPETTNKPIQEASLQIFNIKDYNLDNLLENPNKFDDEKYWITVDTYSAQGERATAFSNTLNNITSKYWRVVFDTKGDRYSSPVVPELQILGYPLPNADTIMKTVTTAKELSQQKDKFSQKMLDELKIKEMALETSLNSKIFDVTAINANAGVLKDCIEKRQLLKK

SEQ ID NO: 9157 - DNA, 591 bp, Streptococcus pyogenes
atgaaacagtttattaaagaatggggcccattcactctctttttaattctctttggtctatctcgtctttttttgtggcaggctgttaaagtagacggccattctatggacccaactctagctcatggcgaacgccttatcgtttttaatcaagctagaattgatcgctttgatattgtagttgctcaggaagaagaaaacggacaaaagaaagaaatcgtaaaaagagttattggattgccaggcgataccatttcttataatgatgacacactttatattaatggtaaaaaaacagttgagccgtatttggctgagtatctaaaacaatttaaaaacgataaactccaaaaaacttacgcctataataccctattccaacagttagcagaaacatctgatgcttttacaactaattctgagggacaaacacgctttgagatgagtgttccaaaaggagaataccttcttcttggtgatgatcgtattgtttccagggatagtcgcgaagttggtagtttcaaaaaagaaaaccttatcggtgaagtgaaagctcgtttttggccactcaataaaatgaccgtttttaat

SEQ ID NO: 9158 - protein, 197 aa, Streptococcus pyogenes
MKQFIKEWGPFTLFLILFGLSRLFLWQAVKVDGHSMDPTLAHGERLIVFNQARIDRFDIVVAQEEENGQKKEIVKRVIGLPGDTISYNDDTLYINGKKTVEPYLAEYLKQFKNDKLQKTYAYNTLFQQLAETSDAFTTNSEGQTRFEMSVPKGEYLLLGDDRIVSRDSREVGSFKKENLIGEVKARFWPLNKMTVFN

SEQ ID NO: 9159 - DNA, 696 bp, Streptococcus pyogenes
atgaagacacttgcatttgatacctcaaataaaaccttgtcccttgctatacttgatgatgagacacttctagcagatatgacccttaacattcagaaaaaacatagtgttagccttatgcctgctattgattttttgatgacttgtactgatcttaaacctcaagatttagaaagaatagtggttgcaaaaggccctggatcttacacaggtttacgagtggcagttgctactgcaaaaacgttagcgtacagtttaaatattgcattggtcgggatttcgagtctatatgctttggctgcgtctacttgtaaacagtatccaaatactttggtggtgccattgattgatgctagaaggcaaaatgcgtatgtaggttattatcggcaaggaaaatcagtgatgccacaagcccatgcttcactagaagttattatagaacaattagtagaagaaggacagctgatttttgttggggagactgctccttttgctgagaaaattcaaaagaaactacctcaggcgatactacttccaacccttccttctgcttacgaatgtggtcttttggggcaaagtttggcaccagaaaatgtagacgcctttgtccctcaatatctcaagagagtggaagctgaagaaaactggctcaaagataatgagataaaagatgatagtcactacgttaagcgaatc

SEQ ID NO: 9160 - protein, 232 aa, Streptococcus pyogenes
MKTLAFDTSNKTLSLAILDDETLLADMTLNIQKKHSVSLMPAIDFLMTCTDLKPQDLERIVVAKGPGSYTGLRVAVATAKTLAYSLNIALVGISSLYALAASTCKQYPNTLVVPLIDARRQNAYVGYYRQGKSVMPQAHASLEVIIEQLVEEGQLIFVGETAPFAEKIQKKLPQAILLPTLPSAYECGLLGQSLAPENVDAFVPQYLKRVEAEENWLKDNEIKDDSHYVKRI

SEQ ID NO: 9161 - DNA, 669 bp, Streptococcus pyogenes
atgaatacacaaaaatttcaatcagtttttgacatcattgggccagtaatgattggtccatcaagtagtcacacagctggtgccgtcagaattggtaaggtagtccattccatctttggagatattcctgatgaagtgacgtttcacctttataattcatttgctaaaacctacagaggacatggtactgataaggctcttgttgcaggaattatgggtatgggtactgataatcctgatattaaaaattctctagaaattgctcatcaaaaagggataaaaatctattgggatatcttaaaagatagtaatgctccccatcccaatactgttaaaatcagtgtcaaaaaagctgacaaaacacttagtgttactggtgtttcaattggaggaggaaacattcaagtaacagaactaaatggtttttctgtctcgttatccatgaatactcctactatagttactgtacacaaagatattcccggaatgatcgcaaaggtaactgatatcctatcttccaataatattaatatcgccacaatgaatgttacacgtgaatccgctggtgaaaaagctactatgattatagaagtcgattctagagagtgccaagaagcagccaaccaaattgcaaaaattcctcatatttataatgtcaacttctttgac

SEQ ID NO: 9162 - protein, 223 aa, Streptococcus pyogenes
MNTQKFQSVFDIIGPVMIGPSSSHTAGAVRIGKVVHSIFGDIPDEVTFHLYNSFAKTYRGHGTDKALVAGIMGMGTDNPDIKNSLEIAHQKGIKIYWDILKDSNAPHPNTVKISVKKADKTLSVTGVSIGGGNIQVTELNGFSVSLSMNTPTIVTVHKDIPGMIAKVTDILSSNNINIATMNVTRESAGEKATMIIEVDSRECQEAANQIAKIPHIYNVNFFD

SEQ ID NO: 9163 - DNA, 549 bp, Streptococcus pyogenes
atgtcctgttgtttttttgtggttctctttatactagggatagttaaaaagaaaaggagactcaaaatgtcgatagagacaagagcagcgtttgaaaaagttaagcccattattttgaaattaaagcgacactattatattcaattgtgggatagagatgactggttacaagaaggacatattatcttattacagttactagaaaggtacccagagttaattgaggaagaagagcgtttatatcgctattttaaaacaaaattttcatcttatttgaaagatttattacgccgtcaagaaagtcaaaagcgtcagttccataagttagcatatgaagagataggggaggttgcacatgccattccatcgagagggttatggctagacgactatgtggcttatcaagaggtaatagctagcttagagaaccaattaaattcgcaagagcgtatgcagtttcaagcacttatcaggggcgaacgtttcaagggaagacgtgctctacttaggaagatcagtccctattttaaggaatttgcacagcagttg

SEQ ID NO: 9164 - protein, 183 aa, Streptococcus pyogenes
MSCCFFVVLFILGIVKKKRRLKMSIETRAAFEKVKPIILKLKRHYYIQLWDRDDWLQEGHIILLQLLERYPELIEEEERLYRYFKTKFSSYLKDLLRRQESQKRQFHKLAYEEIGEVAHAIPSRGLWLDDYVAYQEVIASLENQLNSQERMQFQALIRGERFKGRRALLRKISPYFKEFAQQL

SEQ ID NO: 9165 - DNA, 2133 bp, Streptococcus pyogenes
atgatgtccaaactagtttttttctggcaaaatagagaaaaagaatttagggactttggaggattttctgaaaaaagcgtctatttttgtgatacaatagacaatagaaaacgtttaattttagttgtaataaacagagaggttttacttatgacatttgatgcaattgaccagttggcagtaaacactgtccgcaccctatcaatggatgccattcaagcggcaaattctggacacccaggacttccaatgggggcagcacctatggcctatgttctttggaatcacttcatgaacatcaatcccaaaacaagccgtaattggtcaaacagagaccgttttatcctatcagcaggtcatggaagtgccatgctttatagcttgttacacttagctggttatgatttatctgtagaagatttaaagaacttccgtcaatggggttctaaaacaccaggtcacccagaagtgaaccacacagacggtgtcgaagcaaccacaggacctcttggtcaagggatcgcaaatgccgttgggatggccatggcagaagctcatctagcagctaaatttaacaaaccaggctttgacatcgttgatcactacacatttgctttgaatggtgacggtgaccttatggaaggggtcagccaagaagcagcaagtatggcaggacatttaaaacttgggaaattggtcttgctatatgattcaaacgacatctctcttgatggtccaacctctatggctttcacagaagatgtgaaaggacgtttcgaagcttatggttggcaacatatccttgtgaaagatggaaatgatttagaagaaattgcagctgctattgaagcagctaaagctgaaactgagaaaccaaccatcatcgaagtcaaaaccattattggttttggtgccgaaaaacaaggaacttcagctgttcacggcgctcctcttggagcagaaggcattgcttttgccaaaaaagcttaccaatggactcatcaagattttgaagtgcctgctgaagtaacagagcgctttgctcaaggtcttcaagcgcgtggtgaaaaagcagaacaagcctggaatgacttgtttgcagcttatgaagcagaatatccagaattagcagcagaataccaaaaagcctttactaacgaagctgctcaagtagaacttgaagcgcacgaacttggtagttcaatggcgagtcgtgtatccagtcaacaagccatccaacaaatttcagaacaagtagcctctttctggggtgggtcagcagacctttcagcttcaaacaatactatggttaaggctgaaacagatttccaaccaggtcactacgaaggccgtaacatctggtttggcgttcgtgaatttgccatggctgcagccatgaacggtattgcccttcacggcgggacacgcgtttacggcggaaccttctttgtcttctcaaactatcttcttccagctgttcgtatggcagcgctccaaaacttgccaacagtttatgtcatgacacatgattctatcgctgtcggtgaagatgggccaacgcacgaaccaattgaacaattggcaagtgttcgctcaatgcctaacttgaacgttattcgtccagcagacggtaacgaaacaaatgctgcttggaaacgtgccattgctgaaacagatcgcccaaccatgcttgtattgacgcgtcaaaaccttccagtgcttgagggcacaaaagaattggcagaagatggtcttagcaaaggagcttatatcttgtcagaagccaaaggcgaccttgatggtatcttgattgcaacaggttcagaagtgaaactggcaatggatactcaagaagctcttgaagcagaaggcattcatgtgcgtgtcgtatctatgccatcacaaaatatctttgacgaacagtcagcagagtataaagaaagcatcctaccagcagctgtgactaaacgtctcgctatcgaagcaggttcaagctttggctgggcaaaatatgtcggcctatcaggaaaaacattgaccattgacacttggggtgcttcagctccaggaaatcgtatcttcgaagaatatggtttcactgtggcaaatgcaactgagttatacaaatcactc

SEQ ID NO: 9166 - protein, 711 aa, Streptococcus pyogenes
MMSKLVFFWQNREKEFRDFGGFSEKSVYFCDTIDNRKRLILVVINREVLLMTFDAIDQLAVNTVRTLSMDAIQAANSGHPGLPMGAAPMAYVLWNHFMNINPKTSRNWSNRDRFILSAGHGSAMLYSLLHLAGYDLSVEDLKNFRQWGSKTPGHPEVNHTDGVEATTGPLGQGIANAVGMAMAEAHLAAKFNKPGFDIVDHYTFALNGDGDLMEGVSQEAASMAGHLKLGKLVLLYDSNDISLDGPTSMAFTEDVKGRFEAYGWQHILVKDGNDLEEIAAAIEAAKAETEKPTIIEVKTIIGFGAEKQGTSAVHGAPLGAEGIAFAKKAYQWTHQDFEVPAEVTERFAQGLQARGEKAEQAWNDLFAAYEAEYPELAAEYQKAFTNEAAQVELEAHELGSSMASRVSSQQAIQQISEQVASFWGGSADLSASNNTMVKAETDFQPGHYEGRNIWFGVREFAMAAAMNGIALHGGTRVYGGTFFVFSNYLLPAVRMAALQNLPTVYVMTHDSIAVGEDGPTHEPIEQLASVRSMPNLNVIRPADGNETNAAWKRAIAETDRPTMLVLTRQNLPVLEGTKELAEDGLSKGAYILSEAKGDLDGILIATGSEVKLAMDTQEALEAEGIHVRVVSMPSQNIFDEQSAEYKESILPAAVTKRLAIEAGSSFGWAKYVGLSGKTLTIDTWGASAPGNRIFEEYGFTVANATELYKSL

SEQ ID NO: 9167 - DNA, 801 bp, Streptococcus pyogenes
atgacatcagtgtttttaaccagtggttgggctttttatgattacctcatctcaccgattccacatgggaaactttttagttggcatgctgtttttgatgccattccaaatattatccaacggcttccaattacgcttggtttgacactatcaggagcaacctttggcttggttttggctttgatttttgcccttgtcaaaattaataaagtgaagctactataccctattcaagctatttttgtgagtttcttgcgaggaactcctattttggtacagttgatgttgacctactacggtattcccctctttctaaaatttctcaatcagaagtatggctttgattggaatgttaatgcaattccggcttctatttttgccattacagcctttgcttttaatgaagcagcctacgctagtgaaactattcgggcagccattttatcagtagatacaggtgaaattgaagcagcaaaaagtctaggcatgacttctgtgcaggtttaccgtcgtgtcattattcctaatgcaactgttgtggctattccaaccttgattaatgggttaattggcttaactaaaggaacatcgcttgcctttaatgcagggattgtcgaaatgtttgcccaggctcaaattctaggcggatcagattaccgttattttgaacgttatatctctgttgctcttgtctattggtctatcagtattttgatggagcaagtaggtcgcttgattgaaaacaagatggccatcaaagcaccagaacaagctagaaatgaaaagttaggagaattgcgt

SEQ ID NO: 9168 - protein, 267 aa, Streptococcus pyogenes
MTSVFLTSGWAFYDYLISPIPHGKLFSWHAVFDAIPNIIQRLPITLGLTLSGATFGLVLALIFALVKINKVKLLYPIQAIFVSFLRGTPILVQLMLTYYGIPLFLKFLNQKYGFDWNVNAIPASIFAITAFAFNEAAYASETIRAAILSVDTGEIEAAKSLGMTSVQVYRRVIIPNATVVAIPTLINGLIGLTKGTSLAFNAGIVEMFAQAQILGGSDYRYFERYISVALVYWSISILMEQVGRLIENKMAIKAPEQARNEKLGELR

SEQ ID NO: 9169 - DNA, 1401 bp, Streptococcus pyogenes
atgttattaacaatgctggcttatgccatgattattgtctttatgtacgtggtaatgaagaaaaaaatgaccccttttactgctttggtcatgattccattaatcatgacgattgctgttatactgactggttcagctgacttcaatgcagatgccaaatttgttgcctttgttggtgacggtggaattgctaaagacctaacagctatcggaccaatggttatgtatggtatcaacaatactgctaaaacaggtatcatgttgctatttgccattttgttcttctctgtcatgttagatgcaggattgtttgatccgattactgaaaagatgattcgctttgctaaaggtgatccaatgaaggtgcttatcgcaacagctgtcgttgctgctgcagtatctcttaatggtgatggaacaaccactactttaatttgttgctctgctttcttacctatctataaaaaattggacatgaaaatcatgaacctaggtgtcttgattattcttcaaaatactattatgaacttactgccatggggtggccctactgctcgtgcgatgtctgttcttggtgtcggtcctgaaattcttggctatcttgcaccgggtatgattttatctcttctttatgtgatttgttgggttgctccaagcatggggcgtaaagaacgtgcaagacttggtgttattgacttgtctgaagaagacatgcgtcaactcacagacattactgacccagataccctttttattcgtcgtcctaaaaactttgttttcaatgctatcttaaccattggattaatcacttggttagttgctggctctttcaacaaatctattgctatggcaccgcttcttctttttgcggtgggaacttgtatcgccttgatggtcaattacccagtgcttaaagatcaatcaaaacgcattggtgacaatgctggtgatgcggttcaagtggttattctcgtctttgctgctggtatctttatgggtctttttcaaggttctggtatggctagcgctcttgcacaaagttttgcaaccattattccaaaacaactggcaggtttctggggtctcgttattgccttagtttctgcacctggtaccttctttatctccaatgatggtttttactatggtatcttgcctgttcttgcagaagctggtgctgaatatggtttcagtaacatggctatggcacttgcttccctcatgggacaagccttccacttacttagtccattagttgccttcatttatcttcttcttcgcttgacaggtcttgacatgggggaatggcaaaaagaggctgctaaatatgcccttatcatctttgttatctttgtggtaaccattattgccatgggacaaatgccactttacattccacaa

SEQ ID NO: 9170 - protein, 467 aa, Streptococcus pyogenes
MLLTMLAYAMIIVFMYVVMKKKMTPFTALVMIPLIMTIAVILTGSADFNADAKFVAFVGDGGIAKDLTAIGPMVMYGINNTAKTGIMLLFAILFFSVMLDAGLFDPITEKMIRFAKGDPMKVLIATAVVAAAVSLNGDGTTTTLICCSAFLPIYKKLDMKIMNLGVLIILQNTIMNLLPWGGPTARAMSVLGVGPEILGYLAPGMILSLLYVICWVAPSMGRKERARLGVIDLSEEDMRQLTDITDPDTLFIRRPKNFVFNAILTIGLITWLVAGSFNKSIAMAPLLLFAVGTCIALMVNYPVLKDQSKRIGDNAGDAVQVVILVFAAGIFMGLFQGSGMASALAQSFATIIPKQLAGFWGLVIALVSAPGTFFISNDGFYYGILPVLAEAGAEYGFSNMAMALASLMGQAFHLLSPLVAFIYLLLRLTGLDMGEWQKEAAKYALIIFVIFVVTIIAMGQMPLYIPQ

SEQ ID NO: 9171 - DNA, 1062 bp, Streptococcus pyogenes
atgtctaaaaatgcgcaaaaaattgctgtaccattgatttctgtcttgctaggatttttacttggcgctattattatggttatctttggttatgatcctatctgggggtatgaaggtttattccaaattgcctttggtagtgttaaaaatattggagaaatattccgttcaatggggccattgattttaatagcgcttggctttactgttgctagccgtgcaggcttctttaacgttggtttgtctggacaggctttagctggatggatttcagcaggttggtttgcactcttaaatccagatatgcctcgtccattattgattcttatgacagctcttatcggaatgattgctggtggtattgctggagctattccagggatacttcgtgcttatcttggtacaagtgaagttatcgttacgattatgatgaactacatcattttatatgtcggaaatgctattgttcaacgtggttatcctgagagtgtcaaacaaagtattgattcaactattcaagttagtgataatgctagttatcaaacgcattggttatcagccctaactaataactctcgtattaatattggtattttctttgccattattgccattgccctaatctggttcttgcttaacaaaactactttaggttttgagattcgttcagttggtctcaacccacatgcttcagaatacgcagggatgtcatcaaaacgtactatcattttatcaatgattatctctggagctcttgcaggtcttggaggagtagttgaaggtctaggaacctttgaaaatgtttttgtacaaggatcttctttagcagttggttttgacggtatggcagttagcttattagcagcaaattcaccgcttggaatatttttctcatcattcctatttggtgtcttaaatattggtgctccaggaatgaatattgcaggcattccaccagaacttgttaaagtagtaactgcatcaatcattttctttgttggttcacattacctcattgaacgttacattattcgccctaaaaaattagtgaaaggtggtaaa

SEQ ID NO: 9172 - protein, 354 aa, Streptococcus pyogenes
MSKNAQKIAVPLISVLLGFLLGAIIMVIFGYDPIWGYEGLFQIAFGSVKNIGEIFRSMGPLILIALGFTVASRAGFFNVGLSGQALAGWISAGWFALLNPDMPRPLLILMTALIGMIAGGIAGAIPGILRAYLGTSEVIVTIMMNYIILYVGNAIVQRGYPESVKQSIDSTIQVSDNASYQTHWLSALTNNSRINIGIFFAIIAIALIWFLLNKTTLGFEIRSVGLNPHASEYAGMSSKRTIILSMIISGALAGLGGVVEGLGTFENVFVQGSSLAVGFDGMAVSLLAANSPLGIFFSSFLFGVLNIGAPGMNIAGIPPELVKVVTASIIFFVGSHYLIERYIIRPKKLVKGGK

SEQ ID NO: 9173 - DNA, 1626 bp, Streptococcus pyogenes
atgaattggtctactatttgggaacttatcaagataaacattctttattccaatccacaaagtttagctaacctcaaaaagcgtcaggaaaaacacccgaaagaaaacttcaaagcctataaaagcatgatgaggcaacaggccttaatgattgccatgtttttggtgatttacctttttatgtttattggtgtcgatttcagtcattatccaggacttttctcctttgacgttgctatgttttttatcatgtcaaccttgacagcctttagctctctttacaccattttttatgaaagtaatgacctaaaactttatattcacttaccagtaacgtcagaagaactctatattgcaaaaattgtctcgtcgctagggatgggtgctgtctttttgatgcctcttatctctcttctcttaattgcctattggcaactcttgggaaatcctttgtctattttagtagctatcgtgctctttttagtgttactagtgagttctatggtattagctatttatatcaatgcttgggtaggcaaaatcattgtaagaagtcgcaaacgaaaactcatttcaactatcatgatgtttgtctcaacttttggcgctttcgtcttaatttttgcgattaatattagtaacaacaagcgtacgatgacggatggcgtatttactgattacccaactattccctatttcaaaggattctatgatgttgttcaggcaccgttttctactgcggccctccttaacttttggttgccattgttacttatcctagctatggtatatggtattgtcacaaaagtgatgccaacttattatcgtgaggctttttatattagtaacgagaacaaagtcaagcaaactaaaaaaccagttaatcgtcctcatcagaatcaatcactggcgcagttgttgcgaaaacatcacctattaacgttacaaaatgcaactttactgacacaaacctatctcatgcccctgatgtatgtgatgctttttatcggtccaagtttgtcacgtggcacaggtttctttaagcatatttccccagattactttggggtagccttattatttggggttagtttgggtgtcatgtgtgcaacaccaaccagctttattggagtaggtatttcacttgaaaaggataactttacctttattaaaagcttaccaataacgttaaaaaaattcttgatggataaattttgcttgcttgtaggtctgcagctgattgtgcctatggtgatttatcttgtgtttggtctctttgtgttgcacctgcatcctcttctaacgattgctttttgtcttggctacgccctatcactgattgtgcaaggggaattgatgtatcgtcgtgactaccggcttctggatttaaaatggcaagacatgacgcaactctttaccagaggagatgggcaatggttaacaatgggacttatctttggtaatttaatagttgcaggtgtgctaggttttggagctgttatcattgccaatattatccaacaacctctgttgattagtattctattgagttgtctaatactaatggttttaggtcttgcgcaattatggattcaaaaaaccttctggaaaagcttagagaggctt

SEQ ID NO: 9174 - protein, 542 aa, Streptococcus pyogenes
MNWSTIWELIKINILYSNPQSLANLKKRQEKHPKENFKAYKSMMRQQALMIAMFLVIYLFMFIGVDFSHYPGLFSFDVAMFFIMSTLTAFSSLYTIFYESNDLKLYIHLPVTSEELYIAKIVSSLGMGAVFLMPLISLLLIAYWQLLGNPLSILVAIVLFLVLLVSSMVLAIYINAWVGKIIVRSRKRKLISTIMMFVSTFGAFVLIFAINISNNKRTMTDGVFTDYPTIPYFKGFYDVVQAPFSTAALLNFWLPLLLILAMVYGIVTKVMPTYYREAFYISNENKVKQTKKPVNRPHQNQSLAQLLRKHHLLTLQNATLLTQTYLMPLMYVMLFIGPSLSRGTGFFKHISPDYFGVALLFGVSLGVMCATPTSFIGVGISLEKDNFTFIKSLPITLKKFLMDKFCLLVGLQLIVPMVIYLVFGLFVLHLHPLLTIAFCLGYALSLIVQGELMYRRDYRLLDLKWQDMTQLFTRGDGQWLTMGLIFGNLIVAGVLGFGAVIIANIIQQPLLISILLSCLILMVLGLAQLWIQKTFWKSLERL

SEQ ID NO: 9175 - DNA, 1020 bp, Streptococcus pyogenes
atgacagcatcagatttacaaagggatcaatccctactggctaaaaaacgtttcagaagtggtctttatctagttcttttaattctcagcctcctatttttggcggttattgccttatcccttggtggtttggcggtttcttatggggcaattgtcaagggactgtttgtggcttatgacccccaagtggctttgatttatgatttgcgttttccaagaattgtcattgctttattagcaggagcagggatagctgtttcgggagttctttttcaagcagtgttgaaaaatcctatttcagaccctgctattatagggatttgtagtggtgctagttttatggttttagtctctagtttacttctgccgcagttgctgctgtatggtccaatcgtatcctttttaggaggcggagtgtctttcctgctgatttatggtttagcatggaagaaagggcttaatcctattcggcttattctaacagggattgctattaatgctttatttatggggttatcaactgctttaaccagctttttcacctcagctagtcccatggtcaatgctcttttagcaggtcatattagtcaaaaaacatgggctgatgtaggggttttattcccttatacattcattggcttgttactagctttgttattgtcaaaaacttgtaaccttcttcttttagatgatcaggtgattcgtcatttaggaatcgatgctacagcgttacggttgggaatttccttggttgctgttttattggcttcggtagccacttcgatcgttggagtggtttctttcctaggcttgattgtccctcatatgagccgcttgctggttggaagtaagcaccaaatcttaattcctttttcagctttgcttggagcctttgtctttttgctagccgatactttaggaagaagtcttgcttacccattggaaattagccctgcgattataatgagtattgtaggcgggccttactttatttacctgctaaggaggtctgatattata

SEQ ID NO: 9176 - protein, 340 aa, Streptococcus pyogenes
MTASDLQRDQSLLAKKRFRSGLYLVLLILSLLFLAVIALSLGGLAVSYGAIVKGLFVAYDPQVALIYDLRFPRIVIALLAGAGIAVSGVLFQAVLKNPISDPAIIGICSGASFMVLVSSLLLPQLLLYGPIVSFLGGGVSFLLIYGLAWKKGLNPIRLILTGIAINALFMGLSTALTSFFTSASPMVNALLAGHISQKTWADVGVLFPYTFIGLLLALLLSKTCNLLLLDDQVIRHLGIDATALRLGISLVAVLLASVATSIVGVVSFLGLIVPHMSRLLVGSKHQILIPFSALLGAFVFLLADTLGRSLAYPLEISPAIIMSIVGGPYFIYLLRRSDII

SEQ ID NO: 9177 - DNA, 894 bp, Streptococcus pyogenes
atgaacgaaatgcttatccttagactgatacaagctttgctagtttcggcaatgctttttattttctttatgttagtaaaacatcttaaaaaaaataagatcaatccttttaaacgcttttggacggggttttggattggcctgctaacagatgcccttgacacccttgggatagggtcttttgctactaccacaacgtgctttaagttaactaaattagtcactgacgatagacaattgcctggcactatgaccgtagctcatgtgcttccggtgctcattcaatctctttgctttatttttgtcgtaaaagttgaggttctaactttacttgctatggctgcagcagcctttattggagcttattttgggactcatattacaaaaaactggcatgctccaactgtccaacgaatccttggtagtcttttaatcatagcagctataatcatgatcattagaataatctaccatccaggagaacacctttcagacaccattcatggcctccatggcatctggctttttgttggaattggttttaattttatcgttggagtcttgatgactatggggttaggcaattatgctccagaattgattttcttttcattaatgggtcttagcccaacagttgctatgcctgttatgatgctagatgcagctatgattatgacagcttctagtagccagtttatcaaagcaaaccgtgtcagttgggatggttttgctggaattgtttctggtggtattattggcgttttactagctgtgtttttcttaacgaatttagatattaatagcttgaaacttctggtcatcgctatcgttttcttcactggtggaatgctgattcgttcctcctttacctctcataagcaacaaacaaataga

SEQ ID NO: 9178 - protein, 298 aa, Streptococcus pyogenes
MNEMLILRLIQALLVSAMLFIFFMLVKHLKKNKINPFKRFWTGFWIGLLTDALDTLGIGSFATTTTCFKLTKLVTDDRQLPGTMTVAHVLPVLIQSLCFIFVVKVEVLTLLAMAAAAFIGAYFGTHITKNWHAPTVQRILGSLLIIAAIIMIIRIIYHPGEHLSDTIHGLHGIWLFVGIGFNFIVGVLMTMGLGNYAPELIFFSLMGLSPTVAMPVMMLDAAMIMTASSSQFIKANRVSWDGFAGIVSGGIIGVLLAVFFLTNLDINSLKLLVIAIVFFTGGMLIRSSFTSHKQQTNR

SEQ ID NO: 9179 - DNA, 1341 bp, Streptococcus pyogenes
atgatgttaacgaaggggcaacttccctatagtgctgcttttacaacaggagggctcttttactttgttatcattgcattaagttattatttgggatcgacactttggctagtctttgttcaggtgttttgtttttacttatctggtttatatctttataaactcattaattatatgacaggctttcaaaaagtggctttaactttttcaattagctactatttattatctgttagtcttggttttgggggattgtatcctactcaactggctatgccatttatattaatatcggcttggtttttaactaagtattttgcctgtttagtgaaagatgaggcatttattctttttggctttgtaggtgctcttgcaatgctaattgacccgagtacccttatcttttggtcttttgcttgtgtgacagttttttcttataatataagccaaaagcatcttgcaagaggtttttatcaactgctagcttcgatttttggaatgattttagttttttacacagcaggatatttcattttgaacttacaagtgctaaatccttatttatcacaaacgatgatttatccttttactttttttaaatcaggaaacttatcgttgctttttggactggctattcagttgttcttcgctttggggcttggtcttttgacgggaatggagaatgtcattaggcgatttaaaaacaattctgatagggtcgtcaagtggctatttgtcatggtcattctagaatctatacttgtggctatattttcacaagactatcgcccctatcatcttttacctcttttaccttttggattaattttgactgctattcctgttggctatcagtatggtataggattaggtcagagtagtcatcgcagacgtcatggtaaaaatggtgttggtcgagtaatgatgatttatcttaagagacacttttatttgccaattttaattgtagggacaatactaatctgttctacttattgtttcattagtagtattcctcttaatcaggagcgtgatcatattgctagttatttagaacagaaactaaataaaactcaatctatttatgtttgggatgatacttctaaaatttatttggacagtaaagctaaatctgtttctcaatttagttctcctgacatcaatacgcaaaaagagagtcatcgaaaaatattagaagatgaactattagaaaataaggctgcttatatcgttgttaatcgctataaaaacctgcctaaaatcattcaaaaagtattatctactaattacaaagtagataaacagataacgacaaaaagttttattgtttatcagaaaaag

SEQ ID NO: 9180 - protein, 447 aa, Streptococcus pyogenes
MMLTKGQLPYSAAFTTGGLFYFVIIALSYYLGSTLWLVFVQVFCFYLSGLYLYKLINYMTGFQKVALTFSISYYLLSVSLGFGGLYPTQLAMPFILISAWFLTKYFACLVKDEAFILFGFVGALAMLIDPSTLIFWSFACVTVFSYNISQKHLARGFYQLLASIFGMILVFYTAGYFILNLQVLNPYLSQTMIYPFTFFKSGNLSLLFGLAIQLFFALGLGLLTGMENVIRRFKNNSDRVVKWLFVMVILESILVAIFSQDYRPYHLLPLLPFGLILTAIPVGYQYGIGLGQSSHRRRHGKNGVGRVMMIYLKRHFYLPILIVGTILICSTYCFISSIPLNQERDHIASYLEQKLNKTQSIYVWDDTSKIYLDSKAKSVSQFSSPDINTQKESHRKILEDELLENKAAYIVVNRYKNLPKIIQKVLSTNYKVDKQITTKSFIVYQKK

SEQ ID NO: 9181 - DNA, 831 bp, Streptococcus pyogenes
atgtttacatggggaagcattggatttgttagtaacaaaattggaggaaaaccttcgcaacaaactctaggaatgacttttggggctttattattttcattagctgtttggttaattgttagacctgagatgacactgcaactttggctttttggaatattgggtggttttatctggtcaattggtcaaactggtcaatttcatgccatgcaatacatgggagtctccgttgccaatcctttgtcaagtggctctcaacttgttctgggaagtttgattggtgtcctcgtttttcatgaatggacaagacctatgcaatttgtagtaggaagtctagcactattacttctgattgttggtttttacttttctagtaaacaagatgatgctaatgcacaagtcaatcaccttcataatttttcaaaaggatttagggcgctcacttattcaacaattggttacgtgatgtatgctgtattatttaataacatcatgaaatttgaagttttgtcagtcattttacccatggcagtaggtatggttttaggagctataactttcatgtcatttaaaatttccattgaccagtatgtgattaaaaatagcgttgttggattactttggggcattgggaatatttttatgcttttagctgcatcaaaagcaggacttgctattgcctttagtttctcacaattaggtgctatcatttcgattgtcggaggcattttattcctaggcgaaaccaaaaccaaaaaagaaatgcgttgggttgtcacaggaattatttgttttatcgtaggtgctattttattaggtgtggtcaaatct

SEQ ID NO: 9182 - protein, 277 aa, Streptococcus pyogenes
MFTWGSIGFVSNKIGGKPSQQTLGMTFGALLFSLAVWLIVRPEMTLQLWLFGILGGFIWSIGQTGQFHAMQYMGVSVANPLSSGSQLVLGSLIGVLVFHEWTRPMQFVVGSLALLLLIVGFYFSSKQDDANAQVNHLHNFSKGFRALTYSTIGYVMYAVLFNNIMKFEVLSVILPMAVGMVLGAITFMSFKISIDQYVIKNSVVGLLWGIGNIFMLLAASKAGLAIAFSFSQLGAIISIVGGILFLGETKTKKEMRWVVTGIICFIVGAILLGVVKS

SEQ ID NO: 9183 - DNA, 1506 bp, Streptococcus pyogenes
ttgttagattattatttggaatccgatattattgaccagaaaatcctactggctattttgttgacagaaaaagaactgacgatggcagcagcttgttctcaaacaactttgactgctttaaaaataaagcagtatcttcgacaatttaacgccttatttaaagggtacttacgtattgagcttattaaatctcgtatttattgtgaggtattaaatgataagcgagaagcatttttttatgacatttttgccttatcagatactctaaaaatgttgacattcttattactagataatcccaaacacaaatcaatcgctgtttatacacgaaaacaagggatatcccagtcaaaagcttatcgtcttattcataaattaaaacattatttacaagacattggtttaaatattgtagacaatactgttatcggagatgaacttaaaatacggtatttgattgctcttttacataaagagtacggcattatattatatgatatacaacctgcagacattgaaacgattcatgcttttatctttgcagcacaaaaaaacttacaaccttctgcctttttagatagacgcttcttgttttttgatgtgctgttgatgttgacttggaagcgccatcgctatcctgttcatttgcctcatttagctctttttgaacatctcaaatccttgcctatttttgacaatatcaaaaccattgccgtggatgagctagcacctcgaactcgtgtcacattttcgtctgatgattttgactatctctttttaatttatttaacgactgataactccttcttgagtgggtactggacaagtcatcagcgacaacaactttaccatttaatcaccaaagatcccgattatcatttactaatccatcgtcttcaggcactagttggaaaatattccgatattcatgagcatatccctaacttaattccttttttcaaaagaactctctacaatttacaaactttaattacctttgatggttattattttgatcaatatcaaggcaacatgctactactagataagcttgaaaccgttatcaaagattggctttatgacacaggccgtcaaggcagtattagttctggtcacttacacttgatgtgtttataccttgagcagatcttggaaagctctattgctccaatcaatattactgttattgagagccaagaaactgttggtaacgttatagctaatttcatcacctcaactatcccttcttacaaagttaaactgtcacgggtcaatatcttatctgataatatttatccctatgataaacctgtagatctggttgtaaccagtcagaagctcttgcctttcttaaaagaactcggtgtttttcccaaagagacccgcttgtttggtttgagtttggactgtatccaacagcagcgcgaagatttaatcaaaaccatcttagccttgcaccagaaccactaccaaaaacgtttagaagaactttggagagttccttct

SEQ ID NO: 9184 - protein, 502 aa, Streptococcus pyogenes
LLDYYLESDIIDQKILLAILLTEKELTMAAACSQTTLTALKIKQYLRQFNALFKGYLRIELIKSRIYCEVLNDKREAFFYDIFALSDTLKMLTFLLLDNPKHKSIAVYTRKQGISQSKAYRLIHKLKHYLQDIGLNIVDNTVIGDELKIRYLIALLHKEYGIILYDIQPADIETIHAFIFAAQKNLQPSAFLDRRFLFFDVLLMLTWKRHRYPVHLPHLALFEHLKSLPIFDNIKTIAVDELAPRTRVTFSSDDFDYLFLIYLTTDNSFLSGYWTSHQRQQLYHLITKDPDYHLLIHRLQALVGKYSDIHEHIPNLIPFFKRTLYNLQTLITFDGYYFDQYQGNMLLLDKLETVIKDWLYDTGRQGSISSGHLHLMCLYLEQILESSIAPINITVIESQETVGNVIANFITSTIPSYKVKLSRVNILSDNIYPYDKPVDLVVTSQKLLPFLKELGVFPKETRLFGLSLDCIQQQREDLIKTILALHQNHYQKRLEELWRVPS

SEQ ID NO: 9185 - DNA, 903 bp, Streptococcus pyogenes
gtgctgatgaccaaagtcagaaaagctattattcccgcagcaggtttaggcacacgttttttacctgcaaccaaggcccttgccaaggagatgctacctattgttgataaaccaactattcaatttatcgttgaagaagctctaaaatcaggtatcgaagaaattcttatcgttactggaaaatccaaacgctccatagaagatcattttgattctaattttgaattagaatataatttacaggctaaaggaaaaatcgaacttctaaagttagtagacgagaccacttctattaatcttcactttattcgacagagtcatccaagaggattaggagacgcagttcttcaagcaaagacctttgttggcaatgaaccttttgttgtcatgctaggtgatgatctgatggatattacaaatccaaatgtaaaaccattaaccaaacaattgatcgatgactatgaagaaactcatgctgcaactattgccgtcatgagggttcctcacgaggatgtctctaactacggtatcattgctcctcaagcaaaagcagtaaaaggactctatagtgtggatacttttgttgaaaaaccacaacctcaagatgcacctagtgatttggcaattattggacgttacttgctcacaccagaaatttttagtattttagaaaaacaagaacctggtgcaggcaatgaagttcaactgactgatgctattgataccctcaataagacacagcgtgtctttgctcgtgagtttaaagggaaacgctatgatgttggcgataaatttgggtttatgaaaacttctttggattatgccctgaaacaccctcaagtcaaagatgacttgaaagcctacatcatccaactgggcaaagcactagagaagacaaaacca

SEQ ID NO: 9186 - protein, 301 aa, Streptococcus pyogenes
VLMTKVRKAIIPAAGLGTRFLPATKALAKEMLPIVDKPTIQFIVEEALKSGIEEILIVTGKSKRSIEDHFDSNFELEYNLQAKGKIELLKLVDETTSINLHFIRQSHPRGLGDAVLQAKTFVGNEPFVVMLGDDLMDITNPNVKPLTKQLIDDYEETHAATIAVMRVPHEDVSNYGIIAPQAKAVKGLYSVDTFVEKPQPQDAPSDLAIIGRYLLTPEIFSILEKQEPGAGNEVQLTDAIDTLNKTQRVFAREFKGKRYDVGDKFGFMKTSLDYALKHPQVKDDLKAYIIQLGKALEKTKP

SEQ ID NO: 9187 - DNA, 2619 bp, Streptococcus pyogenes
atggacttagaacaaacgaagccaaaccaagttaagcagaaaattgctttaacctcaacaattgctttattgagtgccagtgtaggcgtatctcaccaagtcaaagcagatgatagagcctcaggagaaacgaaggcgagtaatactcacgacgatagtttaccaaaaccagaaacaattcaagaggcaaaggcaactattgatgcagttgaaaaaactctcagtcaacaaaaagcagaactgacagagcttgctaccgctctgacaaaaactactgctgaaatcaaccacttaaaagagcagcaagataatgaacaaaaagctttaacctctgcacaagaaatttacactaatactcttgcaagtagtgaggagacgctattagcccaaggagccgaacatcaaagagagttaacagctactgaaacagagcttcataatgctcaagcagatcaacattcaaaagagactgcattgtcagaacaaaaagctagcatttcagcagaaactactcgagctcaagatttagtggaacaagtcaaaacgtctgaacaaaatattgctaagctcaatgctatgattagcaatcctgatgctatcactaaagcagctcaaacggctaatgataatacaaaagcattaagctcagaattggagaaggctaaagctgacttagaaaatcaaaaagctaaagttaaaaagcaattgactgaagagttggcagctcagaaagctgctctagcagaaaaagaggcagaacttagtcgtcttaaatcctcagctccgtctactcaagatagcattgtgggtaataataccatgaaagcaccgcaaggctatcctcttgaagaacttaaaaaattagaagctagtggttatattggatcagctagttacaataattattacaaagagcatgcagatcaaattattgccaaagctagtccaggtaatcaattaaatcaataccaagatattccagcagatcgtaatcgctttgttgatcccgataatttgacaccagaagtgcaaaatgagctagcgcagtttgcagctcacatgattaatagtgtaagaagacaattaggtctaccaccagttactgttacagcaggatcacaagaatttgcaagattacttagtaccagctataagaaaactcatggtaatacaagaccatcatttgtctacggacagccaggggtatcagggcattatggtgttgggcctcatgataaaactattattgaagactctgccggagcgtcagggctcattcgaaatgatgataacatgtacgagaatatcggtgcttttaacgatgtgcatactgtgaatggtattaaacgtggtatttatgacagtatcaagtatatgctctttacagatcatttacacggaaatacatacggccatgctattaactttttacgtgtagataaacataaccctaatgcgcctgtttaccttggattttcaaccagcaatgtaggatctttgaatgaacactttgtaatgtttccagagtctaacattgctaaccatcaacgctttaataagacccctataaaagccgttggaagtacaaaagattatgcccaaagagtaggcactgtatctgatactattgcagcgatcaaaggaaaagtaagctcattagaaaatcgtttgtcggctattcatcaagaagctgatattatggcagcccaagctaaagtaagtcaacttcaaggtaaattagcaagcacacttaagcagtcagacagcttaaatctccaagtgagacaattaaatgatactaaaggttctttgagaacagaattactagcagctaaagcaaaacaagcacaactcgaagctactcgtgatcaatcattagctaagctagcatcgttgaaagccgcactgcaccagacagaagccttagcagagcaagccgcagccagagtgacagcactggtggctaaaaaagctcatttgcaatatctaagggactttaaattgaatcctaaccgccttcaagtgatacgtgagcgcattgataatactaagcaagatttggctaaaactacctcatctttgttaaatgcacaagaagctttagcagccttacaagctaaacaaagcagtctagaagctactattgctaccacagaacaccagttgactttgcttaaaaccttagctaacgaaaaggaatatcgccacttagacgaagatatagctactgtgcctgatttgcaagtagctccacctcttacgggcgtaaaaccgctatcatatagtaagatagatactactccgcttgttcaagaaatggttaaagaaacgaaacaactattagaagcttcagcaagattagctgctgaaaatacaagtcttgtagcagaagcgcttgttggccaaacctctgaaatggtagcaagtaatgccattgtgtctaaaatcacatcttcgattactcagccctcatctaagacatcttatggctcaggatcttctacaacgagcaatctcatttctgatgttgatgaaagtactcaaagagctcttaaagcaggagtcgtcatgttggcagctgtcggcctcacaggatttaggttccgtaaggaatctaag

SEQ ID NO: 9188 - protein, 873 aa, Streptococcus pyogenes
MDLEQTKPNQVKQKIALTSTIALLSASVGVSHQVKADDRASGETKASNTHDDSLPKPETIQEAKATIDAVEKTLSQQKAELTELATALTKTTAEINHLKEQQDNEQKALTSAQEIYTNTLASSEETLLAQGAEHQRELTATETELHNAQADQHSKETALSEQKASISAETTRAQDLVEQVKTSEQNIAKLNAMISNPDAITKAAQTANDNTKALSSELEKAKADLENQKAKVKKQLTEELAAQKAALAEKEAELSRLKSSAPSTQDSIVGNNTMKAPQGYPLEELKKLEASGYIGSASYNNYYKEHADQIIAKASPGNQLNQYQDIPADRNRFVDPDNLTPEVQNELAQFAAHMINSVRRQLGLPPVTVTAGSQEFARLLSTSYKKTHGNTRPSFVYGQPGVSGHYGVGPHDKTIIEDSAGASGLIRNDDNMYENIGAFNDVHTVNGIKRGIYDSIKYMLFTDHLHGNTYGHAINFLRVDKHNPNAPVYLGFSTSNVGSLNEHFVMFPESNIANHQRFNKTPIKAVGSTKDYAQRVGTVSDTIAAIKGKVSSLENRLSAIHQEADIMAAQAKVSQLQGKLASTLKQSDSLNLQVRQLNDTKGSLRTELLAAKAKQAQLEATRDQSLAKLASLKAALHQTEALAEQAAARVTALVAKKAHLQYLRDFKLNPNRLQVIRERIDNTKQDLAKTTSSLLNAQEALAALQAKQSSLEATIATTEHQLTLLKTLANEKEYRHLDEDIATVPDLQVAPPLTGVKPLSYSKIDTTPLVQEMVKETKQLLEASARLAAENTSLVAEALVGQTSEMVASNAIVSKITSSITQPSSKTSYGSGSSTTSNLISDVDESTQRALKAGVVMLAAVGLTGFRFRKESK

SEQ ID NO: 9189 - DNA, 879 bp, Streptococcus pyogenes
ttgctgacctttggaggtgcaagtgcggttaaggcggaagaaaatgaaaaagtaagagagcaagaaaagctcatacagcaactttctgaaaagctagtggaaattaatgacttacaaactttaaatggtgataaagagagtatacagtctctcgtagattatctgactcgaagaggaaaacttgaagaagaatggatggaatatttgaattctggtattcaacgcaaactttttgttggtccaaaaggacctgcaggtgaaaaaggagaacaaggtcctactggaaaacaaggcgagcgtggtgagaccggccctgcaggtccacgtggtgacaagggcgaaactggtgacaaaggagcccagggtccagtaggtcccgctggcaaggacggccaaaacggtaaagatggtcttccaggtaaagacggcaaggacggccaaaacggtaaagatggtcttccaggtaaagacggcaaggacggccaagacggtaaagatggcctcccaggtaaagacggtaaggatggccaaaatggcaaagatggtcttccaggtaaagacggtcaaccaggtaaaccagctcctaaaacaccagaggtccctcaaaacccagatactgcaccacatactccaaaaacccctcggatccctggtcaatcaaaagacgtgacacctgctcctcaaaacccttctaatagaggtctaaacaaaccacaaacacaaggtggtaatcagctcgcaaaaacaccggcagctcacgacacacacagacaattgccagcaacaggcgaaacaaccaatccattctttacagcagctgctgtagctatcatgacgacagctggagttgtagctgttgcaaaacgtcaagaaaacaac

SEQ ID NO: 9190 - protein, 293 aa, Streptococcus pyogenes
LLTFGGASAVKAEENEKVREQEKLIQQLSEKLVEINDLQTLNGDKESIQSLVDYLTRRGKLEEEWMEYLNSGIQRKLFVGPKGPAGEKGEQGPTGKQGERGETGPAGPRGDKGETGDKGAQGPVGPAGKDGQNGKDGLPGKDGKDGQNGKDGLPGKDGKDGQDGKDGLPGKDGKDGQNGKDGLPGKDGQPGKPAPKTPEVPQNPDTAPHTPKTPRIPGQSKDVTPAPQNPSNRGLNKPQTQGGNQLAKTPAAHDTHRQLPATGETTNPFFTAAAVAIMTTAGVVAVAKRQENN

SEQ ID NO: 9191 - DNA, 882 bp, Streptococcus pyogenes
atgataaaacgatgtaaaggaattggtctagccttaatggccttctttttggtagcttgtgtgaatcagcaccctaaaacggctaaagagactgaacagcagagaattgtagccacttcggttgctgtggttgatatctgtgaccgtttaaatttagacctcgttggggtttgtgatagtaaattatatacccttcctaaacgctatgatgctgttaagcgtgtgggtttacccatgaatcctgatatagagttgattgcttctttgaaaccaacttggattttgagtcccaattctttacaagaagatttggaacccaagtatcaaaaattggatactgagtatggttttttgaacttacgaagtgttgagggcatgtaccagtccattgatgatttagggaaccttttccaacgtcaacaagaagcaaaagaattgcgccagcaataccaggactattatcgtgctttccaagctaaacgtaaggggaagaaaaagcctaaagtgcttattcttatgggcttgccaggtagttatttggtggcgacgaaccaatcttatgtagggaatcttttggacttggcaggtggtgagaatgtttatcagtcagatgagaaagaatttctatcagctaatcctgaagacatgctggctaaggagcctgacttgattttacgaacagctcatgccattccagacaaggtaaaagtgatgtttgacaaagaatttgctgaaaatgatatttggaaacattttacggcagtcaaggaagggaaagtctatgatttggacaataccctgtttggcatgagtgctaaattgaactacccagaagccttggacaccttaacacagctttttgaccacgtgggagatcatccg

SEQ ID NO: 9192 - protein, 294 aa, Streptococcus pyogenes
MIKRCKGIGLALMAFFLVACVNQHPKTAKETEQQRIVATSVAVVDICDRLNLDLVGVCDSKLYTLPKRYDAVKRVGLPMNPDIELIASLKPTWILSPNSLQEDLEPKYQKLDTEYGFLNLRSVEGMYQSIDDLGNLFQRQQEAKELRQQYQDYYRAFQAKRKGKKKPKVLILMGLPGSYLVATNQSYVGNLLDLAGGENVYQSDEKEFLSANPEDMLAKEPDLILRTAHAIPDKVKVMFDKEFAENDIWKHFTAVKEGKVYDLDNTLFGMSAKLNYPEALDTLTQLFDHVGDHP

SEQ ID NO: 9193 - DNA, 951 bp, Streptococcus pyogenes
atgagaaaagaggctcaaaaggacatgaaacaaatgaataaactcattacaggagtggtaacgctggcgacagtcgtgaccttatcagcttgtcaatcatcacacaacaacaccaaactcgtctcgatgaaaggagacaccatcactgtcagtgacttctacaatgagaccaaaaacacagaactcgcacaaaaagccatgttaagcttggtgattagccgcgtttttgagacacaatatgccaacaaagtctctgacaaagaggttgaaaaagcctataaacaaaccgcagaccaatacggtacatcctttaagacagtcctagcacaatcaggcttaacgccagaaacctataaaaaacaaattcgcctcacaaaattagtcgaatatgccgtcaaagaacaagccaaaaacgaaaccatctcaaaaaaagactaccgtcaggcctatgacgcttataccccaaccatgaccgcagaaatcatgcagtttgaaaaagaagaggatgccaaagcagcgcttgaagccgtcaaagctgaaggggcagactttgcagctattgccaaagaaaaaaccactgcagccgataaaaaaacaacctatacgtttgactcaggcgaaacaaccctaccagcagaagtagttagagctgcatcaggcctcaaagaagggaacagatcagaaatcatcacagcgcttgatccagccacctcaaaacgcacctaccatatcatcaaagtcaccaaaaaagcaactaaaaaagcagactggaaagcgtaccaaaaacgcttgaaagacatcatcgtgactggcaaattaaaagaccctgacttccaaaacaaagtcatcgctaaagctcttgataaagcaaatgtcaaaatcaaagacaaagcatttgccaatatcttagcccagtttgcaaaacctaaccaaaaacaacctgcccaaaaa

SEQ ID NO: 9194 - protein, 317 aa, Streptococcus pyogenes
MRKEAQKDMKQMNKLITGVVTLATVVTLSACQSSHNNTKLVSMKGDTITVSDFYNETKNTELAQKAMLSLVISRVFETQYANKVSDKEVEKAYKQTADQYGTSFKTVLAQSGLTPETYKKQIRLTKLVEYAVKEQAKNETISKKDYRQAYDAYTPTMTAEIMQFEKEEDAKAALEAVKAEGADFAAIAKEKTTAADKKTTYTFDSGETTLPAEVVRAASGLKEGNRSEIITALDPATSKRTYHIIKVTKKATKKADWKAYQKRLKDIIVTGKLKDPDFQNKVIAKALDKANVKIKDKAFANILAQFAKPNQKQPAQK

SEQ ID NO: 9195 - DNA, 1533 bp, Streptococcus pyogenes
atgtctgtgaaagcgttatcgtttactaggaggattcgcatgataaacaaaaaaatatcacttggagttttaagtattctgacagccttttcgcttcaaagtgttagttatgcttgtactggttttattattggcaaagatttaaccaaagacggttctcttctttatggtcgaacagaagatcttgagccacaccataataaaaatttcattgtacgtctagcaaaggacaatcctgctggcgaaaaatggaaagacctctctaatggttttgagtaccccttgcctgagcattcttatcgctatagtgcgattcctgatgtaacacctaacaaaggcgtttatgacgaagctggttttaatgagtttggcgtctctatgtctgcaacagtatcagcttcagctaatgatgccatccaaaaaattgatccttacgtcaaaaatggcttagcggaatcatctatgaccagtgtcattttaccaagtgtcaaaacagcccgtgaaggtgtcgcattgatcgctaaaatagtcactgaaaaaggagctgctgaaggaaatattgttaccttggctgacaaagacggcatctggtacatggaaattctctctggtcaccaatacgttgccatcaaattcccagatgataaatacgctgtttttccaaataccttctatctcggacatgtcgatttcaatgataaggaaaatacgattgcctcagaagatgtggaaaaagtcgctaaaaaagccaaatcttataccgaagttgatggtaaatttcatattgccaaatcttacaatccaccactaaacgatgccaaccgctctcgctctttctcagggattaaatcacttgaccctgattcaaaagtaacttataaagacagcaattatgagttgctccaaagcactgataagaccttcagtctagaagatgcgatgaaactgcaacgtaatcgttttgaggggctggatcttaaaccacttgatcagatggcattagacggtaagggtaaaccaaaatccaaaaaagctgttaaaggttatgcttatcccatatcaaatcctaatgtcatggaagctcatattttccaactgaaaaaagacatccctgctgaattgggtggtgtcatgtggctatctattggcagtcctcgtaatgccccttacttgccataccttggcaatatcagtagaacctatgaagcctatcaagaaaaaagcacccaatataacgataagtcatggtattggacggtgtcacacattaatgatctcgtggctgctcatccaaaaccatttggaactaaagtgattgatgagatgaaaggcttggaaaaaacctggatagccgaacaagacaaaagcaccaaagaaatcagtgacttagtcgtcagtgaccccaaagctgctcaagaaaaagctgataagatttcactagatcgcgctgaaaaaaccttcaaacgcttaaaagctattgaagccaagttggttaaagaaaaacccaaaaacaagaaaggcttgaatagatca

SEQ ID NO: 9196 - protein, 511 aa, Streptococcus pyogenes
MSVKALSFTRRIRMINKKISLGVLSILTAFSLQSVSYACTGFIIGKDLTKDGSLLYGRTEDLEPHHNKNFIVRLAKDNPAGEKWKDLSNGFEYPLPEHSYRYSAIPDVTPNKGVYDEAGFNEFGVSMSATVSASANDAIQKIDPYVKNGLAESSMTSVILPSVKTAREGVALIAKIVTEKGAAEGNIVTLADKDGIWYMEILSGHQYVAIKFPDDKYAVFPNTFYLGHVDFNDKENTIASEDVEKVAKKAKSYTEVDGKFHIAKSYNPPLNDANRSRSFSGIKSLDPDSKVTYKDSNYELLQSTDKTFSLEDAMKLQRNRFEGLDLKPLDQMALDGKGKPKSKKAVKGYAYPISNPNVMEAHIFQLKKDIPAELGGVMWLSIGSPRNAPYLPYLGNISRTYEAYQEKSTQYNDKSWYWTVSHINDLVAAHPKPFGTKVIDEMKGLEKTWIAEQDKSTKEISDLVVSDPKAAQEKADKISLDRAEKTFKRLKAIEAKLVKEKPKNKKGLNRS

SEQ ID NO: 9197 - DNA, 1197 bp, Streptococcus pyogenes
atgtttacaaaaacgcaggaagctttggaggctcttggtgcagctatcactaccaaggaaattaaacaagaaccccgtttatggcaagaaaccatgacgttttttgaagaaacaagagattctctggattcttttttaaagagagtttgtaacagcgctaacagaaataacgttcatgtcatctttacaggtgcgggtacatctgagtacatcggtaataccatttgcccttacttgaagaaggtggggaatcggcagcgctatctctttgagagcgttgcttcaaccgatttggttgcggcgccagattattatcttgttgaggaagagacggtactattagtctcctttgctaggagtggtaatagtccagaaagtgtagcggctgttaacctggtcaatcaactagtgccaaatagttatcatttaaccattacctgcgccaaagatggagaactggcgaaaaaagcacagcaagatgagcgttcttacctttatttgatgcctgaagacgctaatgatgctggttttgccatgactggtagttttacctgtatgatgctagcggctcttttgatttttgatgatgctaacagtatagctcagaaagaagcttatgtgactgatatgattcttgctgggcaagctgttattgaccaagaaagacggctacaagagctagctgatttaggatttgaacgtttagtttatctaggttctgctggtttagccaagttaacccaagaagctcaattaaaaatgttagaattgacagctggacaagttgcgaccctctacgagtcctttatgggctttaggcatggtccgaaatcttttattaatgaccgtaccttagtcattggatttgtcaataatgatgcttacgtcagacagtacgatttggacatgttagaggaaatccaagcagatggcattgcccttaaaatcttggctctattgcaaggaggggatatcaacttttcagaggaccaatttcgactagacacccgtcacttattgccagacgcttacttagcttttcccatgattttagtcgcgcagaccttggccctcttaacggccgttacattaggaaattcccctgacaccccatctgcgacaggaacggttaatcgtgtggtcaaaggagtaacgattcacccttacccgactagtagtcgtcaatgcaacaaagct

SEQ ID NO: 9198 - protein, 399 aa, Streptococcus pyogenes
MFTKTQEALEALGAAITTKEIKQEPRLWQETMTFFEETRDSLDSFLKRVCNSANRNNVHVIFTGAGTSEYIGNTICPYLKKVGNRQRYLFESVASTDLVAAPDYYLVEEETVLLVSFARSGNSPESVAAVNLVNQLVPNSYHLTITCAKDGELAKKAQQDERSYLYLMPEDANDAGFAMTGSFTCMMLAALLIFDDANSIAQKEAYVTDMILAGQAVIDQERRLQELADLGFERLVYLGSAGLAKLTQEAQLKMLELTAGQVATLYESFMGFRHGPKSFINDRTLVIGFVNNDAYVRQYDLDMLEEIQADGIALKILALLQGGDINFSEDQFRLDTRHLLPDAYLAFPMILVAQTLALLTAVTLGNSPDTPSATGTVNRVVKGVTIHPYPTSSRQCNKA

SEQ ID NO: 9199 - DNA, 864 bp, Streptococcus pyogenes
atgaaacggattgttgtggcaaatgatctggttggtgttggtaaggtagccttgtctgctagtattcctttaatggcttcttgtttgttagagcaagttttattaccaacttgccttttatcaagccatactggcggaggacagaaccctgtgaagcatactacatcaagtatattagacgtttttttaacagattgggacaacaaaagaattaagtttgacggcatttttataggttattttacgacaacaagagatgggcaaaagctgctagaatggctttcaagaaagcaacttcccttaattttagatccaattatggcagataatggaaaactttatcaaggcttcagtcaaaaacatatagagattatgataaaacttactcaaaaagctgagcttgttttacctaatattagtgaggcttgtctattaacacaaacagcttatttagcaaaaaattatgatgaagaagatattagacaggtggctagaaaattagctaagcttggacctaaacaggttgtcattagcggaatctcttttgaggagggcagcattggttttgcttactatcagtcagattcagatcaattaacattccattttgggaagcaattcccttaccatttctatggtacaggagatatagcatcagctattataacagcaggattctattatcagctaccactaacacaaattctagatcttgttgtttcatttcttgaaaaagtattgcaaaatacccttacattaaaaagagatttaatcttaggtgttgcttatgaatctcatttaaattacttaactaaatcgtttaaaaagttgttggaggaaaaaaatgtcatctcaaaaattagc

SEQ ID NO: 9200 - protein, 288 aa, Streptococcus pyogenes
MKRIVVANDLVGVGKVALSASIPLMASCLLEQVLLPTCLLSSHTGGGQNPVKHTTSSILDVFLTDWDNKRIKFDGIFIGYFTTTRDGQKLLEWLSRKQLPLILDPIMADNGKLYQGFSQKHIEIMIKLTQKAELVLPNISEACLLTQTAYLAKNYDEEDIRQVARKLAKLGPKQVVISGISFEEGSIGFAYYQSDSDQLTFHFGKQFPYHFYGTGDIASAIITAGFYYQLPLTQILDLVVSFLEKVLQNTLTLKRDLILGVAYESHLNYLTKSFKKLLEEKNVISKIS

SEQ ID NO: 9201 - DNA, 651 bp, Streptococcus pyogenes
atgggaaaagaaataaaagtgaaatgctttttgcgtagatcagcttttggattagttgcggtgtcagcatcagtattagtcggttcaacagtatctgctgttgactcacctatcgaacagcctcgaattattccaaatggcggaaccttaactaatcttcttggcaatgctccagaaaaactggcattacgtaatgaagaaagagccattgatgaattaaaaaaacaagctattgaggataaagaagctacgacagctatagaagcagcaagttcagatgccttagaagcattagcggatcaaacagacgctttacaatcagaagaagctgcggttgttaaagcggataacgctgctagtgacgccttagaagcattggcggatcaaacagacgctttacaatcagaagaagctgaagtagttcaatcagataacgctgctagtgacgcctgggaaaaagcagcaactccaatcgctttagatgttaagaaaactaaagatacaaaacctgtagttaaaaaagaagaaagacaaaacgttaatacccttcctacaactggtgaagagtctaacccattctttacagctgctgcgcttgcaataatggtaagtacaggtgtgttagttgtaagttcaaagtgcaaagaaaat

SEQ ID NO: 9202 - protein, 217 aa, Streptococcus pyogenes
MGKEIKVKCFLRRSAFGLVAVSASVLVGSTVSAVDSPIEQPRIIPNGGTLTNLLGNAPEKLALRNEERAIDELKKQAIEDKEATTAIEAASSDALEALADQTDALQSEEAAVVKADNAASDALEALADQTDALQSEEAEVVQSDNAASDAWEKAATPIALDVKKTKDTKPVVKKEERQNVNTLPTTGEESNPFFTAAALAIMVSTGVLVVSSKCKEN

SEQ ID NO: 9203 - DNA, 1104 bp, Streptococcus pyogenes
atggaacataaatggaaattatggctatttatcgttggagtggtcttgttaataggcggagcttctgttctcattcagaaaggtcaagccaaggcttttagtcaaggcaagcctcaactaccagctaaaaaagtcaaatccactaaagtagatcccaatgcccctgttgatcaaaaagtgatttacctggctggaggctgtttctggggcgttgaagaatatttttcacaagtggatggcgttctagatgcggtgtcaggctatgccaatggtagaggcgataccaccaactaccagttaattcatcagactggtcatgcagaaaccgttgaagtggcctatgatgcgaaccgtattagcttgaaagaattattactgcattttttccgaattattgacccaaccagtcttaataagcaaggaaatgatcgcggtagtcaataccgaactgggatttactatactgacaaagcagatttagctattattgatgaggtcttcaaagaaaaagctaaggattacaagaaaaaaatagtggttgaaaaagcaccattgaaacactttattaaggcagaagactaccaccaagattacctcaagaaaaatccaaatggctactgccatattgacatcaaccaagcgacttatcctgtgattgatgaaagcaagtacccaaaaccaagtgccactgagatcaaggaaaaactatctgcagacgaataccgagtgacgcaaaaaaacgaaactgaaaaagctttttctaatcgctactgggattcttttgatgcaggaatttacgtagacgttgtgacaggagaaccgcttttctcttcaaaagacaaatttgaatcaggttgtggttggccaagctttagccgccccatcagcccagacgttgtccgctacaaggaagataagagtttcaatatgacgagaacagaagtgcgcagccgttcagggaattctcatctggggcatgtctttactgacggacctaaagaccaaggcggccttcgttactgcatcaatagcttgtctattacctttattccaaaagctgatatggaagctaagggctatgggtatttattatcatctgtagaa

SEQ ID NO: 9204 - protein, 368 aa, Streptococcus pyogenes
MEHKWKLWLFIVGVVLLIGGASVLIQKGQAKAFSQGKPQLPAKKVKSTKVDPNAPVDQKVIYLAGGCFWGVEEYFSQVDGVLDAVSGYANGRGDTTNYQLIHQTGHAETVEVAYDANRISLKELLLHFFRIIDPTSLNKQGNDRGSQYRTGIYYTDKADLAIIDEVFKEKAKDYKKKIVVEKAPLKHFIKAEDYHQDYLKKNPNGYCHIDINQATYPVIDESKYPKPSATEIKEKLSADEYRVTQKNETEKAFSNRYWDSFDAGIYVDVVTGEPLFSSKDKFESGCGWPSFSRPISPDVVRYKEDKSFNMTRTEVRSRSGNSHLGHVFTDGPKDQGGLRYCINSLSITFIPKADMEAKGYGYLLSSVE

SEQ ID NO: 9205 - DNA, 1452 bp, Streptococcus pyogenes
atggctaaaaataacacgaatagacactattcgcttagaaaattaaaaacaggaacggcttcagtagcggtagctttgactgttttaggggcaggttttgcgaatcaaacagaggttaaggctaacggtgatggtaatcctagggaagttatagaagatcttgcagcaaacaatcccgcaatacaaaatatacgtttacgttacgaaaacaaggacttaaaagcgagattagagaatgcaatggaagttgcaggaagagattttaagagagctgaagaacttgaaaaagcaaaacaagccttagaagaccagcgtaaagatttagaaactaaattaaaagaactacaacaagactatgacttagcaaaggaatcaacaagttgggatagacaaagacttgaaaaagagttagaagagaaaaaggaagctcttgaattagcgatagaccaggcaagtcgggactaccatagagctaccgctttagaaaaagagttagaagagaaaaagaaagctcttgaattagcgatagaccaagcgagtcaggactataatagagctaacgtcttagaaaaagagttagaaacgattactagagaacaagagattaatcgtaatcttttaggcaatgcaaaacttgaacttgatcaactttcatctgaaaaagagcagctaacgatcgaaaaagcaaaacttgaggaagaaaaacaaatctcagacgcaagtcgtcaaagccttcgtcgtgacttggacgcatcacgtgaagctaagaaacaggttgaaaaagatttagcaaacttgactgctgaacttgataaggttaaagaagacaaacaaatctcagacgcaagccgtcaaggccttcgccgtgacttggacgcatcacgtgaagctaagaaacaggttgaaaaagatttagcaaacttgactgctgaacttgataaggttaaagaagaaaaacaaatctcagacgcaagccgtcaaggccttcgccgtgacttggacgcatcacgtgaagctaagaaacaagttgaaaaagctttagaagaagcaaacagcaaattagctgctcttgaaaaacttaacaaagagcttgaagaaagcaagaaattaacagaaaaagaaaaagctgaactacaagcaaaacttgaagcagaagcaaaagcactcaaagaacaattagcgaaacaagctgaagaacttgcaaaactaagagctggaaaagcatcagactcacaaacccctgatacaaaaccaggaaacaaagctgttccaggtaaaggtcaagcaccacaagcaggtacaaaacctaaccaaaacaaagcaccaatgaaggaaactaagagacagttaccatcaacaggtgaaacagctaacccattcttcacagcggcagcccttactgttatggcaacagctggagtagcagcagttgtaaaacgcaaagaagaaaac

SEQ ID NO: 9206 - protein, 484 aa, Streptococcus pyogenes
MAKNNTNRHYSLRKLKTGTASVAVALTVLGAGFANQTEVKANGDGNPREVIEDLAANNPAIQNIRLRYENKDLKARLENAMEVAGRDFKRAEELEKAKQALEDQRKDLETKLKELQQDYDLAKESTSWDRQRLEKELEEKKEALELAIDQASRDYHRATALEKELEEKKKALELAIDQASQDYNRANVLEKELETITREQEINRNLLGNAKLELDQLSSEKEQLTIEKAKLEEEKQISDASRQSLRRDLDASREAKKQVEKDLANLTAELDKVKEDKQISDASRQGLRRDLDASREAKKQVEKDLANLTAELDKVKEEKQISDASRQGLRRDLDASREAKKQVEKALEEANSKLAALEKLNKELEESKKLTEKEKAELQAKLEAEAKALKEQLAKQAEELAKLRAGKASDSQTPDTKPGNKAVPGKGQAPQAGTKPNQNKAPMKETKRQLPSTGETANPFFTAAALTVMATAGVAAVVKRKEEN

SEQ ID NO: 9207 - DNA, 1266 bp, Streptococcus pyogenes
atgtttcagttaagaaaaaaaatgacgcgcaaacaattagccttgttgagtgctggagtgttgacctgtgtggttggtggtagctacttgataatgaaccatcaacaacaagaaattgtctctagtgtcaacaaagtaaaagccttaaccataaaagaagccatggaacaaggaaaagatatcagcttgaccttagctggcgaagtaacagctaacaacagcagcaaagtcaaaatcgactcaagtaaaggagaagtcaaagaggtctttgttaaaaaaggcgatgttgtcaaagtaggacaacccttgtttagctatgaaacgtcacagcggttaacggctcaaagttcagaatttgatgttcaaaccaaagccaatcagctccaagttgctaaaaccaatgcagcattgaagtgggaaacctacaatcgcaaggtcaatgaaatcaacaccctaaaatctcgctacaacactgcaccagatgagagcttactagagcaaattcgcagcgcagaagacagtgtatcccaagcactaagcgatgccaaaacagcagatagcgatgtcaaaaccgctcaaatcgaactcgataaagctaatgctactgccacaacggaaaaaggtaaactagagtatgacaccgttaagtcagacaccgcaggaaccattgttagtctaaatactgatttgccaaatcaatcaaaatccaaaaaagaaaatgaaacttttatggaaattatcgacaaatcaaaaatgttagtcaaaggtaacattagtgaatttgaccgtgacaagttaaaaatcggtcaaaaagtcgaagtgattgaccgcaaagacaactctaaaaaatggactggaaaagtaacccaagttggcaacctcaaagcagaggaaaaaggccaaggtcaaggccaaggtggcaatgaccaacaagataatccaaaccaagcaaaattcccttatgttattgaacttgaccaatcagacaagcagccactcattggctcacacacctatgttaatgtgctcaacaatgttccagaagctggcaagatcgtattgaaagaaacctttacaatggcagaaaatggaaaaacctatgtgtggaaagttgataaaaacaaggtcaaaaaacaagaaatcaagactaagcccttctcaaaaggttatgttgaggtaacaagtggcttgactatgcaagataagattgctcagccgcttcctggcatgaaagacggtatggaggtaggaagtattgttaaacct

SEQ ID NO: 9208 - protein, 422 aa, Streptococcus pyogenes
MFQLRKKMTRKQLALLSAGVLTCVVGGSYLIMNHQQQEIVSSVNKVKALTIKEAMEQGKDISLTLAGEVTANNSSKVKIDSSKGEVKEVFVKKGDVVKVGQPLFSYETSQRLTAQSSEFDVQTKANQLQVAKTNAALKWETYNRKVNEINTLKSRYNTAPDESLLEQIRSAEDSVSQALSDAKTADSDVKTAQIELDKANATATTEKGKLEYDTVKSDTAGTIVSLNTDLPNQSKSKKENETFMEIIDKSKMLVKGNISEFDRDKLKIGQKVEVIDRKDNSKKWTGKVTQVGNLKAEEKGQGQGQGGNDQQDNPNQAKFPYVIELDQSDKQPLIGSHTYVNVLNNVPEAGKIVLKETFTMAENGKTYVWKVDKNKVKKQEIKTKPFSKGYVEVTSGLTMQDKIAQPLPGMKDGMEVGSIVKP

SEQ ID NO: 9209 - DNA, 813 bp, Streptococcus pyogenes
atgaatctacttggatcaagacgggttttttctaaaaaatgtcggctagtaaaattttcaatggtagctcttgtatcagccacaatggctgtaacaacagtcacacttgaaaatactgcactggcacgacaaacacaggtctcaaatgatgttgttctaaatgatggcgcaagcaagtacctaaacgaagcattagcttggacattcaatgacagtcccaactattacaaaaccttaggtactagtcagatcactccagcactctttcctaaagcaggagatattctctatagcaaattagatgagttaggaaggacgcgtactgctagaggtacattgacttatgccaatgttgaaggtagctacggtgttagacaatctttcggtaaaaatcaaaaccccgcaggctggactggaaaccctaatcatgtcaaatataaaattgaatggttaaatggtctatcttatgtcggagatttctggaatagaagtcatctcattgcagatagtctcggtggagatgcactcagagtcaatgccgttacagggacacgtacccaaaatgtaggaggtcgtgaccaaaaaggcggcatgcgctataccgaacaaagagctcaagaatggttagaagcaaatcgtgatggctatctttattatgaagctgctccaatctataacgcagacgagttgattccaagagctgtcgtggtatcaatgcaatcttctgataataccatcaacgagaaagtattagtttacaacacagctaatggctacaccattaactaccataacggtacacctactcagaaa

SEQ ID NO: 9210 - protein, 271 aa, Streptococcus pyogenes
MNLLGSRRVFSKKCRLVKFSMVALVSATMAVTTVTLENTALARQTQVSNDVVLNDGASKYLNEALAWTFNDSPNYYKTLGTSQITPALFPKAGDILYSKLDELGRTRTARGTLTYANVEGSYGVRQSFGKNQNPAGWTGNPNHVKYKIEWLNGLSYVGDFWNRSHLIADSLGGDALRVNAVTGTRTQNVGGRDQKGGMRYTEQRAQEWLEANRDGYLYYEAAPIYNADELIPRAVVVSMQSSDNTINEKVLVYNTANGYTINYHNGTPTQK

SEQ ID NO: 9211 - DNA, 1233 bp, Streptococcus pyogenes
atgataaaaaggtgggttatccttttttttatggtattaacttgttcagggtttggtaaaacagttctcgcagctgattttcaagtgggagcagaacatgcgattgtcgtagaggcagactctgggagagttctgtatgagaaagacgctaagacgccagatgctattgcctctttgaccaaattggtgacggcttatctggttttagataaggttaaatcaggccagctgcaattatcagatcaagttaatctctcagattatgccttcgagttaacaaaagataggtctttaagtaatgtaccttttgacaaaaaaacttattcagttcaagacctgttgacagctactttggtagcaagctcaaatagcgctgctattgcgttagccgaaaaagtggcgggctcagagcttcattttgtaaatcaaatgagagaacagctatctcattgggggattacttctggtaaaatcctcaacgcttcaggactgccgaatgaggtgctaaaggaccatcgttatcctggttctgcgttggaagaagagaatatgttgagtgctcaggatgttgccattgtgacgatgcatttactggaagattttcctgagattttagagatcactaaacaaacagaagttgattttgctggtaattctattaaaagttttaatcaactcttaccaggtatggctaagggtagagcaggagtggatgggctaaagacaggaacgacagatttggcaggtcattgccttgtggtaacttctattgaaaatggtatgaggctgattaccgttattctaaatgctgatggatctgataaaaaccaaaacacgcggtttgagcaagcaaatcgcttgttggactatgtggctagaacttattgtcgtcgtaagattcttaaaaaaggaagtcttgtctcggagcgatcgctccctattcaagatggccaagtaaaagaactaccgatatctgttgccgaagatgtaaccatcattttgcaacagggtgaacaagttcccaaacctaaacaatttatgatatcagagacttctttattagcaccgattactaaaggtgaagtggttgcttatttgacgtctccaagaataacagatcagtcagtgaggtatttaaaggaacctaagcgtattcctcttaaagctagccaatctctaaaaaaagcctctgacttacagctgtggtggcgagattttcttgaaaaaagacgt

SEQ ID NO: 9212 - protein, 411 aa, Streptococcus pyogenes
MIKRWVILFFMVLTCSGFGKTVLAADFQVGAEHAIVVEADSGRVLYEKDAKTPDAIASLTKLVTAYLVLDKVKSGQLQLSDQVNLSDYAFELTKDRSLSNVPFDKKTYSVQDLLTATLVASSNSAAIALAEKVAGSELHFVNQMREQLSHWGITSGKILNASGLPNEVLKDHRYPGSALEEENMLSAQDVAIVTMHLLEDFPEILEITKQTEVDFAGNSIKSFNQLLPGMAKGRAGVDGLKTGTTDLAGHCLVVTSIENGMRLITVILNADGSDKNQNTRFEQANRLLDYVARTYCRRKILKKGSLVSERSLPIQDGQVKELPISVAEDVTIILQQGEQVPKPKQFMISETSLLAPITKGEVVAYLTSPRITDQSVRYLKEPKRIPLKASQSLKKASDLQLWWRDFLEKRR

SEQ ID NO: 9213 - DNA, 1257 bp, Streptococcus pyogenes
atgtcatggaattggaaaaaaacatctgtgcttggaactttatccttagcttcagtgctacccctaactgcttgcgtaagtggtggtggtaaaggcgttaaggaaacagacggaaagactattgtagtctctgttgatgagggatatgttgattacattaagagtattaagggtgagtttgaaaaagaacataaagtcaccgttaaagtcaaaaaagaaggtatgatggatactcttgataagctatcaacggatggtccaacaggagcttcaccagatgtctttttagcaccttttgaccgtgtaggtggtttaggaactgaaggtcaaatcgctgaggttactttaggaaacagcaaagagtttgatgatacggttaagaaattagtaaccattgatggtaaaacttatggtgcaccagacgtaattgaaactttggtaacttattataataaggatttagtgcctcaagcacctaaaagctttactgaattagaagtcttacaaaaagattctaagtttgcttttgcctctgaaccaggaaaatctgtaggtttcttggcgaaatggacagacttctattatggttatggtttaattgccggttatggcggttatatctttggtgataaaggaaccaaaccaagtgatttaggcctaggtaacgacggaactgttgaagggttaaactacgcgaaacagtggtatggcacttggcctcaaggaatgcaagacactaaaaaagctggtgattttatcactgaacaatttatttctaaaaaagctggtgtcattattgatggtccatgggcagctagctcctttaaagatgctggtgttaactttggggtaatggaaattcctactttgacaaatggtaaaaaataccaaccgttcgcaggtggtaaagcttgggttatttcaaactattctaaaggaaaaacgactgctcaaaaattccttgattatgtgaccaatgctgaaaaccaaaaacgtttctatgataaaacacaagaaattccagctaacttaacagcacgtaactatgcttctaaagagggtaatgagttaacgaaagctgtgattagtcagtttgagagcgcacaaccaatgccaaatattccagaaatggctgaagtttgggaaccaggtgcaaatatgttctttaacgtggcttctggtaaggaagaagcatctaaagctgcaaaagaagcagcaaaaactattaaggaagctattgaacaaaaatacgctgaa

SEQ ID NO: 9214 - protein, 419 aa, Streptococcus pyogenes
MSWNWKKTSVLGTLSLASVLPLTACVSGGGKGVKETDGKTIVVSVDEGYVDYIKSIKGEFEKEHKVTVKVKKEGMMDTLDKLSTDGPTGASPDVFLAPFDRVGGLGTEGQIAEVTLGNSKEFDDTVKKLVTIDGKTYGAPDVIETLVTYYNKDLVPQAPKSFTELEVLQKDSKFAFASEPGKSVGFLAKWTDFYYGYGLIAGYGGYIFGDKGTKPSDLGLGNDGTVEGLNYAKQWYGTWPQGMQDTKKAGDFITEQFISKKAGVIIDGPWAASSFKDAGVNFGVMEIPTLTNGKKYQPFAGGKAWVISNYSKGKTTAQKFLDYVTNAENQKRFYDKTQEIPANLTARNYASKEGNELTKAVISQFESAQPMPNIPEMAEVWEPGANMFFNVASGKEEASKAAKEAAKTIKEAIEQKYAE

SEQ ID NO: 9215 - DNA, 1218 bp, Streptococcus pyogenes
atgaaattacttggaaaatggctattcttcttgatgtttctgactttttgcgtcagtttttggcagaaagactatcagcggattgcctttgaaaaagaacacaaactttatcaagatttagtggcacctttttaccaaaactatcctaaattacgagaactccagctttcagaagctattaaattacgccacgacttgcttgattatgttcgaaagctcgataaggacggatggtcctataaagccatccaaaaaggataccttgaacaactcgctgttagaggaaactcttatcatttcgaacaactttatagtcgcattcgcctgataggatcacctgactttcaaaagctctggcaacaagaggagatggcacagacgcctcaagaagctcaaaaacggttacaactgctcttgacgtatttaaagatgccagacgagttgacaggacaatcaaaacaaacacagcaagtattggcacaattaagtccaaagctatcgccaacagatcctttttgggaccaattatctaccctgattcaggcttattatgttaatctcgaacacattccttatagccgttttaatcggaaaattcatcaactccgttacctcatatcaacccagcaaacggagtgggttcgctcacattatgggaataaagggaaaaccgatgcggatgccttagccaaatatttggctactctagaagatgacgattatgctctttatgaatcttctagataccataataaggttgctagtattttagatgctaatggcaatcatcaggcagtctatacagacaatattcctcaagccaactataagattttaattcattttcactcagagtttattttgtcagaatctggacaatttttagtagcactagatcctgataacctaacgcgaaatagtattgtcaatggttcttctttcaattatggcaaccaaaacgatgacttgcaccgtctgcttgatattgaccctattctgctttttgatccggcttttattgaaaaagcaattaatagtcctgatgcaacttttctagttcccgatttagaacagcaaagggataagcacaatcccatttacagcagaaatggcaaatcatctaagcagctaacacgcgctgccgttaaaaaattcaaaaaattgcttcaccattatcaagaaacaagaggtgacaataagacctcaaaaacacagcat

SEQ ID NO: 9216 - protein, 406 aa, Streptococcus pyogenes
MKLLGKWLFFLMFLTFCVSFWQKDYQRIAFEKEHKLYQDLVAPFYQNYPKLRELQLSEAIKLRHDLLDYVRKLDKDGWSYKAIQKGYLEQLAVRGNSYHFEQLYSRIRLIGSPDFQKLWQQEEMAQTPQEAQKRLQLLLTYLKMPDELTGQSKQTQQVLAQLSPKLSPTDPFWDQLSTLIQAYYVNLEHIPYSRFNRKIHQLRYLISTQQTEWVRSHYGNKGKTDADALAKYLATLEDDDYALYESSRYHNKVASILDANGNHQAVYTDNIPQANYKILIHFHSEFILSESGQFLVALDPDNLTRNSIVNGSSFNYGNQNDDLHRLLDIDPILLFDPAFIEKAINSPDATFLVPDLEQQRDKHNPIYSRNGKSSKQLTRAAVKKFKKLLHHYQETRGDNKTSKTQH

SEQ ID NO: 9217 - DNA, 900 bp, Streptococcus pyogenes
atgacacagcaatcaatgttactaagtattgagcaagtaaataaatcctatggtaaaaatcaggttttaagtgatatctcttttgatatttacaaaggagaaatttgcggccttgtgggtcaaaatggtgctggaaagacaacgttaatgcgtattttatctggcctaattggaaaagattcagggcaaatcaaacagttacaaccctatcgaatgggatcaattattgagtcaccgacactttatcccaatatgacagctcatgataatctttactatgcagcgttgcaattgagattagctgatgcaaaagagcgcatacatgaggttttggaacttattgggttagaaaaagtgagcaaaaagaaaaaggtgaaagattattctttagggatgcgccaacgtttggctattggtctttcgatactggattttccagaatttttaatcttggatgaacccattaatggtcttgatccagcaggaatcaaagaaatgcgtcagattattttgaacctaagagattgctatggtattacgattttgatttccagtcatattttatcagaattagacttagttgttgatcgttacgtgattatgcataaaggcaaagttattaagagtatggacaaagcagagcttaaagctcaagtaaaagtacaaattgcccttcatacaagcgatgatcagctggtaaaaaatagacttttagaattggggcttagagttgagactgatggtcagatgctactaataaaaccaactttatcagtaatggagcttatcaaaattgttctagatctgcctgttgagatttttgacatttatcatcatcaagtgagctttgaacattattacctcgatttgttaggtaaagatgcagcatcaccattaatt

SEQ ID NO: 9218 - protein, 300 aa, Streptococcus pyogenes
MTQQSMLLSIEQVNKSYGKNQVLSDISFDIYKGEICGLVGQNGAGKTTLMRILSGLIGKDSGQIKQLQPYRMGSIIESPTLYPNMTAHDNLYYAALQLRLADAKERIHEVLELIGLEKVSKKKKVKDYSLGMRQRLAIGLSILDFPEFLILDEPINGLDPAGIKEMRQIILNLRDCYGITILISSHILSELDLVVDRYVIMHKGKVIKSMDKAELKAQVKVQIALHTSDDQLVKNRLLELGLRVETDGQMLLIKPTLSVMELIKIVLDLPVEIFDIYHHQVSFEHYYLDLLGKDAASPLI

SEQ ID NO: 9219 - DNA, 372 bp, Streptococcus pyogenes
atgtccgccaagaaaactttttttgcaagtaatttaaagtaccttagattaaaaaagaacatggaacaattagaacttgctaatctcctaggacgaaaaagctcttcttcaatcagtgagtgggaaaaaggaaaatatactccaaagtctggtctattaagtgatattgctgctatctttgatgttagtttaaccgccctaatggaagaagatttaaccttagaaaataagggagtctcttatcagttgccacaacgagagttagcgatgatttcagaacaattatccgaaaataactacactaagtgggttgacttcgcacaaattcttttagaacaacaagctaaagaagatcgtgaattagataaccac

SEQ ID NO: 9220 - protein, 124 aa, Streptococcus pyogenes
MSAKKTFFASNLKYLRLKKNMEQLELANLLGRKSSSSISEWEKGKYTPKSGLLSDIAAIFDVSLTALMEEDLTLENKGVSYQLPQRELAMISEQLSENNYTKWVDFAQILLEQQAKEDRELDNH

SEQ ID NO: 9221 - DNA, 909 bp, Streptococcus pyogenes
atggtatctgtttcccttataatgagtgtaatatactattttaagaccatacatgataaattgagttttgttacccaaagatggttaggtgattacaaagctcgtatagaactattatttctacttcttatcctttgttggattgtactcatgaaggtattagttaaagattttttgctattttttatagttgttgacgcaagcacgttgttttgtctagtggtaatttcttgcatcttttattatttagaaaactccaaacaaaattttgactatgaaaatagaagactgaactattttatgaaatcagaggaaaacatgagagtggagttctcaaattatttgcatgatgatgttttacaaaatatcatagcgataaaaaacttgttttctctagaaaatagtaatataacacatggttttattgttaatgagttgaatgatttagtttctggtatcagagatgaaatggatacttaccacccaatagttcccgctaatcaaacaatgaaagaaaacatacagtctctttttgatgatattgttaaaagtagaaaaagtaataccttattgtattttaactgttcagataatatggtagtgccatccccatatggagatattgtttataggtttataaaagagctaataaacaatgctataaaatatggagatggaaaagacattcgtttatctttaacgattcaatctgatattattatcattgaggagagcaatcaagtagtggaaaaagtacactctataaattatggcagaggattgaaatcatttcaagaaacactagcagcttttgatggagatctagaactacaaatggatactaaacaatttactatcagaatattacttcccatagattggaaattgtgttatgaagattttattaat

SEQ ID NO: 9222 - protein, 303 aa, Streptococcus pyogenes
MVSVSLIMSVIYYFKTIHDKLSFVTQRWLGDYKARIELLFLLLILCWIVLMKVLVKDFLLFFIVVDASTLFCLVVISCIFYYLENSKQNFDYENRRLNYFMKSEENMRVEFSNYLHDDVLQNIIAIKNLFSLENSNITHGFIVNELNDLVSGIRDEMDTYHPIVPANQTMKENIQSLFDDIVKSRKSNTLLYFNCSDNMVVPSPYGDIVYRFIKELINNAIKYGDGKDIRLSLTIQSDIIIIEESNQVVEKVHSINYGRGLKSFQETLAAFDGDLELQMDTKQFTIRILLPIDWKLCYEDFIN

SEQ ID NO: 9223 - DNA, 1773 bp, Streptococcus pyogenes
gtgaaccaaggaaaaataataaccgtttcgggacctcttgttgtggcttctgggatgcaagaagctaatattcaagatatttgtcgtgtgggacatcttggcttagtcggagaaattattgaaatgcgtcgcgatcaagcgtctattcaggtttatgaggaaacatcagggatcggtccaggagaaccagtagtgactactggttgtcctttgtcggtcgagttaggcccgggcctgatttcagaaatgtttgacggtattcagcgaccgcttgatcgttttcaaaaagcaacggacagcgactttttaatccgtggtgtggctatcccaagtcttgatcgaaaggctaagtgggcatttattcccaagctaagtgttggtcaagaagtagttgcaggtgatattttaggaactgtgcaagaaacagctgtcattgagcaccgtatcatggttccttataaagtttcagggaccttggtggctattcatgcaggggacttcacagtaacagatacagtttatgaaattaagcaggaagacggttccatttaccaaggtagcctcatgcagacttggccagttcgtcaaagtcgccctgttgctcaaaagcttatcccagtcgaacctttggttacaggtcaacgggttattgacacctttttccctgttacaaaaggtggtgccgctgccgttcctggaccatttggggcaggaaaaacagttgtgcagcatcaaatagctaaatttgccaacgttgatattgttatttatgtcggttgtggggaacgcggcaacgagatgaccgacgttttgaatgagtttccagagttaattgacccaaatacaggccagtccattatggagcgcacggtgttaattgcaaacacctctaatatgccagtagcagcgcgtgaagcgtcgatttacacaggtattaccattgccgaatatttccgtgatatgggctattctgtggctatcatggcagactcgacatcacgttgggcagaagctctgcgcgagatgtcaggacgcctacaagaaatgcctggtgatgaaggctacccggcttacttagggagtcgtattgccgaatattatgaacgggctggtcgtgttcggaccttgggaagtcaagaacgtgagggaaccattacagccatcggcgcggtttctcctcctggaggggatatttcagagcctgtcactcaaaacacccttcggattgtcaaagttttctgggggctcgacgcgcctcttgcgcaacggcgtcacttcccagcgattaactggctgacgtcttattcattgtatcaagatgatgtaggaagctatattgaccgtaaacagcaatctaattggtccaacaaggtaactcgtgccatggctattttgcagcgtgaagccagtctagaagaaattgtacgcttggtggggcttgattcactgtctgaacaagatcgtttgaccatggctgttgcccggcaaattcgggaggattatctccagcaaaatgcctttgattcggtggatacctttacttcctttccgaaacaagaggccatgctaaccaatattttgacctttaatgaggaagccagcaaagccctttctttgggagcttattttaatgagattatggaaggcactgctcaggtacgcgatcgcatcgcacgcagcaaatttatcccagaagaaaacttagagcagattaaagggcttactcagaaggttaccaaagagattcaccacgttttagcaaagggaggaatt

SEQ ID NO: 9224 - protein, 591 aa, Streptococcus pyogenes
VNQGKIITVSGPLVVASGMQEANIQDICRVGHLGLVGEIIEMRRDQASIQVYEETSGIGPGEPVVTTGCPLSVELGPGLISEMFDGIQRPLDRFQKATDSDFLIRGVAIPSLDRKAKWAFIPKLSVGQEVVAGDILGTVQETAVIEHRIMVPYKVSGTLVAIHAGDFTVTDTVYEIKQEDGSIYQGSLMQTWPVRQSRPVAQKLIPVEPLVTGQRVIDTFFPVTKGGAAAVPGPFGAGKTVVQHQIAKFANVDIVIYVGCGERGNEMTDVLNEFPELIDPNTGQSIMERTVLIANTSNMPVAAREASIYTGITIAEYFRDMGYSVAIMADSTSRWAEALREMSGRLQEMPGDEGYPAYLGSRIAEYYERAGRVRTLGSQEREGTITAIGAVSPPGGDISEPVTQNTLRIVKVFWGLDAPLAQRRHFPAINWLTSYSLYQDDVGSYIDRKQQSNWSNKVTRAMAILQREASLEEIVRLVGLDSLSEQDRLTMAVARQIREDYLQQNAFDSVDTFTSFPKQEAMLTNILTFNEEASKALSLGAYFNEIMEGTAQVRDRIARSKFIPEENLEQIKGLTQKVTKEIHHVLAKGGI

SEQ ID NO: 9225 - DNA, 1413 bp, Streptococcus pyogenes
atgagcgttctcaaagaatatcggacggttagcgaagtggttggccctttgatgattgttgatcaagttgcaggagtgcactacaacgaattggtagatattactttgcataatggagaaaggcgtaaaggtcaagtcttagaagtccaaggtgacaaggctatggtacagctatttgaaggatcaactggcatcaacctagccaaaaccaaggttcgatttacagggcatcctttggaattagccgtatcagaagatatggtagggcgcatctttgatggaatggggcagcccatagacggcggtccagaacttattcccgaaaaataccttgatattgatggtcaagcgatcaatcctgtcgctcgtgattacccagacgaatttatccagacaggtatctcagctattgatcacctcaataccctcgttcgtggtcaaaagttaccagttttttcgggctcagggttacctcataatgaattggccgcacagattgctcgtcaggcaactgttctaaactctgatgataactttgcggttgtgtttgcagctatgggtattacttttgaagaggcagaattctttatgaatgacttgcgtgaaacgggtgccattgatcgatctgttttatttatcaatttagctaatgaccctgctattgaacgcattgcaacaccacgtatagctctgacaacagccgaatacttggcttatgaaaaaggtatgcatgttttagtcatcatgacagatatgacaaattattgtgaagccttacgagaagtatcagccgctcgcagagaagttccaggcagacgaggttatcctggctatctctatactaatctctccaccttatatgaacgggctggtcgcttgatcgggaaaaaagggtcagtgactcaaattcctattttaaccatgccagaagatgacattacccaccctatccccgatttgacaggttatattaccgaaggtcagattattttgtcgcaagaactatataaaaatggttttagaccgcctattaatgtcttgccatcgctatctcgcctaaaagataaaggctcaggtgaaggtaagactcgacaagaccatgctgctacaatgaatcagctctttgcagcctatgcccaaggaaaacaagctaaggaattggctgttgtgctcggtgaatcagccctttctgaaacggataaactatatgtggcctttaccaaccggtttgaagaagaatacattaaccaaggattttacaccaaccgtagcattgaagaaagtcttgacttgggttgggaattgttgtcgattttgccacgtaccgaattaaaacgcattaaagatgatatgttagatcgttatttgcctaaagcagataccacgatgacaaaggtttttgttgcaaatgat

SEQ ID NO: 9226 - protein, 471 aa, Streptococcus pyogenes
MSVLKEYRTVSEVVGPLMIVDQVAGVHYNELVDITLHNGERRKGQVLEVQGDKAMVQLFEGSTGINLAKTKVRFTGHPLELAVSEDMVGRIFDGMGQPIDGGPELIPEKYLDIDGQAINPVARDYPDEFIQTGISAIDHLNTLVRGQKLPVFSGSGLPHNELAAQIARQATVLNSDDNFAVVFAAMGITFEEAEFFMNDLRETGAIDRSVLFINLANDPAIERIATPRIALTTAEYLAYEKGMHVLVIMTDMTNYCEALREVSAARREVPGRRGYPGYLYTNLSTLYERAGRLIGKKGSVTQIPILTMPEDDITHPIPDLTGYITEGQIILSQELYKNGFRPPINVLPSLSRLKDKGSGEGKTRQDHAATMNQLFAAYAQGKQAKELAVVLGESALSETDKLYVAFTNRFEEEYINQGFYTNRSIEESLDLGWELLSILPRTELKRIKDDMLDRYLPKADTTMTKVFVAND

SEQ ID NO: 9227 - DNA, 285 bp, Streptococcus pyogenes
atgacaaaacgtaattcaaaagcctatatattatggcaaaaaattatcaaaattttaggaattattgcactaattggtacttttttcctcgctttttggctgtatagactaggtatattaaacgatagtaatgctcttaaagacttagtgcagcgctatagattatgggggccgtttgtttttattgtcgtgcagatcatacagattgtttttcctgtgattcctggaggccttacgacagttgcaggttttttaatctttggcccctgtaacaggttttattta

SEQ ID NO: 9228 - protein, 95 aa, Streptococcus pyogenes
MTKRNSKAYILWQKIIKILGIIALIGTFFLAFWLYRLGILNDSNALKDLVQRYRLWGPFVFIVVQIIQIVFPVIPGGLTTVAGFLIFGPCNRFYL

SEQ ID NO: 9229 - DNA, 309 bp, Streptococcus pyogenes
atgaaatctattatgttagtttgtaatgccggtatgtcaactagtatgttggtgactaagatgcaaaaagcagcccaagcgcgtgaccttgaagtttctatttgggcagttcctgtgagtgaagctgacaacgaaatggctgctaatagcattgacgttctcttgttaggtccacaagtcaaattcttactaaaggattttaaagataagtttgaaccagatattaaagtagatgccattaacatggctgattatggtcttatgaacggtgaaaaagtccttgaaacagccctagcaatgatggaggag

SEQ ID NO: 9230 - protein, 103 aa, Streptococcus pyogenes
MKSIMLVCNAGMSTSMLVTKMQKAAQARDLEVSIWAVPVSEADNEMAANSIDVLLLGPQVKFLLKDFKDKFEPDIKVDAINMADYGLMNGEKVLETALAMMEE

SEQ ID NO: 9231 - DNA, 975 bp, Streptococcus pyogenes
atgacaatcacagcaaataaaagacattacttagaaaaagtgagccatcaaggaatcatatcagctttagcttttgatcaacgaggtgcactgaagcaaatgatggcagcacatcaagaaggagaagcgacagttacacagatagaaacattgaaagttctcgtttctgaggaattgacgccttatgcttcatctattttattagatccagaatatgggttgctggctactaaggtaagagctaatcagacaggcttactgttagcttacgaaaaaacaggttatgatgctacaaccactagccgtttacccgattgcttagtggaatggtcggtcaaacggttgaaagcagcaggtgcagatgctattaaatttttgctctattatgatgttgatggagatgaacaaatcaatttacaaaaacaagcttatattgaacgcattggttcagaatgtacagctgaagacatccctttttttcttgaacttttgagttatgatgagagaatatcagataacaacagtgcggcatacgcaaagcttaagccacataaggttaacggtgctatgtcagtattttcggataagcgttttggcgttgatgtgctaaaagtagaggttcctgttaatatggcttatgtagaaggttttactgaaggggaagtccattacagtcaagctgaggctattaaagcttttcaagaccaagaagctgccagccacctcccttatatctatttgagtgcaggcgtatctgccaaactttttcaagagacattatactttgcagcagcagcaggtgctcaatttagtggtgttttgtgtgggcgtgccacgtgggcaggatccgttccagtttatattactaaaggagaggacgaagcaagaaagtggctatgcactgaaggcttccaaaatattgacgagttaaacagggtactcgaagagaccgctagcccttggacggaaaaaatc

SEQ ID NO: 9232 - protein, 325 aa, Streptococcus pyogenes
MTITANKRHYLEKVSHQGIISALAFDQRGALKQMMAAHQEGEATVTQIETLKVLVSEELTPYASSILLDPEYGLLATKVRANQTGLLLAYEKTGYDATTTSRLPDCLVEWSVKRLKAAGADAIKFLLYYDVDGDEQINLQKQAYIERIGSECTAEDIPFFLELLSYDERISDNNSAAYAKLKPHKVNGAMSVFSDKRFGVDVLKVEVPVNMAYVEGFTEGEVHYSQAEAIKAFQDQEAASHLPYIYLSAGVSAKLFQETLYFAAAAGAQFSGVLCGRATWAGSVPVYITKGEDEARKWLCTEGFQNIDELNRVLEETASPWTEKI

SEQ ID NO: 9233 - DNA, 246 bp, Streptococcus pyogenes
gtgttaacgatgatatggtctttaattgtaggtgcctttatcggcatgatagcaggtaaaatgactgaaaaaagccagtccatgggttgttttactaatattatcgcaggtctcatagggtcagctgttgggcaaaggctttttggggattggggaattcagttggcaggtatggctattttcccgtccattttgggagcagcaattgtaattgtacttgtttcagctatttttggaaaaaggtat

SEQ ID NO: 9234 - protein, 82 aa, Streptococcus pyogenes
VLTMIWSLIVGAFIGMIAGKMTEKSQSMGCFTNIIAGLIGSAVGQRLFGDWGIQLAGMAIFPSILGAAIVIVLVSAIFGKRY

SEQ ID NO: 9235 - DNA, 834 bp, Streptococcus pyogenes
atgagtaagaacagcagtcatattcaggtgcaaaacctttcctttgcttatgaggaaaaacttgttttagatgacctgacctttagcattccaaaagggaaaattaccactattatgggggcaaatggcagtggcaagtcaaccttattacaattattaaccaaaaaccttccgttaaaacaagggcaggtttggcttgagcaggaagaattagcaacgatttctctcaaggcttttgcgaaaaaagtggcagtggtacaccaataccatcaagtggtcgaaggtttgttagtgggtgaattggtagccatggctaggcttgcccgtcgttctttttttaaaactactaccaaagaagatgaggagcgccttgcttgggccttagaagtaacggctttgagtgattatgtttatcgtgatatccaacacctttctggtggtgaacagcagagggtttggattgccatggcccttgcccaggatacagatattatttttttagatgagccaacgacttatttggatattaagtaccagcttgacattctcaagctgattactaaaatcaaccaagagctaggcctaacgattgtgttagtattacatgacatcaatcaggccttgtctctttcagaccatcttattggactgaaagatgggcgactttatgcccaaggtcaaccaagagacctccttgatcaacagtttatcagagatgtctttggtgttgaattgccctttgttgagagaaatggtcaacagtttgtcctcacttcattggtcaatgaaaccaatggtattagaactcaaaggagagataggaacaagaacaga

SEQ ID NO: 9236 - protein, 278 aa, Streptococcus pyogenes
MSKNSSHIQVQNLSFAYEEKLVLDDLTFSIPKGKITTIMGANGSGKSTLLQLLTKNLPLKQGQVWLEQEELATISLKAFAKKVAVVHQYHQVVEGLLVGELVAMARLARRSFFKTTTKEDEERLAWALEVTALSDYVYRDIQHLSGGEQQRVWIAMALAQDTDIIFLDEPTTYLDIKYQLDILKLITKINQELGLTIVLVLHDINQALSLSDHLIGLKDGRLYAQGQPRDLLDQQFIRDVFGVELPFVERNGQQFVLTSLVNETNGIRTQRRDRNKNR

SEQ ID NO: 9237 - DNA, 363 bp, Streptococcus pyogenes
atgactgtaaaaattaatacaaaagatggtctaatcgagctatccgacgatgtgattgcaactgtcgtgggaggatcagcaacggaaatttttggtgttgttggaatggccagcaaaagtgcaataaaagacaattttcaatcactacttcgcaaagaaaactacgctaagggtgttgtagtaaaatcaacagatctgggtatttctgttgatgtctacactgtgatgagttatggtgtgaaaatcagtgaagtctctaaaaatatccaagaacgcgtgaaatttaaccttgaaagtcagcttggtctcactgctgatatggttaatgtttacgtgcaaaatattaaggttgtaggagaaaat

SEQ ID NO: 9238 - protein, 121 aa, Streptococcus pyogenes
MTVKINTKDGLIELSDDVIATVVGGSATEIFGVVGMASKSAIKDNFQSLLRKENYAKGVVVKSTDLGISVDVYTVMSYGVKISEVSKNIQERVKFNLESQLGLTADMVNVYVQNIKVVGEN

SEQ ID NO: 9239 - DNA, 480 bp, Streptococcus pyogenes
atgcctcagattacccttgtttttattagcctcagtggcaacacccttagctttgtcaagcggctatccctttatctagcagacaattacgattaccatgtcaaacagattaacattaaagatttgaagcacgagacttttcccgtcaaggaagagtttgtggcgattttacccacttatctagaaggcggaaatggcgttgactctggtgatgtggagatcctcaccactcctttgggagagtttattgctgcccatggcaacgcccagcgttgtcttgggattattggctcaggcaacaaaaactttaaccatcagtattgcctgacagccaaacagtatgccaaacgctttggctttccactgctaggtgattttgagctgcgagggactcctgatgacatttcgcggttagcccaggtcatcatggaggccagctccagacactcgtctaacgacacacagacactgcctaacagc

SEQ ID NO: 9240 - protein, 160 aa, Streptococcus pyogenes
MPQITLVFISLSGNTLSFVKRLSLYLADNYDYHVKQINIKDLKHETFPVKEEFVAILPTYLEGGNGVDSGDVEILTTPLGEFIAAHGNAQRCLGIIGSGNKNFNHQYCLTAKQYAKRFGFPLLGDFELRGTPDDISRLAQVIMEASSRHSSNDTQTLPNS

SEQ ID NO: 9241 - DNA, 840 bp, Streptococcus pyogenes
atggaaattggtgaaaccgttgaattcattaggcattcaaaaaacatttcgattaaacaagtttgtggtgattatctcactaggcaaacctattatcgttttattaaaaataatcttgacatttcttcgaaaaagttactttatatcttagacaacttgaatgtcaatgttgatgagtttctctttattagtaataactttaaacaatacaaagaatttattgatatggatacggcaaaacattattttgaatgccgaaacatagaaggtttaaatcatatccttgattcttataaagatagtaagtcaacaaaggaaaagaacctttttgccttggtcaaggtgttattagcaactcttactgaggaagactgtctgacagagcggacttatttgtcaaactatcttattaatattgaaacttggagtcactatgagactgtgctttttaataattgtatgtttatttttgagtcttgctttattgagatggtgttttcaaaagttattttgaacctcgataaatacaataccctaaggtattatgggaatgaatcgattcggatgtttgtcaatatgttgattttgtttattcagcgacaagagtatgataaagcttctgagattttggcaaaaattgaagattatcagctaaatgatgattgcttatatgaacggtgttgtgtgtctttttttgatggcattattggcctcataaatggtaaagagggggctgagcaaaagtgtgtgcagatcttggagatcttccaattacttaattgcaaaacgatccatcatatgtttcaaacctacctagaagccattaaacataaactgtcc

SEQ ID NO: 9242 - protein, 280 aa, Streptococcus pyogenes
MEIGETVEFIRHSKNISIKQVCGDYLTRQTYYRFIKNNLDISSKKLLYILDNLNVNVDEFLFISNNFKQYKEFIDMDTAKHYFECRNIEGLNHILDSYKDSKSTKEKNLFALVKVLLATLTEEDCLTERTYLSNYLINIETWSHYETVLFNNCMFIFESCFIEMVFSKVILNLDKYNTLRYYGNESIRMFVNMLILFIQRQEYDKASEILAKIEDYQLNDDCLYERCCVSFFDGIIGLINGKEGAEQKCVQILEIFQLLNCKTIHHMFQTYLEAIKHKLS

SEQ ID NO: 9243 - DNA, 396 bp, Streptococcus pyogenes
ttgctatctgcttcttatttaagagtgattgttgctccagcttcttcaagtttagctttgatttcttcagcttctgcagcagcaacgccttctttaacgttagcaggtgctccatcaacaagacctttagcttctttaagaccaagacctgtgatttcacgaacagctttgataacgccaacttttttgtcgccagcagatgtcaattcaacgtcgaatgaatctttagcagcttcttcagcaccaccagcagctgcagcagctacaggagcagctgcagttacaccaaattcttcttcgatagcttttacaagatcgttaagctcaaggattgaagcttctttaatttcagcaataatgttttcaatgttcaatgccattgtgatttcctccaaa

SEQ ID NO: 9244 - protein, 132 aa, Streptococcus pyogenes
LLSASYLRVIVAPASSSLALISSASAAATPSLTLAGAPSTRPLASLRPRPVISRTALITPTFLSPADVNSTSNESLAASSAPPAAAAATGAAAVTPNSSSIAFTRSLSSRIEASLISAIMFSMFNAIVISSK

SEQ ID NO: 9245 - DNA, 513 bp, Streptococcus pyogenes
atgaaaattgctgtaggttgtgaccatattgttacttatgaaaaaatcgctgttgtggattacctaaaatcacaaggtcataaagttattgattgtggtacgtatgataatgttcgcacacactatccaatttttggtaaaaaagttggtgaagcagtagcaagtggtgaagcagaactaggtgttgttatctgtggtactggtgttggtatcacaaatgctgtaaacaaagttcctggaattcgttcagcactcgttagagatatgacatctgctatctactcaaaagaagagctaaacgcaaacgttattggttttggtggaaaaattatcggtggtttattgatgaatgatattatcgatgctttcttggccgcggaatacaaaccaactgaagaaaataaaaaatggattgaaaaaatggatagcttgcaacatgctagccaagatcaaaacaacccacacttctttgatgaattcctagaaaaatgggaccgtggtgaatatcacgac

SEQ ID NO: 9246 - protein, 171 aa, Streptococcus pyogenes
MKIAVGCDHIVTYEKIAVVDYLKSQGHKVIDCGTYDNVRTHYPIFGKKVGEAVASGEAELGVVICGTGVGITNAVNKVPGIRSALVRDMTSAIYSKEELNANVIGFGGKIIGGLLMNDIIDAFLAAEYKPTEENKKWIEKMDSLQHASQDQNNPHFFDEFLEKWDRGEYHD

SEQ ID NO: 9247 - DNA, 771 bp, Streptococcus pyogenes
atgaaaaagaaagagcgtcatgaaaaaattctcgatatcttaaaagttgacggttttataaaagtaaaagatattatcgatgaaatgaacatctcagatatgaccgctagacgagatctcgatacattggcagataaaggattacttatcaggacccatggtggtgctcaatatttggattattcttcagcaaaggacgaaggtcacgagaaaacacacactgaaaagaaggtcttacagactaccgaaaaaaaacaaattgcacaaagagctaaaaacattattaaagatggcgaaactgtctttataggtccagggacaacattagagcatctagctgtcgaattgaaaaatagaaatatcagagttattacaaatagccttcctgtttttttaattttgcacccgagcactactattgatttgattttaattggtggtgaatgtcgtgaaattactggtgcttttgttggtgctattgccattaataacctagaaacattaacattttcaaaagcttttgtcagcgcaaacgcagtttacaataattctattgcgacgtacagtgatctcgaaggagaagttcaaagggttgcattgaataatgctgttgagaaaatccttctagttgatagtaccaagtttgaaagttatgacttctataatttttaccaactagatcaagtggacttaattgtgactgataaaaatgtgacaactgatatcatagaaaagtacaagaaattctcaaaaatcataatcgctgacaag

SEQ ID NO: 9248 - protein, 257 aa, Streptococcus pyogenes
MKKKERHEKILDILKVDGFIKVKDIIDEMNISDMTARRDLDTLADKGLLIRTHGGAQYLDYSSAKDEGHEKTHTEKKVLQTTEKKQIAQRAKNIIKDGETVFIGPGTTLEHLAVELKNRNIRVITNSLPVFLILHPSTTIDLILIGGECREITGAFVGAIAINNLETLTFSKAFVSANAVYNNSIATYSDLEGEVQRVALNNAVEKILLVDSTKFESYDFYNFYQLDQVDLIVTDKNVTTDIIEKYKKFSKIIIADK

SEQ ID NO: 9249 - DNA, 555 bp, Streptococcus pyogenes
atgtcgcatttttctgataagtttatggagatttcaggaaaaattgggtcacaacggcatttagtagctattcgtgattcctttatttcaatgatgcctattaccatggcaggttcagttgctgtcttattgaacgtttttttacgcgatattccaaacaatatgggatggacaggatttgcaaaagctatgcaacctgttatcgacatcaatggctatgtttattttgggacaattggtatcatggcgctcttttttgcctttgctttcggttacaatttagctgttatgcataagattaatccattggcaggaggattgatttcttttggctcatttattgccaccctacctcagactttaaccatttcgacaccacttgaaaatgcctctgctaacctaattagcaatttgaaagaaatggggctttcagtcgttactgcgggtggagcttcaagtattgaaactagtcaatggggagcaatagctctaaagtatgtcggtgccacaggcttgttcacagctttaattattggctttttatcaagttttgtg

SEQ ID NO: 9250 - protein, 185 aa, Streptococcus pyogenes
MSHFSDKFMEISGKIGSQRHLVAIRDSFISMMPITMAGSVAVLLNVFLRDIPNNMGWTGFAKAMQPVIDINGYVYFGTIGIMALFFAFAFGYNLAVMHKINPLAGGLISFGSFIATLPQTLTISTPLENASANLISNLKEMGLSVVTAGGASSIETSQWGAIALKYVGATGLFTALIIGFLSSFV

SEQ ID NO: 9251 - DNA, 948 bp, Streptococcus pyogenes
atgataagacaaaccaacaaaaagacatccttttggaaaaatgtgattaaataccgggccttattattaatggtattaccaggtttcatctggttcatctttttcttttatattccagttttagccaatgtggttgcttttaaagattttcattattcagcagggggctttatggaaagtttgaaggagagcccttgggttggtttggctaacttcaaatacctctttgcttccaaagatgcttggttgattaccagaaataccattgcttacaatgtgattttcttactctttaatgttttctttgcgattgcttttgccattatcatgagtgagttacgaaataagagaacggttaaggtctatcacaccatgtccttattgccttatttcttatcatgggtggttattgaatactttgtttctgcctttttaaatacggataaaggtttcattaatcagctcttgaccggaagtggagcagatccaatcaagtggtattccaatcccacttggtggcccttgattttacttttcatgagtgtctggaaggggctaggctacaatagcattatctactatgcttcagtcaaagggatttctgatacttattatgaagctgctatggtggatggtgcaagcaaatggcaacaaattaggaacatcaccattccacaattattgccaatgatgtctatcttattgatcattaatattggtaatatttttaaatctgatttcggacttttctacgttattcctaagaattcaggcccactttatgacgtgaccagtgtgttaaatacctatgtctacaatgccttgactgctacaggagatattgggatggcatcggcagctagcctttatcagtcagtagttgggaccagcatcttgttagtcaccaatgcgattgttcgtcgcatggaccctgatgcagccttgttt

SEQ ID NO: 9252 - protein, 316 aa, Streptococcus pyogenes
MIRQTNKKTSFWKNVIKYRALLLMVLPGFIWFIFFFYIPVLANVVAFKDFHYSAGGFMESLKESPWVGLANFKYLFASKDAWLITRNTIAYNVIFLLFNVFFAIAFAIIMSELRNKRTVKVYHTMSLLPYFLSWVVIEYFVSAFLNTDKGFINQLLTGSGADPIKWYSNPTWWPLILLFMSVWKGLGYNSIIYYASVKGISDTYYEAAMVDGASKWQQIRNITIPQLLPMMSILLIINIGNIFKSDFGLFYVIPKNSGPLYDVTSVLNTYVYNALTATGDIGMASAASLYQSVVGTSILLVTNAIVRRMDPDAALF

SEQ ID NO: 9253 - DNA, 555 bp, Streptococcus pyogenes
atgtcatctcaaaaattagctaattatattgaattgagtatgtatgccgctttaatttttatttcagtacaagtgttgcgtgtccctgtcggtatgcagtttattcatcttggcaatgcattagttgttattgcagtcttaatctatggtagtaaaaaaggagctctagttgctagtcttggtttagggatctttgatgttttgaacggctatgcttcagtcgtttggataactatcttagaatccttggctatttgtttaattttgcatttggtatatgaaagagctatgcaatctagtaaaaaaccaaaagccattataacaataacagttattgctgcattgtcaaaattaactattaaccttataaaatacttactgttagcttatataggtactcagctaccactttcggtatctttttgggtagctcttggaaaaattggtggtagtttcggaacatcttttgtgactttagttgctgttcctcttttgtatcctgttatcaaaaacttaaaagaaaaggttacaatcggacaagcaaaaagaggtttt

SEQ ID NO: 9254 - protein, 185 aa, Streptococcus pyogenes
MSSQKLANYIELSMYAALIFISVQVLRVPVGMQFIHLGNALVVIAVLIYGSKKGALVASLGLGIFDVLNGYASVVWITILESLAICLILHLVYERAMQSSKKPKAIITITVIAALSKLTINLIKYLLLAYIGTQLPLSVSFWVALGKIGGSFGTSFVTLVAVPLLYPVIKNLKEKVTIGQAKRGF

SEQ ID NO: 9255 - DNA, 858 bp, Streptococcus pyogenes
atgagaaagacctatgtttcaatatccatgaaacgcaaacgtttcttcacccaattattgacttatctctatctaatctccttagtgatcgtgattttattcccaatactagtgacggtcagttcagcttttagaccaggaaataccacagcctttagttttcattttgatgggccatggaccttgtctaactttaaaacactctttcaagataccttatacttaagatggtattggaataccttgatcgtggcattcttcaccatgctcatacaagtaacagtcatcactttgacaggttatgcgtatagccgttacaatttctttggacgcaaaaaaagtttaatctttttcctagtcgtacagatggttcctaccatggcggctttaacggcttactttgttatggcgtggctctttaatgccttaaaccaatactggttcttgattttgatttacgtcggtggtggtattcctatgaatgcctggttgatgaagggttattttgacacggtaccttatgacttggacgaatctgctaagttagatggttctggacactttaggaccttctaccaaattgtccttcctcttgtgcgaccaatgattgcagtacaatccttatgggcttttatgggtcctttcggagacttcatgttggctaaattccttttaagggcgcaagaaaattatacggtagcagttggtcttcaatcgtttattacgaatgatgctagaaatcccaaggtaaccttatttgctgcgggagctattctgattgcagtgcctatttcagttctctttttcttcctacagaaaaatttcgtttccggtttaacaagtggtggtaccaaaggg

SEQ ID NO: 9256 - protein, 286 aa, Streptococcus pyogenes
MRKTYVSISMKRKRFFTQLLTYLYLISLVIVILFPILVTVSSAFRPGNTTAFSFHFDGPWTLSNFKTLFQDTLYLRWYWNTLIVAFFTMLIQVTVITLTGYAYSRYNFFGRKKSLIFFLVVQMVPTMAALTAYFVMAWLFNALNQYWFLILIYVGGGIPMNAWLMKGYFDTVPYDLDESAKLDGSGHFRTFYQIVLPLVRPMIAVQSLWAFMGPFGDFMLAKFLLRAQENYTVAVGLQSFITNDARNPKVTLFAAGAILIAVPISVLFFFLQKNFVSGLTSGGTKG

SEQ ID NO: 9257 - DNA, 1305 bp, Streptococcus pyogenes
atggtagagaaccaaagacaacagaagcctaataaagccatgtggctatctgttatcccaggtttgggacaactatacaataaacaaatcgttaaagggggagtcttattagttgttttcttcctagagctactagaaattgtagttctaggaattcctgctttaacaggtctttacagtcttggaagtgttccaatgcaagatcactccttatttatgttaattaagggggccatgcaattaattactctagtcttatttggtatttttcatttggttgctatgagagatgctaaattagttgcacatcaaatgaatgaaggcaagaaggttccggtgacggctaaagagacccttgaagcgatttatgaaaaaggatttccttacttgctcatcattccggcttatttagcaatggctttcgctattatttttccagttttagtgaccttgctgattgcttttaccaattacgattttaggcatattcctccgtatcgtttattggattgggtagggttgaagaattttcttaatatcttagaattaagcaccttcaaaacagcatttacatctgttttgtcatggacgctgatctggacattagcagcgacaagtcttcaaattgttattggaattgcaacggctgttattgctaatcaatcctttatcagaggaaaacgtctctttggtgtgatattcttgttaccatgggctgttccagcatttatctctattatgagttttggtaatttctttaatgattccattggggccatgaatgttcaggttcttcctttcatcgagaaattccttcctttcgttgacttcggaattgtgtcctggaagacagaccccttctggacaaaagtggctgttattatggtgcaaggttggctaggatttccctatatctatattttggtatcaggtattttacaggcaattccagctgatttatacgaagcagcaaccgttgatggtgcgacagtcttacagaaattccgccatatcaccatgccaatgatttttgcggttgcagcaccaacctttatctctcagtacacctttaacttcaataatttctctattatttatctgtttaataatgggggccctggtactgtggggggcggagctgggacaactgatattctgatttcttggatttacaagttgaccacacaaacctcgcctcagttttcgatggcgtcggcagtgaccttaatcatctctgtaatagtgatttcggtatcgttgattacctttaagaaatttaaagcttttgatatggaggagagatca

SEQ ID NO: 9258 - protein, 435 aa, Streptococcus pyogenes
MVENQRQQKPNKAMWLSVIPGLGQLYNKQIVKGGVLLVVFFLELLEIVVLGIPALTGLYSLGSVPMQDHSLFMLIKGAMQLITLVLFGIFHLVAMRDAKLVAHQMNEGKKVPVTAKETLEAIYEKGFPYLLIIPAYLAMAFAIIFPVLVTLLIAFTNYDFRHIPPYRLLDWVGLKNFLNILELSTFKTAFTSVLSWTLIWTLAATSLQIVIGIATAVIANQSFIRGKRLFGVIFLLPWAVPAFISIMSFGNFFNDSIGAMNVQVLPFIEKFLPFVDFGIVSWKTDPFWTKVAVIMVQGWLGFPYIYILVSGILQAIPADLYEAATVDGATVLQKFRHITMPMIFAVAAPTFISQYTFNFNNFSIIYLFNNGGPGTVGGGAGTTDILISWIYKLTTQTSPQFSMASAVTLIISVIVISVSLITFKKFKAFDMEERS

SEQ ID NO: 9259 - DNA, 921 bp, Streptococcus pyogenes
atgagacatgatcgtctattctactataataaaggagaacacctcatgagcttgttatgtattgatataggaggcacttcccttaaatttgccctctgtcacaatggccaattaagccagcaaagcagctttcccactccctctagtctggaaaagttttaccaattactcgaccaagaagttgctcgttactctgcttaccatttctcaggtattgccatcagttcacctggggcagtcaataaagaaaagggggttatcgaaggcgccagcgctattccctacattcaccattttaaaatacaagaggccttagaagaacggctacattaccctatttctatcgaaaatgatgccaattgtgccgccttagctgaagctaccttaggggcaggaaaaggcgctagtagcctagccatgctcgttcttggtactggagttggaggaagcttggtcattgatggcaagatttaccatggtgcccacttatttgggggcgagtttggtttcatgatcatgaacgaccgctaccaaacctttagtcagttagggacagtggtaaatatggccaagcgctatagtgcaatcgtcaataacggaaaagattatactggcaaagctgtccttgccctcgcagaacaaggagatcccctagcactcaaagaaaggcaggtctttctccaaagtttagccatcggtatttttaacattcaacacgcctttgatcctcaactgattttaatcgggggtggtgtttcccaagctgactttctactgtcagcgattgaagctgaactagacaaactctaccaagccgtcgaaatctccgaccttagaccccaattagctatttgtcactttaaaaacgaagctaatcttctgggagctgccattgatttttaccaagaacacaaggaggcc

SEQ ID NO: 9260 - protein, 307 aa, Streptococcus pyogenes
MRHDRLFYYNKGEHLMSLLCIDIGGTSLKFALCHNGQLSQQSSFPTPSSLEKFYQLLDQEVARYSAYHFSGIAISSPGAVNKEKGVIEGASAIPYIHHFKIQEALEERLHYPISIENDANCAALAEATLGAGKGASSLAMLVLGTGVGGSLVIDGKIYHGAHLFGGEFGFMIMNDRYQTFSQLGTVVNMAKRYSAIVNNGKDYTGKAVLALAEQGDPLALKERQVFLQSLAIGIFNIQHAFDPQLILIGGGVSQADFLLSAIEAELDKLYQAVEISDLRPQLAICHFKNEANLLGAAIDFYQEHKEA

SEQ ID NO: 9261 - DNA, 813 bp, Streptococcus pyogenes
ttgaccaaacgtaatattaccattaccttaccagataatgtaccacctgcggttaataaagcctttgctgccattattccaggaacagttgcgatttacgcttcggcaattttcgcctacctcattttcgcattaacaggttcttccctaagtgatgtcatttcaacctatatccaattaccattgctaggcttatcacagggtattggttcagttatcttgttaaccttcttagttcaactgctctggttcttcggcttgcatggtcataatgtcttagccccagtgatggatggtatttatatggtagctttaacagaaaatacagctgcttacaatacagcgcatagcgctgctaatttaccatacctttggacacgcgggtcctttgatgcttatgctcaaatgggtggttcaggagtaaccttggcattgattattgctatcttcatattctcaaaacgagaagagcataaaaccattgccaaattgtccgcaccaatgggtgttttcaatatcaacgaaccaattacatttgggatgccaattgttttgaatccaacctttgtgattccatggctaattgtgccaccaatttgtgctagcatagcttattttgctactgcaataggtttgattccaccggtattcttatcagtaccttggattacccctgttggactttatgcttacctagctactggaggtaatattatggcaggtttggtttcactgtttaacctctttgttgccttccttatctgggcaccatttgtcattttggccaataaagaaaaagcgagtgaccttgca

SEQ ID NO: 9262 - protein, 271 aa, Streptococcus pyogenes
LTKRNITITLPDNVPPAVNKAFAAIIPGTVAIYASAIFAYLIFALTGSSLSDVISTYIQLPLLGLSQGIGSVILLTFLVQLLWFFGLHGHNVLAPVMDGIYMVALTENTAAYNTAHSAANLPYLWTRGSFDAYAQMGGSGVTLALIIAIFIFSKREEHKTIAKLSAPMGVFNINEPITFGMPIVLNPTFVIPWLIVPPICASIAYFATAIGLIPPVFLSVPWITPVGLYAYLATGGNIMAGLVSLFNLFVAFLIWAPFVILANKEKASDLA

SEQ ID NO: 9263 - DNA, 1860 bp, Streptococcus pyogenes
atgacaatcagacaatggatggcagaccatcttcatttgatggagactttagcgtgtttggtattaataataattggcctagcctttttacactcatttccacaagtggcttccgctattttcattacagccttcttgattggaggatatgcgtctgcaaaaacgggtatattggatttggtgaagaacaaacacttgtcagtggatattttgatgattttggcagctatcggtgctggaattatcggctattggctggagggtgctctgcttatttttatcttttcgttgtccaatacgcttgaagaaatggccatggaaaaaagtaaggatgctatttcagccttgatgtccttgacgccagatacagctcgtcaataccaagaagatggccatattttagaagttgagaccagatccttgagtgttggtgaccgtttacaagttcgtaaaggcgaagctgttccaattgacgggcagttgcttagtccttttggtcaatttgatgaatctatggtcactggtgagcctatcactgttgataaggcagaaggccaggatctgattgggggaaccattaaccaaggacaaaccatagatatgttggttactattgaaaatgacgatactctctttgccaagattattaatctggtggaatctgcccaagaaaagaaaagcaaaaccgccacctttatcgaaagcttagaagatggttatgtcaaatttgtgctcgtccttattcctgcctttatcctctttagccactttgtgctttcttggacttggttggctgctttttaccgagggatgattctcttaacagtagcttcaccatgtgccctaattgccagttccacacctgctagcttggctgctatttctcgtgcagccagaaagggattgattatcaaaggaggggatattgtcgataacatgggagatattaaggctgttgtcatggataaaacgggaacgctcacccaaggaaaaccttctgttgtgaatgctcattatttggaagatgagttgctcgtgaatagactggtaaaaggagcagagactgctagtacccatcctatttctaaagcccttcttgaatacactgaaaaattggagccactgacctttgaccacttagaagaaatttctgggaaaggttttcagggcttctatcaagggcaagaatggcgaattggcaagaaaacctacattttggaaaaggttcaagacctatcagcttttgaagaaactattcaagtggaagaaaatcaagggaaaaccctaatctttgtttcacgtgaccatcaattgatagcttactatgccctcttggatgatatcaaaatagaatcaaaacgtgctattaagtctcttcatgccatgggaatcaaaacagtcatgttaacaggtgaccaagaacgaaccgccaattatgtggcacaaaaacttggtattgatgaagtggtagccaactgtatgcctcaagataaggtggctaagttagcagaattaaagactaaatatggttttgtggctatggtaggagatggtattaatgatgctcctgcccttgctcaagcagatgtttcttatgctattggatcaggaacagatattgcaatggaaagtgcagacagtgtgattatggatgacttgactcgtattccattttcgattcaactttcccgcacaatgaagaccattatcaaacaaaatattgtttttgccttatctgtgattaccttattgattttagccaatgtttttcaggtagttaacttgccgcttggtgttgttggacacgaaggctcaacgattttagtgattttaaatggcttgcgtttactttcttttaaa

SEQ ID NO: 9264 - protein, 620 aa, Streptococcus pyogenes
MTIRQWMADHLHLMETLACLVLIIIGLAFLHSFPQVASAIFITAFLIGGYASAKTGILDLVKNKHLSVDILMILAAIGAGIIGYWLEGALLIFIFSLSNTLEEMAMEKSKDAISALMSLTPDTARQYQEDGHILEVETRSLSVGDRLQVRKGEAVPIDGQLLSPFGQFDESMVTGEPITVDKAEGQDLIGGTINQGQTIDMLVTIENDDTLFAKIINLVESAQEKKSKTATFIESLEDGYVKFVLVLIPAFILFSHFVLSWTWLAAFYRGMILLTVASPCALIASSTPASLAAISRAARKGLIIKGGDIVDNMGDIKAVVMDKTGTLTQGKPSVVNAHYLEDELLVNRLVKGAETASTHPISKALLEYTEKLEPLTFDHLEEISGKGFQGFYQGQEWRIGKKTYILEKVQDLSAFEETIQVEENQGKTLIFVSRDHQLIAYYALLDDIKIESKRAIKSLHAMGIKTVMLTGDQERTANYVAQKLGIDEVVANCMPQDKVAKLAELKTKYGFVAMVGDGINDAPALAQADVSYAIGSGTDIAMESADSVIMDDLTRIPFSIQLSRTMKTIIKQNIVFALSVITLLILANVFQVVNLPLGVVGHEGSTILVILNGLRLLSFK

SEQ ID NO: 9265 - DNA, 603 bp, Streptococcus pyogenes
atgaatggcattgaaaaaacctgctttttaatttggaaaatgatccaattgaccctcatttttcatctcttgtccttagctggactgattgtgtttggggtggggccagcctggcaaaccattgtcaccctatttttaaaaacacctcaagaagaaaaccactattctttgaaaagggctgttcaactttggaaatcttatttcaaagaagctaatctaagatttggtctttttgccctgactttcctttttttaacctttaatttgcattgggcagtacagtttccatccttgttttggtttaccgtgtctttcttgattgtaatagccatggtttggctaaccatgacctatctttacatggttttttatgcagtgagctatgagattaacctttggaataatatgaaattagcctttatcagcgtctttttaagtttcaaatcctttttactcatgctgagtgttttgttgggaattaccttagtgacttggcaatacaaaggtctttatctctttttaaccttcggagctctagtcttttgcttggactttgtcactaaggctaatcgtcgactagtagatggagtgattgatgagtgt

SEQ ID NO: 9266 - protein, 201 aa, Streptococcus pyogenes
MNGIEKTCFLIWKMIQLTLIFHLLSLAGLIVFGVGPAWQTIVTLFLKTPQEENHYSLKRAVQLWKSYFKEANLRFGLFALTFLFLTFNLHWAVQFPSLFWFTVSFLIVIAMVWLTMTYLYMVFYAVSYEINLWNNMKLAFISVFLSFKSFLLMLSVLLGITLVTWQYKGLYLFLTFGALVFCLDFVTKANRRLVDGVIDEC

SEQ ID NO: 9267 - DNA, 924 bp, Streptococcus pyogenes
atggagaaaaagaaaaaagtcgaaaaggttaatgttagaacctttgatcgaaaaaccaatgctatctttaatattctgattggtctgtttgccatctcttgtatcattccttttatcttcgtgattattatttccttcactgatgaaagttacttgattaatcatgggtatagtttttttccagatgtctggtcaactaaggcttaccagtatatttttcaaggagccatgtcccatagaatcatgaggtcatttgggatatccgtgtttattacagtggtgggaacctttattaacacgaccatgacatcaacctatgcttatgcgatttcaagaccttatttcccatacagacgtttttttactgtttatgcacttatcaccatgctctttgcaccagggatggttgctaattacttggtggtcagcaatctccttcatttgaaggatacggtttgggccttgattttaccaatggctctgggcccatttggcatcttggtcatgagaacgttctttaaaaagacagttccagatagcattattgagtcggctcgtatggatggggctagtgaatggatgatttttatgaaaattgtcttaccattagctgttccagggattgccaccatcagtttattttctgccttaacttattggaatgattggtttaacgccttgctttatgtgcaaagtgagaatctttacccaatgcagtacttactgatgaaaattcagagcaacctacaggccttggcacaaaatgctggcatgagtgcacaaatggcagatagcttagcatcgctgccaaaagaatcagttcgtatggctatcgtggttattgcaaccttgccgattgccttgacttacccattcttccaaaagtactttgtcggtggtttgaccattggtggggtgaaggaa

SEQ ID NO: 9268 - protein, 308 aa, Streptococcus pyogenes
MEKKKKVEKVNVRTFDRKTNAIFNILIGLFAISCIIPFIFVIIISFTDESYLINHGYSFFPDVWSTKAYQYIFQGAMSHRIMRSFGISVFITVVGTFINTTMTSTYAYAISRPYFPYRRFFTVYALITMLFAPGMVANYLVVSNLLHLKDTVWALILPMALGPFGILVMRTFFKKTVPDSIIESARMDGASEWMIFMKIVLPLAVPGIATISLFSALTYWNDWFNALLYVQSENLYPMQYLLMKIQSNLQALAQNAGMSAQMADSLASLPKESVRMAIVVIATLPIALTYPFFQKYFVGGLTIGGVKE

SEQ ID NO: 9269 - DNA, 1668 bp, Streptococcus pyogenes
atggctaaacctaacagatctaccttaagcctggtttggcgtttattaaccctaatgaaaactctgctaccttggattatcttggctgttggctttgctgttatgggttttgtcatcacggtaagtattccaactggaatagcttatttaggactactagctattagacaagaagtgattccaatattagctttatatcttttgattgctctagcctttttaagaggttttgttcgttatggagagcattattttggtcattttgttgcttttcatagtttagcagcttttaggaacttgatctttaagaaactaagagctctttctccagcttgcttggatagtcaagacagtggttatttgcttaaaatgattggagaagatattgaggcattagaagttttttttgcccacacaatcgcacctatttgtacagcaatattgtctgcaggtttaatgttctggtacttttgtcaaagtagttggcagttagccttattagctttggcaacctatgcttgtttagccattgttatacccatttattttgctaatattttacaggttttactaaaaagccaaaatgaaggtcgaaaagattacctgtcttattttttagagagtttacgatcagtcaaagatcttttgcaatttcaggtattagacgagcaatttgaacgattaataaaaaaaagtaatcatgtaaatgctcttgatcgtaacgtagcgcaagcccaatttttgcaaatggcattgacttttttctggcttggcttaatgatcttagcattttcttatatggtttttgatgggatatgccatgacagcttatcatttgataaaggcttattaacttttattgctttcactgcttcgttttctccttttttagaactaggacgtttgccattaggttttaagcgtgctatgaatgcggctcgaaatatttttgaccttctagacgaaaatgtcatagtagatgaaggcacaaaacaaatagatcgtttaaggagtgtttcttttgaggacctcagttttgcttatccaaagcgccaagagctggtttttaaggatttaacagttacctttcaagaaaaggggattattggcattaaaggcgaatcaggatctggtaaatcaactttggtgaaattaattatgaaatggtataattggaagacaggagatatttttcttaatgataggaatagttgcttactaaatgctgctaaattacaagatactattgcttatgtgccacaaacagcgcagcttttccaacagtctatccgtgaaaatcttatctttggccgtcaagatatttcagatgagtccatttggaatttagctgaggcttgtggtatgaaagacagactgttagcttgtaaggaaggtttggatacgattatcaagagtccttctgacttttcagctggagaaggtcaacgtttagagttgatgcgagctttattgaaagatgcgagttgctatatttttgatgaacccacgtcaaatttagattctctaaatgaagctatcttgcttgatttaattaaaacacattgtcaaggattggtcttcttaatttctcacaggccatcaaccctagcttgtgttgatcatctattttgcgtaaaaaatggttccctaaaagaggtgaataaaaaa

SEQ ID NO: 9270 - protein, 556 aa, Streptococcus pyogenes
MAKPNRSTLSLVWRLLTLMKTLLPWIILAVGFAVMGFVITVSIPTGIAYLGLLAIRQEVIPILALYLLIALAFLRGFVRYGEHYFGHFVAFHSLAAFRNLIFKKLRALSPACLDSQDSGYLLKMIGEDIEALEVFFAHTIAPICTAILSAGLMFWYFCQSSWQLALLALATYACLAIVIPIYFANILQVLLKSQNEGRKDYLSYFLESLRSVKDLLQFQVLDEQFERLIKKSNHVNALDRNVAQAQFLQMALTFFWLGLMILAFSYMVFDGICHDSLSFDKGLLTFIAFTASFSPFLELGRLPLGFKRAMNAARNIFDLLDENVIVDEGTKQIDRLRSVSFEDLSFAYPKRQELVFKDLTVTFQEKGIIGIKGESGSGKSTLVKLIMKWYNWKTGDIFLNDRNSCLLNAAKLQDTIAYVPQTAQLFQQSIRENLIFGRQDISDESIWNLAEACGMKDRLLACKEGLDTIIKSPSDFSAGEGQRLELMRALLKDASCYIFDEPTSNLDSLNEAILLDLIKTHCQGLVFLISHRPSTLACVDHLFCVKNGSLKEVNKK

SEQ ID NO: 9271 - DNA, 1695 bp, Streptococcus pyogenes
atgaatggattaattgctcagattgagaaagggaaacctttcttcgagaaaatttctcgaaacatctatcttcgcgctattcgtgatggttttatcgctggtatgcctgttatcttgttttcaagtatctttatcttgattgcctatgttccaaatgcatggggcttccattggagtaaggatattgagaatctcttgatgacgccatacaactactcaatgggtattttaggtttgtttgtggctggtacgactgcaaaagcattaaccgattcaatgaaccgctcattgcctagcactaaccaaatcaactttatttcaaccatgcttgctgctattgtaggttttttacttatggcagcaaatccagcaaaagacggtggtttcttaactggatttatgggaacaaaaggtttgttaacggccttcatcgcagcttttattaccgtaaatgtctataaagcctgtgtgaaaaacaatgttactattcgcatgccagaagaggtgccaccaaatatatctcaagtttttaaagatttgattccatttacattatcagttgtacttctttatgtgattgaattgattgttcatactactttaggcgttaacgttgccgagtcaattggtaaacttcttgcaccattgttccaagcagcagatggttatgttggaatcactattatcttcggtgcatttgctttcttctggtttgttggtattcatggaccatctattgttgaaccagccattgcagcgattacttacgcaaatgctgaaaccaaccttcaattacttcaagctggtgaacatgctgacaagattttgacttcagggactcaaatgttcatcgttaccatgggtggtactggtgcaactctcgtcgttccattcatgttcatgtggttaacaaaatcaaaacgtaacaaagccattggacgtgcatcagttgttccaacattctttggtgttaacgaacccattttgtttggtgctccacttgttttgaacccaattttctttattccatttatcttggcaccgattgtcaacgtatggattttcaaattcttcattgacacacttggaatgaacagtttcactgcaaacttaccttggactacaccagctccattaggtctcattcttggtacaaacttccaagttctagcattcattttggcagctttgttaattgtcgttgatgtgatcatctactacccattcttgaaagtatatgatgagcaaattcttgctgaagaagcagcaggtacgaattcatcagatgccctcaaagaaaaagtagcagcaaactttgatactaaaaaagctgatgctattcttgaaaaatcagcagctaaagaaaccaaagaaatcactgatcaaactaatgttctcgttctttgtgccggtggtggtacaagtggtttgcttgcaaatgctttgaataaagcagctaaagaatatggtgcacctgtcactgcagcagcaggaagttatggtgctcaccgtgagattttaccacaatatcaacttgttatccttgcacctcaagtagcttctaactatgaagatatgaaagtggaaactgataaacttgatattaaattagctaaaacagaaggggctcaatacatcaaattgacccgtgatggtcaaggagctcttgattttgtaaaagcacagtttgaaaat

SEQ ID NO: 9272 - protein, 565 aa, Streptococcus pyogenes
MNGLIAQIEKGKPFFEKISRNIYLRAIRDGFIAGMPVILFSSIFILIAYVPNAWGFHWSKDIENLLMTPYNYSMGILGLFVAGTTAKALTDSMNRSLPSTNQINFISTMLAAIVGFLLMAANPAKDGGFLTGFMGTKGLLTAFIAAFITVNVYKACVKNNVTIRMPEEVPPNISQVFKDLIPFTLSVVLLYVIELIVHTTLGVNVAESIGKLLAPLFQAADGYVGITIIFGAFAFFWFVGIHGPSIVEPAIAAITYANAETNLQLLQAGEHADKILTSGTQMFIVTMGGTGATLVVPFMFMWLTKSKRNKAIGRASVVPTFFGVNEPILFGAPLVLNPIFFIPFILAPIVNVWIFKFFIDTLGMNSFTANLPWTTPAPLGLILGTNFQVLAFILAALLIVVDVIIYYPFLKVYDEQILAEEAAGTNSSDALKEKVAANFDTKKADAILEKSAAKETKEITDQTNVLVLCAGGGTSGLLANALNKAAKEYGAPVTAAAGSYGAHREILPQYQLVILAPQVASNYEDMKVETDKLDIKLAKTEGAQYIKLTRDGQGALDFVKAQFEN

SEQ ID NO: 9273 - DNA, 876 bp, Streptococcus pyogenes
atgtcaattgaccaacgtttacagttaaagaaattttgctttattattttaggagctgctatctacgcctttgcttttgtttatttttacatggctaatcgcattgcagccaatggtttagctggtctcaccctagttggtaaggcactttttgagattgatccttctttgataggctatttgattaatttgcctttggtcttgctgggagctagatgttttgggaaaagagccatggtttacacagtaacgggtattttatcactttacttttttgtgtggctgtttcaacgctttcctttggtcgttgacttggaccatgacaatttagtcgtttccttgatggctggaattattggtggtctaggtggcggtcttgtgtttcgcaatggtggaaccatcggtggagcagatattattgctaagttattagaagacaagttaggactacagctgaatcaagctcttttaggcattgatctttttgtcatgattgtctctttgacttatatttccctgccgcaaatgatgtatgctctgattgctagctttatgtatggtcaaattgttcgcttggtacaacaaggtggttattcagcccgtggcatttttatcgtttcagaacaagcggagaaaattgcccggttcatcatggacgaattgggaagaggagttacttatctaacaggtgaaggagcctactctggtcgccgtaaaaaagtgatttatgtggctttggggcgaagagatattagggaattaaaagcttttttaactcaggttgatcccaatgcctttatcacttattttgatgttaatgaagtcaatagcccagaatttttaactattaaaagcaaataccataaaaagagaaaa

SEQ ID NO: 9274 - protein, 292 aa, Streptococcus pyogenes
MSIDQRLQLKKFCFIILGAAIYAFAFVYFYMANRIAANGLAGLTLVGKALFEIDPSLIGYLINLPLVLLGARCFGKRAMVYTVTGILSLYFFVWLFQRFPLVVDLDHDNLVVSLMAGIIGGLGGGLVFRNGGTIGGADIIAKLLEDKLGLQLNQALLGIDLFVMIVSLTYISLPQMMYALIASFMYGQIVRLVQQGGYSARGIFIVSEQAEKIARFIMDELGRGVTYLTGEGAYSGRRKKVIYVALGRRDIRELKAFLTQVDPNAFITYFDVNEVNSPEFLTIKSKYHKKRK

SEQ ID NO: 9275 - DNA, 1992 bp, Streptococcus pyogenes
atgttatcaaaaaaagaactggccatcataacatttctaatccatcacaaagagcagtttgtctctagtgcaactctggctgaggttatcggtatgagtgaccgtacggttaggaaatacctcaaagaactgatcagtagccttcctgaacacggagctcacatcatttctaaacaaggtcgaggttactgcttagaaattgaccattctatggcatttgacatcttttggcaagaaagtgtgacgtctaaaaaacgtttggcagatgtgactcaagtggaagaatcggttgatcgagaagattatgtgcttcataaattcttttttgaagatgccgttcaggattttgaagagctttgtcaagaattgtatatcagtcggacaactttaaaacatgttttagcaggtattaaggagcgcataataccttaccagttagagcttgaaataactcaccaacatattcaaataagaggtaaagaagaggacattaggcattttatcatggactatttttttgttactagttttgataataccttgtccaccatggtaggtaatacctttcttgaaggtattaattttgcagaaatcatgattattgtcttggatgaatgtcgggatgctaagttgaaactttctgattttgtcatgaataatctagtcttgcatattgccctaatggttcagcgtattcgatcggggtgtccattagaactgttttccattccaatagctattcgtcagtctgatgagtatcaagtagctctgcgcattttgtatcgagtggaagaagtgatggggatacgttttcctaaagaggaggctaattatattgcactgcatctaaaggtcaaacattctgttggtaagcattggcaagatgataataccgatgaaaagttgcaggaccatttaaaagcatgtattgccaagattagtcaattgacaggcatgactttagaaacagataccaatttatttcaaggtttattagcccacatgatgcccttgaccatacgtcttgaaaaccatattcagctgactaatcctttaactgaggaaattaaaagccagtatcctgaaatatttacccttaccaagcagaccttttcggatttgcttgtatgtcaaaagaatgatgtctcagatgatgaatgggcttatattagtttgcatttaatggcggccattgagcgttattcaaaccgtcataaattgagggttctagtagtttgtgccacaggttatggtagtgccatgatgttgaaaaatcgcttggaaaaggaatttgaaggacgtttgcgtattgtcgatgttatcagttactatgaaataaccgaagagcgactgaaaaccgttgatttgattatttcctctatcagccttgccaatctgatgtttttaacaccagtgattactgtcagtgtttttttgtcaaatcaggatattgaaactattcgacaatttattggagaacaagaaggtatcaagaaagaggtcagtttaccgtcacagatgagtttagcaaaagcagagcagcttctaacaggtgtttttagccctaatcgttttctttatttagacgagaaaatctcaaaggaagacttgcttttacggatgattgcttgtcttgacgaggcgggaacagaaacgtttgtagaggacttctatcatcaaatggtactgagggaaaattacagcccagtcatctatggagaagtgcttgcctttccgcatcctgctaatcccatgacttattctgaacaggtagtagtggttatttgccgagagcctcttgagtgggacaaggcgcatcaagctgttcattttgtctttctattatccccgtctaaagggcataatcataggttaaaatatgtatcaccaggtttggcatcttttgtcaatcaggtggagcttcagcaagcgttactagaagaaccaaattattccaaattcatgacagtgtttaccccacttattcatgat

SEQ ID NO: 9276 - protein, 664 aa, Streptococcus pyogenes
MLSKKELAIITFLIHHKEQFVSSATLAEVIGMSDRTVRKYLKELISSLPEHGAHIISKQGRGYCLEIDHSMAFDIFWQESVTSKKRLADVTQVEESVDREDYVLHKFFFEDAVQDFEELCQELYISRTTLKHVLAGIKERIIPYQLELEITHQHIQIRGKEEDIRHFIMDYFFVTSFDNTLSTMVGNTFLEGINFAEIMIIVLDECRDAKLKLSDFVMNNLVLHIALMVQRIRSGCPLELFSIPIAIRQSDEYQVALRILYRVEEVMGIRFPKEEANYIALHLKVKHSVGKHWQDDNTDEKLQDHLKACIAKISQLTGMTLETDTNLFQGLLAHMMPLTIRLENHIQLTNPLTEEIKSQYPEIFTLTKQTFSDLLVCQKNDVSDDEWAYISLHLMAAIERYSNRHKLRVLVVCATGYGSAMMLKNRLEKEFEGRLRIVDVISYYEITEERLKTVDLIISSISLANLMFLTPVITVSVFLSNQDIETIRQFIGEQEGIKKEVSLPSQMSLAKAEQLLTGVFSPNRFLYLDEKISKEDLLLRMIACLDEAGTETFVEDFYHQMVLRENYSPVIYGEVLAFPHPANPMTYSEQVVVVICREPLEWDKAHQAVHFVFLLSPSKGHNHRLKYVSPGLASFVNQVELQQALLEEPNYSKFMTVFTPLIHD

SEQ ID NO: 9277 - DNA, 1776 bp, Streptococcus agalactiae
atgagaataaaatggttttctttggtacgtataacaggactactacttgttttactttaccatttctttaagaatagttttccaggaggatttgttggcgttgacatcttctttacattttctggttttctgattacggccttattgattgatgaattttctaaaacgaaaaaaattgattttgttagtttttgtcgtagacgtttttaccgtattttcccaccattagtattgatggttttggtgacaataccttttgtatttctggttaaaagcgattttagagcaagtattggctctcaaattatgactgctttaggttttaccagcaacttttacgaaatcttgactggtggtaactacgaaagtcaatttatccctcacttatttgtgcatacctggagtctttctattgaagtccatttttatgttttatggggcttaacggtatggctcttatcgaaaagatcaaaagatcaaaagcaattgagggggactttgttccttatttccatgggaatttttggagtcagcttccttaccatgtttgttagagcctttttcgttgataatttttcaacgatatatttctctacattatcacatatatttccgttctttttaggagcgatggtggctacaatatctggtattcgagagattaccggacgattcaagaaaaatatcaaaaatctgactttgaagcataatttaatcatgatgggtagtgcttttgctggtctaatgattttaacttttgcacttgattttgataatcggctaacatatctttttggttttgtattgtctagcatttttgctagtgtaatgatttacaatgcacgtattttacacgagcatacaccagatatttcagaaccttttgtgattacttatcttgctgatatcagttacggtatgtacctttttcattggccattttatattatttttagtcgtttatccccaaactggatagctgttattttgacagtagtattatcagcagtcttctcaacattatcattttatatcattgaaccttttattttaggtagaaaacctaaattccttgattatgaatttgacttgttgccttacaaaaagtggttatttagtatcggaggggtactaactcttattactgtagtgacaatgttgacagctccaagtataggtagttttgagacagaattattgcagaattcgttacaacaagctagaacaaatactaaccgaacacatacactagccgcaggggatgcaggtgctcttagtgatgtgacagtaatcggagattcagttgccttaaggtcaagtgctgcttttaataaattgttaccagaagtacaattagatgctgcggtgagtcgtaattttagtaaatcatttgatatttttgaaaaccgtattcaaaataaagccttgtccaaaattgttgttttggcagttggtgtgaattcattagataactacaagacagacttgagccaatttattaaatctttgcctaagggacaccgtttgattatagtaacaccttataatgctaaaaatatgagtcaagttacgacagtgcgtgattatgaactctcgctaatgaaaaaatataattacataacggttgctgactggtataaggttgcgacagaacatccagaaatctggggaaatacagatggtgtgcattatagtgatagcgatactacaggggctgatttatatgttagtaacgtcaaaaaagctattcaaaaatcagctcaacgagctgcaaaa

SEQ ID NO: 9278 - protein, 592 aa, Streptococcus agalactiae
MRIKWFSLVRITGLLLVLLYHFFKNSFPGGFVGVDIFFTFSGFLITALLIDEFSKTKKIDFVSFCRRRFYRIFPPLVLMVLVTIPFVFLVKSDFRASIGSQIMTALGFTSNFYEILTGGNYESQFIPHLFVHTWSLSIEVHFYVLWGLTVWLLSKRSKDQKQLRGTLFLISMGIFGVSFLTMFVRAFFVDNFSTIYFSTLSHIFPFFLGAMVATISGIREITGRFKKNIKNLTLKHNLIMMGSAFAGLMILTFALDFDNRLTYLFGFVLSSIFASVMIYNARILHEHTPDISEPFVITYLADISYGMYLFHWPFYIIFSRLSPNWIAVILTVVLSAVFSTLSFYIIEPFILGRKPKFLDYEFDLLPYKKWLFSIGGVLTLITVVTMLTAPSIGSFETELLQNSLQQARTNTNRTHTLAAGDAGALSDVTVIGDSVALRSSAAFNKLLPEVQLDAAVSRNFSKSFDIFENRIQNKALSKIVVLAVGVNSLDNYKTDLSQFIKSLPKGHRLIIVTPYNAKNMSQVTTVRDYELSLMKKYNYITVADWYKVATEHPEIWGNTDGVHYSDSDTTGADLYVSNVKKAIQKSAQRAAK

SEQ ID NO: 9279 - DNA, 1014 bp, Streptococcus agalactiae
atgaaagcggttgttgttaatcaagctagtacaggtgttgaagttgttgagcatgatcttccaaaagttggtcatggtgaagcacttgtaaaagtagaatactgtggtgtatgccatactgatttacacgttgcacatggagatttcggccaggtaccaggacgcattttgggtcacgaaggcattggtatagtagaagaaattggagaaggcgtaacgtctttgagggttggtgatcgtgtctctattgcatggttctttgaagggtgcggtcattgcgaatactgtactacaggacgtgagacactttgtcgtagtgttaaaaatgctggatacagtgttgatggtggtatgagtgaatacgctattgttaccgcggactatgcggttaaggttcctgagggattagacccagctcaagcatcatcaatcacttgtgctggagtaacaacatacaaggctatcaaagaagctggagctgctcctggtcagtggattgcagtgtatggtgcaggtggtcttggaaacttagcagtccaatatgcaaaaaaagtattcaatgctcatgttgtagctgttgatattaacgcagataaacttcaattagctaaagaggttggagcagatttgacagttaatggcaaagaaataaaagatgttgcggcatatattcaagaaaagacaggcggttgtcatggagtggttgtgactgctgtttctaaagttgcgtttaatcaggcgattgacagcgttcgtgctggaggtacagtggtagctgtcggtcttccatcagaatatatggaattgagtattgtaaaaacagtacttgatgggattcgtgtggttggttccttagttggaactcgtaaagacttagaagaagccttcgcatttggagcagaaggcttggtagtaccggtggttgaaaaagtgcctgtggatacagctcctcaagtattcgatgaaatggaaagaggattgattcaaggacgtaaagttcttgactttacaaag

SEQ ID NO: 9280 - protein, 338 aa, Streptococcus agalactiae
MKAVVVNQASTGVEVVEHDLPKVGHGEALVKVEYCGVCHTDLHVAHGDFGQVPGRILGHEGIGIVEEIGEGVTSLRVGDRVSIAWFFEGCGHCEYCTTGRETLCRSVKNAGYSVDGGMSEYAIVTADYAVKVPEGLDPAQASSITCAGVTTYKAIKEAGAAPGQWIAVYGAGGLGNLAVQYAKKVFNAHVVAVDINADKLQLAKEVGADLTVNGKEIKDVAAYIQEKTGGCHGVVVTAVSKVAFNQAIDSVRAGGTVVAVGLPSEYMELSIVKTVLDGIRVVGSLVGTRKDLEEAFAFGAEGLVVPVVEKVPVDTAPQVFDEMERGLIQGRKVLDFTK

SEQ ID NO: 9281 - DNA, 381 bp, Streptococcus agalactiae
ttggctaaaccaacacgcaaacgtcgtgtgaaaaagaacatcgaatctggtgttgctcatattcacgctacattcaataacactattgttatgattacagatgtgcatggtaacgctcttgcatggtcatcagctggtgctcttggatttaaaggttctcgtaaatctactccatttgctgctcaaatggctgctgaagctgctgctaaatctgcacaagaacacggtcttaaaactgttgaagttactgtaaaaggtcctggttcaggtcgtgaatctgctatccgtgcccttgctgcagctggtcttgaagtaactgcaattcgtgatgtgactcctgtaccacataatggtgctcgtcctccaaaacgtcgtcgtgta

SEQ ID NO: 9282 - protein, 127 aa, Streptococcus agalactiae
MAKPTRKRRVKKNIESGVAHIHATFNNTIVMITDVHGNALAWSSAGALGFKGSRKSTPFAAQMAAEAAAKSAQEHGLKTVEVTVKGPGSGRESAIRALAAAGLEVTAIRDVTPVPHNGARPPKRRRV

SEQ ID NO: 9283 - DNA, 1281 bp, Streptococcus agalactiae
atgtctacatcatttgaaaataaagctacaaaccgtggtattatcacatttacaattagtcaagatgagatcaagccagctcttgatcaagcattcaacaaagtaaaaaaagatttgaacgttccaggattccgtaaaggacatatgcctcgtacagttttcaaccaaaaatttggtgaagaagcactctacgaaaatgcattgaatttagtgttgccaaaggcttacgaagcagctgttgcagaacttggtttagacgttgttgctcaaccaaaaattgatgttgtatcaatggaaaaaggtcaagattggaagttgacagctgaagttgttacaaaaccagaagttaaacttggagattacaaagacctttcagtagaagttgatgcttcaaaagaagtttcagatgaagaagttgatgctaaagttgaacgtgagcgtaacaaccttgcagaattgactgttaaagatggtgaagcagcacaaggtgatacagttgttattgactttgtaggttcagttgatggtgttgaatttgatggtggtaaaggagataacttctcacttgaacttggttcaggtcaatttatcccaggatttgaagaacaattagtaggttctaaagctggtcaaactgtagacgttaatgtaacattcccagaagattatcaagcagaagatcttgctggtaaagatgctaaatttgttacaacaattcacgaagtaaaaactaaagaagttccagcacttgatgatgaacttgcaaaagatattgatgatgaagttgaaacacttgatgagttgaaagcgaaatatcgcaaagagctagaatcagcaaaagaaattgcatttgatgatgcagttgaaggtgcagcaatcgaattagctgttgccaatgcagaaattgttgaattaccagaagaaatggtccatgatgaagtacatcgtgctatgaatgagttcatgggtaatatgcaacgtcaaggaatttcaccagaaatgtacttccaattaacaggtacaactgaagaagaccttcataagcaataccaagcagatgctgacaaacgcgttaaaactaaccttgttatcgaagcaattgcagctgcagaaggctttgaagcaacagatgaagaaatcgaaaaagaaatcacagatcttgcttcagaatacaatatggaagctgaccaagtacgcggtctactttcagcagatatgcttaaacatgatattgcaatgaaaaaagcggttgacgttatcactagctcagctactgtaaaa

SEQ ID NO: 9284 - protein, 427 aa, Streptococcus agalactiae
MSTSFENKATNRGIITFTISQDEIKPALDQAFNKVKKDLNVPGFRKGHMPRTVFNQKFGEEALYENALNLVLPKAYEAAVAELGLDVVAQPKIDVVSMEKGQDWKLTAEVVTKPEVKLGDYKDLSVEVDASKEVSDEEVDAKVERERNNLAELTVKDGEAAQGDTVVIDFVGSVDGVEFDGGKGDNFSLELGSGQFIPGFEEQLVGSKAGQTVDVNVTFPEDYQAEDLAGKDAKFVTTIHEVKTKEVPALDDELAKDIDDEVETLDELKAKYRKELESAKEIAFDDAVEGAAIELAVANAEIVELPEEMVHDEVHRAMNEFMGNMQRQGISPEMYFQLTGTTEEDLHKQYQADADKRVKTNLVIEAIAAAEGFEATDEEIEKEITDLASEYNMEADQVRGLLSADMLKHDIAMKKAVDVITSSATVK

SEQ ID NO: 9285 - DNA, 924 bp, Streptococcus agalactiae
atgaaaaagattcgattatcaaagtttattaaaatgattgttgttattttgtttttaattagtgtagcagctagtttttattttttccacgttgcccaagttcgagatgataaatcctttatttcaaatggtcaacgtaagcctggaaactctttatatgcttatgataaatcctttgataagctattaaagcaaaaaatagaaatgacaaaccaaaatataaagcaagttgcttggtatgttcctgctgttaagaaaactcataagacagctgttgtcgttcatggttttgcgaatagcaaagagaatatgaaggcatatggttggctgtttcataagttaggatacaatgttcttatgcctgacaatattgcacatggtgaaagtcatgggcagttgataggctatggctggaacgaccgcgagaacattatcaaatggacagaaatgatagttgataagaatccatcaagccaaattactttatttggtgtttcaatgggtggagcaacagtcatgatggctagtggtgaaaaattacctagtcaggttgttaatatcattgaagattgcggttattctagtgtttgggatgaattaaaatttcaggctaaagagatgtatggtttaccagccttcccactcttatatgaagtttcaacaatttctaaaatcagagcaggtttttcgtatggacaagcaagtagtgtcgaacaattgaaaaagaataatttaccagccctctttattcatggtgataaggataattttgttccaacaagtatggtttatgacaactataaagctacagcaggtaagaaagagctttatattgtaaaaggggcaaaacatgcgaaatcttttgaaacagagccagaaaaatatgagaaacgtatctctagttttttgaaaaaatatgaaaaa

SEQ ID NO: 9286 - protein, 308 aa, Streptococcus agalactiae
MKKIRLSKFIKMIVVILFLISVAASFYFFHVAQVRDDKSFISNGQRKPGNSLYAYDKSFDKLLKQKIEMTNQNIKQVAWYVPAVKKTHKTAVVVHGFANSKENMKAYGWLFHKLGYNVLMPDNIAHGESHGQLIGYGWNDRENIIKWTEMIVDKNPSSQITLFGVSMGGATVMMASGEKLPSQVVNIIEDCGYSSVWDELKFQAKEMYGLPAFPLLYEVSTISKIRAGFSYGQASSVEQLKKNNLPALFIHGDKDNFVPTSMVYDNYKATAGKKELYIVKGAKHAKSFETEPEKYEKRISSFLKKYEK

SEQ ID NO: 9287 - DNA, 939 bp, Streptococcus agalactiae; identical to SEQ ID NO: 8977

SEQ ID NO: 9288 - protein, 313 aa, Streptococcus agalactiae
MKNMMKYISELTTLIALAGLMVIITLINPNFLTTNNLLNLLLQVTANGFIAFGMTFVILTGGIDLSVGSILALSSALTAGLIGHGVPVGIAIVLSVALGGILGMLNGLFISYGKLAPFIVTLATMTIFRGATLVYSNGNPITAGLSDSFLFQFLGQGYIVGIPFPVILMFLTFIILYILLHKTAFGKSVYALGGNEKAAYISGIKLNKVKIIIYTISGIMASISGLIITSRLSSAQPTAGASYEMDAIAAVVLGGTSLSGGKGRIIGTLIGALIIGVLNNGLNIIGVSAFWQQVVKGIVILMAVLLDRFKVAK

SEQ ID NO: 9289 - DNA, 879 bp, Streptococcus agalactiae
atggcaatcgtttcagcagaaaaattcgtccaagcagctcgtgataacggctatgcagtaggtggatttaacacaaacaaccttgagtggactcaagctatcttgcgcgcagcagaagctaaaaaagctccagtacttatccaaacttcaatgggtgcggctaaatacatgggtggttacaaactttgtaaacaacttattgaaactttggttgaatcaatgggtattactgtaccagttgctatccaccttgaccacggtcattacgatgatgcccttgagtgtattgaagtaggttacacttcaattatgtttgatggttcacaccttccagttgaagaaaaccttgaaaaagcacgcgaagttgttgctaaagcacatgctaaaggtatttcagtagaagctgaagttggtactatcggtggtgaagaagatggtattgtcggtaaaggtgaattagcaccaatcgaagacgctaaagctatggttgaaactggtattgacttcttggctgcaggtatcggtaacattcatggaccatacccagcaaactgggaaggacttgaccttgatcacttgaagaaattgactgaagctgttcctggtttcccaatcgtgttacacggtggttcaggtattcctgatgatcaaatccaagaagctatcaaacttggtgttgctaaagttaacgttaacacagaatgtcaattagctttctgtcaagcaactcgtgactacgctgttgaattcaacgctaacgaagctgaatacatgaagaaaaaactctttgacccacgtaaattcttgaaacctggtttcgatgcaattacagaagcagttgaagaacgtattgacgtgtttggttcagcaaacaaagca

SEQ ID NO: 9290 - protein, 293 aa, Streptococcus agalactiae
MAIVSAEKFVQAARDNGYAVGGFNTNNLEWTQAILRAAEAKKAPVLIQTSMGAAKYMGGYKLCKQLIETLVESMGITVPVAIHLDHGHYDDALECIEVGYTSIMFDGSHLPVEENLEKAREVVAKAHAKGISVEAEVGTIGGEEDGIVGKGELAPIEDAKAMVETGIDFLAAGIGNIHGPYPANWEGLDLDHLKKLTEAVPGFPIVLHGGSGIPDDQIQEAIKLGVAKVNVNTECQLAFCQATRDYAVEFNANEAEYMKKKLFDPRKFLKPGFDAITEAVEERIDVFGSANKA

SEQ ID NO: 9291 - DNA, 1662 bp, Streptococcus agalactiae
gtgtcaaagattacgacaagtttattccaagaaatggtacaagctgccagtacacgtctgagtaaacaggcagagtatgtcaactcattaaatgtattcccagttccagatggtgatactggtacgaatatggggatgactatggaaaacggagccaaggaagtttcggacaaaccagcgacgactgttggagaagttggtcaaattctttctaaaggtgtattgatgggagcacgtggaaattcaggtgtaattacatcacaattattccgtggttttggtcaaagtatcaaggataaagaagaattaacgggtcaagatttggcacacgctttccagaatggtgttgaagtagcttataaagccgttatgaaaccagttgaaggaactatcttgacagtatcacgcggtgcagctaccgctgctctaaaaaaagctgaagaaactgatgatgcagttgaagttatgcgcgcaactctcaaaggtgctaagcgtgctcttgctaaaacaccggatatgctacctgttcttaaagaggttggtgttgttgattctggtggtcaaggactcgtctttatttacgaaggtttcctctcagcactgactggggaatatatcgcatcagaagattttaaagcaactcccgcaacaatgactgaaatggttaatgcagagcaccataaagctgtagtaggccacgtagccacagaagatattaaatatggctattgtacagaagtcatggttggtttaaagcaaggaccaacttacgttaaggaatttaactacgaagaatttcaaggttatcttagcaatctaggggattctttactagttgttaatgatgatgaaattgtcaaggttcatgttcatacagaagatccaggtcttgttatgcaagaaggtttgaaatatggatcgcttgtgaaggttaaagttgaaaacatgcgtaaccaacatgatgcccaaatgcaaaaggttgaagttgaagaaactgtcaaagaaactaaagaatatggtattattgctgttgtagctggtgacggtctagctgagatttttaaatcacaaggtgttgattatatcatctctggcggccagactatgaacccatctacagaagatattgtaaaagcgattgaaaaagtaaacgctagaaatgttattattttaccaaacaataagaacatcttcatggctgcacagtcagctgcagatgtcgttgatattccagcagcagtagtagagacacgtacagttccacaaggatttactagcttacttgcttttgatcctgctaagtctcttgaaactaatgtagctgatatgacaaatagcctctcagatgtcattagtggtagtgtgactttagctgttcgtgatacaacgatagatggccttgaaattcatgaaaacgacatccttgggatggttgatggtaaaattctagtatctacaccagatatggaaaaagcacttaaagacacttttgataaaatgattgatgaagatagtgaaatcgtgacaatctatgttggtgaagatggtaagcaagcattagctgagaccttgtcggaatatcttgaggaaacttatgaagatgttgaagttgagatccaccaaggagatcaacctgtatatccatacctcatgagcgttgaa

SEQ ID NO: 9292 - protein, 554 aa, Streptococcus agalactiae
MSKITTSLFQEMVQAASTRLSKQAEYVNSLNVFPVPDGDTGTNMGMTMENGAKEVSDKPATTVGEVGQILSKGVLMGARGNSGVITSQLFRGFGQSIKDKEELTGQDLAHAFQNGVEVAYKAVMKPVEGTILTVSRGAATAALKKAEETDDAVEVMRATLKGAKRALAKTPDMLPVLKEVGVVDSGGQGLVFIYEGFLSALTGEYIASEDFKATPATMTEMVNAEHHKAVVGHVATEDIKYGYCTEVMVGLKQGPTYVKEFNYEEFQGYLSNLGDSLLVVNDDEIVKVHVHTEDPGLVMQEGLKYGSLVKVKVENMRNQHDAQMQKVEVEETVKETKEYGIIAVVAGDGLAEIFKSQGVDYIISGGQTMNPSTEDIVKAIEKVNARNVIILPNNKNIFMAAQSAADVVDIPAAVVETRTVPQGFTSLLAFDPAKSLETNVADMTNSLSDVISGSVTLAVRDTTIDGLEIHENDILGMVDGKILVSTPDMEKALKDTFDKMIDEDSEIVTIYVGEDGKQALAETLSEYLEETYEDVEVEIHQGDQPVYPYLMSVE

SEQ ID NO: 9293 - DNA, 1656 bp, Streptococcus agalactiae
atggcaaaacagaaaaataactggcgccgtgttggagttggtgtccttacacttgcttcagttgcgactcttgctgcatgtggaagtaaatcagcttcccaggattctaatggagcgattaattgggctattccaacagaaatcaatacactagatttatctaaagtcacagacacttactcaaatctagctattggtaactctagtagtaatttccttcgcttagataaagatggaaagacaagaccagatttggctactaaagtagatgtttcaaaagatggcttaacttatacagctacattacgtaaaggcttgaagtggtcagatggcagtaaacttactgcaaaggattttgtttattcatggcaacgtttagttgatcctaaaacagcttcacaatatgcttaccttgctgttgaagggcatgtgcttaatgccgataaaatcaacgaaggacaagagaaagacttgaataagctaggtgttaaggcggaaggcgatgacaaagttgttattactttatctagtccgtctccacaatttatctactaccttgcattcactaacttcatgccacaaaaacaagaagttgttgaaaaatatggaaaagattacgcaactacttcaaaaaatacagtttactcaggaccatatactgttgaaggttggaatggttcgaatggtactttcacgctgaagaaaaacaaaaattattgggacgctaaaaatgtaaaaacaaaagaagttcgcatccagactgttaaaaaaccagataccgccgttcaaatgtataaacgtggtgagttagatgcagctaatatctcaaatacttctgctatttatcaagctaataagaataataaagatgtcacagatgttctagaagcgaccactgcctatatggaatataatactactggttctgtgaaagggcttgataatgttaagattcgtcgcgccttaaacttagcaactaaccgtaaaggagttgttcaagcagccgttgatacaggctcaaaaccggcaattgcttttgcacctactggtttagccaaaacaccagatggaactgatttggcaaaatatgttgccccaggttatgaatataataaaactgaagcagcaaaactctttaaagaaggtttggctgaatcaggcttgactaagctaaaattaacaattacagcagatgctgatgctcctgctgccaaaaactctgttgactatatcaagtctacttgggaagctgctcttccaggacttactgttgaagaaaaatttgtaacctttaaacaacgcttagaagacagtagaaaacaaaactttgacatcgtagtttctctttggggtggggattatccagaaggatcaactttctacggcctctttaagtcagattcacaaaataacgatggaaaatttgctaacaaggactatgatgctgcttataacaaggcaatttctgaagatgcgatgaaaccagcagaatcagcgaaggactataaagaagcagagaaaattttatttgagcaaggtgcttataacccactctacttccgtagtggtaaaggtttacaaaatccaaaattaaaaggtgttattcgtaatactacaggtttgtcaatagactttacacatgcttataaaaataat

SEQ ID NO: 9294 - protein, 552 aa, Streptococcus agalactiae
MAKQKNNWRRVGVGVLTLASVATLAACGSKSASQDSNGAINWAIPTEINTLDLSKVTDTYSNLAIGNSSSNFLRLDKDGKTRPDLATKVDVSKDGLTYTATLRKGLKWSDGSKLTAKDFVYSWQRLVDPKTASQYAYLAVEGHVLNADKINEGQEKDLNKLGVKAEGDDKVVITLSSPSPQFIYYLAFTNFMPQKQEVVEKYGKDYATTSKNTVYSGPYTVEGWNGSNGTFTLKKNKNYWDAKNVKTKEVRIQTVKKPDTAVQMYKRGELDAANISNTSAIYQANKNNKDVTDVLEATTAYMEYNTTGSVKGLDNVKIRRALNLATNRKGVVQAAVDTGSKPAIAFAPTGLAKTPDGTDLAKYVAPGYEYNKTEAAKLFKEGLAESGLTKLKLTITADADAPAAKNSVDYIKSTWEAALPGLTVEEKFVTFKQRLEDSRKQNFDIVVSLWGGDYPEGSTFYGLFKSDSQNNDGKFANKDYDAAYNKAISEDAMKPAESAKDYKEAEKILFEQGAYNPLYFRSGKGLQNPKLKGVIRNTTGLSIDFTHAYKNN

SEQ ID NO: 9295 - DNA, 975 bp, Streptococcus agalactiae; identical to SEQ ID NO: 8471

SEQ ID NO: 9296 - protein, 325 aa, Streptococcus agalactiae
MKHITTVVIWKILRCLSLVFGVSILTFILLKQSPVDPVMASVNYDTSLTPVQYKAIAHHYGLDKPAPVQYFIWLKNFIQGHLGTSLVYRQPVIDIIRSRAGASFILMGLSWVLSGLIGFILGTLSAFHQGKLLDRIVRWFSYLQISVPTFWIGLIFLLIFSVQLGWFPIGISSPIGTLSQDITLADRIKHLILPVFTLSILGIANVTLHTRTKMMSVLSSEYVLFARARGETEWQIFKNHCLRNAIVPAITLHFSYFGELFGGSVLAEQVFSYPGLGSTLTEAGLKSDTPLLLAIVMIGTLFVFAGNLIADILNSIINPQLRRKV

SEQ ID NO: 9297 - DNA, 1146 bp, Streptococcus agalactiae
atgacgaagtacatcaaggctgaccgattcttttatgctgatcatgtaaaggaaaacggttatttagaaataaaagataatcactttggtaaatggatagaaaatatttctggacaagaggagattttagattattcaggttatcaaatagcacctggtttagttgatacacatattcatggttttgctggcgctgatgttatggattgtgattcagaaggaattttgcgaatgagtgctggcttactatctactggagtcacatctttcttgccgacaaccctaacttcagatacaaagcgactagaagaggcgtctaaatcagttgcggcagtagcgggcaaagaacaaggagcaaaaattcaaggcatctattttgagggaccatattttactgaggaatataaaggagctcaaaatccgatttatatgagaaatccaaacttggaagagtttgctcaatggcagaaggctgcaaaaggcttgattacaaaaattgctttggcaccagaacgtgagggagttgaggaatttgtctcagcaatcacaaagcaaggtgttacggtagctttaggtcattctaatgggacatataaagaagctaaaaaggcagtgaaggcgggtgcctcagtttgggtacatgcgtataatggtatgcgtggtttgacacaccgagaaccaggtatggttggtgcggtttataatttacctaatacctatgccgaactcatttgcgatggtcatcacgttgatcctgttgcttgtgacattttaatgacacaaaaaggccataatcatgtggcattaataacagattgtatggcagctggaggtgcccctgatggagattatatgttaggggaattgcccgtggttgtgtctaatggaactgcgcgtttgaaagatggaggtaatttagctggttctattcttaagctcaaagatggattaaaaaatgttgtagaatggggaattgctactccggaagaggcagtgcgtatggcgagttatgttccggcagtgtctgtaggcattgataatgtctgtggacagataaaagaaggttatgcagcggattttattgtattagataaacatctagatttagttgcaacataccttgatggggaaaaacgttggcaatct

SEQ ID NO: 9298 - protein, 382 aa, Streptococcus agalactiae
MTKYIKADRFFYADHVKENGYLEIKDNHFGKWIENISGQEEILDYSGYQIAPGLVDTHIHGFAGADVMDCDSEGILRMSAGLLSTGVTSFLPTTLTSDTKRLEEASKSVAAVAGKEQGAKIQGIYFEGPYFTEEYKGAQNPIYMRNPNLEEFAQWQKAAKGLITKIALAPEREGVEEFVSAITKQGVTVALGHSNGTYKEAKKAVKAGASVWVHAYNGMRGLTHREPGMVGAVYNLPNTYAELICDGHHVDPVACDILMTQKGHNHVALITDCMAAGGAPDGDYMLGELPVVVSNGTARLKDGGNLAGSILKLKDGLKNVVEWGIATPEEAVRMASYVPAVSVGIDNVCGQIKEGYAADFIVLDKHLDLVATYLDGEKRWQS

SEQ ID NO: 9299 - DNA, 753 bp, Streptococcus agalactiae
atgaatagattagaaaatattattagtttagtatcccagtaccaaaaaatagatgttaatacactctcggagttgttgcaagtttctaaagtaacgatacgtaaagatttagataaactagaaggcaaagggcttttgcatagagagcacggttatgcagttttaaacagtggggatgaccttaatgttaggttatcttttaaccataaaactaaaaaagaaattgctgccttagctgcaaatatggtgtctgacaatgacactatcttaatagaatcaggctctacttgtgctcttttagcagaaaatatctgtcagacaaagcgaaatgtcactattttgaccaactcttgctttattgctaactatttacgagagtatgattcatgccaaattgtcttacttggtggtgagtatcaatcaagttcacaggttacggtaggtcctctcttgaaaaagatgatttcactttttcatgtctcgttagcttttgttgggactgatggttttgatccaaaactaggatttatgggtagagatttaatgcgttctgaagttgcacaagagatggcgaatgctgccgatgaagtcattattttaacagattctagtaagtttaatcagactgcattggtggaacagcttccgttgtcaactgtatcacaagttattacagataaacatccaaattcggaaattgctaatttgttccaagaagcagagattaccattcaatctttattacaagtacca

SEQ ID NO: 9300 - protein, 251 aa, Streptococcus agalactiae
MNRLENIISLVSQYQKIDVNTLSELLQVSKVTIRKDLDKLEGKGLLHREHGYAVLNSGDDLNVRLSFNHKTKKEIAALAANMVSDNDTILIESGSTCALLAENICQTKRNVTILTNSCFIANYLREYDSCQIVLLGGEYQSSSQVTVGPLLKKMISLFHVSLAFVGTDGFDPKLGFMGRDLMRSEVAQEMANAADEVIILTDSSKFNQTALVEQLPLSTVSQVITDKHPNSEIANLFQEAEITIQSLLQVP

SEQ ID NO: 9301 - DNA, 810 bp, Streptococcus agalactiae
atggcggatatttcaattatctcaatgattttggtcgttatcgttgccttctttgctggtcttgaaggtatcctcgaccaattccaaatccatcaacctcttgttgcttgtactttaatcggtcttgtaactggtcacctcgaagcgggtattattcttggtggtagtctccaaatgattgctcttgcttgggcaaatatcggagctgccgtagcaccagacgctgcacttgcctctgttgctgctgctattattttggttaaaagtggtgacttcactcaaaaaggtatcaactttgccttctctactgctgtacctctagctattgctggacttttccttacaatgattgttcgtacaatctcaactgcacttgttcacgctggtgacaaagctgcttctgaaggaaacttcgcagcaattgaacgttttcactttatcgccctccttctccaaggattacgtattgcattcccagctgcgcttcttttagctattccatcttcttcagtacaaagtattcttgaagcaatgcctgattggttaaatggtggtatgcaagttggtggtgccatggttgttgccgttggttacgctatggttatcaatatgatggctactcgcgaagtttggcctttctttgctcttggatttgctctagcagctttgaaccagttaactcttattgcaatgggtactattggtgttgctatcgccctcatctacatcagtttatcaaaaatgggtggaagcaaaggtacttctaacgcaggttctaacgatcctatcggcgatatcttagaggactac

SEQ ID NO: 9302 - protein, 270 aa, Streptococcus agalactiae
MADISIISMILVVIVAFFAGLEGILDQFQIHQPLVACTLIGLVTGHLEAGIILGGSLQMIALAWANIGAAVAPDAALASVAAAIILVKSGDFTQKGINFAFSTAVPLAIAGLFLTMIVRTISTALVHAGDKAASEGNFAAIERFHFIALLLQGLRIAFPAALLLAIPSSSVQSILEAMPDWLNGGMQVGGAMVVAVGYAMVINMMATREVWPFFALGFALAALNQLTLIAMGTIGVAIALIYISLSKMGGSKGTSNAGSNDPIGDILEDY

SEQ ID NO: 9303 - DNA, 306 bp, Streptococcus agalactiae
atgcaagagtactttggtattggtcttgatagtagcagccgctgttaccactatcatactaaattggatattgtcgctttaaaatgtgctgtttgtcaaaaatattatgcttgttataaatgtcatgatgcactcgaggagcattgttttgcagcaacaaaatctgatgaaacgtttcctgtcttatgcggttcttgtcgtcagatgttgacattaaaagagtataaaactggtttttgtccttattgtcgtatgctttttaatccaaattgtcaacgccatgattctatttatttttcgaaggag

SEQ ID NO: 9304 - protein, 102 aa, Streptococcus agalactiae
MQEYFGIGLDSSSRCYHYHTKLDIVALKCAVCQKYYACYKCHDALEEHCFAATKSDETFPVLCGSCRQMLTLKEYKTGFCPYCRMLFNPNCQRHDSIYFSKE

SEQ ID NO: 9305 - DNA, 1347 bp, Streptococcus agalactiae
atgacacatattacatttgactattcaaaagtcttgggtcaatttgtaggcgaacacgagttagactacctacaaccacaagtaagtgcagcagatgctttccttcgtcaagggactggtcctggctcagattttctcggatggatggacctcccagaaaactatgacaaagaagaattttctcgcattcaaaaagccgctgaaaagattaaatcagatagcgaagtactcgtggttattggtattggtggttcgtaccttggcgcaaaagcagcaattgactttttgaataatcattttgctaatttgcaaaccgcagaagaacgtaaagcgcctcagattctttatgctggaaattctatttcatctacttaccttgccgatttagttgaatacgtccaagataaagaattctcagtaaatgtcatttcaaaatcaggtacaacaactgaaccagcgattgctttccgtgtatttaaagaacttctagttaaaaagtacggtcaagaagaagctaataaacgtatctacgctacaactgataaagttaaaggtgccgtaaaagttgaagcagatgctaacaattgggaaacatttgtagttcctgataatgttggtggtcgtttctcagtactgacagccgtaggtcttcttccaattgctgcttcaggagcagatattactgctcttatggaaggcgcaaatgctgctcgtaaagatttatcttcagataaaatctctgaaaacattgcttatcagtacgctgcagttcgtaatgttctttatcgcaaaggttatatcacagagattttagctaactacgaaccatcattacaatactttggtgaatggtggaaacaattagcaggtgaatcagaaggtaaagatcaaaaaggtatctatcctacatcagcaaacttctcaactgatcttcactcacttggtcaatttattcaagaaggttaccgtaacctctttgagacagttgttcgcgttgagaaacctcgtaaaaatgtgactattcctgaattaaccgaagatttagatggtcttggttatcttcaaggaaaagatgtagattttgttaataaaaaagcaacagatggtgtactccttgctcatacagatggtggggttccaaatatgtttgtaacgcttcctacacaagacgcttacacccttggttacactatttacttctttgagttagcaattggcctttcaggttatcttaactcagtaaatccatttgatcaaccaggggtagaagcatataaacgtaatatgtttgctcttctaggtaaacctggattcgaagagcttagcgctgaattgaatgcacgtctt

SEQ ID NO: 9306 - protein, 449 aa, Streptococcus agalactiae
MTHITFDYSKVLGQFVGEHELDYLQPQVSAADAFLRQGTGPGSDFLGWMDLPENYDKEEFSRIQKAAEKIKSDSEVLVVIGIGGSYLGAKAAIDFLNNHFANLQTAEERKAPQILYAGNSISSTYLADLVEYVQDKEFSVNVISKSGTTTEPAIAFRVFKELLVKKYGQEEANKRIYATTDKVKGAVKVEADANNWETFVVPDNVGGRFSVLTAVGLLPIAASGADITALMEGANAARKDLSSDKISENIAYQYAAVRNVLYRKGYITEILANYEPSLQYFGEWWKQLAGESEGKDQKGIYPTSANFSTDLHSLGQFIQEGYRNLFETVVRVEKPRKNVTIPELTEDLDGLGYLQGKDVDFVNKKATDGVLLAHTDGGVPNMFVTLPTQDAYTLGYTIYFFELAIGLSGYLNSVNPFDQPGVEAYKRNMFALLGKPGFEELSAELNARL

SEQ ID NO: 9307 - DNA, 1080 bp, Streptococcus agalactiae
gtgaatagagaggttactatgtcaatagaatcagattttttccggaaaaaacgttttattttttcatcgcttgaggagtttggatttatcaaatctgaccaagagtatatctattgtcaaacatttatggataatgactttaaagctattatcacgatttcattggatggaaagatagctggtaaggttattgattcggcacttgaagaagaatatttaccgcttcgagcagcaaattataatggttcgtttgttggcgaagtacgatcggcttatatggctatattaggtgatatttcagattcttgttgtaaggacttattatttaccaaagatcaaagtaatcgtttagcggagaagatagctaaaacttttgaagattcagttgattatccatttgcgaagcacccacaatatgcttcctatcgtgtgtcaggtaaatggtatgctctgctttttccattgaagatggggaaactagaaaatgttccagctcaactgtcagaagatgaggttgaagttttgaatattaaagtcaatcctcaagatatggaaatacttttacaaaaagaaggtatttatccttcttatcatatgtctaaaaagacttgggtatctatcgttttagacaatactttgtctgatatagaaatttttaaattggtatcagatagtcgtaagcttgtttctcacaataaaaaatcaaattctgagccagagttttggattattcctgctaatcctaaattttacgatattgataaggagtttgcagagcatcaattgattgattggactcaaaaaggaaagattgcggtgggagattatgtgtttatttatattacagcacctattcgtgcttttcgctatgtctgtcaagtgatagaacgtgaccttaaaacaagtacttacttaggagcaagagatgtcaaagcttatatgcgactcaaactgataaggcaatttgaagattctacctatcctgtagcatttttagcagaacacggcgttaagactgtgagaggaccacggcgaatgaccaaggaattgcgacaagtcatggcaaaaacaattctagag

SEQ ID NO: 9308 - protein, 360 aa, Streptococcus agalactiae
MNREVTMSIESDFFRKKRFIFSSLEEFGFIKSDQEYIYCQTFMDNDFKAIITISLDGKIAGKVIDSALEEEYLPLRAANYNGSFVGEVRSAYMAILGDISDSCCKDLLFTKDQSNRLAEKIAKTFEDSVDYPFAKHPQYASYRVSGKWYALLFPLKMGKLENVPAQLSEDEVEVLNIKVNPQDMEILLQKEGIYPSYHMSKKTWVSIVLDNTLSDIEIFKLVSDSRKLVSHNKKSNSEPEFWIIPANPKFYDIDKEFAEHQLIDWTQKGKIAVGDYVFIYITAPIRAFRYVCQVIERDLKTSTYLGARDVKAYMRLKLIRQFEDSTYPVAFLAEHGVKTVRGPRRMTKELRQVMAKTILE

SEQ ID NO: 9309 - DNA, 990 bp, Streptococcus agalactiae
atgaagaaaagctttattcatcagcaacaggagatttcttttgtcaaaaatacttttacacaatatttgattgataagttagaaatcgtcgaagtgcaaggacctattcttagtcaggtcggggatggtatgcaagataatttatctggtattgaacatcctgtatcggtgaaagtccttaatatacctgaagctgaatttgaagtcgttcactcattggctaaatggaaacgccatactttggcaagatttgggtttaatgagggagaaggtctttttgttcatatgaaagctcttcgtccagatgaagattctcttgatccaacacactcagtttacgtagatcagtgggactgggagaaggtcattcctgatggtagacgtaatttggactatctaaaagaaactgtggaaaaaatctacaaagctatccgcctaacagagcttgccgtggaagctcgttttgatattgaatccattttaccaaagcgtattacctttattcatacagaagaattggtagaaaaatacccagacttaagccctaaagagcgtgaaaatgccatcgctaaggagtatggcgcagtctttttgattggtattggtggagagttagcagatggtaaaccacatgatggtcgtgcaccggactatgatgactggacaacaccatcagaaaatggttttaaaggtctcaatggtgatattttagtgtggaacgaacagcttggaactgcctttgaactatcatcaatgggaattcgagttgatgaagatgctcttaaacgtcaagttgttctcaccggtgatgaagatcgtttagagtttgagtggcataagacgctattacgtggtttcttccctctgactattggtgggggaattggtcaatcacgattagctatgttcttgcttcgtaaaaaacatattggagaagtacagtcaagtgtctggccaaaagaagtcagagatacctttgaaaatatatta

SEQ ID NO: 9310 - protein, 330 aa, Streptococcus agalactiae
MKKSFIHQQQEISFVKNTFTQYLIDKLEIVEVQGPILSQVGDGMQDNLSGIEHPVSVKVLNIPEAEFEVVHSLAKWKRHTLARFGFNEGEGLFVHMKALRPDEDSLDPTHSVYVDQWDWEKVIPDGRRNLDYLKETVEKIYKAIRLTELAVEARFDIESILPKRITFIHTEELVEKYPDLSPKERENAIAKEYGAVFLIGIGGELADGKPHDGRAPDYDDWTTPSENGFKGLNGDILVWNEQLGTAFELSSMGIRVDEDALKRQVVLTGDEDRLEFEWHKTLLRGFFPLTIGGGIGQSRLAMFLLRKKHIGEVQSSVWPKEVRDTFENIL

SEQ ID NO: 9311 - DNA, 732 bp, Streptococcus agalactiae
atggttgagccaattatttcaatacaaggacttcataaaagttttgggaaaaatgaggttttaaaaggcattgacttggatattcatcaaggagaagtagtggttattattggcccttctggctctggtaagtcaacatttttaagaacaatgaatctcttggaagtaccaacaaagggaacagtgacttttgaagggattgatataacagacaaaaagaatgatatttttaaaatgcgcgaaaaaatgggcatggtttttcaacagttcaatctatttcccaatatgactgtactagaaaatattactttatcacctattaagacaaaggggctttctaatcttgatgctcagacaaaagcatatgagctacttgaaaaagttggactcaaagagaaggctaatacttatccagctagcttatctggaggacaacaacaacgaattgctattgcaagaggtcttgcaatgaatcctgatgtccttctttttgatgaacctacttcagctcttgatcctgaaatggtaggtgaagtcttgactgttatgcaagatttagctaaatctggtatgacgatggttattgtcactcatgaaatgggttttgcacgtgaagtagcggatcgtgtcatttttatggatgcaggaattattgttgagcaaggggcccctaaggaagtatttgagcagacaaaagaaatccgcacaagagatttcttaagtaaagtatta

SEQ ID NO: 9312 - protein, 244 aa, Streptococcus agalactiae
MVEPIISIQGLHKSFGKNEVLKGIDLDIHQGEVVVIIGPSGSGKSTFLRTMNLLEVPTKGTVTFEGIDITDKKNDIFKMREKMGMVFQQFNLFPNMTVLENITLSPIKTKGLSNLDAQTKAYELLEKVGLKEKANTYPASLSGGQQQRIAIARGLAMNPDVLLFDEPTSALDPEMVGEVLTVMQDLAKSGMTMVIVTHEMGFAREVADRVIFMDAGIIVEQGAPKEVFEQTKEIRTRDFLSKVL

SEQ ID NO: 9313 - DNA, 273 bp, Streptococcus agalactiae
atggctaacaaacaagatttaattgcaaaagtagcagaagctacagaattaactaaaaaagattcagcagcagcagtagatgcagtttttgcagctgtagcagattaccttgctgaaggtgaaaaagtacaattaatcggttttggtaactttgaagttcgtgaacgtgcagctcgtaaaggtcgtaacccacaaactggtgcagaaatcgaaattgcagcatcaaaagttccagcatttaaagctggtaaagctcttaaagacgctgttaaa

SEQ ID NO: 9314 - protein, 91 aa, Streptococcus agalactiae
MANKQDLIAKVAEATELTKKDSAAAVDAVFAAVADYLAEGEKVQLIGFGNFEVRERAARKGRNPQTGAEIEIAASKVPAFKAGKALKDAVK

SEQ ID NO: 9315 - DNA, 933 bp, Streptococcus agalactiae
atgattatttttcaacaaattcttgataaaatcaaagagtacgacaccatcattatccatcgacatatgagaccagaccctgatgctcttggtagccaaatcggcttaagggatatcatcaggcataattttccaaagaaaaaagtacttgctactggttttgacgaacccactctcgcttggattgctaaaatggatcaagtgaccgaccaagactatcaaggcgctcttgttgttgttacagatacagcaaataccccacgcattgatgatgaacgttataaaaaaggtgactttttaattaaaattgaccatcatccaaacgatgaagtctatggagatctctcttatgtagatactaacgcctctagtgcaagtgaaattgtgacagactttgctctttcttgtgatttgttgttatcaacaagtgcagcaagagttctatataatggtattgtaggagatacaggacgctttttatatcctgctaccacaagtaaaacactgaagattgctagcaaacttcgtgaatttgactttgatttttctgcaatggcacgtcaaatggattcctttcctttcaaaattgcaaaattacaaggctttatttttgagcaacttaaaattgacaagaacggcgctgcatgcgttactttaacacaagaagacctaaaacgcttcgatgtaacagatgcagagactgctgcaatcgttggtgtacctggaaaaattgatattgtagaaagttgggcaattttcgttgaacaaagcgatgggcattatcgtgtgcgcctacgtagtaagtcacacatcattaatgaaatagctaaacgtcataatggtggcggacatcctttagccagcggagctaattcttatagtttggaagagaatcaagctatttaccaagaaatccaggaaatactttcttta

SEQ ID NO: 9316 - protein, 311 aa, Streptococcus agalactiae
MIIFQQILDKIKEYDTIIIHRHMRPDPDALGSQIGLRDIIRHNFPKKKVLATGFDEPTLAWIAKMDQVTDQDYQGALVVVTDTANTPRIDDERYKKGDFLIKIDHHPNDEVYGDLSYVDTNASSASEIVTDFALSCDLLLSTSAARVLYNGIVGDTGRFLYPATTSKTLKIASKLREFDFDFSAMARQMDSFPFKIAKLQGFIFEQLKIDKNGAACVTLTQEDLKRFDVTDAETAAIVGVPGKIDIVESWAIFVEQSDGHYRVRLRSKSHIINEIAKRHNGGGHPLASGANSYSLEENQAIYQEIQEILSL

SEQ ID NO: 9317 - DNA, 1194 bp, Streptococcus agalactiae; identical to SEQ ID NO: 8577

SEQ ID NO: 9318 - protein, 398 aa, Streptococcus agalactiae
MIKRFDNYAQYVLVLGFSLLIGGVVGAITAVFGRVLLFLTAFRSDYIAYLLPFLSIVGLFIVFVYQKFGGKSVKGMGLVFEVGHGNEETIPKRLVPLVILTTWLTHLFGGSAGREGVAVQIGATVSHYFQKYCRLQNASQLFLVMGMAAGFAGLFQTPLAATFFAIEVLVVGRLMVSYVLPSLIAALTANFVSHSLGLEKFSHSIATSMALTPDIILKLLVLGLCFGLCGNLFAYLLAKAKLIASSRLLNPYKRIFTLGLLATFLLFIFHFGRYSGLGTNLIEASFTNKNLYDYDWLLKLCLTVITLAAGYQGGEVTPLFAIGASLGVIIAPILGLPVILVAALGYTSVFGSATNTLLGPILIGGEVFGFANTPYFVIVCLVAYSISHAHTIYGAQSR

SEQ ID NO: 9319 - DNA, 1077 bp, Streptococcus agalactiae
atgtggatagaggagctagccaacgggaaatttaaatatatcgaaagatatactgaccctctaacaaataagtacaaaaaagtatctgtgacactagataaaaattctagtcaagctcagaaaaaagctggtttaatattgcaggaaaagattgaagataggctcgctatcagaaatcactcagaaatgacttacggagaacttaaaaaggaatatctaaagcaatggataccgaccgtcaaagactccacaaaacgtggttatttagtatctgacagtcatatagcaaccgtgttaccagatgatacaattatcaacaagttgactaaacgtgatattagactaatcattgataaactattaaaacacaattcgtatcatgttacgcataaatgtagaaagagattgcatgccatattttcttatgcgatacaaatggactatatgacaagtaatccgacggagaacgtcttagttcccaaaccaaaggatgattacaagcctgaaaaggtgctttatttaacatctaacgaggtttacgacctgtgcaatagaatgatagacaatgacgaacaaacgctcgcagacatcgttttattcatgtttttgacgggtgtacggtatggagaattatcttgtctgacttacgacaaaatagattttgaaaataaagaaattctgattaatgcaacttacgattttaacacacgagaaatcactacgaccaagaccaaaaaatcaacacgcaaaatatctgtatcagataatattttagatatcgtcaatagacagaaaaagacaagttcattcgtctttccaaattcgaacggtgtaccgattttaaacgcgtacatcaataagcgattgaaaatttatggagattatcacacgcacttatttagacactcgcatatatcatttttagcagaaaaagggataccgctaaatgcgataatggatagagttggtcacagcgatccaaaaacaacattatctatttacagtcacacaactgtaaatatgaaagaaattataaataaacaaactgccccttttgtgccccttttaaaatcggaa

SEQ ID NO: 9320 - protein, 359 aa, Streptococcus agalactiae
MWIEELANGKFKYIERYTDPLTNKYKKVSVTLDKNSSQAQKKAGLILQEKIEDRLAIRNHSEMTYGELKKEYLKQWIPTVKDSTKRGYLVSDSHIATVLPDDTIINKLTKRDIRLIIDKLLKHNSYHVTHKCRKRLHAIFSYAIQMDYMTSNPTENVLVPKPKDDYKPEKVLYLTSNEVYDLCNRMIDNDEQTLADIVLFMFLTGVRYGELSCLTYDKIDFENKEILINATYDFNTREITTTKTKKSTRKISVSDNILDIVNRQKKTSSFVFPNSNGVPILNAYINKRLKIYGDYHTHLFRHSHISFLAEKGIPLNAIMDRVGHSDPKTTLSIYSHTTVNMKEIINKQTAPFVPLLKSE

SEQ ID NO: 9321 - DNA, 453 bp, Streptococcus agalactiae
atgactgaacttgacaataaaatcctacaaaaagcaagcggtgaaaatcgtcttgatcctgatcaacaacgttactaccttggtacttataaagaaagagttgtgctccacttaagtttaaaagaggcacaagaagaaaagtttcaacttgctataacatctgctcttaataatctgatacttgaatatcctaatcttagtttaaaattatcaccaaatctccctactgatgttcaaatgttctacatgaagttagctaaccgtctatcactagctgctacgattgttaatgaagcaaatgccaattctccatttggtattattatacatagtgataaggctgaaaacgttgaatggaacgattttgagacacaattccctgatttattcaattcaccaaaaaaagaggagtctcctaaaaaaagtctatggcaacatttctttagtcaaaaa

SEQ ID NO: 9322 - protein, 151 aa, Streptococcus agalactiae
MTELDNKILQKASGENRLDPDQQRYYLGTYKERVVLHLSLKEAQEEKFQLAITSALNNLILEYPNLSLKLSPNLPTDVQMFYMKLANRLSLAATIVNEANANSPFGIIIHSDKAENVEWNDFETQFPDLFNSPKKEESPKKSLWQHFFSQK

SEQ ID NO: 9323 - DNA, 783 bp, Streptococcus agalactiae
atgaaaagattacataaactgtttataaccgtaattgctacattaggtatgttgggggtaatgacctttggtcttccaacgcagccgcaaaacgtaacgccgatagtacatgctgatgtcaattcatctgttgatacgagccaggaatttcaaaataatttaaaaaatgctattggtaacctaccatttcaatatgttaatggtatttatgaattaaataataatcagacaaatttaaatgctgatgtcaatgttaaagcgtatgttcaaaatacaattgacaatcaacaaagactatcaactgctaatgcaatgcttgatagaaccattcgtcaatatcaaaatcgcagagataccactcttcccgatgcaaattggaaaccattaggttggcatcaagtagctactaatgaccattatggacatgcagtcgacaaggggcatttaattgcctatgctttagctggaaatttcaaaggttgggatgcttccgtgtcaaatcctcaaaatgttgtcacacaaacagctcattccaaccaatcaaatcaaaaaatcaatcgtggacaaaattattatgaaagcttagttcgtaaggcggttgaccaaaacaaacgtgttcgttaccgtgtaactccattgtaccgtaatgatactgatttagttccatttgcaatgcacctagaagctaaatcacaagatggcacattagaatttaatgttgctattccaaacacacaagcatcatacactatggattatgcaacaggagaaataacactaaat

SEQ ID NO: 9324 - protein, 261 aa, Streptococcus agalactiae
MKRLHKLFITVIATLGMLGVMTFGLPTQPQNVTPIVHADVNSSVDTSQEFQNNLKNAIGNLPFQYVNGIYELNNNQTNLNADVNVKAYVQNTIDNQQRLSTANAMLDRTIRQYQNRRDTTLPDANWKPLGWHQVATNDHYGHAVDKGHLIAYALAGNFKGWDASVSNPQNVVTQTAHSNQSNQKINRGQNYYESLVRKAVDQNKRVRYRVTPLYRNDTDLVPFAMHLEAKSQDGTLEFNVAIPNTQASYTMDYATGEITLN

SEQ ID NO: 9325 - DNA, 519 bp, Streptococcus agalactiae
ttgatgtcaattttaattgcgatgattttctgtttcttgatcgtatctccaatcacaacagttgggattgctttggcaattagtttgtccggaattggttctggtgctgctaatttaggtatctgtgctgctagttttgggctttgtatggctgggtggtcagtcaattctaaggggacagccttagcgcatgttttagggtctcctaagatttcgatggctaatgtattagcaaaaccgaagattatgctacctatgatatcttcagcagcaatactaggaattctcggagctctctttaatattcaaggaacaccagctagtgcaggttttggtatcagtggtttgattggaccgattaatgctcttaatttagcaaaaggtggatggtcagttatgaatatgttattgataattataatatttgttgctgcaccaattatattgaattttatttttaattacctctttataaaagtacttaaaattattgatccaatggactataaattagatatt

SEQ ID NO: 9326 - protein, 173 aa, Streptococcus agalactiae
MMSILIAMIFCFLIVSPITTVGIALAISLSGIGSGAANLGICAASFGLCMAGWSVNSKGTALAHVLGSPKISMANVLAKPKIMLPMISSAAILGILGALFNIQGTPASAGFGISGLIGPINALNLAKGGWSVMNMLLIIIIFVAAPIILNFIFNYLFIKVLKIIDPMDYKLDI

SEQ ID NO: 9327 - DNA, 1266 bp, Streptococcus agalactiae
atgaaaattgataaaaggcatcttctgaattattccatcctcattccctatttgatattgtctattctaggcttaattgtaatttattcgacaactagtgcaactctaattcagcttggagctaacccttttcgttcagtaatcaaccagggtgtcttttgggcagtcagtttggttgcaattatctttatctataaactgaaactaaattttttgaaaaattctaaagtgttgactatggcagtattggtagaagtatttttactactaatagcgcgcttttttacacaagaagttaatggagcacatggttggattgttattggtcctattagttttcaacctgctgaatatttaaaagttatcattgtatggtatttagcgtttacttttgctcgaaggcaaaaaaagatagaaatatatgattatcaagctttgacaaaagggagatggcttccgagatcactaagcgacctaaaagattggcgattttattctttatttatgattggtttggtaattgcacaacctgatttaggaaatggttcgataattgttctaacggtcattattatgtactgtattagtggtattggttatcgatggttttcagctttacttggtctaatcgtcgtggggtcaactttatttatcggaactattgcagttgttggagttgagacaatggctaaagtccctgtctttggttatgtagctaagcgatttaatgctttttttgacccatttaaagatttaacagattcaggacaccagttggctaattcgtattatgcaatgagcaacggtggctggtttggtcgaggacttgggaattctattgaaaaattagggtacttaccagaagcaacaacagactttgtcttttcaattgttattgaggaattaggagttattggtgcagggtttattttagctttggttttcttcttaattttacgtattatgcacgtaggtataaaggctaaagatcctttcaactcaatgatcgctcttggtattggagcaatgctattgatgcaagtttttgttaacattggtggtatttctgggttaatcccctcaactggagtgacatttcctttcttatcccaaggagggaacagcctcttggtactttctgtagcgatcggattcgtgcttaatattgatgctaacgagaaaaaggaactcataatgaaagaagcagaagagcaatataagccacaagaaaaaaatgaaaaaataatcaaccttgatgcctttaaa

SEQ ID NO: 9328 - protein, 422 aa, Streptococcus agalactiae
MKIDKRHLLNYSILIPYLILSILGLIVIYSTTSATLIQLGANPFRSVINQGVFWAVSLVAIIFIYKLKLNFLKNSKVLTMAVLVEVFLLLIARFFTQEVNGAHGWIVIGPISFQPAEYLKVIIVWYLAFTFARRQKKIEIYDYQALTKGRWLPRSLSDLKDWRFYSLFMIGLVIAQPDLGNGSIIVLTVIIMYCISGIGYRWFSALLGLIVVGSTLFIGTIAVVGVETMAKVPVFGYVAKRFNAFFDPFKDLTDSGHQLANSYYAMSNGGWFGRGLGNSIEKLGYLPEATTDFVFSIVIEELGVIGAGFILALVFFLILRIMHVGIKAKDPFNSMIALGIGAMLLMQVFVNIGGISGLIPSTGVTFPFLSQGGNSLLVLSVAIGFVLNIDANEKKELIMKEAEEQYKPQEKNEKIINLDAFK

SEQ ID NO: 9329 - DNA, 1536 bp, Streptococcus agalactiae
atgaataaatcattcaataccaaattaggtttggtaactgtagcggtattatcaggtattgtattaacgtctcaattacctgtgaacgctaaagctgagacaccagtaatggcagcaagtgcacaacaaggtttccgttttgtagcaaccgttgtagatagtcagacgcatgtcttgccgggaaaattggtaactttgtcagaggtgacaagtggtcagcctaaaattattgcaagtgtgaaaacgaatgatgccggacaagctatttttaataatctccctataaaacgtaaccttagtgtgtctgttgatggacaagtaaaaggatatactattcgaactgacgtagcaggttctagtaaagcagctagttttacagcaacaggagtagggacaaatgagccaacgtattcaaaaaaaaccatagacatcacagtgagagaccagaatgctgaacctgtttcaggcaggacagttaccttaaaaacacaagctggtcgtgagattgctagcttggtttctggtgacaatggattaactcgctttactgatcgtttactagatggaacattctaccaatattttgttgatgggaaaaaaattggtgatattgtacctggagaatcaagaagtgcatatgttaatgttgcacctaaaaaagattattttacctttacagtcactgctttagataaagatggacttgttgttaagggaaaagaagtaacgttgactgatattactgatggtaaagcagtagcgcttgcttctttaaaaacgaatgataatggacaagctatctttaccaacctaccattatcaagaaatatcagtgtttcaattgatggaaaatcaaagggctatactcttcgaactgatgtagcaggctctcataaagcggctgcattctatgtagatggtaaaggtaccaaagcacctcaatttagtgcagaagcagcggttgtaactgtttacgatgctaatggaaatactatagcaaaccaagaagtgacattaactaattcaaatgggacaattgttgcaaaaggtttgactgaaaaagatggcaaagcaaggttcgccaataaattaatggcaggaacgttatacaatatttttgtaaatggtattgagatgcctaaaactgcccttgttggtagtgatgtcagtgtttttctaacagataaacaaattaagaaagaaaaacctgttactcctgataaattggataaagaaatgaaccaagagaaggaaaaggagctcttagatactccaaaaccagtaccacctacttcgaaaccaacagcaccaattaaaaataaaaaggacgattcccctaagaagttcacgaaaagtcaatcttctagtttgaagtcaagtgttaaggctataggtgctaagccaaaagctatgacagccttagctaaaaaattgcctaaaactggtgatcaagccattagtattttaactttggttggttttattgtaacagggttagcgattatgttaggcttccttaaaaaatcacgatcaaaa

SEQ ID NO: 9330 - protein, 512 aa, Streptococcus agalactiae
MNKSFNTKLGLVTVAVLSGIVLTSQLPVNAKAETPVMAASAQQGFRFVATVVDSQTHVLPGKLVTLSEVTSGQPKIIASVKTNDAGQAIFNNLPIKRNLSVSVDGQVKGYTIRTDVAGSSKAASFTATGVGTNEPTYSKKTIDITVRDQNAEPVSGRTVTLKTQAGREIASLVSGDNGLTRFTDRLLDGTFYQYFVDGKKIGDIVPGESRSAYVNVAPKKDYFTFTVTALDKDGLVVKGKEVTLTDITDGKAVALASLKTNDNGQAIFTNLPLSRNISVSIDGKSKGYTLRTDVAGSHKAAAFYVDGKGTKAPQFSAEAAVVTVYDANGNTIANQEVTLTNSNGTIVAKGLTEKDGKARFANKLMAGTLYNIFVNGIEMPKTALVGSDVSVFLTDKQIKKEKPVTPDKLDKEMNQEKEKELLDTPKPVPPTSKPTAPIKNKKDDSPKKFTKSQSSSLKSSVKAIGAKPKAMTALAKKLPKTGDQAISILTLVGFIVTGLAIMLGFLKKSRSK

SEQ ID NO: 9331 - DNA, 1542 bp, Streptococcus agalactiae
atgacattacaagacgaaatcaaaaaacgccgtacttttgccatcatctctcacccggatgctggtaagacgactattactgagcaattattatattttggtggtgaaattagagaagcagggacagtaaaagggaaaaaatcaggtacttttgcaaagtccgactggatggatattgaaaagcaacggggtatctctgttacttcatctgttatgcaatttgattacgcgggtaaacgtgttaatattttggatacacctggacatgaggatttctcggaagatacataccggaccttaatggctgtggatgcagctgtcatggttgtagattcggctaaaggtattgaggctcaaactaaaaaactttttgaagttgttaagcatcgtaatattccggtttttacgtttattaataaattggaccgtgatggacgtgagccattggatttgcttgaagagttagaagaagtactaggtattgcttcttatccaatgaattggccgattggtatggggaaatcatttgaagggctttatgatttacataataaacgtttagaactctataagggagacgagcgttttgcaagtattgaagacggtgatcagctgtttgccaataatccattttatgaacaagtcaaagaagatattgaacttcttcaagaagcaggtaatgacttttcagaacaagctattcttgatggtgacctaactccagtattctttggctctgcccttacgaactttggagttcagacttttcttgatactttcttggagtttgctccagaacctcatggtcacaagactacagaaggtaatgttattgaccccttggctaaagatttttcaggttttgtctttaaaattcaagctaacatggacccacgtcatcgcgaccgtattgcttttgttcgtattgtttctggtgaatttgagcgcggtatgggagttaatttgacacgtactggtaaaggtgctaagctctccaatgttactcaatttatggcagaatcacgtgaaaatgtgacgaatgctgttgctggggatattatcggggtttatgatacaggaacttatcaagttggggataccttaacagttgggaaaaataaatttgaatttgaaccattaccaacttttaccccagaattatttatgaaagtatcagcaaaaaatgttatgaagcagaaatcattccacaaaggtattgagcaattagtacaagaaggagcaatccagctttataagaattatcagacaggcgaatacatgctgggtgctgtgggtcaacttcagtttgaagtttttaaacatcgtatggaaggtgaatacaatgctgaagttgttatgacaccaatgggtaaaaagactgtacgttggattaactcagacgatttagacgaacgcatgtcttcaagccgaaatattttagcaaaagatcgttttgaccaaccagttttcctatttgaaaatgattttgcacttcgctggtttgctgataagtatcctgatgtgaagcttgaagaaaaaatg

SEQ ID NO: 9332 - protein, 514 aa, Streptococcus agalactiae
MTLQDEIKKRRTFAIISHPDAGKTTITEQLLYFGGEIREAGTVKGKKSGTFAKSDWMDIEKQRGISVTSSVMQFDYAGKRVNILDTPGHEDFSEDTYRTLMAVDAAVMVVDSAKGIEAQTKKLFEVVKHRNIPVFTFINKLDRDGREPLDLLEELEEVLGIASYPMNWPIGMGKSFEGLYDLHNKRLELYKGDERFASIEDGDQLFANNPFYEQVKEDIELLQEAGNDFSEQAILDGDLTPVFFGSALTNFGVQTFLDTFLEFAPEPHGHKTTEGNVIDPLAKDFSGFVFKIQANMDPRHRDRIAFVRIVSGEFERGMGVNLTRTGKGAKLSNVTQFMAESRENVTNAVAGDIIGVYDTGTYQVGDTLTVGKNKFEFEPLPTFTPELFMKVSAKNVMKQKSFHKGIEQLVQEGAIQLYKNYQTGEYMLGAVGQLQFEVFKHRMEGEYNAEVVMTPMGKKTVRWINSDDLDERMSSSRNILAKDRFDQPVFLFENDFALRWFADKYPDVKLEEKM

SEQ ID NO: 9333 - DNA, 732 bp, Streptococcus agalactiae
atgataatagaattaaagagtgttggaaaaatttttccaaaatcacagtttagattagatgatatttcttttaatatagaagaaggcgagatagttggtctgattggttctaatggtactggaaagagtactattttgaagatgattaatggcttaatcccttatgataaaggaaatatttattatcaaggaaaagaagtgaagtctttttctgataataagttacgtcagatgcgtaaagatattgcttatatttttcaaaatcataatttgttagcaggagaaagtgtatattatcatctagctttagtttataaattaaatcatcaaaaagtaaatcatgacgcaattaatgatatcttagattttttaggtttgatggatttaaaacaggtgaaatgccatagtttgagtggtgggcagcaacaaaaagttgcaatcgctatggctgttttgcaaaaaccgaaacttattctatgtgatgagatcagctctgccttagatactaatagtgaaaaagagatatttaacttgttgtctgatcttcgtgaaaaatatggtatctctatcttgatgattgctcatcacctatctcttttaaaacaatattgtgatcgtgtaatgattttggatcaccagactattgtagatactgttgttccagtgaaagcaactctgaatcaattaaagtcaaactacgtagatcaagtaaaggagtttttgttacatgat

SEQ ID NO: 9334 - protein, 244 aa, Streptococcus agalactiae
MIIELKSVGKIFPKSQFRLDDISFNIEEGEIVGLIGSNGTGKSTILKMINGLIPYDKGNIYYQGKEVKSFSDNKLRQMRKDIAYIFQNHNLLAGESVYYHLALVYKLNHQKVNHDAINDILDFLGLMDLKQVKCHSLSGGQQQKVAIAMAVLQKPKLILCDEISSALDTNSEKEIFNLLSDLREKYGISILMIAHHLSLLKQYCDRVMILDHQTIVDTVVPVKATLNQLKSNYVDQVKEFLLHD

SEQ ID NO: 9335 - DNA, 606 bp, Streptococcus agalactiae
atggcaattattttaccagatttaccctatgcatatgatgcgcttgagccacatattgatgctgagacaatgacactacatcatgataagcaccatgcaacttatgttgctaatgcaaatgctgctcttgagaaacatcctgaaattggagaagacttagaggcgctcttagctgatgtttctcaaattccagaagatattcgtcaggcagtcatcaataacggtggtggacatcttaaccacgctcttttctgggaattgatgtcaccagaagaaactcaaatttcacaagagttatctgaagacattaatgcaacttttggttcatttgaagactttaaagctgctttcacagcagcagcaacaggacgttttggttcaggttgggcttggcttgttgttaatgctgaaggcaaacttgaagtgctttcaactgccaatcaagatactccaattatggaaggcaagaaacctattttagggcttgatgtatgggagcatgcttattacttaaactatcgtaatgttcgtcctaactacatcaaagctttctttgaaattattaactggaataaagtaaatgaactttaccaagctgctaaagct

SEQ ID NO: 9336 - protein, 202 aa, Streptococcus agalactiae
MAIILPDLPYAYDALEPHIDAETMTLHHDKHHATYVANANAALEKHPEIGEDLEALLADVSQIPEDIRQAVINNGGGHLNHALFWELMSPEETQISQELSEDINATFGSFEDFKAAFTAAATGRFGSGWAWLVVNAEGKLEVLSTANQDTPIMEGKKPILGLDVWEHAYYLNYRNVRPNYIKAFFEIINWNKVNELYQAAKA

SEQ ID NO: 9337 - DNA, 894 bp, Streptococcus agalactiae
ttgacacttatgtcagttgccacattagctgcctgctcaggtaaaacatcaaatggaacaaatgttgttacaatgaagggcgacactattacagtctctgatttttatgatcaagtaaaaacatcaaaagctgcacaacaatcaatgcttacattgatcctctcacgtgtttttgatacacagtatggtgataaagtttcagataaaaaagtatcagaagcttataataagacagctaaaggctatggtaattcattttcaagcgcactttcacaagcaggtttgactccggaaggttacaaacaacaaattcgcacaactatgcttgtggaatatgctgtaaaagaagcagctaagaaagaattaacagaagcaaactataaagaagcatataaaaactatactcctgaaacttctgtacaagtaatcaaattggatgcagaagataaagctaaatctgtccttaaagatgtaaaggctgatggagctgattttgcaaagattgcaaaagaaaaaacaacagctactgataagaaagttgagtataaatttgattctgcagggacaaccctccctaaagaagttatgtcagcagcctttaagctagataaaaatggtgtttcagatgtggtttcaacggttgattcaacaacttataaaacaagttactacatcattaaagtaactgataagacagagaaaaaatctgattggaaatcttacaaaaatcgcttaaaagaagttattcttaaggataaaacaagcgatagagccttccaaaataaagtgatttcaaaagccttagaaaaagctaatgttaagattaaagataaagcatttgcaggcatcttatcacaatatgctacaacaagtggttcatcatcacttaaaaaa

SEQ ID NO: 9338 - protein, 298 aa, Streptococcus agalactiae
MTLMSVATLAACSGKTSNGTNVVTMKGDTITVSDFYDQVKTSKAAQQSMLTLILSRVFDTQYGDKVSDKKVSEAYNKTAKGYGNSFSSALSQAGLTPEGYKQQIRTTMLVEYAVKEAAKKELTEANYKEAYKNYTPETSVQVIKLDAEDKAKSVLKDVKADGADFAKIAKEKTTATDKKVEYKFDSAGTTLPKEVMSAAFKLDKNGVSDVVSTVDSTTYKTSYYIIKVTDKTEKKSDWKSYKNRLKEVILKDKTSDRAFQNKVISKALEKANVKIKDKAFAGILSQYATTSGSSSLKK

SEQ ID NO: 9339 - DNA, 1038 bp, Streptococcus agalactiae
atggatttacaaaaacaattagaagagttgaaaatatcaactcaagaaaagcttaaagaaatgactgggaaccacactaaagaattacaagacttacgtgtacaagttttaggaaaaaaaggttctctaacagaattactaaaaggtctgaaagatttatctaatgatttacgaccagttgttggaaaacaagtcaatgaagtacgtgatattttaacaaaagcgtttgaggaacaagctaaagtagtggaagctgcgaagattcaagcacagttagagtctgagagtgtcgacgttaccttgcctggtcgtcaaatgacattaggtcaccgtcatgtcttaacacaaactagcgaagagattgaagatatctttttaggtatgggattccaagtggttgatggttttgaagttgagaaagactactataattttgaacgaatgaatttaccaaaagatcatccagcccgtgatatgcaagatactttttatattacagaagaaatcttgctacgtactcatacttcgcctgttcaagcacgaacaatggaccaacatgatttttctaaagggcctttaaaaatgatttctcctggacgtgttttccgtcgtgatactgatgatgctactcatagccatcaattccatcaaattgaaggcttagttgttggagaaaatatttcaatgggcgatctcaaaggaacacttcaactgatttctcaaaaaatgtttggagcagagcgtaaaatccgacttcgtccttcatatttcccattcacagaaccttcagttgaagttgatgtctcttgcttcaagtgcggaggtaagggatgtaatgtctgcaaacagacaggttggattgagatattgggtgctggtatggttcacccaagtgttttggaaatgtctggtattgattctgagaaatactccggttttgcctttggtttaggtcaagaacgtattgcaatgttacgctacggtatcaatgacattcgtggcttctatcaaggtgatgttcgcttcacagatcaattt

SEQ ID NO: 9340 - protein, 346 aa, Streptococcus agalactiae
MDLQKQLEELKISTQEKLKEMTGNHTKELQDLRVQVLGKKGSLTELLKGLKDLSNDLRPVVGKQVNEVRDILTKAFEEQAKVVEAAKIQAQLESESVDVTLPGRQMTLGHRHVLTQTSEEIEDIFLGMGFQVVDGFEVEKDYYNFERMNLPKDHPARDMQDTFYITEEILLRTHTSPVQARTMDQHDFSKGPLKMISPGRVFRRDTDDATHSHQFHQIEGLVVGENISMGDLKGTLQLISQKMFGAERKIRLRPSYFPFTEPSVEVDVSCFKCGGKGCNVCKQTGWIEILGAGMVHPSVLEMSGIDSEKYSGFAFGLGQERIAMLRYGINDIRGFYQGDVRFTDQF

SEQ ID NO: 9341 - DNA, 639 bp, Streptococcus agalactiae
atgtcttatattttagaaatcttacctagcttattagtaggtgcgcaagtgacattgcaagttttctttattgttatttgtttatcaattccacttggtattgttgtagccttcctaatgaaagttcattttaagccgcttcaatggctactgacaacttatatttggattatgcgaggcacgcctctgttattacagcttatctttttttattactttttaccaagtgtagggatttcttttgatcgtatgccagctgcgattattgcttttacgatgaattatgcagcttattttgcagagatttttcgaggaggtattgagtctattcctaaagggcaatatgaagctgcaaaggtattaaagttttctaagtttcaaacggtttggtacatagtattacctcaagtcttcaaaatagtcttaccgagtgttttcaatgaaacgattactttagtgaaagattcctcattggtttacatacttggtgtgggcgacttacttctagaaagtaagacagccgcaaatagggatgcaacacttgcaccaatgtttatagcaggtggtatttacctattattaattggtcttttaactattttatctaaacaagttgaaaagcgttttaactactataaa

SEQ ID NO: 9342 - protein, 213 aa, Streptococcus agalactiae
MSYILEILPSLLVGAQVTLQVFFIVICLSIPLGIVVAFLMKVHFKPLQWLLTTYIWIMRGTPLLLQLIFFYYFLPSVGISFDRMPAAIIAFTMNYAAYFAEIFRGGIESIPKGQYEAAKVLKFSKFQTVWYIVLPQVFKIVLPSVFNETITLVKDSSLVYILGVGDLLLESKTAANRDATLAPMFIAGGIYLLLIGLLTILSKQVEKRFNYYK

SEQ ID NO: 9343 - DNA, 858 bp, Streptococcus agalactiae
atgaaaaaaaacatttttttgttaaccttgctagccaccgtcttattgacgctgtctggttgtgctaattggattgataaaggtcaatcaatcaccagcgttggttcaaccgccttacagccacttgtagaagctgcagcagatgagtttggtaagacaaacctcggtaagactatcaatgtccaaggaggaggctcaggaacaggcttatcacaagtacagtctggagctgttcaaattggtaatagcgacttatttgcagaagaaaaagatggtattgatgctaagaaattgaaagaccatcaagtcgcagtagctggattagctgttattgttaataaaaaagttaatgttaaaaatctaaccacccaccaacttcgtgatatttttgcaggaaaaatcaagaattggaaagaagtgggaggacaagatttagatatttccatcatcaatcgagcagcaagttctggatcccgtgcaaccttcgataatactattatgggaaatgttgctcctattcaaagccaagaacaagattcaaatggtatggtgaaatcaattgtttctcaaacacctggtgcgatttcatacctcgcttttgcatacgttgataaatctgtcggaacattaaaactaaatggttttgcgccaacagctaaaaatgttactaccgacaactggaaactttggtcatatgaacatatgtatacaaaaggtaatgaaacaggtctaacaaaagaattcttagactacatgaaaagtgataaagttcaaagtagtatcgtacaacatatgggatatatctctattaacgacatgaaagttgttaaagatgctgaaggtaaagtaaccccaaaa

SEQ ID NO: 9344 - protein, 286 aa, Streptococcus agalactiae
MKKNIFLLTLLATVLLTLSGCANWIDKGQSITSVGSTALQPLVEAAADEFGKTNLGKTINVQGGGSGTGLSQVQSGAVQIGNSDLFAEEKDGIDAKKLKDHQVAVAGLAVIVNKKVNVKNLTTHQLRDIFAGKIKNWKEVGGQDLDISIINRAASSGSRATFDNTIMGNVAPIQSQEQDSNGMVKSIVSQTPGAISYLAFAYVDKSVGTLKLNGFAPTAKNVTTDNWKLWSYEHMYTKGNETGLTKEFLDYMKSDKVQSSIVQHMGYISINDMKVVKDAEGKVTPK

SEQ ID NO: 9345 - DNA, 1308 bp, Streptococcus agalactiae
atgaaattaccgaatgaatttattgaaaaatatcagactatacttaaagatgaagcagaagctttttttgacagttttgaacaaaaacccatatcggcatatcgcaccaatcctctcaaagaaaagcaacttgattttccaaatgccatcccaagtaccccttgggggcattatgggaaaatatcaggaaaatcaatagaacacacaactggccttgtttattctcaagaacctgctgctcagatagtggctcagattgctgaaccacaagaaggaatgaaagtgctagatttagcagctgcacctggtggaaaaacaacacaccttctatcatatttaaacaatactggtctattagttagtaatgaaatttcaaataaacgtagtaaaattttagtcgaaaatgtcgaacgttttggtgctagaaatgttatcgtgactaatgaaagctcccaacgactagccaaatgttttaattctttttttgatcttattgtttttgacggtccgtgttctggtgagggaatgttccgcaaagatcctcaagcaatacaatattggcacaaagattaccccactgaatgtgcacagttacaaagagatattttaaaagaagcaatcaaaatgctagctcatggtggtatacttgtatactctacttgtacatggtcaccagaagagaacgaagaagtggttaattggctccttcaagagtatgattacttagaacttgttgatattcctaaactaaatgggatggttgaagggattaatgtaccacaagttgcaaggatgtaccctcatcattttcaaggtgaaggacaattcgttgcaaaactgagagatactagatctaaggaagcacagaaaattaagccaaaagcacagaaaataaataaaatgcagttacaattgtggcaacaatttgcacaagaccatttaaagatagacttgaacggtgttttagatgttttcggcgaccaactctatcttctacctaatggtctccccgatttgtctaaattaaaaatagcacgcaatggtctccatctaggcactttcaagaagaatcgttttgagccatcgtttgctttaggaatggcacttagcgaacatgacctagtacagtctattgaaattgatatagaacagtttgaggtgtacgtatctggaaatgtagtcaaactagacaagactgttccaaacggttggtatcaaattcttgtaaaaggcaatggattaggttttgcaaaagtgacaaataatactcttaaaaattattaccctaaaggactacgatttcagaca

SEQ ID NO: 9346 - protein, 436 aa, Streptococcus agalactiae
MKLPNEFIEKYQTILKDEAEAFFDSFEQKPISAYRTNPLKEKQLDFPNAIPSTPWGHYGKISGKSIEHTTGLVYSQEPAAQIVAQIAEPQEGMKVLDLAAAPGGKTTHLLSYLNNTGLLVSNEISNKRSKILVENVERFGARNVIVTNESSQRLAKCFNSFFDLIVFDGPCSGEGMFRKDPQAIQYWHKDYPTECAQLQRDILKEAIKMLAHGGILVYSTCTWSPEENEEVVNWLLQEYDYLELVDIPKLNGMVEGINVPQVARMYPHHFQGEGQFVAKLRDTRSKEAQKIKPKAQKINKMQLQLWQQFAQDHLKIDLNGVLDVFGDQLYLLPNGLPDLSKLKIARNGLHLGTFKKNRFEPSFALGMALSEHDLVQSIEIDIEQFEVYVSGNVVKLDKTVPNGWYQILVKGNGLGFAKVTNNTLKNYYPKGLRFQT

SEQ ID NO: 9347 - DNA, 876 bp, Streptococcus agalactiae
atgagagagtctatttttgaggaaactgcaaaaggtaaagtatcaaggcatgtccttttaactatattattggctttgatattactatttacagcagatttccttacctatattattattgaattgattatctcgcttgatttttggaaactagagtgggatagcgatatcgtccagttaatcattttactagcaacttcaattagtacggtaatgttatttatgtgggtgaaatttaaagagaagcgtccaattagttctctagggctatttaaagaaggagccctaacagaattatctagaggatggttagtcgggagcgttctctttggagcctgcttaatattaacaataatttcaggctctggagttatcgaaactgttcgttttacagctgataaattgatttggtttcttatttttgctgttggatggcaggtacaaagcgcatctgttgaaatattgtgtcgtggatggttacttccggtgagtgccacaaagtatagtaagatagtttctgtcagtatcagttcaatctttttcggtcttctgcatagcgctaataatcatgtaagccttatctcgattttcaatctgtgtctctttggactatttctatcgctctatgttattttaaaaggtaacatctggggggcgtgtggtattcatggcgcctggaactgtgtacaagggagtgtctttggaatcgaagttagtggagagccaatgttgtctaactccctagtccatgttaaaacctatggtgctgactggattagcggtggaaaatttggtgtggaaggaagcatgattaccagtattgttcttatcgtagcatgttattggctttatcaaaaatcgaattttccttacgac

SEQ ID NO: 9348 - protein, 292 aa, Streptococcus agalactiae
MRESIFEETAKGKVSRHVLLTILLALILLFTADFLTYIIIELIISLDFWKLEWDSDIVQLIILLATSISTVMLFMWVKFKEKRPISSLGLFKEGALTELSRGWLVGSVLFGACLILTIISGSGVIETVRFTADKLIWFLIFAVGWQVQSASVEILCRGWLLPVSATKYSKIVSVSISSIFFGLLHSANNHVSLISIFNLCLFGLFLSLYVILKGNIWGACGIHGAWNCVQGSVFGIEVSGEPMLSNSLVHVKTYGADWISGGKFGVEGSMITSIVLIVACYWLYQKSNFPYD

SEQ ID NO: 9349 - DNA, 2628 bp, Streptococcus agalactiae
atgggaaagacattttggaaagatatctatcgatcaattacgacttcaaaaggtagattttcatcaatcctcttacttatgatgttaggctcatttgcttttataggactgaaggtctcagcacctaatatgcaaagaacagcacaaaattaccttgctcatcatcatgttatggatattaccgttttcaattcttggggacttgacaaacatgatcaaactgttttagaaagcttaaaaggatcacaagttgaattttcttactttgtagatacaacccctcaacagaatagtaaatcttatcgattgtattccaataccaaaacgatatcaacctttgatcttgttaagggacgtctccctttaaataaatcagaaattgctctctcatttcaggaacgaaaaaaatatgcaataggtgataaaattaattttaaacaagataaaaacaaactgttttcaaatacaggtcctctaactattgtaggttttgttaattctaccgagatttggtctaagacaaaccttggtagttctcaaacaggggacggcgacttagatagttatggcgtattagataagacagcatttcactctccagtatatacaatggcaagggtaacttttaaagatcttaggttgattaaccctttctcaataagttacaaagaaaaagtagcgaaataccaagaaaaggtatcgcgaaaattaaatattcacaataaaataagatataccaaaacaaaaaaagagagcctacgtaaaatcgatgaggaggaaaaaagcctactaaaagctcaaaaacaaatcaatcggttagataatgatagcctagcgatgccactatctcaaagacaagctattcaaatgaaaattaaacaagaccgactatctcttttgaaacgaacaaaagagcttctaaaattgagacataacacccaaataatggaatcgcctcaaattattgtctacaaccgtactacctttcctggaggacaaggatataacacttttgactccagtacaaatagcacttctaaaatcagtaatcttttccccattattttatatttagtcgcagcattagtaaccttaacaacaatgactaggttcgtcgaggaagaaagaaccaacgcaggcatattaaaagcactaggctatagtgaccgccaagttatctttaaatttattatttatggttttatagcaggaacattagggactactttgggtatcattggagggcattatcttttacctcgtattatttctgatatcatttccaaagacctgactattccaaacacacagtatcatcttttcttaaattacagtttactagcctttgttttttcattattaagcattgttcttccagtttttgttatcactcgacgtgagttgaaagaaaaagcagcatttttattattaccaaaaccaccagctaaaggatctaaaatagctttagagtatatcaattggatttggaaaaaactgtccttcacacaaaaagtaactgctagaaatatttttcgttacaaacaaaggatgattatgaccatatttggagttgctggatcagtagcgctcttattttcaggtctaggaatacaatcctccttaaagcaaaccgtcaatgaacatttcggtcgtattatgccctatgatatattgctaacatataacacaaatgcttctcccccaaaaatacttgaactactttcaaaagattcaaaaatagacaaataccaaccaatacaccttgaaaatcttgacgaatccattcctggacaaattaataaacagtcaatttccctattcataacagacaaaaaacaattactaccttttatttatttacaagaagcaacaactaataagtcattgcacttgaataataaagggattattatttctaaaaaattagctcaattttatcatgttaataccggtgattttatccatttatctcattcacaaacacttccttctagaaaattaaaaataacaggagttgtcaatgcgaatgttggtcactatatttttatgacaaaacaatactatcgaactatttttaagaaagaagctaaagataacgcttttttggttaagttaaccaaacataaaatcgcaaataacttagcagaaaaacttttagaaattaatggagttgagtctcttacgcaaaatgctcttcagctggctagtgtagaagccgttgtgcgttctttagatggctctatgactattttagttgtcgtatctttattgttagccattgtaattctctataatctcactaatattaatttagcagaacgtaagcgggagctatcaactataaaggtattaggtttttataatgaagaagtaactttatacatttaccgcgaaaccattattttatcaaccatcggtgtgattctaggcaccattagcggtacttatttacaccgtcaaatgatgttgctaattggttcagatcaaatactttttggtgaaaaagtatcaccaactacatttataataccaataagcgtagtagtcatcattctaataagtctaggttttatagttaaccatcaattaaaaaaactcaatatgttagatgccttgaaatcagtagat

SEQ ID NO: 9350 - protein, 876 aa, Streptococcus agalactiae
MGKTFWKDIYRSITTSKGRFSSILLLMMLGSFAFIGLKVSAPNMQRTAQNYLAHHHVMDITVFNSWGLDKHDQTVLESLKGSQVEFSYFVDTTPQQNSKSYRLYSNTKTISTFDLVKGRLPLNKSEIALSFQERKKYAIGDKINFKQDKNKLFSNTGPLTIVGFVNSTEIWSKTNLGSSQTGDGDLDSYGVLDKTAFHSPVYTMARVTFKDLRLINPFSISYKEKVAKYQEKVSRKLNIHNKIRYTKTKKESLRKIDEEEKSLLKAQKQINRLDNDSLAMPLSQRQAIQMKIKQDRLSLLKRTKELLKLRHNTQIMESPQIIVYNRTTFPGGQGYNTFDSSTNSTSKISNLFPIILYLVAALVTLTTMTRFVEEERTNAGILKALGYSDRQVIFKFIIYGFIAGTLGTTLGIIGGHYLLPRIISDIISKDLTIPNTQYHLFLNYSLLAFVFSLLSIVLPVFVITRRELKEKAAFLLLPKPPAKGSKIALEYINWIWKKLSFTQKVTARNIFRYKQRMIMTIFGVAGSVALLFSGLGIQSSLKQTVNEHFGRIMPYDILLTYNTNASPPKILELLSKDSKIDKYQPIHLENLDESIPGQINKQSISLFITDKKQLLPFIYLQEATTNKSLHLNNKGIIISKKLAQFYHVNTGDFIHLSHSQTLPSRKLKITGVVNANVGHYIFMTKQYYRTIFKKEAKDNAFLVKLTKHKIANNLAEKLLEINGVESLTQNALQLASVEAVVRSLDGSMTILVVVSLLLAIVILYNLTNINLAERKRELSTIKVLGFYNEEVTLYIYRETIILSTIGVILGTISGTYLHRQMMLLIGSDQILFGEKVSPTTFIIPISVVVIILISLGFIVNHQLKKLNMLDALKSVD

SEQ ID NO: 9351 - DNA, 315 bp, Streptococcus agalactiae
atgtggcaggcacttacccttggggccaaagaacttggctaccagtttggaccatttatgggtaatggtggcgattggaaaaataagccgggctatcaaaccacacacgaggcaaaaacaggctacgccatctcatttagccccggccaagctggtgctgatagaacttacggccacgtggccatcgtcgaagacgttaaggaagacggatctatcccgatctccgaatcaaatgtcctaggacttggcaccatctcctaccgcaccttcagtgcagcagaagcagcacaattgacttatgtagttggggagaag

SEQ ID NO: 9352 - protein, 105 aa, Streptococcus agalactiae
MWQALTLGAKELGYQFGPFMGNGGDWKNKPGYQTTHEAKTGYAISFSPGQAGADRTYGHVAIVEDVKEDGSIPISESNVLGLGTISYRTFSAAEAAQLTYVVGEK

SEQ ID NO: 9353 - DNA, 1539 bp, Streptococcus agalactiae
atgagtattttagaagtaaaaaacttaagtcacggttttggtgatcgtgctatttttgagaatgtttcttttcgccttttaaaaggtgaacatataggacttattggtgctaatggtgaaggaaaatcaacattcatgtcaattgtcacaggtcatcttcaacctgatgaaggaaaaattgaatggtcaaaatatgtaactgctggttaccttgatcaacatactgtattagaagaaggtcaaacagttcgtgatgttttgcgaacagcatttgatgaactttttaaaacagaggcacgtatcaatgatatatatatatccatggcagatgatggcgcagatgtagatagccttatggaagaagttggagaactacaagatcgtttagaatcacgtgatttttatacacttgatgctaaaattgatgaagttgcacgggcattaggagttatggattttggtatggattctgatgttactgaattatctggtggtcaaaggacaaaggttcttttagcaaaactgttattagaaaagccagacatcctcctgcttgatgagcctacaaactaccttgatgctgaacacattgattggttaaaacgctatttacaaaattatgaaaatgcttttgttttaatctcacacgatattccatttttgaacgatgttatcaatattgtctatcatgttgaaaatcaagatttagtaagatattccggtgattatactaattttgaatcagtctatgcaatgaaaaaggctcaattagaagcagcctatgaacgtcaacaaaaggaaatagctgatttacaagattttgttaatcgtaataaagcacgcgtcgcaacacgtaatatggcaatgtctcgtcaaaagaaactagacaaaatggatattattgagttacaagcagagaaaccaaagccaagtttcgaatttaaagaatctcgcacaccaggacgttttattttccaagctaaagatcttcaaattggatatgatcgtgctttaacaaaacctctaaacctaacatttgaacgtaatcaaaaaatagctattgttggagcaaatgggataggaaaaacaacattacttaagagtttactaggtattatcccccctatttctggtaatgttgaacgaggtgattttattgatttaggttattttgaacaagaagtacccggaggaaatcgccaaactccactcgaagcagtatgggatgcttttcctgctttgaaccaagcagaggttagggcagctcttgctcgttgtggtttaacttcaaagcatattgaaagtcagattcaggtgttatctggtggggagcaatcaaaggtcagattttgcttattaatgaatcgcgaaaataatgtccttgtacttgacgaaccaaccaatcatttagatgtagatgctaaagatgagttaaaacgtgctttaaaagcttataagggatcaatcttgatggtatgtcatgaaccggacttttatgaaggatggatggatgatgtttgggactttaaccaacttagt

SEQ ID NO: 9354 - protein, 513 aa, Streptococcus agalactiae
MSILEVKNLSHGFGDRAIFENVSFRLLKGEHIGLIGANGEGKSTFMSIVTGHLQPDEGKIEWSKYVTAGYLDQHTVLEEGQTVRDVLRTAFDELFKTEARINDIYISMADDGADVDSLMEEVGELQDRLESRDFYTLDAKIDEVARALGVMDFGMDSDVTELSGGQRTKVLLAKLLLEKPDILLLDEPTNYLDAEHIDWLKRYLQNYENAFVLISHDIPFLNDVINIVYHVENQDLVRYSGDYTNFESVYAMKKAQLEAAYERQQKEIADLQDFVNRNKARVATRNMAMSRQKKLDKMDIIELQAEKPKPSFEFKESRTPGRFIFQAKDLQIGYDRALTKPLNLTFERNQKIAIVGANGIGKTTLLKSLLGIIPPISGNVERGDFIDLGYFEQEVPGGNRQTPLEAVWDAFPALNQAEVRAALARCGLTSKHIESQIQVLSGGEQSKVRFCLLMNRENNVLVLDEPTNHLDVDAKDELKRALKAYKGSILMVCHEPDFYEGWMDDVWDFNQLS

SEQ ID NO: 9355 - DNA, 1716 bp, Streptococcus agalactiae
atgacttacacagaaaatcttcaaaaatggttagattttgagcagcttcctgactatcttcgtcaagaattactatcaatggatgaaaaaacaaaagaagatgctttttacacaaacttagaatttggtactgctggtatgcgtggttatattggtgctggtacaaatcgtattaatatttatgttgtccgtcaagcaaccgaaggattggcaaaattaatcgaaactaagggagaggaagctaaaaaacgtggtgtagccattgcctatgattcacgccacttctctccagaatttgcttttgagtctgcacaggtcttggcacagcatggaattaaatcttacgtatttgaagctcttcgtccaacaccagaactctcttttgctgttcgccatttaaatgcctatgctggtattatggttactgcaagccacaatccagcacctttcaatggttataaagtctatggacaagacggaggtcaactaccaccagctgatgctgatgcactaacagactttatccgtgctattgaaaatccatttgcagttgaacttgctgatttagatgaaagcaaatcatcgggccttattcaggttatcggtgaagatgttgatattgaatatcttagagaggttaaagatgttaatatcaatcaagatttaatcaataactttggaaaagacatgaaaattgtctatactcctctccacggaactggtgagatgttgacacgccgtgcccttgctcaagccggttttgaatctgttgttgtagtagaatcacaagctaaggcagatccagacttttctactgtcaaatctcctaaccctgaaagccaagctgcctttgctcttgctgaagaactcggacgagaagttgatgcagatgtcttagtagctactgatcctgatgcagaccgcctaggcgttgaaattcgccaaccagatggttcttataaaaacctttctggaaatcaaattggagcgattattgcgaaatacatcctggaagctcataaaacagcaggaacacttccagaaaatgctgctctcgctaaatcaatcgtatcaacagaattagtaacaaaaattgccgaaagttacggcgctacaatgtttaacgttttaactggatttaaattcatcgctgagaaaattcaagagtttgaagaaaaacataaccacacctatatgtttggttttgaagaaagcttcggatatcttattaaaccatttgtccgtgataaagacgctattcaagcagttcttttggttgctgagatcgcagcttattaccgttcgcgtggtttaacacttgcagatggtattgatgaaatttacaaagaatatggttattttgctgaaaaaacgatttcagtaacactttcaggtgtggatggagctgctgaaattaagaagattatggacaaattccgtgaaaatggtccaaaacaatttaacaatactgacattgtattattagaagatttccaaaaacaaaccgctactaaaaatgatggaacaatatctaacttaacaactcctccaagtaatgttttgaagtacacgttagctgatgattcatggattgcagttcgcccttcaggaactgaaccaaaaatcaagttctatattgccacggtcggtaatgatttagcagatgcagaaacaaaaatcgccaatattgaaaaagagattacaacatttgtaaat

SEQ ID NO: 9356 - protein, 572 aa, Streptococcus agalactiae
MTYTENLQKWLDFEQLPDYLRQELLSMDEKTKEDAFYTNLEFGTAGMRGYIGAGTNRINIYVVRQATEGLAKLIETKGEEAKKRGVAIAYDSRHFSPEFAFESAQVLAQHGIKSYVFEALRPTPELSFAVRHLNAYAGIMVTASHNPAPFNGYKVYGQDGGQLPPADADALTDFIRAIENPFAVELADLDESKSSGLIQVIGEDVDIEYLREVKDVNINQDLINNFGKDMKIVYTPLHGTGEMLTRRALAQAGFESVVVVESQAKADPDFSTVKSPNPESQAAFALAEELGREVDADVLVATDPDADRLGVEIRQPDGSYKNLSGNQIGAIIAKYILEAHKTAGTLPENAALAKSIVSTELVTKIAESYGATMFNVLTGFKFIAEKIQEFEEKHNHTYMFGFEESFGYLIKPFVRDKDAIQAVLLVAEIAAYYRSRGLTLADGIDEIYKEYGYFAEKTISVTLSGVDGAAEIKKIMDKFRENGPKQFNNTDIVLLEDFQKQTATKNDGTISNLTTPPSNVLKYTLADDSWIAVRPSGTEPKIKFYIATVGNDLADAETKIANIEKEITTFVN

SEQ ID NO: 9357 - DNA, 648 bp, Streptococcus agalactiae
atggataaattaaaatgccttggagaaaagttttcagagggtcacttttatccacttcaactggatattacaagtagagaatcggttgacaaagctttagaaagtctgcctaaaaaattgcaatcaattgatttgttggttaataatgcaggtttagcacttggattggataaatcatatgaagctgattttggagattggatgactatgattaatactaacgttgtaggattaatttacttgacacgatgcattttacctaaaatggtagaagttaatagagggttaattatcaatttgggatcaactgcaggaacaattccttatccaggagctaatgtctatggcgcatcaaaagcttttgtaaaacaattttctctcaacttgcgtgccgatttagctggaactaaaatcagagtgactaacctagaacccggtttatgtgaagggacagaattttcaactgtacgtttcaaaggggatcataaaagagttgaaaaactttatgaaggtgcgcatgcaattcaagcagaggatattgctaataccgtgtcatgggttgctagccaaccagaacacattaatattaatcgcatagaaataatgccagtcagtcaaacttatggacctcaacctgtttatcgtgat

SEQ ID NO: 9358 - protein, 216 aa, Streptococcus agalactiae
MDKLKCLGEKFSEGHFYPLQLDITSRESVDKALESLPKKLQSIDLLVNNAGLALGLDKSYEADFGDWMTMINTNVVGLIYLTRCILPKMVEVNRGLIINLGSTAGTIPYPGANVYGASKAFVKQFSLNLRADLAGTKIRVTNLEPGLCEGTEFSTVRFKGDHKRVEKLYEGAHAIQAEDIANTVSWVASQPEHININRIEIMPVSQTYGPQPVYRD

SEQ ID NO: 9359 - DNA, 990 bp, Streptococcus agalactiae
atgcgttccttatttggtggtttaagagaaaaagttgcaagtgattatgttaagattgttttccctgagggaagcgatgaacgtgtattacgtgcagcagctcgtttgaaatttgaaggtcttgttgatcctgttattttaggtaaggctgacgaagttcacgattctttggcaagacttggttttgttgatcaagattatagcattattgaccctgaacaatacgaaaaatttgaagagatgaaagaagcttttgttgagattcgtaaaggcaaagctactatggaagatgcagatcgtcttttgaaggatgttaactattttggggttatgttagtaaaacttggtttggcagatggtatggtatcaggggccattcattcaacagctgatactgtacgtcctgctcttcaaattattaaaacaaaaccaggaatttcacgcacttcaggtgtattcttgatgaaccgtgaaaatacacaggaacgttatatttttgctgactgtgctattaacattgatcctaatgcacaagagctagcagaaattgcagtaaatactgcggatacagctaaaatatttgatattgatcccaagattgctatgcttagtttttcaacaaaaggaagtgcaaaagcgcctcaagctgaaaaagttcaagaagcagctaaaattgccaaagatttatctcccgaattagctgttgatggagaattacaatttgatgcagcttttgttccggaaactgcagaaattaaagctcctaatagtgatgttgctggaaaagcaaatgtttttattttcccagaccttcaatcaggaaatattggctataaaattgcacaacgtttgggtatgtttgaagcaatcggaccgattttacaaggattgaatgctccagtaaatgatttatcacgtggatcaagtgctgaagatatttataaacttgctatcattacagctgctcaagctattgatgagaaatcaaaa

SEQ ID NO: 9360 - protein, 330 aa, Streptococcus agalactiae
MRSLFGGLREKVASDYVKIVFPEGSDERVLRAAARLKFEGLVDPVILGKADEVHDSLARLGFVDQDYSIIDPEQYEKFEEMKEAFVEIRKGKATMEDADRLLKDVNYFGVMLVKLGLADGMVSGAIHSTADTVRPALQIIKTKPGISRTSGVFLMNRENTQERYIFADCAINIDPNAQELAEIAVNTADTAKIFDIDPKIAMLSFSTKGSAKAPQAEKVQEAAKIAKDLSPELAVDGELQFDAAFVPETAEIKAPNSDVAGKANVFIFPDLQSGNIGYKIAQRLGMFEAIGPILQGLNAPVNDLSRGSSAEDIYKLAIITAAQAIDEKSK

SEQ ID NO: 9361 - DNA, 549 bp, Streptococcus agalactiae
atggaaaatcaaaaacaagatattaaaacttcagtaacttatgaagaaaaggtaattgctaaaattgttggacatgctttagaatcagtagacggactcttagctgtgagtggaggtttcttctctaatctaaaaaatagcgttgtaaattctgactcagtaactgatggtgtaaatgttgaagttggtactaaagaagttgcagttgatttagacatcgttgttgaatacggcaaggacatcccagctatcgttgaaagcattaaagcgattgtcagtcaaaacgttgaagtgatgacccaccttaaagttgttgaattgaacgcaaatgtcgtagatattaagactaaagctgaacatgaagctgactcagtgacagtacaagatcgtgtatctgatgcagcacaagcaacaggaaactttgcttctgaacaagctggcaaagctaaagcagcaatttcctctggagcagagaaaacaaaagaagcagtatcaaatggtactgaggctgcaaaagaaaaaatctcagaagctcgtactagtgaatct

SEQ ID NO: 9362 - protein, 183 aa, Streptococcus agalactiae
MENQKQDIKTSVTYEEKVIAKIVGHALESVDGLLAVSGGFFSNLKNSVVNSDSVTDGVNVEVGTKEVAVDLDIVVEYGKDIPAIVESIKAIVSQNVEVMTHLKVVELNANVVDIKTKAEHEADSVTVQDRVSDAAQATGNFASEQAGKAKAAISSGAEKTKEAVSNGTEAAKEKISEARTSES

SEQ ID NO: 9363 - DNA, 1398 bp, Streptococcus agalactiae
ttggggtatagccaagcggtaaggcaagggactttgactccctcatgcgttggttcgaatccagctaccccagtcaaaggtatcaaacttttgtttgacaccgtcaaagagatatttgttgtccttgcgggttaccttgagaaaatatattgttatcaaaagctagctcggctagcttttgttggaggattttttagaatgaatgaatttgaagatttgctaaacagtgttagcgaagtgaatcctggtgacgttgtcactgcggaagttttaacagttgataacggtcaagcaaacgttgttatcgatggtactggtgttgaaggtgtcttgacacttcgtgaattgactaacgatcgtgatgctgatatcaatgattttgttaaagctggcgacacagttgaagtacttgttcttcgtcaagttgtaggtaaagatactgatacagtaactttccttgtatctaaaaaacgcttggaagctcgtaaagcatgggacaaacttgttggtcgtgaaggtgaagttgttactgttaaaggtacacgtgctgttaaaggcggactttcagttgaatttgaaggacttcgtggtttcatcccagcttcaatgattgatactcgttttgtacgtaatactgaaaaatttgttggacaagaatttgatgctaaaatcaaagaagttgatgcagcagaaaatcgcttcatcctttcacgtcgtgaagttgttgaagaatcagcagctgcagcacgtaaagaagttttctcaaacattgaagtaggttcagttgtaactggtaaagttgctcgtttaacaagctttggtgctttcattgaccttggtggtgttgatggacttgtacacgtaactgaattatcacatgagcgcaatgtttcacctaaatcagttgtaactgttggtgaagaagttgaagttaaagtactttcaattgatgaagaagctggtcgtgtatcactttcacttaaagcaactacacctggcccatgggatggcgttgaacaaaaacttgctgctggtgatgttattgaaggtaaagtaaaacgcttgactgactttggtgcttttgttgaagtgttacctggcattgatggacttgtacacatttcacaaatttcacacaaacgtgttgaaaatcctaaagacgtattatctgcaggacaagaagttactgttaaagttcttgaagttaattcagatgcagaacgtgtctcactttcaatgaaagctcttgaagagcgtccagcgcaagcagaaggtgaaaaagaagaaaaacgtcaatcacgtccacgtcgtccacgtcgtcaagaaaaacgcgactacgagcttccagaaacacaaactggattctctatggctgacttattcggtgatattgaatta

SEQ ID NO: 9364 - protein, 466 aa, Streptococcus agalactiae
MGYSQAVRQGTLTPSCVGSNPATPVKGIKLLFDTVKEIFVVLAGYLEKIYCYQKLARLAFVGGFFRMNEFEDLLNSVSEVNPGDVVTAEVLTVDNGQANVVIDGTGVEGVLTLRELTNDRDADINDFVKAGDTVEVLVLRQVVGKDTDTVTFLVSKKRLEARKAWDKLVGREGEVVTVKGTRAVKGGLSVEFEGLRGFIPASMIDTRFVRNTEKFVGQEFDAKIKEVDAAENRFILSRREVVEESAAAARKEVFSNIEVGSVVTGKVARLTSFGAFIDLGGVDGLVHVTELSHERNVSPKSVVTVGEEVEVKVLSIDEEAGRVSLSLKATTPGPWDGVEQKLAAGDVIEGKVKRLTDFGAFVEVLPGIDGLVHISQISHKRVENPKDVLSAGQEVTVKVLEVNSDAERVSLSMKALEERPAQAEGEKEEKRQSRPRRPRRQEKRDYELPETQTGFSMADLFGDIEL

SEQ ID NO: 9365 - DNA, 228 bp, Streptococcus agalactiae
gtgagtaaaaaagataagaaaattgaaattcaaatttcagacgctcaagtaacagttaatggaactaaggttgatggataccaactcgttattggaaaaaaaattgtaggtcaaattgcagagctagattctaaatttgctgtgattaaaggtgagcaagtgagtggattctataaaaatttagatcaagctatgggaaatattattgaagaatataatcttaatcgc

SEQ ID NO: 9366 - protein, 76 aa, Streptococcus agalactiae
MSKKDKKIEIQISDAQVTVNGTKVDGYQLVIGKKIVGQIAELDSKFAVIKGEQVSGFYKNLDQAMGNIIEEYNLNR

SEQ ID NO: 9367 - DNA, 1044 bp, Streptococcus agalactiae
atgactgaatttaaaaacattatcgtaactggtggagctggtttcatcggatcaaactttgtacactatgtttacaataaccacccagatgttcatgtaactgtccttgataaattgacatatgcaggtaaccgtgctaacattgaagccattcttggtgatcgtgttgagttagttgttggtgacatcgctgacgctgaattggtagacaagttggctgccaaagcagatgctattgttcactatgcggctgagagccacaatgacaactcacttaacgatccaagtccatttatccatacaaactttatcggaacttacactttgcttgaagcagctcgtaaatacgatatccgtttccaccacgtgtcaactgatgaagtttatggagatctgccacttcgtgaagaccttccaggaaatggtgaaggaccaggtgaaaaattcactgctgaaacaaaatacaatccatcatcaccttactcatcaactaaggcagcttctgaccttatcgttaaggcatgggtacgttccttcggcgtaaaagcgaccatttcgaactgttcaaataactatggaccataccaacacatcgaaaaattcattccacgtcaaattacaaatatcttggcaggaatcaaaccgaaactttatggtgaaggtaaaaacgtccgtgactggatccacacaaatgatcattcaacaggtgtctgggctattttgactaagggtcgtattggtgaaacataccttattggtgccgacggtgagaaaaacaacaaggaagttcttgaacttatccttgagaaaatgggtcaaccaaaagacgcttacgatcacgtaactgaccgtgctggacacgaccttcgttacgctatcgattctacaaaattgcgtgaagaacttggttgggaaccacaattcacaaacttctcagaaggtttggaagaaacaatcaactggtacactgaaaaccaagattggtggaaagcagagaaagaagcagttgaagctaactacgctaaaacgcaagaagtcattaac

SEQ ID NO: 9368 - protein, 348 aa, Streptococcus agalactiae
MTEFKNIIVTGGAGFIGSNFVHYVYNNHPDVHVTVLDKLTYAGNRANIEAILGDRVELVVGDIADAELVDKLAAKADAIVHYAAESHNDNSLNDPSPFIHTNFIGTYTLLEAARKYDIRFHHVSTDEVYGDLPLREDLPGNGEGPGEKFTAETKYNPSSPYSSTKAASDLIVKAWVRSFGVKATISNCSNNYGPYQHIEKFIPRQITNILAGIKPKLYGEGKNVRDWIHTNDHSTGVWAILTKGRIGETYLIGADGEKNNKEVLELILEKMGQPKDAYDHVTDRAGHDLRYAIDSTKLREELGWEPQFTNFSEGLEETINWYTENQDWWKAEKEAVEANYAKTQEVIN

SEQ ID NO: 9369 - DNA, 1779 bp, Streptococcus agalactiae
atgaatgaactgattaaacataagctagaattgttaccagacagtcctggttgttaccttcataaagataagaatgggacaattatttatgtaggtaaggctaaaaatcttaagaatcgtgtgaaaagttattttcatgggagtcataatactaagacagaacttttggtctctgagattgaagactttgaatacattgtgacaacatctaataccgaagctctattattggaaattaatttaatccaagaaaatatgccgaagtataatattcgattgaaagatgataagtcttacccatatatcaaaataacaaatgaacgttatcctcgtcttatgattacacgtcaagtaaaaaaatcagatggcacttattttggaccttatccggattctggggcagcaactgagattaagcggttactagataggctctttccttttaagaaatgtactaatccagcaaataaagtatgcttttattatcatttagggcaatgcaatgcacatacagtttgtcaaactaataaagcttattgggatagtctgagagaagatgtaaaacagtttcttaatggtaaagataataaaattgttaacggattaactgaaaaaatgaagagcgctgctatgactatggaatttgagcgtgcggctgaatatcgagatttgatcgaagcaattagtttgttgcgtactaagcagcgtgttattcatcaagatatgaaggatagagatgtttttggttatttcgttgataagggttggatgtgtgtacaggtcttttttgttcgaaatggaaaattgattcagcgtgacgtgaatatgtttccttattataatgaaccagaggaagattttctaacttacatagggcaattttatcaagatacaaaacattttctacccaaagaagtctttattccacaggatattgatgctaagtcggttgaaacaattgtaggctgtaagattgttaaaccacaacgtggtgaaaagaaacagttagtaaatctggcaataaaaaatgctcgtgtcagtttacaacagaagtttgacttactggaaaaagatattcgtaaaactcatggggcaattgaaaatttaggtaatcttcttaatatccctaaaccagtacgcatagaagcatttgataattccaatattcaagggacaagtccagtagctgctatggtggtatttgtgaatggaaagccaagtaaaaaagactatcgaaagtttaaaattaagactgttatcggaccagatgattatgctagtatgagagaagtcattcatcggcgttatagtagggttttaaaagatggcttgacacctccggacttgattgtaattgatggtggtcaggggcaagtaaatatagcgcgtgatgttattgagaaccaatttggtttagccatacctattgcaggtttgcaaaagaatgataaacaccaaacacatgaattactttttggagatcctttagaagtagtagagctaccgcgtaattcagaagaatttttcttacttcaccgtattcaagatgaggtacatcgttttgctattacttttcatcgtcaattacgctccaaaaattccttttcttcaaaattagatggtatcactgggttgggaccaaaacgtaaacaattgctaatgaaacattttaaaagcttacctaatatccaaaaagctgagattgaggacattattatgtgtggtattcctaggactgttgcagaaagtctccgagattctcttaatgatcctcctaaa

SEQ ID NO: 9370 - protein, 593 aa, Streptococcus agalactiae
MNELIKHKLELLPDSPGCYLHKDKNGTIIYVGKAKNLKNRVKSYFHGSHNTKTELLVSEIEDFEYIVTTSNTEALLLEINLIQENMPKYNIRLKDDKSYPYIKITNERYPRLMITRQVKKSDGTYFGPYPDSGAATEIKRLLDRLFPFKKCTNPANKVCFYYHLGQCNAHTVCQTNKAYWDSLREDVKQFLNGKDNKIVNGLTEKMKSAAMTMEFERAAEYRDLIEAISLLRTKQRVIHQDMKDRDVFGYFVDKGWMCVQVFFVRNGKLIQRDVNMFPYYNEPEEDFLTYIGQFYQDTKHFLPKEVFIPQDIDAKSVETIVGCKIVKPQRGEKKQLVNLAIKNARVSLQQKFDLLEKDIRKTHGAIENLGNLLNIPKPVRIEAFDNSNIQGTSPVAAMVVFVNGKPSKKDYRKFKIKTVIGPDDYASMREVIHRRYSRVLKDGLTPPDLIVIDGGQGQVNIARDVIENQFGLAIPIAGLQKNDKHQTHELLFGDPLEVVELPRNSEEFFLLHRIQDEVHRFAITFHRQLRSKNSFSSKLDGITGLGPKRKQLLMKHFKSLPNIQKAEIEDIIMCGIPRTVAESLRDSLNDPPK

SEQ ID NO: 9371 - DNA, 1338 bp, Streptococcus agalactiae
atgtatcaaactcagacaaataaggaaaaatttgttttatttttgaaattatttatcccagtattgatttatcaatttgctaatttttcagctacttttattgattcggttatgactggacagtatagtcagctacatttggcaggtgtgtcaactgctagtaatttatggactccgtttttcgctttattagtaggtatgatttcagcattagtaccagtagttggtcaacatttgggtagaggaaataaagaacaaattcgcacagaatttcatcaatttctatatttaggtttgatactgtccttaatattatttttaatcatgcaatttattgctcaacctgtcttggggagtttgggtttagaagatgaagttctagcagttggtcgtggttatttaaattatatgttgattggaatcatgccgctggtgttgtttagcatttgccgttcattctttgatgcattggggttaacaaggttatctatgtatctgatgcttttaattctaccctttaattcattttttaattatatgcttatctacggtaaatttggtatgcctagactaggaggtgcgggggcaggtcttggaacttctttaacttattgggctatttttattgttattattattgtgatgtcacttcatcctcaaattaaaacatatcatatatggactctggaaagaataaaagctcctttgattattgaagatattcgattgggattaccgattggtttacaaatttttgcagaagttgcaatttttgcagtagtaggcttattcatggcaaaattttcttcaatcattattgcagcacatcaggctgctatgaatttttcatcattaatgtatgcctttcctttaagtatttccactgctctagctattacaatatcgtttgaagtaggggcagagcgctttcaggacgcaaacacttatagtaggataggacgcttaacagcggtagggattacatcaggaaccttactatttttatttctatttcgtgagaatgtagcagcaatgtataatagtgaccctcactttgtcgctattacagctcaattcctaacttatagtctctttttccagtttgcagatgcttatgcagctcctgtacaggggattttacgaggctataaggatacaacaaaaccatttatgatcggtgcgggctcttattggttatgtgctttgccattagcggttatcttagaaaaaaatagccagttaggtccttttgcctattggattggtttaatcacaggtatttttgtttgtggtctatttctaaaccaacgtctgcaaaagattaagaagttgtattat

SEQ ID NO: 9372 - protein, 446 aa, Streptococcus agalactiae
MYQTQTNKEKFVLFLKLFIPVLIYQFANFSATFIDSVMTGQYSQLHLAGVSTASNLWTPFFALLVGMISALVPVVGQHLGRGNKEQIRTEFHQFLYLGLILSLILFLIMQFIAQPVLGSLGLEDEVLAVGRGYLNYMLIGIMPLVLFSICRSFFDALGLTRLSMYLMLLILPFNSFFNYMLIYGKFGMPRLGGAGAGLGTSLTYWAIFIVIIIVMSLHPQIKTYHIWTLERIKAPLIIEDIRLGLPIGLQIFAEVAIFAVVGLFMAKFSSIIIAAHQAAMNFSSLMYAFPLSISTALAITISFEVGAERFQDANTYSRIGRLTAVGITSGTLLFLFLFRENVAAMYNSDPHFVAITAQFLTYSLFFQFADAYAAPVQGILRGYKDTTKPFMIGAGSYWLCALPLAVILEKNSQLGPFAYWIGLITGIFVCGLFLNQRLQKIKKLYY

SEQ ID NO: 9373 - DNA, 297 bp, Streptococcus agalactiae
atgacccaaacactagaagaaatgcgttataaacttgaagaatggttggcacaaggctatacaagtccagaagatagggcaaactaccaaactttaaaggaacagtatgaagatgagacctttgattacagtttttcaaagcgtgaaattactggacagctggaactcatcatcaaaagtcgtgagaatgatttttcaaacttagatgaggtgacgaagacggaataccttgacttggttacccaacttgatgaacttgaccaggaacaagccaactattatcgtaagcaattagcc

SEQ ID NO: 9374 - protein, 99 aa, Streptococcus agalactiae
MTQTLEEMRYKLEEWLAQGYTSPEDRANYQTLKEQYEDETFDYSFSKREITGQLELIIKSRENDFSNLDEVTKTEYLDLVTQLDELDQEQANYYRKQLA

SEQ ID NO: 9375 - DNA, 171 bp, Streptococcus agalactiae
atgcaaaaggaagaacagtcatcacgtcatatcgtgaagagccatatcatgaccatcatgggagttgataatctaaaagcaactcaactggtaaatgaaatggaacaaacaggtttaatccgatttgatgaattcgggaattttggacttttagtcttggagggacaatca

SEQ ID NO: 9376 - protein, 57 aa, Streptococcus agalactiae
MQKEEQSSRHIVKSHIMTIMGVDNLKATQLVNEMEQTGLIRFDEFGNFGLLVLEGQS

SEQ ID NO: 9377 - DNA, 1374 bp, Streptococcus agalactiae
atggaaaatcatcgttatgaagatgaaggtaaattccagcgtaagatgaccagtcgtcatctctttatgttatcgctaggtggtgttatcgggactgggcttttcttgagttcaggttataccattgcacaggctggtccgcttggagctgtgctgtcttatttgattggtgccgttgtggtttatttggtcatgctatcacttggggaattggcggttgccatgccggtgacggggtcattccacacttatgccactaagtttatcagtcctggaacaggttttactgttgcttggctatattggatttgttggacggtcgccttggggactgaatttttaggtgctgccatgctgatgcagcgctggttcccaaatgtgccggcttgggcatttgcttccttttttgcccttgtgatttttggtttaaatgctcttagcgtacgcttttttgcagaagcagagtctttcttctcaagtattaaggttattgctatcattatctttattatcttgggcttaggtgctatgtttggtctagtttcctttgaaggtcagcacaaggctattctcttcactcatctgactgccaatggtgcctttccaaatggtatcgttgcagttgtctcagtcatgttggctgttaactatgccttctctggtactgagttaattggtattgcggctggtgaaacggataatcccaaagaagctgtaccaagggctattaaaacgacaatcggtcgcttggttgttttctttgtactgacaattgttgtcctagcttcgctattgccaatgaaagaggcaggcgtatccacagcaccattcgttgatgtctttgacaagatgggaatcccttttacggcggatatcatgaacttcgttatcttgacagccatcctgtctgctggtaactcaggtctctacgcatcaagccgtatgctctggtcccttgccaatgaaggtatgttgtcaaaatctgttgtgaaaatcaataaacacggtgtcccaatgcgtgctcttctcttgtcaatggcaggagcagtgctgtcgctcttttcaagtatttacgctgcagacacagtttatctagccttggtttcaatcgcgggctttgctgttgttgtcgtatggctagccattccagtcgcacaaatcaatttccgcaaggaattcttgaaagagaatcaactagaagatttgtcttacaaaacaccttttacaccagttctcccttatatcacaatcattttgctcttgatttcgattgtagggattgcttgggatagctcacaacgtgctgggctttacttcggtgttccatttattattttctgctatatttatcacaaactacgttacaagaaatgg

SEQ ID NO: 9378 - protein, 458 aa, Streptococcus agalactiae
MENHRYEDEGKFQRKMTSRHLFMLSLGGVIGTGLFLSSGYTIAQAGPLGAVLSYLIGAVVVYLVMLSLGELAVAMPVTGSFHTYATKFISPGTGFTVAWLYWICWTVALGTEFLGAAMLMQRWFPNVPAWAFASFFALVIFGLNALSVRFFAEAESFFSSIKVIAIIIFIILGLGAMFGLVSFEGQHKAILFTHLTANGAFPNGIVAVVSVMLAVNYAFSGTELIGIAAGETDNPKEAVPRAIKTTIGRLVVFFVLTIVVLASLLPMKEAGVSTAPFVDVFDKMGIPFTADIMNFVILTAILSAGNSGLYASSRMLWSLANEGMLSKSVVKINKHGVPMRALLLSMAGAVLSLFSSIYAADTVYLALVSIAGFAVVVVWLAIPVAQINFRKEFLKENQLEDLSYKTPFTPVLPYITIILLLISIVGIAWDSSQRAGLYFGVPFIIFCYIYHKLRYKKW

SEQ ID NO: 9379 - DNA, 684 bp, Streptococcus agalactiae
atgagagtattaattgcagaagatgaagaacagatgtcacgtgtccttagtacggcaattagtcaccaaggttatgttgttgatgtcgcctacgatggtcagactgctattgatttagctaatcaaaatgcatatgatgtcatggttatggatgtcatgatgcctgttaaaacaggtattgaggctgtcaaagaaattagacaatcaggaaataaatctcacattattatgctaacagccatggcagaaattgatgatagagtaacaggtctagatgctggtgcagatgattatttaacaaaacccttctctctaaaagaattattagcaaggcttcgctctatgtcccgaagattggaagatttcacacctaatgtattgtcattgggaagagtaaccttatcagtcggtgaacaagagttgcaatgtgaaaacactattcgtctagcgggtaaagaagctaaaatgttagcatttttcatgttgaaccatgataaagaattatctacacaacaacttttcgaacatgtctggggagcagataaggaccaagaagatgtagatgagggatacgtctttatctatgtttcttatttgagacaaaaattgcaggcaattggtgctaacttggagattattggtcaagaaggtagtagctataaattaagtgaaataaatggtggc

SEQ ID NO: 9380 - protein, 228 aa, Streptococcus agalactiae
MRVLIAEDEEQMSRVLSTAISHQGYVVDVAYDGQTAIDLANQNAYDVMVMDVMMPVKTGIEAVKEIRQSGNKSHIIMLTAMAEIDDRVTGLDAGADDYLTKPFSLKELLARLRSMSRRLEDFTPNVLSLGRVTLSVGEQELQCENTIRLAGKEAKMLAFFMLNHDKELSTQQLFEHVWGADKDQEDVDEGYVFIYVSYLRQKLQAIGANLEIIGQEGSSYKLSEINGG

SEQ ID NO: 9381 - DNA, 687 bp, Streptococcus agalactiae
atgcgttggttcgaatccagctaccccagtttcacatggtccgttggtcaaggggttaagacaccgccttttcacggcggtaacacgggttcgaatcccgtacggactatcgtggccagttgcattttagcggctggtttttcttttattttcaaaaatatcggagttactatggaatactttaacgttggaaaaattgtcaatacacaaggattacaaggcgaaatgcgtgtattaagcgtgactgactttgtagaagaacgctttaaaaaaggtcaagtgttagctttattcgatgaaaagaatcagtttgttatggatattgaaattgctagtcatcgtaagcagaagaattttgacattataaaattcaaaggaatgtatcatattaatgatattgaaaaatataaaggtttcacactgaaggtggcagaggatcaactgagcgaccttaaagatggtgaattttattatcatgaaattattggcttagatgtctatgaaggggaagagctgattggaaaaatcaaagaaattttacaaccaggagcaaatgacgtttgggttgtggaacgtcatggaaaacgtgatcttttattaccctatatcccgccagtagtattagaagtggacctttctaatcagcgtgttcaagttgaattgatggaaggtttagatgatgaagat

SEQ ID NO: 9382 - protein, 229 aa, Streptococcus agalactiae
MRWFESSYPSFTWSVGQGVKTPPFHGGNTGSNPVRTIVASCILAAGFSFIFKNIGVTMEYFNVGKIVNTQGLQGEMRVLSVTDFVEERFKKGQVLALFDEKNQFVMDIEIASHRKQKNFDIIKFKGMYHINDIEKYKGFTLKVAEDQLSDLKDGEFYYHEIIGLDVYEGEELIGKIKEILQPGANDVWVVERHGKRDLLLPYIPPVVLEVDLSNQRVQVELMEGLDDED

SEQ ID NO: 9383 - DNA, 1509 bp, Streptococcus agalactiae
ttgctatttgattttctcgaagaaaaaataaaactgaaagcatacctgatgaccgccttacttgatgatggagaaattaaccttgatcactttaaaacagaatatgctttgagtgaaaagattttacaaggtcttatttcggaactacaaatactttattctgatttctaccttgttgtcaaaagtagaacaatggtattgttccattacgaaacactttctaagctagagactttgcataccatttatcgagagtctaatacgttacagtttttggcatattttattgctcctcaaaatgtcagtttttctgaattcacggctaagaaattcatatccgtcgcaagtgcctaccgaataaagaaaaactgtaaactttatttggagagtgttaagttatcaatacaaaaaaataaagtgacaggtccagaatatcagattaggctgctgattgctttgttacagtatcattttggttttattatttatccttttgatgctacaagtgaggtaatgataagggattttattgaatactcgaattttaaagggtgtgactacgaccttaaagacttatctgaagaatattactatttttatattttggtgaatttagtttggaaaagaaaagaatataaagtagaaattcctcaaacagaatcctttaatcaactaaaaaaatctattctctacatggagttatccaaagcagctcaaaagagtattgctatacatcttggtatagagttgaatgaaggtttacttgattatctatatttagtgttttgtattagtgatggtcctctatttagcaatcgagatgatatcaatatcaacgaagaatttatttttgcttcttataagatatcaaagtctaaagcctttaagaatttttgtggtcgattattgggtagagaatttattgactcgcagcattttaaagatattaatgcctattttttgagacattttatttgttattgttattattttattcctgatttttattttttaaatacatcaaggctgagctattctaaggatttatatcacctattagataaaggtctggctgatatttttaaccttaaaggagggaatttaactttttcaaaacatgagacagtgctactaacaatgcaattatctaacttaatagagactttcttagctcctctttctgtatatgtaatttcatctagtaatattagattacaaacctatcaagtaatgttaaaccaatattttacatctaagatagcggaattcttttttgtaaactatcaaacgactcagatagatgaaaaattactaaaaaaagcagatatcattattgctgagagacgctatatatcttctttaaaaaatgactcaggtgtggctatacaagatatattagaaattgggatgaataataagcagtaccatgaactacttttacaagctattatcgaaaaaagggaccaaaaagtttttgaatatatttcaaaaatgaaacataaaatactt

SEQ ID NO: 9384 - protein, 503 aa, Streptococcus agalactiae
MLFDFLEEKIKLKAYLMTALLDDGEINLDHFKTEYALSEKILQGLISELQILYSDFYLVVKSRTMVLFHYETLSKLETLHTIYRESNTLQFLAYFIAPQNVSFSEFTAKKFISVASAYRIKKNCKLYLESVKLSIQKNKVTGPEYQIRLLIALLQYHFGFIIYPFDATSEVMIRDFIEYSNFKGCDYDLKDLSEEYYYFYILVNLVWKRKEYKVEIPQTESFNQLKKSILYMELSKAAQKSIAIHLGIELNEGLLDYLYLVFCISDGPLFSNRDDININEEFIFASYKISKSKAFKNFCGRLLGREFIDSQHFKDINAYFLRHFICYCYYFIPDFYFLNTSRLSYSKDLYHLLDKGLADIFNLKGGNLTFSKHETVLLTMQLSNLIETFLAPLSVYVISSSNIRLQTYQVMLNQYFTSKIAEFFFVNYQTTQIDEKLLKKADIIIAERRYISSLKNDSGVAIQDILEIGMNNKQYHELLLQAIIEKRDQKVFEYISKMKHKIL

SEQ ID NO: 9385 - DNA, 1176 bp, Streptococcus agalactiae
atggcaagaatcccttatcagaaaacacttattttttgtgtagccgttattattgctatttttattttggggttatctaaggatttagcacaatctaaagggcaaaaggttgcaaataataatactgtaaaaacagcacgtgtggttgcaaacggagatattttgctgcacgatgtactatatgccagtgcgcgccaacccgacggcacttataattttactccttattttaaagaggtaaaatcttggattgagagcgctgatttagcgattggtgattatgaagggacgattagttcagaatatcctttagcgggctatcctttatttaatgctcctaatgagattgcaactactatgaaagaaactggatatgatgtcgttgacttagcacataatcatattctggattcacaactggcaggtgctatcaatactgtcaagacttttaatcgtctgggattggatactattggggtttatttaaaggatagaaataaagaagatatcttaattaagcatgtaaatggtattaaaattgctattttaggttattcgtatggctacaatggtatggaagctaatgtttcaaagagtgactatgaaaaacatatgtctgatttagatactaaaaagattaagcaagatattaaaaaggctgaaaaagaagcagatatcaccattgtcatgccacagatggggatagaatatcaaaaaaaacctactacagaacaagtaatgctttatcatagtatgattaaatggggggcagatattatattcggaggacaccctcacgttgttgaaccgtctgaagtgataaaaaaagatggccagaaaaaatttattatttactctatgggaaattttatttcaaatcagcgtttagaaacggttgatgatatctggacagaaagaggattattaatggatgtaaccatagagaaaaaaggtcaaaaaacagtaattaaaaaagttaaggcgcatccaacactagtagaagcaaaaccaaatggccgttatgttgaagaaggctttccagcttatgattataggacgctagttttagaggattatattgaaggtggtaagaaacgttctacgattgatcagactatgaaagataaagttgataaagcatataaggagatgaatgagttagttaatttgaagtgg

SEQ ID NO: 9386 - protein, 392 aa, Streptococcus agalactiae
MARIPYQKTLIFCVAVIIAIFILGLSKDLAQSKGQKVANNNTVKTARVVANGDILLHDVLYASARQPDGTYNFTPYFKEVKSWIESADLAIGDYEGTISSEYPLAGYPLFNAPNEIATTMKETGYDVVDLAHNHILDSQLAGAINTVKTFNRLGLDTIGVYLKDRNKEDILIKHVNGIKIAILGYSYGYNGMEANVSKSDYEKHMSDLDTKKIKQDIKKAEKEADITIVMPQMGIEYQKKPTTEQVMLYHSMIKWGADIIFGGHPHVVEPSEVIKKDGQKKFIIYSMGNFISNQRLETVDDIWTERGLLMDVTIEKKGQKTVIKKVKAHPTLVEAKPNGRYVEEGFPAYDYRTLVLEDYIEGGKKRSTIDQTMKDKVDKAYKEMNELVNLKW

SEQ ID NO: 9387 - DNA, 357 bp, Streptococcus agalactiae
atggctcgtgttaaaggtggagttgtttcacgtaaacgtcgtaaacgcgtacttaaattagctaaaggttactatggtgcaaaacatatcttgttccgtactgcaaaagaacaagtaatgaattcttactactatgcataccgtgaccgtcgtcagaaaaaacgtgacttccgtaaattatggatcactcgtatcaatgcggctgctcgtatgaatggtttatcatattcacaattgatgcacggtttgaaattagctgaaatcgaagttaaccgtaaaatgcttgctgatttagcagttaacgatgcagcagctttcacagctcttgcagatgcagctaaagctaaacttggtaaa

SEQ ID NO: 9388 - protein, 119 aa, Streptococcus agalactiae
MARVKGGVVSRKRRKRVLKLAKGYYGAKHILFRTAKEQVMNSYYYAYRDRRQKKRDFRKLWITRINAAARMNGLSYSQLMHGLKLAEIEVNRKMLADLAVNDAAAFTALADAAKAKLGK

SEQ ID NO: 9389 - DNA, 522 bp, Streptococcus agalactiae
atggcgaaaaaaccatgggaaaaaaaagttgtggaaaacaatagtcatagaaaagacaaaattacaagaacgagtagaggtgtggtgtcaagtactccttggattaccgctttcttgagtgcattctttgttattgtcgttgctattttatttatagtattttatacttcaaatagaggagaagacagagcaaaagaaacttctggtttttatggtgcttcaagccaaaaagttaatagttctaaaacgaaaaaagcatctacaagtaagaaaacaacgtcatcatcaaaaactaaaactagtgataaatcaacaacatcttctagtactgtagcaagttcgagtgagacatcgacatcatcttcagtaaacggtggaacaatcgtagttcaaccaggtgagggagcagcctccatagctgctcgtgcaggtatctcagttgctcgtttacaagaacttaatcccagtcatatgacctcagggtattggtatgctaatccaggcgatcctgtggttgtaaat

SEQ ID NO: 9390 - protein, 174 aa, Streptococcus agalactiae
MAKKPWEKKVVENNSHRKDKITRTSRGVVSSTPWITAFLSAFFVIVVAILFIVFYTSNRGEDRAKETSGFYGASSQKVNSSKTKKASTSKKTTSSSKTKTSDKSTTSSSTVASSSETSTSSSVNGGTIVVQPGEGAASIAARAGISVARLQELNPSHMTSGYWYANPGDPVVVN

SEQ ID NO: 9391 - DNA, 210 bp, Streptococcus agalactiae
gtgaaaatgttacaatatcttgaggaggtgaaacatatgtcaaaaacagtagtacgtaaaaacgaatcacttgacgatgcacttcgtcgtttcaaacgttctgtgactaaagctggtactcttcaagaatcacgtaaacgtgaattctacgaaaaaccttctgtaaaacgtaaacgtaaatcagaagcagctcgcaaacgtaaaaaattc

SEQ ID NO: 9392 - protein, 70 aa, Streptococcus agalactiae
MKMLQYLEEVKHMSKTVVRKNESLDDALRRFKRSVTKAGTLQESRKREFYEKPSVKRKRKSEAARKRKKF

SEQ ID NO: 9393 - DNA, 1026 bp, Streptococcus agalactiae
atggtaactataaaagatgttgctgccaaagctggtgttaatccatcgacagtaagtcgtgtactaaaagataatgcatctatttcaagtaagacgaaagagcgcgtgaaaaaagctatggaagagctgggctatgttcctaatgttgcagcacaaatgttggctagtggtttaacgcaaaatattggagttatttttcctccactggttttaccagaccgcttaagtgaaccctttttcatggagattctttctacattaactaatgaagcaaaagagcatgagtttacagtttctattgcaacaagtatgtcttctgaggagttgttagaacaagtaaaattaatgcatctacaaaaacgagtggatggttttattgttctctattcggatcaaaaagatcctatcagagagtatttattaaaatataaactgccctttgttgttgttggtgctgctaatggctatgaaaatgagattacttatattgataatgataatcagctgatggggaaatctgccattgattatctctataaaaaaggacataaaagcatccagtttgttacagatgatttaaattcagaagtatcagaagagcgctatttagggtattttaaaggtgctagaaagttaggtttaaaccaaaagccagctcttttatttgacagaggcaatccgcaagttttagaggaatttataaatagagtcaaagaagaagaaacaactgctttaattgttattggtgatactgtctctgttagagtaatgcaatttctttctttctataaattaaaagttccagatgacatttctatcatgacctttaataattctctcttctcacatctgattcatccttacctaagcacatttgatattaatgttaataatctaggaaggacaagcgttcgtcgtctgattgacatcattaaatctccagacaaagtctttagtgagactattattgtgccttttactttagaagagcgtgaaagtgtccgagatatttctaaaaataataat

SEQ ID NO: 9394 - protein, 342 aa, Streptococcus agalactiae
MVTIKDVAAKAGVNPSTVSRVLKDNASISSKTKERVKKAMEELGYVPNVAAQMLASGLTQNIGVIFPPLVLPDRLSEPFFMEILSTLTNEAKEHEFTVSIATSMSSEELLEQVKLMHLQKRVDGFIVLYSDQKDPIREYLLKYKLPFVVVGAANGYENEITYIDNDNQLMGKSAIDYLYKKGHKSIQFVTDDLNSEVSEERYLGYFKGARKLGLNQKPALLFDRGNPQVLEEFINRVKEEETTALIVIGDTVSVRVMQFLSFYKLKVPDDISIMTFNNSLFSHLIHPYLSTFDINVNNLGRTSVRRLIDIIKSPDKVFSETIIVPFTLEERESVRDISKNNN

SEQ ID NO: 9395 - DNA, 1470 bp, Streptococcus agalactiae
atggaaaaaacaaaatcattctttggacatcctcgtggtttgtccactcttttctttactgaaatgtgggaaagattctcatactatggtatgcgtgctattttgctgtactatatgtactatagtgtttctcaaggtggccttggtatggacaagactgtcgctgcatcaatcatggctgtctatggttcactggtttatctctcatcagtaattggtggttttgtcagcgaccgtattctaggtagtcgtaaaactgttctgtatggtggtattctaatcatgctaggtcatattgctctagctacaccatttggtcaaacagctctattcatttcgattgctctaattatccttggtactggactattaaaaccaaatgtatcagagatggttggtaatttatatggagaaaatgattctcgtcgtgatgctggttttagtatctttgtttttggtattaaccttggtgcttttatttcacccattgtagtggggtacctcggacaagaagtaaatttccatcttggtttctcacttgctgctattggtatgttctttggtctcctccaatataccttagatggaaaaaaatatttgactgaagagagtctcagaccaaacgatcctttaagtcctgaagaaaagtcctctctatataaaaaagttgggcttatccttattggtattgttattgtacttattctacttcacttgatgcatatgctaacaattgaagtaattatcgatatttttagtattattgcaatcgccatcccaattatttattttatcaagattttaagtagtaaaaagatttcttctgttgagcgttctcgagtgtgggcatatatccctctctttatcgcctcaattctattttggtcaattgaagaacaaggttcagttgtcttagccttatttgcagatgaacaaacaaaactttaccttaacttctttgggcatcatattaatttcccatcaagttatttccaaagtatgaaccctctcttcattatgctttatgtaccattctttgcttggttatgggctaaatggggaagtaagcaaccttcatcacctaaaaaatttgcgtatggacttttctttgctggagcttcattcttatggatgatgctaccaggtttactctttggagttaacgctaaagtaagccctctttggttaacaatgagttgggctattgtcatcgttggggaaatgctaatctcaccagttggattatcagcaactagtaagctcgcacctaaagcattccaagctcaaatgatgagcatctggttcttaagtaatgctgcagcacaagctattaacgctcaaatcgttaaattgtacacacctgatactcaaactctttattatggtgttgttggtggtataacagttgtatttggatttatcctcttattttatgttccacgcattgaaaaactaatgtctggagttaaa

SEQ ID NO: 9396 - protein, 490 aa, Streptococcus agalactiae
MEKTKSFFGHPRGLSTLFFTEMWERFSYYGMRAILLYYMYYSVSQGGLGMDKTVAASIMAVYGSLVYLSSVIGGFVSDRILGSRKTVLYGGILIMLGHIALATPFGQTALFISIALIILGTGLLKPNVSEMVGNLYGENDSRRDAGFSIFVFGINLGAFISPIVVGYLGQEVNFHLGFSLAAIGMFFGLLQYTLDGKKYLTEESLRPNDPLSPEEKSSLYKKVGLILIGIVIVLILLHLMHMLTIEVIIDIFSIIAIAIPIIYFIKILSSKKISSVERSRVWAYIPLFIASILFWSIEEQGSVVLALFADEQTKLYLNFFGHHINFPSSYFQSMNPLFIMLYVPFFAWLWAKWGSKQPSSPKKFAYGLFFAGASFLWMMLPGLLFGVNAKVSPLWLTMSWAIVIVGEMLISPVGLSATSKLAPKAFQAQMMSIWFLSNAAAQAINAQIVKLYTPDTQTLYYGVVGGITVVFGFILLFYVPRIEKLMSGVK

SEQ ID NO: 9397 - DNA, 1386 bp, Streptococcus agalactiae
atgtcaaaaaataataatgaccacactcaaaaatctgagaatggtatggtacgcggcctagaaaatcgtcacgtacagttaattgcgattgcagggacaatcggaactgggctttttcttggtgcaggtcgttcaattagcctgacgggtccttcaatagttcttgtctatgctatcactggcgctttcatgttcttcatgatgcgtgctattggagagatgctttatcaagatccaaatcagcatacttttattaatttcattaccaaatatttaggacccggttggggatttttctcaacactttcttattggatttccctaatatttatcggtatggcagagattacagccgtaggagagtatgttcaattttggttccctgaatggccatcctggattatccaaattgtttttttagctatcctaagttctatcaacttaattgctgtaaaagcattcggagaaaccgagttttggtttgctatgataaaagttattgcaattcttggtttaatagcaaccggtatctttatggtattgacaaactttgacaccggtcacggataccatgcttcaatctcaaatatcaccaatcattttgaatggttccctaaaggtaaattgaatttcttcatggctttccaaatggtattctttgcttatttagctattgaatttgtcggagtaacaacttctgaaacagctaatccacgtaaagttttaccaaaagcaatccaagaaattccgatgcgtattattttattctacgcaggttcattattagcaattatggccatcttcccatggcaacagttaccagttaatgagtcacctttcgttacagtattcaaactagctgggattaagtgggctgccgctttgattaactttgttgtcctaacgtctgcagcatctgctcttaattctactttgtactcaacagggcgtcatttattccaattggctaatgaatcaccaaatgctcttacaaaagcgttaaaattagaccaattatctcgtcaaagcgttccaagtcgagctattattgcatcagctgtaatcgttggagcttcagcacttatcagtgttttacctggtatttcagatgccttctccttaattactgcatcatcttctggtgtttacatttctatctatgttcttattatgattgcacattggaaatatcgtaaatcacctgattttatggaagatggttataaaatgcctgcctacaaaatcctttcaccaatcacacttctcttcttcctctttgtattcgtttctctcttcttgcaagattcaacatacatcggggctattggagcaaccatctggattattggatttggtttatatagtcacttcaaacataaatcacat

SEQ ID NO: 9398 - protein, 462 aa, Streptococcus agalactiae
MSKNNNDHTQKSENGMVRGLENRHVQLIAIAGTIGTGLFLGAGRSISLTGPSIVLVYAITGAFMFFMMRAIGEMLYQDPNQHTFINFITKYLGPGWGFFSTLSYWISLIFIGMAEITAVGEYVQFWFPEWPSWIIQIVFLAILSSINLIAVKAFGETEFWFAMIKVIAILGLIATGIFMVLTNFDTGHGYHASISNITNHFEWFPKGKLNFFMAFQMVFFAYLAIEFVGVTTSETANPRKVLPKAIQEIPMRIILFYAGSLLAIMAIFPWQQLPVNESPFVTVFKLAGIKWAAALINFVVLTSAASALNSTLYSTGRHLFQLANESPNALTKALKLDQLSRQSVPSRAIIASAVIVGASALISVLPGISDAFSLITASSSGVYISIYVLIMIAHWKYRKSPDFMEDGYKMPAYKILSPITLLFFLFVFVSLFLQDSTYIGAIGATIWIIGFGLYSHFKHKSH

SEQ ID NO: 9399 - DNA, 2403 bp, Streptococcus agalactiae
atgaaagaaaaaattataaaatatttggaagaacacggtaaaaccagcgttaatgatttagctgctgccctagatatggcaggcgcaaaagcatttccaaaattaatcaaaacaatctcaaatttggagagccacaggcaattaagatttgacgataatggaagtctttctcttcaaaagaaagaagctaagaaaaaggaaatcacagtaaggggtctttttagagcaaataaagcaggatttggttttcttagtattgaccaagacgaagatgatatgtttatcggaaaaaacgatattgcttatgctattgatggtgacacggtagaagctgttgtaaagaaaccagcggaccgtcttaacgggactgcagcagaagcgcgtgttgttaatattgttgaacgtagtttaaagacgcttgttggtaagtttgtcttagacgatgagcgccctaaatacgcaggatatatcaaatcgaaaaatcaaaaaatcaatcaaaagatttatatacgcaaagaaccggtcgttttagacggaacagaaattatcaaagtagatattgataaatatccgacacgaggacatgattacttcgtagcaagtgttcgtgatatcgttggacatcaaggagatgttggtattgatgttttagaagtcttggaaagtatggatatcgtctcagaatttcctgaggacgttattgcagaagccaatgctatcccagatgctccaacggagaaagatttaattgggcgtgttgatttacgtcaagaggtcactttcactattgatggagcggacgccaaagatttagacgatgctgtgcatattaaattactggataatggtcattttgaacttggagttcatatcgcagatgtatcatactacgttactgaaggctctgccttaaatcgtgaagcacttagtcgtggtacgtccgtatatgtcacagatcgcgttgtaccaatgttaccagagcgtctatctaacggtatatgttcattaaatccaaatcttgatcgtttaacgcagtcttgtattatggaaattgaccaaaatgggagagttgttaatcatcaaattacacagtcagtgattaataccacttatcgtatgacttataccgctgtaaatgatattattgctggcgatgaggaaatctgctcagaatatgagtctattgtgtcctcagtacagcatatggtcactttacaccatactttggaagctatgcgtacgcgtcgtggagcgctgaattttgacacatctgaagcaaaaattatggttaatgataagggaatgccagttgatattgttattcgcaacagaggcattgctgaacgcatgattgagtcatttatgttggcggcaaatgaaacggttgctgaacattatgctcgtctaaaactgccatttatttatcgtatacacgaagagcctaaagctgaaaaattacaaaaattcatcgattatgcttctgttttcggtgttcagattcaaggaacagcaactaaaatcacccaatctgctttacaggactttatgaaaaaagtacaagggcagccaggaagtgaagtgttatctatgatgttattgcgctcgatgcaacaagctagatattctgaacacaaccatggacattatggacttgctgcggaatattacactcactttactagccccattcgacgttatccagacttgttagttcatcgtatgattcgtgattatgatgataaagcgatggataaagctgatcattttgctaaccttatcccagaaattgcaactcaaacgtctagtcttgagagacgtgccattgatgctgaacgtattgtagaggcaatgaagaaagccgaatatatggaagaatatgttggtgaggaatttgaaggtgtggttgcaagcgttgttaaatttggtatgtttgtagaattaccaaatactattgaaggattgattcacgtaacgaccttgcctgaatattatcactttaatgaacgtacgctgacgcttcaaggtgagaaatctgggaaagttttccgtgttggtcaacaaattaaggttaagttgattcgttctgataaggaaactggtgatatcgattttgattatttaccatcagattttgatattgttgaaaaggtaagtaaaagttcgcgtgagggtcgtcctaatagaagttctaaacgagaacatcagcatagaatttctgatcgtgataataagaataaaaatacatctaagaaaaaagcatctcgaaaacccaaaaggaactcggatagcaaatcacatcatcataaagacgatagaacaacaggttcaaccaagaaaaaaacgaaaaaacctttctataaaggcgttgctaagaaaggtcagaaacggaaatctaagaaaggt

SEQ ID NO: 9400 - protein, 801 aa, Streptococcus agalactiae
MKEKIIKYLEEHGKTSVNDLAAALDMAGAKAFPKLIKTISNLESHRQLRFDDNGSLSLQKKEAKKKEITVRGLFRANKAGFGFLSIDQDEDDMFIGKNDIAYAIDGDTVEAVVKKPADRLNGTAAEARVVNIVERSLKTLVGKFVLDDERPKYAGYIKSKNQKINQKIYIRKEPVVLDGTEIIKVDIDKYPTRGHDYFVASVRDIVGHQGDVGIDVLEVLESMDIVSEFPEDVIAEANAIPDAPTEKDLIGRVDLRQEVTFTIDGADAKDLDDAVHIKLLDNGHFELGVHIADVSYYVTEGSALNREALSRGTSVYVTDRVVPMLPERLSNGICSLNPNLDRLTQSCIMEIDQNGRVVNHQITQSVINTTYRMTYTAVNDIIAGDEEICSEYESIVSSVQHMVTLHHTLEAMRTRRGALNFDTSEAKIMVNDKGMPVDIVIRNRGIAERMIESFMLAANETVAEHYARLKLPFIYRIHEEPKAEKLQKFIDYASVFGVQIQGTATKITQSALQDFMKKVQGQPGSEVLSMMLLRSMQQARYSEHNHGHYGLAAEYYTHFTSPIRRYPDLLVHRMIRDYDDKAMDKADHFANLIPEIATQTSSLERRAIDAERIVEAMKKAEYMEEYVGEEFEGVVASVVKFGMFVELPNTIEGLIHVTTLPEYYHFNERTLTLQGEKSGKVFRVGQQIKVKLIRSDKETGDIDFDYLPSDFDIVEKVSKSSREGRPNRSSKREHQHRISDRDNKNKNTSKKKASRKPKRNSDSKSHHHKDDRTTGSTKKKTKKPFYKGVAKKGQKRKSKKG

SEQ ID NO: 9401 - DNA, 1167 bp, Streptococcus agalactiae
gtggcttggctcggtaatttttttactggggcaagcttttcacttgttatgccttttatggtattatatgtagaacaattaggagcacctagcaacaaagtagagtggtatgcaggcctatcagtatccttatcagccttgtcttcagctttagttgccccattatgggggcgcttagctgataaatatggtagaaaaccgatgatggtaagagcagggttgatgatgacttttactatgggaggtcttgctttcattcatagtgttacaggacttctgattttacgtatattaaacggcatttttgcaggctatgtacctaactctacagctttgatagcaagtcaagctcctcaagaggaatcaggatatgccttaggaaccttagcgacaggagtgactggaggtatgttaattggtccacttttagggggacttttagcagagtggtttggtattagggaagtttttttattagtgggaaccatattgttaatatctactttaatgaccatttttatggtaaaggaagatttcaaacccatttctaacgaagaaaccatgccaactacagaagtgttcaaaagcgttaaaagcttacaaattttaatagggctgtttgtaacaagcatgattattcaaatttctgcacaatcaattgcacctattttaacactttacattcgtcatttaggacagactgaaaacttgatgtttgtttccggattaattgtttctggtatgggattctctagtattctgagtagtccaaagctaggaagaatcggggatcgcataggcaatcatcgtttgctattattagctctactgtatagtttcctcatgtatgtcttatgttcattggcacagacttcattacagctaggggttattagattcctgtatggttttggaacaggtgccttgatgccgagtattaattcaatcttgactaaaattgctccaagacaaggtttatcaaggattttcagttataaccaaatgtttagcaatttaggacaagtattaggtccttttgtcggttcagcagtttctattcatttaggattccgatgggttttctttgtgactagcttcatcgttttagctaattttgtttggtgttttattaattttagaaaatatattagagttaaggaaattgtg

SEQ ID NO: 9402 - protein, 389 aa, Streptococcus agalactiae
MAWLGNFFTGASFSLVMPFMVLYVEQLGAPSNKVEWYAGLSVSLSALSSALVAPLWGRLADKYGRKPMMVRAGLMMTFTMGGLAFIHSVTGLLILRILNGIFAGYVPNSTALIASQAPQEESGYALGTLATGVTGGMLIGPLLGGLLAEWFGIREVFLLVGTILLISTLMTIFMVKEDFKPISNEETMPTTEVFKSVKSLQILIGLFVTSMIIQISAQSIAPILTLYIRHLGQTENLMFVSGLIVSGMGFSSILSSPKLGRIGDRIGNHRLLLLALLYSFLMYVLCSLAQTSLQLGVIRFLYGFGTGALMPSINSILTKIAPRQGLSRIFSYNQMFSNLGQVLGPFVGSAVSIHLGFRWVFFVTSFIVLANFVWCFINFRKYIRVKEIV

SEQ ID NO: 9403 - DNA, 924 bp, Streptococcus agalactiae
atgaaaaagtggttagttattgtatcatgttttgtagcatttttaggcttaggtgcctgtgctaacaagcaggatcaagccaaaaacgaaaaattaaaagtagttgtaaccaactctattttggcagatataacaaaaaatatagccggtaacaaaatcgacttacatagtattgtacctgttggtaaagatcctcatgaatatgagccattaccagcagacgttgaaaaaacaactcaagcagaccttgttttttacaacggaattaatcttgaaacaggcggtaatgcttggtttacaaaattaataaagaacgctaagaagaaagaaaacaaagattactttgcggttagcgatggagttgatgttatttatctaaatggtcaaagcggaaaaggtaaagaagacccacatgcttggttgaaccttgaaaatggtattatttactcaaaaaatattgctaagcaattaattgctaaagatccaaaaaacaaagctacttatgagaaaaacagagatgcttatgtagctaaattagaaaaattggataaagaagcaaaatctaaatttaatgccattccagctaataaaaaattaattgttactagtgaaggttgctttaaatatttctcaaaagcttatggagttccatcagcatacatctgggaaattaacactgaagaagaaggtacaccagatcaaattactagcttagttaagaaattaaaacaagtaagaccttcagctttattcgttgaatcaagtgttgacaagcgtcctatgaaatctgtttcaagagaatcaggtatcccaatttacgcagaaatcttcacagactcaattgctaaaaaaggtcaaaagggtgacagctactacgctatgatgaaatggaatcttgataagattgcagaaggtttagcaaaa

SEQ ID NO: 9404 - protein, 308 aa, Streptococcus agalactiae
MKKWLVIVSCFVAFLGLGACANKQDQAKNEKLKVVVTNSILADITKNIAGNKIDLHSIVPVGKDPHEYEPLPADVEKTTQADLVFYNGINLETGGNAWFTKLIKNAKKKENKDYFAVSDGVDVIYLNGQSGKGKEDPHAWLNLENGIIYSKNIAKQLIAKDPKNKATYEKNRDAYVAKLEKLDKEAKSKFNAIPANKKLIVTSEGCFKYFSKAYGVPSAYIWEINTEEEGTPDQITSLVKKLKQVRPSALFVESSVDKRPMKSVSRESGIPIYAEIFTDSIAKKGQKGDSYYAMMKWNLDKIAEGLAK

SEQ ID NO: 9405 - DNA, 645 bp, Streptococcus agalactiae
atgactccaaataaagcagattacctaaaatgcattcatgaattaggtgaaaaaaacaacaaaatttccaataagaaaatcgctgaaatgatgcaagtctcggctcctgccgtgtcagaaatgattaaaaaaatgataagtgaacaactgattgttaaagataaagatttaggatattatcttaccaaacaaggtttattagttgtttctgacctttaccgtaaacatcgtctagtagaggtatttttagttaaccatttgcactatactgctgatgatattcatgaagaagcggaagttttagaacatactgtatcaacaacttttgttgatcaattagaaaagttgttagactttccacaattttgtccacacggtgggactattcctaaaaagggagagtttttagtagaaattaaccaaatgacattggaccaaattagtcagcttggcacatatgttatcagtcgtgttcatgatgattttcagctactgaaatacctagaacaacaccgtttgcatatcaacgataccattgaattgacacaaattgacccttatgcaaaaacttatcacatcacctataacgatgaaaatctaacaatccctgagcgtatcgcaagtcaaatatatgtatctgctaca

SEQ ID NO: 9406 - protein, 215 aa, Streptococcus agalactiae
MTPNKADYLKCIHELGEKNNKISNKKIAEMMQVSAPAVSEMIKKMISEQLIVKDKDLGYYLTKQGLLVVSDLYRKHRLVEVFLVNHLHYTADDIHEEAEVLEHTVSTTFVDQLEKLLDFPQFCPHGGTIPKKGEFLVEINQMTLDQISQLGTYVISRVHDDFQLLKYLEQHRLHINDTIELTQIDPYAKTYHITYNDENLTIPERIASQIYVSAT

SEQ ID NO: 9407 - DNA, 1341 bp, Streptococcus agalactiae
ttgcttatggtaaaaaaaggctttttaacgggattactcttatttggtatcttctttggtgcagggaacctcatttttccaccagcattaggtgtagcatctggacaagatttctggccagcgattttaggattttgtttgtcaggagttggattagctattattaccctcctactaggcacactaactaatggtggttataagacagagatgtcggaaaaatttagtccgtggttttctttaacatttttagttatactctacctaactattggtccactttttgctattcctagaacagcaacggtttcttttgaaattggggttgctccaattgtagggcatagtccgattgctcttttgtgttttacagcctgtttttttgctgcagcttattatctcgctattagaccaaatggtatattagatagtgttggaaaaatcttaacgcctgtttttgcctttttaattctctctttggttgttgttggagctattgcttatggaaacttggagagtgctaaggcgagtgctgactatgcaggaaaagcgtttggaagtggtgtcttagcaggctataatacacttgatgcacttgcagcagttgctttttgtctagtagcaacagaaacgcttaaaaagtttggttttaaaactaaaaaagaatatttatcaaccatttggattgttggaattgttactagtttagcatttagtattttatatattggcttaggttttttagggaataagtttcctgtcccagctgatattttagctgacccaaatgttaataaaggagcttatgtattatcacaagcatcttataaattatttggaaattttggtcgttatttcttgagtattatggtaacattgacatgctttacaacaacagttgggcttattgtgtcagtatctgaattttttgataagaactttcgttttgggaattataaattatttgctactgtttttactttgattggctttttaattgctaatcttggtttaaatgctgtaattactttttcagttcctgtgctaactttattgtatccgattgttattgttattgtcttaattattttgattaataagtggttgccgctttcaaaaaagggaatgtctttgacaattggtcttgtcactttagtgtcgtttgttgaggttctagcgggacaatggcaagaaaaaacattaactcagttagttggattcctcccctttcatactatttcaatggggtggctagttccaatgttgattggtatagtattttctttggtgctgtcagataaacaaaaaggccaagcatttgatttagagaaatttgaagga

SEQ ID NO: 9408 - protein, 447 aa, Streptococcus agalactiae
MLMVKKGFLTGLLLFGIFFGAGNLIFPPALGVASGQDFWPAILGFCLSGVGLAIITLLLGTLTNGGYKTEMSEKFSPWFSLTFLVILYLTIGPLFAIPRTATVSFEIGVAPIVGHSPIALLCFTACFFAAAYYLAIRPNGILDSVGKILTPVFAFLILSLVVVGAIAYGNLESAKASADYAGKAFGSGVLAGYNTLDALAAVAFCLVATETLKKFGFKTKKEYLSTIWIVGIVTSLAFSILYIGLGFLGNKFPVPADILADPNVNKGAYVLSQASYKLFGNFGRYFLSIMVTLTCFTTTVGLIVSVSEFFDKNFRFGNYKLFATVFTLIGFLIANLGLNAVITFSVPVLTLLYPIVIVIVLIILINKWLPLSKKGMSLTIGLVTLVSFVEVLAGQWQEKTLTQLVGFLPFHTISMGWLVPMLIGIVFSLVLSDKQKGQAFDLEKFEG

SEQ ID NO: 9409 - DNA, 1164 bp, Streptococcus agalactiae
atggaaaagagacttagtttaggagcgcttgttttagctagtacagttcttttagcagcatgtggaaatgtcggaggaggagcatcttcgacaggaacaaaaatagggaaagatattaaggtagggtataactgggaattatcaggaaacgtttcttcgtatggaaattcaatgaagaatggagctgacttagcagtaaaagaaattaatgctgctggaggggttggcggcaagaagttaaaagtcctatcacaggataataaatcagaaaatgcagaggcagcaacggttgccacaaacttggttaccaaaggagctaatgtcattatcggaccagcaacatcgggtgcagctgcatcttcaactccaaaagtaaatgcagcagcagttccaatgattgcacctgctgcgacacaagacaatttagtctatggttctgatggaaaaaccttaaatcagtatttcttccgagctacttttgtcgataattatcaaggaaagctattgtctcagtatgctacagacaaccttaaagctaaaaaagttgttctattttatgataattcatcagattactcaaagggggtagcaaaatcatttaaggaaagttatagtggaaaaattgttgatagtatgacattctccgctggtgatactgatttccaagcgtcattgactaagttgaaagggaaagaatatgatgctattgtgatgccaggttactataccgagacaggattaatagttaagcaagcgcgtgatttaggtatctctaaaccggttcttgggcctgatggttttgatagtccgaaatttgtgcaatcggcaacacctgtaggagcttcaaacgtttattatttgacaggtttcactacacaaggatcaaccaaagctaaagctttccatgatcattacgttaaggcatatggtgaagaaccatccatgttctcggctttatcatacgacgctgtgtatatggcagctaaatctgctaaaggagctaaaacttcaattgatattaaaaaagctttagctaagctgaaagattttaaaggtgtgacagggaaaatgtctattgataaaaatcacaatgttgttaaatcagcttacgttgtcaaattagaggatggaaaaacaagtagcgttaacattatttcagcaaaa

SEQ ID NO: 9410 - protein, 388 aa, Streptococcus agalactiae
MEKRLSLGALVLASTVLLAACGNVGGGASSTGTKIGKDIKVGYNWELSGNVSSYGNSMKNGADLAVKEINAAGGVGGKKLKVLSQDNKSENAEAATVATNLVTKGANVIIGPATSGAAASSTPKVNAAAVPMIAPAATQDNLVYGSDGKTLNQYFFRATFVDNYQGKLLSQYATDNLKAKKVVLFYDNSSDYSKGVAKSFKESYSGKIVDSMTFSAGDTDFQASLTKLKGKEYDAIVMPGYYTETGLIVKQARDLGISKPVLGPDGFDSPKFVQSATPVGASNVYYLTGFTTQGSTKAKAFHDHYVKAYGEEPSMFSALSYDAVYMAAKSAKGAKTSIDIKKALAKLKDFKGVTGKMSIDKNHNVVKSAYVVKLEDGKTSSVNIISAK

SEQ ID NO: 9411 - DNA, 1350 bp, Streptococcus agalactiae
atggagaatcataattctattaaacagacctatggattaatgactacaattgctatgattgtaggtgtagtgattggttcaggcatttattttaaagttgatgacatccttaaatttactggtggagatgtctttttaggcatggtaattttagtactaggttctttttcgattgtttttggaagtttgtcaatttctgagctagctattagaacgagtgaaagtggtggtattttttcttactacgaaaaatatgttagcccagctttagcagcaactttaggcttgtttgcgtcttttttgtatcttccaactttaacagcaatcgtttcatgggtagctgcattttatactttaggtgaatcatcaagtttggaatcacagattattttagctgctgtttatattttagcgcttagtctcatgaatatctttgctaagcgtattgcagggggattccaatctttaacgacctttgtaaaaatgattcctttagttctaattgctttaattggtgctttttggtctgataaagctccacaacttccacaacatttaacagctattcaaccgtcaaatgttggatggagttgggtgtcaggtctggtaccattgtattttgcatatgatggttggacaatttttgttaatattgcaccagaagtcaagaatcccaagaagaatttaccacttgcctttgtcattggtccagcgcttatcttattatcatatttggcatttttctatggtttgacacaaattttaggtgctagctttattatgacaaccggtaatgatgctattaattatgcagctaatattattttcggtcctagtgttgggcgtttattatctttcattgttattctatctgtattaggtgttgccaatggacttttacttgggacgatgcgtctacctcaagcttttgcggaacgcggatggatcaaaagtgagaggatggctaacataaatttgaagtatcaaatgtcattgccagctagtttgacggtgacggctgtagctattttttggctttttgttcattttatggttacaaaatttaacttattgccgggtagtgatattagtgaaattgctgtggtgtttaataataccagtttaatcattctttatgttttagtactcagcctttatctcaaaaaagatattaaaaataaatttaccggcttagtttcaccgattctagcaattttaggcggtttgatcctccttatcgggagtttgttaagtaatttctttacggttttaattttccaatgtttttgcttattattctgtttgatttgtcattatatctatcaaaaaaataacccaaaaactcatgaa

SEQ ID NO: 9412 - protein, 450 aa, Streptococcus agalactiae
MENHNSIKQTYGLMTTIAMIVGVVIGSGIYFKVDDILKFTGGDVFLGMVILVLGSFSIVFGSLSISELAIRTSESGGIFSYYEKYVSPALAATLGLFASFLYLPTLTAIVSWVAAFYTLGESSSLESQIILAAVYILALSLMNIFAKRIAGGFQSLTTFVKMIPLVLIALIGAFWSDKAPQLPQHLTAIQPSNVGWSWVSGLVPLYFAYDGWTIFVNIAPEVKNPKKNLPLAFVIGPALILLSYLAFFYGLTQILGASFIMTTGNDAINYAANIIFGPSVGRLLSFIVILSVLGVANGLLLGTMRLPQAFAERGWIKSERMANINLKYQMSLPASLTVTAVAIFWLFVHFMVTKFNLLPGSDISEIAVVFNNTSLIILYVLVLSLYLKKDIKNKFTGLVSPILAILGGLILLIGSLLSNFFTVLIFQCFCLLFCLICHYIYQKNNPKTHE

SEQ ID NO: 9413 - DNA, 741 bp, Streptococcus agalactiae
atgactactattataacttcaaaatcaaataatctcattaaaaaaacgaaaaagttgttacaaaaaaaatatcggaaatcttcatatcttattgaaggctggcatttatttgaggaagctgaaaaatatggtgcacaatttttaaatatttttgtgacagaaacggcaatagatcgtttgagaaaacccgagagagctattgttgttacagatgatgttttgaaagaattaactgactcacagactcctcaagggattgtagctgagattgcctttcaagagacaagatggacagatattaaaaaaggacgttttcttgtattagaagatgtgcaggatccaggaaacctaggaacaatggttcgaactgcagatgcagcgaattttgatgctgtttttttatctcagaaatctgctgatttgtataaccaaaaaacacttcgttctatgcaaggcagtcactttcatttaccagtatttagggtagaaatagagcagtttgttaacttttgtaaagcagaagggataactatgattgcgacaactttatctgaacaatcggtaaattataagaatctccctaaatatgattattttgctttaatcatgggaaatgagggacagggaatttccaaaactatgacagaagaagcagatgttttagcacatattgaaatgcctggacaagcagaaagtcttaatgtagcagtagctgcgggagtagtcattttcagcttaatt

SEQ ID NO: 9414 - protein, 247 aa, Streptococcus agalactiae
MTTIITSKSNNLIKKTKKLLQKKYRKSSYLIEGWHLFEEAEKYGAQFLNIFVTETAIDRLRKPERAIVVTDDVLKELTDSQTPQGIVAEIAFQETRWTDIKKGRFLVLEDVQDPGNLGTMVRTADAANFDAVFLSQKSADLYNQKTLRSMQGSHFHLPVFRVEIEQFVNFCKAEGITMIATTLSEQSVNYKNLPKYDYFALIMGNEGQGISKTMTEEADVLAHIEMPGQAESLNVAVAAGVVIFSLI

SEQ ID NO: 9415 - DNA, 1206 bp, Streptococcus agalactiae
atgaaacgatttttaaaagcttggagaaaaacaagcttgataaaaaaaataacaattggagtcgttattggcttattcttgggtattttagtccctaaagcctctgcgattggtttacttggtcaactttttgtaggagggttgaaagctattgcccctcttttagttttcactttagttattagtgccttgtcgcaacaccgtgagggcggtaagaccaatatgtcaacgataattggtttgtatatcactgcaacttttgcagcggccctaatcgctgttgttgtgaactatattttccctttgacactgatattgaaaacgccagcaaagacagacttattacctcccaaggggatttcagaagtctttcaatctcttttgttgaaaattgttgataatcccattcatgccattaccgaggccaattatatgagtattctattttgggcggttatttttggtttggcgatgcgaagcagtaatcagcgtacaaaagatttaatgcaaacttttgctgatgctacttcacaagttgtcaaatggattatcaatttggccccaattggtattatggggttggttttcactagcatttcagaaaacggtattggtatactaggtgattatggtcttttaatattagttttggtgggtacgatgttatttgtagctcttgtcgttaacccaatcattgcttttgttatgatgcgtaaaaatccttaccctttggtattacgatgcttaaaggattcaggtattacagctttctttacacgtagttctgcggcgaatattcctgttaatatgagactatgtgaggatttaggattagataaagacacttactcagtatctatcccgcttggtgcagctatcaatatggctggtgcagctattacaattaatatcctgactttagcagcagtaaatactttaggaattactgttgattttccaacagcattcttattaagtgtggttgctgctgtatcagcatgtggagcttctggtgtaactggtggttcacttttattgattccggtggcatgtagcttatttggtatttcaaatgacgttgcaatgcaagtcgtaggagttggtttcattgtaggggtgatacaggattcgtgtgagacagccttaaattcatcgacagacgttctgttcacggctgtagctgaaaaatcagtttttggaaaaaaa

SEQ ID NO: 9416 - protein, 402 aa, Streptococcus agalactiae
MKRFLKAWRKTSLIKKITIGVVIGLFLGILVPKASAIGLLGQLFVGGLKAIAPLLVFTLVISALSQHREGGKTNMSTIIGLYITATFAAALIAVVVNYIFPLTLILKTPAKTDLLPPKGISEVFQSLLLKIVDNPIHAITEANYMSILFWAVIFGLAMRSSNQRTKDLMQTFADATSQVVKWIINLAPIGIMGLVFTSISENGIGILGDYGLLILVLVGTMLFVALVVNPIIAFVMMRKNPYPLVLRCLKDSGITAFFTRSSAANIPVNMRLCEDLGLDKDTYSVSIPLGAAINMAGAAITINILTLAAVNTLGITVDFPTAFLLSVVAAVSACGASGVTGGSLLLIPVACSLFGISNDVAMQVVGVGFIVGVIQDSCETALNSSTDVLFTAVAEKSVFGKK

SEQ ID NO: 9417 - DNA, 1368 bp, Streptococcus agalactiae
ttgatgaaactaaaaaacacttatatcattatcggcttgatgctttttgcgctgttctttggagccggtaatcttatttatccagcctacttaggtatctactctggttctaattgggcgtgggctatcattgggttctgcttaacaggcgtaactttacccctacttggtgttgcagctgtggcgtactcaggagcaaccgatgttgaaagcttcaccaaacctgtctctaaaacatatgctattttctttgcagtagcactatacctatctattggacctttctttgccattcctcgaacaggggcaacctcattctcagttggtattcaacctatcttaggcgacagctccttagtcaaaattatctatggtttaattttctttggtatttcttatttcttagctattagacctagtcagattgtagatcgtattggtaaatatctaactccctttttactaactgttattagtattttaattattgcctcactcatccatccagctgctatcgttggaacaccacataacgcttcaacgaatgtcagcgatgctttcaaggatttaccattcctagcaggactgattcaggggtatggtacaatggatgcccttgcatcaattgcttttgctattatcgttattcaagcaagtaaacagtacggagcaattaccaaaaaagaaattacttctatggcacttaaatctggtgctatcgctacatttcttttagcttttatttatatttttgtaggacgtattggtgcaacttcacaaagcttgtttaaatttgcaaatggttccttcttacttcacaatactccaatagacggtgggcatgttcttagtcaatcagctaacttctatttaggaattgtgggacaagctattttaggtacggctatttttcttgcttgcttaacaacagctactggattaatcactgcttgtgcggaatacttccacaaattacttccaaagattagtcacattacttgggctacaatctttactttaattgctattacgttctattttggtggtttatcagagattatccgttggtcactaccagttctctaccttctctatccattaactatagtcttaattttcttagtcttttttgatcaaaaatttgaaagtagccgcattgtctaccaaacttctattgccgccactgctgtcgctgctttatacgatgccttatcaaaactcggcgaaatgactggtttatttaccattccatccgctttgaccacattctttactaaagttgttcctttaggtgaatattctatgggatggattagttttgcaatttgtggtgtcttagttggtcttattctaaaaaaagtaaaagca

SEQ ID NO: 9418 - protein, 456 aa, Streptococcus agalactiae
MMKLKNTYIIIGLMLFALFFGAGNLIYPAYLGIYSGSNWAWAIIGFCLTGVTLPLLGVAAVAYSGATDVESFTKPVSKTYAIFFAVALYLSIGPFFAIPRTGATSFSVGIQPILGDSSLVKIIYGLIFFGISYFLAIRPSQIVDRIGKYLTPFLLTVISILIIASLIHPAAIVGTPHNASTNVSDAFKDLPFLAGLIQGYGTMDALASIAFAIIVIQASKQYGAITKKEITSMALKSGAIATFLLAFIYIFVGRIGATSQSLFKFANGSFLLHNTPIDGGHVLSQSANFYLGIVGQAILGTAIFLACLTTATGLITACAEYFHKLLPKISHITWATIFTLIAITFYFGGLSEIIRWSLPVLYLLYPLTIVLIFLVFFDQKFESSRIVYQTSIAATAVAALYDALSKLGEMTGLFTIPSALTTFFTKVVPLGEYSMGWISFAICGVLVGLILKKVKA

SEQ ID NO: 9419 - DNA, 1053 bp, Streptococcus agalactiae
atgagagctgcaacttatctttcagctaatgaattatcacttactgataaggctaaacctcaagtaataaaacccacagatgcggttgtaagacttgtcaaaacaaccatttgtggtactgatctacatatccttggtggcgatgttcctgcttgtaaaccaggaacaactttaggtcatgaaggcattggtatcgtcgaagaagttggttctgctgtcaatcattttaaagtcggagataaagtaattatttcttgtgtcactgcctgtaatacttgctattactgtaagcaccagttgccttcacattgtgaagatggcgggtggattttaggacatcttattgaaggtactcaagcagaatatgttcatattccacatgcagatggtagcctttatcatgcacctgaaggtgtttgtgacgatgcattggttatgttatctgatattttaccaacttcatacgaaatcggcgtcttaccttctcacattaaaccaggtgatactgtttgtattgtaggcgctggaccaattggactatctgccttactaactgcacaattctattctcctgccaaaattattatggttgatttatctcaaaaacgacttgaagcctctaaaaaatttggtgcaacacacaccattctatcaacgtctactcaagaagttaaagaagaaattgataaaattaccaaaggccgtggcgttgatgtcgtattagaatgtgttggttatcctgcaacatttgatatttgtcaaaatgtagtttctattggaggacatatcgcaaatgttggtgttcatggtaaacctgttgaatttaacctccaagatttatggataaaaaatataacccttaatactggattagttaatgctaatacaactgaaatgctccttgaagttcttgagacaggcaaaatcgatgcaacacaactagtaacacatcacttcaagctatctgaaatcgaagaagcttataaggtatttaaagctgctgaagaaaacaatactctcaaagttatcatcgaaaacgatattactccagcc

SEQ ID NO: 9420 - protein, 351 aa, Streptococcus agalactiae
MRAATYLSANELSLTDKAKPQVIKPTDAVVRLVKTTICGTDLHILGGDVPACKPGTTLGHEGIGIVEEVGSAVNHFKVGDKVIISCVTACNTCYYCKHQLPSHCEDGGWILGHLIEGTQAEYVHIPHADGSLYHAPEGVCDDALVMLSDILPTSYEIGVLPSHIKPGDTVCIVGAGPIGLSALLTAQFYSPAKIIMVDLSQKRLEASKKFGATHTILSTSTQEVKEEIDKITKGRGVDVVLECVGYPATFDICQNVVSIGGHIANVGVHGKPVEFNLQDLWIKNITLNTGLVNANTTEMLLEVLETGKIDATQLVTHHFKLSEIEEAYKVFKAAEENNTLKVIIENDITPA

SEQ ID NO: 9421 - DNA, 1128 bp, Streptococcus agalactiae
atgagggcaaatggtgaaaagatattgcggttaaatactggaaatccagctgcctttggcttcgaagcgccagatgaagtcattcgtgatttaattacgaatgcgcgtgaatcagaaggttactctgattcgaaaggtattttttcagctcgtaaggctgttatgcagtattaccagttacaaaacatccatgttgacatggatgatatatacattgttaatggtgttagtgagggaatctctatgtcaatgcaagctttgcttgataatgatgacgaggttctagttccaatgccagattacccgttatggacagcttgtgttagccttgctggtggaaatgctgtgcattatatttgtgatgaggaagctaattggtatcctgatattgatgatatcaaatcaaaaatcacatccaaaacaaaagcaattgtcctcattaatccaaataatccaactggagcagtctatccgcgtgaaattctgcaagagattgtggatatcgctagacaaaatgacttgattattttttcagacgaggtttatgaccgtttagttatggatggaatggagcatatcccaattgcttctattgcagaggatatttttacagttactttatctggcttatctaaatcacatcgcatctgtggtttccgcgttggttggatggtattgtctggtccgcgacaacatgttaaaggttatattgaaggtttgaatatgttagctaacatgaggctgtgttcaaatgttcttgctcaacaggttattcaaacatcgttaggcggacagcaatctattgatagtatgttgttgccaggaggtcgtatctacgagcaacgtaattatatccataaagcaattaatgaaatacctggtttatctgctgtaaaaccaaatgctggactgtatcttttccctaaaattgatacagatatgtaccgtattgataatgatgaagagtttgtgcttaatttcttaaaacaagaaaaagtattactaacacacggtagaggatttaatatgaataccgctgaccattttagaattgtttacttaccacgtgttgatgaattgactgaactacaagaaaaaatggctcgctttttaagccaatacaagcgc

SEQ ID NO: 9422 - protein, 376 aa, Streptococcus agalactiae
MRANGEKILRLNTGNPAAFGFEAPDEVIRDLITNARESEGYSDSKGIFSARKAVMQYYQLQNIHVDMDDIYIVNGVSEGISMSMQALLDNDDEVLVPMPDYPLWTACVSLAGGNAVHYICDEEANWYPDIDDIKSKITSKTKAIVLINPNNPTGAVYPREILQEIVDIARQNDLIIFSDEVYDRLVMDGMEHIPIASIAEDIFTVTLSGLSKSHRICGFRVGWMVLSGPRQHVKGYIEGLNMLANMRLCSNVLAQQVIQTSLGGQQSIDSMLLPGGRIYEQRNYIHKAINEIPGLSAVKPNAGLYLFPKIDTDMYRIDNDEEFVLNFLKQEKVLLTHGRGFNMNTADHFRIVYLPRVDELTELQEKMARFLSQYKR

SEQ ID NO: 9423 - DNA, 285 bp, Streptococcus agalactiae
atggctaaatacgaaattctttatattattcgtccaaacattgaagaagaagctaaaaacgctttggtagcacgttttgattctatcttatctgacaacggtgcaactgttgttgaatcaaaagattgggaaaaacgtcgtcttgcatacgaaatccaagatttcactgaaggactttaccatatcgttaacgttgaagctgaagatgcagtagctcttaatgagtttgatcgtctttcaaaaatcaacggtgacattcttcgtcacatgatcgttaaagtagac

SEQ ID NO: 9424 - protein, 95 aa, Streptococcus agalactiae
MAKYEILYIIRPNIEEEAKNALVARFDSILSDNGATVVESKDWEKRRLAYEIQDFTEGLYHIVNVEAEDAVALNEFDRLSKINGDILRHMIVKVD

SEQ ID NO: 9425 - DNA, 1122 bp, Streptococcus agalactiae
atgtggcctgaagatagaatcgcttcttttcgtcgcacacttttagggtggtatgaccaagaaaaacgtgatctcccttggcgaagaactactaatccatactatatttgggtttctgaaatcatgttgcaacaaacacaagttaatacagtaatcccttattataaacgttttctagagtggtttcctcaaataaaagatttggcagacgctcctgaagaacaattactaaaggcatgggagggactaggctattattctcgggtgcgtaatatgcaaaaggctgcacagcaagtgatggttgattttggtggcatatttcctcacacttatgatgatattgcttcattaaaagggattggtccttatactgcaggtgctatcgccagcatctcattcaacttaccagagcctgctgttgatggcaatgtgatgcgtgtcatggctcgtttgtttgaagttaattatgacatcggtgaccctaaaaatcgtaaaatttttcaagctattatggaaatactaattgaccctgacagacccggtgattttaaccaagcacttatggatctgggtacagacatcgaatccgctaagacacctagacctgatgaaagccctattcgtttctttaatgctgcttatttgaatggtacttatagtaaatatcccataaaaaatactaagaaaaagcctaaaccaatgcgaattcaggcttttgtcattcgtaaccaaaatggtcaatatctactggagaaaaatactaaagggagacttctagggggtttttggtcatttcctattatcgaaacgtcacctctttctcaacaattagatttatttgatgacaatcaatccaaccccataatctggcaaacccaaaatgaaactttccaaagagaatatcaattaaagccccaatggactgataatcactttccaaatattaagcacacttttagtcaccagaagtggacaatagaactcatagagggggtggtcaaagcaacagatttacctaatgctcctcacctaaagtgggtagcaattgaggacttttctctgtatccctttgcaacaccacaaaagaaaatgctagagacctacttaaaacagaaaaatgct

SEQ ID NO: 9426 - protein, 374 aa, Streptococcus agalactiae
MWPEDRIASFRRTLLGWYDQEKRDLPWRRTTNPYYIWVSEIMLQQTQVNTVIPYYKRFLEWFPQIKDLADAPEEQLLKAWEGLGYYSRVRNMQKAAQQVMVDFGGIFPHTYDDIASLKGIGPYTAGAIASISFNLPEPAVDGNVMRVMARLFEVNYDIGDPKNRKIFQAIMEILIDPDRPGDFNQALMDLGTDIESAKTPRPDESPIRFFNAAYLNGTYSKYPIKNTKKKPKPMRIQAFVIRNQNGQYLLEKNTKGRLLGGFWSFPIIETSPLSQQLDLFDDNQSNPIIWQTQNETFQREYQLKPQWTDNHFPNIKHTFSHQKWTIELIEGVVKATDLPNAPHLKWVAIEDFSLYPFATPQKKMLETYLKQKNA

SEQ ID NO: 9427 - DNA, 867 bp, Streptococcus agalactiae
atgaagactacaaaagttttttcagttttatcgttatctgttgctgtatttatgatgacagcatgtcagtcaaaccacagtactaaaaaagctgatatgtctccagataaggtggagcaaaagacgaaatttaaaaatatttctctaagttctaataaactgttggctaaggaaaacactatgtctgtcctttggtatcaaaattctgcagaagccaaggctttatatttacaaggttataatgttgctaaaatgaagttagatgattggttacaaaagcccagtgaaaaaccatattcaattatcttagatttagatgaaacagttttagataatagcccatatcaagcaaagaatattaaagatggctctagtttcacgccagagagttgggataaatgggtgcaaaagaaatcagctaaggctgttgcgggtgccaaagaatttttgaagtatgctaatgaaaagggaataaaaatttattatgtctcagatcgtacagatgctcaagttgatgcgactaaagaaaatttagagaaggaaggtatacctgttcaagggaaagaccacttgcttttccttaaaaaaggaatgaaatctaaagagagtcgccgtcaggcagttcaaaaagataccaatttaattatgctttttggagataatttagttgattttgctgatttttctaaatcatctagtacagatagagaacaactactaactaaacttcaaagtgagtttggtagtaaatttattgttttcccaaatcctatgtacggttcttgggaaagtgctatttatcaaggaaaacatctggatgttcaaaaacaattgaaagaacgacaaaaaatgttgcattcgtatgat

SEQ ID NO: 9428 - protein, 289 aa, Streptococcus agalactiae
MKTTKVFSVLSLSVAVFMMTACQSNHSTKKADMSPDKVEQKTKFKNISLSSNKLLAKENTMSVLWYQNSAEAKALYLQGYNVAKMKLDDWLQKPSEKPYSIILDLDETVLDNSPYQAKNIKDGSSFTPESWDKWVQKKSAKAVAGAKEFLKYANEKGIKIYYVSDRTDAQVDATKENLEKEGIPVQGKDHLLFLKKGMKSKESRRQAVQKDTNLIMLFGDNLVDFADFSKSSSTDREQLLTKLQSEFGSKFIVFPNPMYGSWESAIYQGKHLDVQKQLKERQKMLHSYD

SEQ ID NO: 9429 - DNA, 411 bp, Streptococcus agalactiae
atgcctacaattaaccagttggtacgtaaaccacgtaaatctaaagttgaaaaatcagattcacctgctttgaatattggttacaacagtcacagaaaagttcacactaaattatctgcaccacaaaaacgtggtgttgcaactcgtgttggaactatgacacctaaaaaacctaactctgcccttcgtaaatttgctcgtgtacgtttgagcaaccttattgaagttactgcttacattccaggtatcggacacaacttgcaagaacacagtgttgtgcttatccgtggtggacgtgtaaaagaccttccaggggtacgttaccatatcgttcgtggtgcacttgatactgcaggtgtagctgatcgtaaacaaggccgttctaaatacggtgctaaacgtcctaaaggg

SEQ ID NO: 9430 - protein, 137 aa, Streptococcus agalactiae
MPTINQLVRKPRKSKVEKSDSPALNIGYNSHRKVHTKLSAPQKRGVATRVGTMTPKKPNSALRKFARVRLSNLIEVTAYIPGIGHNLQEHSVVLIRGGRVKDLPGVRYHIVRGALDTAGVADRKQGRSKYGAKRPKG

SEQ ID NO: 9431 - DNA, 1353 bp, Streptococcus agalactiae
atgaaaaaagaaagtatatctattaaagatatcttgtggtttattattccgtcgttatttggagtattattattaatgactccatttaaatataatggtatgacaacagtagctgtctctgtaatctctaagacaattaatcaatggattaacgctgtttttcctatacattatattattttactaatcatttttatttcatgtgtgttagcactttgttatcgtctgtttagacctagctttattgaaaaaaatgacttgctaaaagaaatttctgacattaccattttctggctgattattcgtttgatcggtttggcacttggtctgatgacggttttacatattggtcctgaaatggtatgggggaaagagacaggcggccttatcctttttgatttgattggtggtttgtttaccattttccttgctgcgggttttattcttccatttttgacagaatttggtctactggagtttgttggtgtcttcctaactcccattatgcgtccattctttcagctacctggtcggtcagcagttaattgtgtagcctcatttgtaggtgatggtactattggaattgctttgaccgataagcagtatgttgagggttattataccagtagagaagctgcaacgatttccactactttttcagcagtatcaatcactttttgtcttgttgttttgcagaatgttggcttaactgattattttggccatttttatctaacagtcatcattagcagtgttgtctgtgcattcattatcccttatatccctcccttatctcgtcaatcaaatagttattacactaaaccaaagaaagaaacatctgaggtaattccggatggttataacaagatagagtggggacttaagcttgccatcgataaatcaaaagcaaatggaaacatgaagacttttgtcaataatgcctctaagacagtacttagtttatggtttggcgttatgccaacaattatgactgtcggaacaatagctttgattatttcagtatcaacacctatttttaaaattttaggtacaccattccttccgttccttgaacttttagggattccagaagcagatattgcgagtcaaaccatgattgttggtttttcagatatggttgttccttcgataatggcggctgaaattcacagtgagatgacaagatttattgtcgcaacagtttctattgtgcaattaatttatatgtctgagactggtgcggtgatattaggttccaagatccctatcaacattctagaattatttatcatttttatagagagaacaattatttcattacctattattgttttgatggcacatcttttcttt

SEQ ID NO: 9432 - protein, 451 aa, Streptococcus agalactiae
MKKESISIKDILWFIIPSLFGVLLLMTPFKYNGMTTVAVSVISKTINQWINAVFPIHYIILLIIFISCVLALCYRLFRPSFIEKNDLLKEISDITIFWLIIRLIGLALGLMTVLHIGPEMVWGKETGGLILFDLIGGLFTIFLAAGFILPFLTEFGLLEFVGVFLTPIMRPFFQLPGRSAVNCVASFVGDGTIGIALTDKQYVEGYYTSREAATISTTFSAVSITFCLVVLQNVGLTDYFGHFYLTVIISSVVCAFIIPYIPPLSRQSNSYYTKPKKETSEVIPDGYNKIEWGLKLAIDKSKANGNMKTFVNNASKTVLSLWFGVMPTIMTVGTIALIISVSTPIFKILGTPFLPFLELLGIPEADIASQTMIVGFSDMVVPSIMAAEIHSEMTRFIVATVSIVQLIYMSETGAVILGSKIPINILELFIIFIERTIISLPIIVLMAHLFF

SEQ ID NO: 9433 - DNA, 951 bp, Streptococcus agalactiae
atgaaaaaattaacaaaaggcagccacattcgtgttcttagtccctcttcttccattgagcgtctgggtggttttgaggctaacctattagccaaagaagtactagaaaagctgggatttcaagtgtcattctctaagcactatctagaaaatgatatcctctattctgcttcgattactagccgtgtagaagatttacatgaagcatttgccgacccttctgttgatgccatattagcaaccattggcggattcaattccaacgagcttttaccatatttagattatgatttaatctctaagaatcccaaaataatttgtggttactcagattcaacggccttccttaatgctatttttgccaaagcaaaaatccaaacttacatgggccctgcttattcttctttcaaaatgaaggaaggtcaaccttaccaaacacaagcttggcttactgccatgacagaaaaccactatgaactttggcctagtgaagaatggtctagtgatccctggtatgatcccagcaaaccacgccaatttttcccaacagaatggaaaatttataatcacggaaaagcttccggtacgattatcggaggtaatctctctacgtttggcctacttcgaggtactccttatgcaccgaaaattgaacgctatgtcctcttgattgaagaggctgaggaaagtaatttttatgaatttgaccgcaaccttgctgcaattttacaagcttatcctcatccacaagctattcttatggggcgctttcctaaagaatgcggcatgactccacaagtctttgaatatatcctttcaaaacatgctattttcaaggaaattcctgttatttatgatatggattttgcgcacacccaacctcttttgacagtgactattggagctgagctaagcgttgacactactacattatctctatctataaaagaa

SEQ ID NO: 9434 - protein, 317 aa, Streptococcus agalactiae
MKKLTKGSHIRVLSPSSSIERLGGFEANLLAKEVLEKLGFQVSFSKHYLENDILYSASITSRVEDLHEAFADPSVDAILATIGGFNSNELLPYLDYDLISKNPKIICGYSDSTAFLNAIFAKAKIQTYMGPAYSSFKMKEGQPYQTQAWLTAMTENHYELWPSEEWSSDPWYDPSKPRQFFPTEWKIYNHGKASGTIIGGNLSTFGLLRGTPYAPKIERYVLLIEEAEESNFYEFDRNLAAILQAYPHPQAILMGRFPKECGMTPQVFEYILSKHAIFKEIPVIYDMDFAHTQPLLTVTIGAELSVDTTTLSLSIKE

SEQ ID NO: 9435 - DNA, 750 bp, Streptococcus agalactiae
atgtttatatttaaaagaaaaaaacaagtagaaatgcctttggagaaaataccagcacatattggtattatcatggatggtaacggacgttgggcaaaaaaacgtttaaaaccacgcgttatgggacataaggcggggatggatgctcttcaagaagttacaatagcagcttcaggattaggtgttaaagtactaactgtctatgccttttctacagaaaattggtcacgtccagatgatgaagttaagtttattatgaaccttccggttaaattttttgataaatatgtaccagagttagataaaaataatgtacgtgtacaggtcatcggagatactcataaattacctaaggcaacatacgatgcaatgcaacgcgcttgtttgaggacaaaacataattcggggctcgtcttgaattttgcgctaaattatggcggacgttcagaaatcactaatgccattaaggaaattgctcaggatgttttggaagctaagttgaatcctgacgatattacagaggatttagtagcaaatcatttaatgacaaatagcttaccctatctttatagagaccctgatttgattatccgaactagtggagagttacgcttgagtaactttttaccttggcaatcagcttatagtgaattttactttactcccgttttatggccagattttaaaaaagacgaactacataaggccattgtggattataatcaacgccatcgtcgatttggtagtgta

SEQ ID NO: 9436 - protein, 250 aa, Streptococcus agalactiae
MFIFKRKKQVEMPLEKIPAHIGIIMDGNGRWAKKRLKPRVMGHKAGMDALQEVTIAASGLGVKVLTVYAFSTENWSRPDDEVKFIMNLPVKFFDKYVPELDKNNVRVQVIGDTHKLPKATYDAMQRACLRTKHNSGLVLNFALNYGGRSEITNAIKEIAQDVLEAKLNPDDITEDLVANHLMTNSLPYLYRDPDLIIRTSGELRLSNFLPWQSAYSEFYFTPVLWPDFKKDELHKAIVDYNQRHRRFGSV

SEQ ID NO: 9437 - DNA, 339 bp, Streptococcus agalactiae
atgagcttacctattattatgcttgttgttatggttggtatgatgttcttcatgcaacgtcagcaaaagaaacaagcacaagaacgtcaaaaacaattgaatgctgttcaaaaaggtgatgaaattgtcacaattggtggtctttttggagtagttgatgaagttaatactgaagcacaacgaatggttttagatgttgatggtgtctatttgacgtttgagttggcagctatcaaatctgttgtctctaaggcagcaacaccaacagaaccagttgaagatgttaagattattgaagtcaatgaagacgaaaataaagaaacagccatcgaaactgaa

SEQ ID NO: 9438 - protein, 113 aa, Streptococcus agalactiae
MSLPIIMLVVMVGMMFFMQRQQKKQAQERQKQLNAVQKGDEIVTIGGLFGVVDEVNTEAQRMVLDVDGVYLTFELAAIKSVVSKAATPTEPVEDVKIIEVNEDENKETAIETE

SEQ ID NO: 9439 - DNA, 282 bp, Streptococcus agalactiae
atgttaaaaccattaggtgatcgtgtgatcatttcgtttgttgaaactgaagagaaatctgtcggtggttttgttcttgcaggagcaagccatgatgcgacaaagacagccaaagttcttgctgtgggtgacggtattcgtaccttaacaggggaattagttgcaccgagcgttgcagagggtgatactgttttagtcgaaaatggtgctggtctggaagttaaagacggtaacgaaaaagtgacagttgttcgcgaaagtgacattgttgctgtcgttaaa

SEQ ID NO: 9440 - protein, 94 aa, Streptococcus agalactiae
MLKPLGDRVIISFVETEEKSVGGFVLAGASHDATKTAKVLAVGDGIRTLTGELVAPSVAEGDTVLVENGAGLEVKDGNEKVTVVRESDIVAVVK

SEQ ID NO: 9441 - DNA, 354 bp, Streptococcus agalactiae
atgtctactttaacaataattattgcaacattaactgctttggaacatttttatattatgtatttggagacgttagccacccagtcaaatatgactgggaagatttttagtatgtctaaagaagagttgtcatatttacccgttattaaactttttaagaatcaaggtgtatacaacggcttgattggcctattcctcctttatgggttatatatttcacagaatcaagaaattgtagctgtttttttaatcaatgtattgctagttgctatttatggtgctttgacagttgataaaaaaatcttattaaaacagggtggtttacctatattagctcttttaacattcttattt

SEQ ID NO: 9442 - protein, 118 aa, Streptococcus agalactiae
MSTLTIIIATLTALEHFYIMYLETLATQSNMTGKIFSMSKEELSYLPVIKLFKNQGVYNGLIGLFLLYGLYISQNQEIVAVFLINVLLVAIYGALTVDKKILLKQGGLPILALLTFLF

SEQ ID NO: 9443 - DNA, 870 bp, Streptococcus agalactiae
atgtctaaaaaaattaagaattttatactattaaatattggatctctaattgttgcatttggtttcaacgctttctttcttcataatcatattgtcacgggggggattagtggtttggcagttagttttcatgaagtatttggttgggattctgctttttttattatgattatcaatattccattgctccttctttgctactttggcttaggtaaacaaacctttttaaaaactgtctatggttcttggatttttcctgtttttattaagttaacacaaagtgtaccaactttgacccacaacccactcctcgcagcactttttggaggtgttattgtaggatgtggtttggggattgttttttggagcgactcttcaactggtggaacggggattatcattcaattcttaggaaaatatactcctataagccttggacaaggggttatattgattgatggacttgttacaattgttggtttcctagcttttgacagtgatacggttatgttttctattattgggttgataactattagttatattattaatgctatccaaactggatttacaaccttaagcactgtcttaatcgtttctcaagagcaccaaaaaattaagacatatatcaatactgtcgcagatagaggagtaacagaaattcccgttaaagggggatattctggaactaatcaaatcatgcttatgacaactattgctggttatgagtttgctaaattacaagaggcaatagcagaaattgacgaaacagccttcataacagtaactccaacatcacaagcttctggacgtggatttagtcttcaaaaaaatcatggacgtcttgatgaagacattcttatgccaatg

SEQ ID NO: 9444 - protein, 290 aa, Streptococcus agalactiae
MSKKIKNFILLNIGSLIVAFGFNAFFLHNHIVTGGISGLAVSFHEVFGWDSAFFIMIINIPLLLLCYFGLGKQTFLKTVYGSWIFPVFIKLTQSVPTLTHNPLLAALFGGVIVGCGLGIVFWSDSSTGGTGIIIQFLGKYTPISLGQGVILIDGLVTIVGFLAFDSDTVMFSIIGLITISYIINAIQTGFTTLSTVLIVSQEHQKIKTYINTVADRGVTEIPVKGGYSGTNQIMLMTTIAGYEFAKLQEAIAEIDETAFITVTPTSQASGRGFSLQKNHGRLDEDILMPM

SEQ ID NO: 9445 - DNA, 1227 bp, Streptococcus agalactiae; identical to SEQ ID NO: 8873

SEQ ID NO: 9446 - protein, 409 aa, Streptococcus agalactiae
MKKKLVSSLLKCSLIIIVSFAGGAFASFVMNHNDNIPNGGVTKTSKVNYNNITPTTKAVKKVQNSVVSVINYKQQESRSDLSDFYSHFFGNQGGNTDKGLQVYGEGSGVIYKKDGKNAYVVTNNHVIDGAKQIEIQLADGSKAVGKLVGSDTYSDLAVVKIPSDKVSNIAEFADSSKLNIGETAIAIGSPLGTEYANSVTQGIVSSLKRTVTMTNEEGQTVSTNAIQTDAAINPGNSGGALINIEGQVIGINSSKISSTSNQTSGQSSGNSVEGMGFAIPSNDVVKIINQLESNGQVERPALGISMAGLSNLPSDVISKLKIPSNVTNGIVVASIQSGMPAQGKLKKYDVITKVDDKEVVSPSDLQSLLYGHQVGDSITVTFYRGENKQTVTIKLTKTSKDLAKQRANN

SEQ ID NO: 9447 - DNA, 966 bp, Streptococcus agalactiae
atgtcttattctaatttaaaattgtttgcactgtcatcaaacaaagaactagcgaaaaaagtgtctcagacgattggaattccgctaggtcaatcgacagttcgccaattttctgatggtgagattcaagttaatattgaagagtctattcgtggccatcatgtttttattttacaatcaacaagctcaccagttaatgataatttgatggaaattttaattatggttgacgctttaaagcgtgctagtgcggagtctgttagtgtggtaatgccttactatgggtatgctcgtcaagatcgcaaggcacgttctcgtgaacctattacttcgaaactcgttgcgaacatgctagaagttgctggtgttgatcgtcttttaacagttgatttacatgcagctcaaattcagggattctttgatattcccgttgatcaccttatgggggctccccttattgcagattactttgatcgtcagggattggttggtgatgatgttgttgtcgttagtcctgatcatggtggcgtaacacgtgcacgtaagctggcacagtgtttaaagacaccgattgctatcattgataagcgccgtagtgttactaaaatgaatacatctgaagtaatgaatattattggtaatatcaaaggtaaaaaatgtattttaattgatgatatgattgatactgcaggtactatttgccatgctgcagacgctttagctgaagcaggggcaacagcggtttatgcttcatgtactcaccctgttttatcagggccggctttggataatattcaaaattcagctattgaaaaattaattgtgttagatacgatttacctccctgaagaacgtttgattgataagattgaacaaatttcaattgcggaattgattggtgaagctattatccgtattcacgagaaacgtcctttatcaccattatttgaaatgaataaactaaaa

SEQ ID NO: 9448 - protein, 322 aa, Streptococcus agalactiae
MSYSNLKLFALSSNKELAKKVSQTIGIPLGQSTVRQFSDGEIQVNIEESIRGHHVFILQSTSSPVNDNLMEILIMVDALKRASAESVSVVMPYYGYARQDRKARSREPITSKLVANMLEVAGVDRLLTVDLHAAQIQGFFDIPVDHLMGAPLIADYFDRQGLVGDDVVVVSPDHGGVTRARKLAQCLKTPIAIIDKRRSVTKMNTSEVMNIIGNIKGKKCILIDDMIDTAGTICHAADALAEAGATAVYASCTHPVLSGPALDNIQNSAIEKLIVLDTIYLPEERLIDKIEQISIAELIGEAIIRIHEKRPLSPLFEMNKLK

SEQ ID NO: 9449 - DNA, 1173 bp, Streptococcus agalactiae
atgacattagagaaacgatttaataagtacttagatagaatagaggtctccttaattcgtcagtttgatcaatctatttcagatatacctggaatggtaaaattaactcttggagaaccagattttaccactcctgatcatgttaaagaagcagctaaatcagctattgatgcgaatcaatcgtattacactggtatgagcggtttattagctctaaggcaagctgctgcagattttgcaaaggataaatataatcttacttataatcctgattgtgagatcttggttacgataggtgccacagaagctctgtctgcatctcttatagctattttagaagctggtgatgttgttctattacctgcccccgcttatccaggatatgagccaatagttaaccttgtaggagctgatatcgtagaaattgatactagagaaaatgactttagactaactcctgaaatgttagaaacggctattatccaacaaggtgaaaaattaaaggctgttttacttaattatcctactaaccctacaggtattacctattcaaggcaagaaattgctgcattagctgaagtccttaaaaaatatgatatttttgttattagtgatgaagtttattctgagttaacttacactggtcagcagcatgtttcaattgcagaatatttacctaaccaaactatcttaattaatggcttatcaaaatcacatgctatgactggttggagagttggattggtgtatgctcctgaagcatttattgctcaaatcattaaaagtcatcaatacatggtgacagctgctagtactatttcgcaatttgctggggtagaagccttatctgtgggtaaaaatgatacgttacctatgcgtcaaggatatattaaacgtagagattatatcattgataaaatgtctaaacttggtttcaaaataattaaaccgagtggcgctttttatatctttgctaaaatacctgatagctatccacaggattctttcaagttttgtcaggattttgcttatcaacaagctgtagctattattccaggagtggcttttggtaaatatggtgaaggatatatacgtctttcttatgctgctagtatggaagttattgaaacagcaatggctagattgaaagtttttatggaatcatatgagggt

SEQ ID NO: 9450 - protein, 391 aa, Streptococcus agalactiae
MTLEKRFNKYLDRIEVSLIRQFDQSISDIPGMVKLTLGEPDFTTPDHVKEAAKSAIDANQSYYTGMSGLLALRQAAADFAKDKYNLTYNPDCEILVTIGATEALSASLIAILEAGDVVLLPAPAYPGYEPIVNLVGADIVEIDTRENDFRLTPEMLETAIIQQGEKLKAVLLNYPTNPTGITYSRQEIAALAEVLKKYDIFVISDEVYSELTYTGQQHVSIAEYLPNQTILINGLSKSHAMTGWRVGLVYAPEAFIAQIIKSHQYMVTAASTISQFAGVEALSVGKNDTLPMRQGYIKRRDYIIDKMSKLGFKIIKPSGAFYIFAKIPDSYPQDSFKFCQDFAYQQAVAIIPGVAFGKYGEGYIRLSYAASMEVIETAMARLKVFMESYEG

SEQ ID NO: 9451 - DNA, 660 bp, Streptococcus agalactiae
atgttttttgtaaagcatgcttcaaagtcaaaattcaatgctgtgctccaacctttgactattgctcattttattttaaaaattaatgataatggtctttcttatattgatgattataaagaagttttagcatttcaagaaaccaattcagacttgtttaagttgtcatatgcgagttatattacttctttggctgatgtggctattagtgataatgtagcggatgctcaattatttattttcctaaagaaaacgttagaattgattgaggacggtttagattatgagattctaacgaatatttttgaagtacaactactagagaggttcggtgttgctttaaattttcatgattgtgttttttgtcatagggtaggattaccttttgatttttcacacaaatattctggattattatgtccaaaccattattataaagacgagagaagaaaccacctagatcctaatatgctgtacttaatcaatcgttttcagtcaattcaatttgatgatttacaaacaatttctgtgaaacctgagatgaaacttaaaattcgtcaatttttggacatgatttacgatgaatatgtagggattcatcttaaaagtaaaaaatttattgatgatttgtctagttggggaagtattatgaaatcagat

SEQ ID NO: 9452 - protein, 220 aa, Streptococcus agalactiae
MFFVKHASKSKFNAVLQPLTIAHFILKINDNGLSYIDDYKEVLAFQETNSDLFKLSYASYITSLADVAISDNVADAQLFIFLKKTLELIEDGLDYEILTNIFEVQLLERFGVALNFHDCVFCHRVGLPFDFSHKYSGLLCPNHYYKDERRNHLDPNMLYLINRFQSIQFDDLQTISVKPEMKLKIRQFLDMIYDEYVGIHLKSKKFIDDLSSWGSIMKSD

SEQ ID NO: 9453 - DNA, 849 bp, Streptococcus agalactiae
atgaaaaaaacattatacattaccaataaactcttttttgctaactggtttgtgccagttattggtgcagttctaattcaagttatcggcatcattgtaagtagacgccttgtagtaaaattgctacctgatgattataaattcaatttatacattgcgcttttactatttgttcctattttggcaagtattttactatttttaatctattttcaaaaaagggattttacttccttgggatttactaaagataataatgttttaacaacgatctcaggatttattactggtagtttactgatgttttttatttatatttgccactggttatcaggttttgtggaaatttcttccagcaattccttttcttttggaccttttttctttttatttcttgcatactttatccaaagcttgacagaggaaattttatttagaggatatgttatgacaacagttaccaaatttaaaggtagttttgcaggtgttttatgtaattctatgttgttttcttttatccactttagaaactatggtatcacagcaatagcactttttaatttatttttacttggtattattttttctattctttttaatatgaccaaaaatattctttttgttacaggagttcatactacatggaattttactatgggatgtgtattaggtaataaggttagtgggggggattctcctgtttctctttttagaattactgaaaattctagctttgctctttggaatggtggggattttggttttgaagggggagtactatgttctttgatattagtaggttgtttagcatacttttctttggaaagcgtgagagtatctgttagatat

SEQ ID NO: 9454 - protein, 283 aa, Streptococcus agalactiae
MKKTLYITNKLFFANWFVPVIGAVLIQVIGIIVSRRLVVKLLPDDYKFNLYIALLLFVPILASILLFLIYFQKRDFTSLGFTKDNNVLTTISGFITGSLLMFFIYICHWLSGFVEISSSNSFSFGPFFFLFLAYFIQSLTEEILFRGYVMTTVTKFKGSFAGVLCNSMLFSFIHFRNYGITAIALFNLFLLGIIFSILFNMTKNILFVTGVHTTWNFTMGCVLGNKVSGGDSPVSLFRITENSSFALWNGGDFGFEGGVLCSLILVGCLAYFSLESVRVSVRY

SEQ ID NO: 9455 - DNA, 990 bp, Streptococcus agalactiae
atgaagaaaattgctatagatgctatgggtggagattacgctcccaaagctattgtagagggtgttaatcaagctatttcagattttagtgatattgaagtacaactctatggcgatcagaaaaaaattgagaaatatttaacagtaacggagcgagttagtattattcatactgaagaaaaaattaattctgatgatgagcctgctaaagctgttcgtcgtaaaaaacagtcttcgatggtcttaggagctaaggcagtcaaagatggtgttgcacaggcctttatttctgcagggaatacaggagctttattagctgctggtttgtttgtagtaggacgtataaaaggtgttgatcgaccaggcttaatgtcaactatgcctacgttagatggtgtgggttttgatatgcttgatttaggagctaatgcagaaaacacagcttctcatcttcatcaatatgctattttagggtcgttttatgcaaaaaatgtccgtggtattgaagttcctcgtgtaggtctcttaaataacggaacggaagaaacaaaaggcgattctcttcataaagaagcttatgaactgttagcagcagagccttctattaattttattggaaatattgaagcacgtgatttgatgtctagtgtagcagatgttgttgtcactgatggttttactggaaatgctgttctaaagacaatggaaggtacagctatgagtattatgggaagcctaaaatcttcaattaaatcaggtggcgtgaaagctaaattaggagcacttctattaaaagatagcctatatcagctaaaagatagtatggactattcaagcgcgggtggagcggttctttttggtttaaaagctccaatagtaaaatgccatggatcaagtgattctaaagctgtttattctactttgaagcaagttcgtacaatgttggaaactcaagtagttgatcaattagttgatgcctttacagatgaa

SEQ ID NO: 9456 - protein, 330 aa, Streptococcus agalactiae
MKKIAIDAMGGDYAPKAIVEGVNQAISDFSDIEVQLYGDQKKIEKYLTVTERVSIIHTEEKINSDDEPAKAVRRKKQSSMVLGAKAVKDGVAQAFISAGNTGALLAAGLFVVGRIKGVDRPGLMSTMPTLDGVGFDMLDLGANAENTASHLHQYAILGSFYAKNVRGIEVPRVGLLNNGTEETKGDSLHKEAYELLAAEPSINFIGNIEARDLMSSVADVVVTDGFTGNAVLKTMEGTAMSIMGSLKSSIKSGGVKAKLGALLLKDSLYQLKDSMDYSSAGGAVLFGLKAPIVKCHGSSDSKAVYSTLKQVRTMLETQVVDQLVDAFTDE

SEQ ID NO: 9457 - DNA, 237 bp, Streptococcus agalactiae
atgtcaagagatgaagtttttgaaaagatgctggaattattaaggcagcaacttggtgacccacagttagatatcacaccagagtcatcgttacatgatgatttagcaattgactctatcgctttaacagagtttattatcaatttggaagatgtgtttcatctagagattccagatgaggctgtcgaacacatgtcaagcgtccaacaactattagattatatcattgaacataag

SEQ ID NO: 9458 - protein, 79 aa, Streptococcus agalactiae
MSRDEVFEKMLELLRQQLGDPQLDITPESSLHDDLAIDSIALTEFIINLEDVFHLEIPDEAVEHMSSVQQLLDYIIEHK

SEQ ID NO: 9459 - DNA, 588 bp, Streptococcus agalactiae
atgcctcttttagctttggcagctcaagaagcaggagcggttggtataagagccaatagtgtccgcgacattaaggaaattcaagaggttactaatttacctatcatcggcattattaaacgtgaatatcctccacaagaaccatttatcactgctacgatgacagaggtggatcaattagctagtttagatattgcagtaatagccttagattgtacacttagagagcgtcatgatggtttgagtgtagttgagtttattcaaaagataaaaaggaaatatcctgaacagttgttaatggctgatataagtacttttgaagaaggcaaaaatgcttttgaagcaggagttgattttgtgggtacaactctatctggatacacagattacagccgccaagaagaaggaccggatatagaactccttaataagctctgtcaagccggtatagatgtgattgcggaaggtaaaattcatactcctaagcaggctaatgaaattaatcatataggtgttgcaggaattgtagttggtggtgctatcactagaccaaaagaaatagcggagcgtttcatctcaggacttagt

SEQ ID NO: 9460 - protein, 196 aa, Streptococcus agalactiae
MPLLALAAQEAGAVGIRANSVRDIKEIQEVTNLPIIGIIKREYPPQEPFITATMTEVDQLASLDIAVIALDCTLRERHDGLSVVEFIQKIKRKYPEQLLMADISTFEEGKNAFEAGVDFVGTTLSGYTDYSRQEEGPDIELLNKLCQAGIDVIAEGKIHTPKQANEINHIGVAGIVVGGAITRPKEIAERFISGLS

SEQ ID NO: 9461 - DNA, 1089 bp, Streptococcus agalactiae
atgaactcatttaagaccattgggattattggtggtggtcagctggggcagatgatggcgattgcggctatctacatgggccacaaggtcattacgctggatccagctagcgactgccctgcctcccgcgttagcgaggtgattgtggcaccttacgatgatgttgaggctttgggaacattagctgcgcgttgcgatgttttgacctatgagtttgagaatgtcgatgccgatggtctggatgccgttgtgtcagctggtcagctaccgcaggggactgatctgctccgcatttctcaaaaccgtatctttgaaaaagactttctggcaaataaggctggcgtgactgtcgctccctataaggtggtgacatctagccttgacctagaggggcttgacttgaccaagacctatgtcctcaagacagcgacaggtggttatgacggtcatgggcaaaaggttatccgctcagcagaagacctgccagaggcgcagcaattagccaactcagctcagtgtgtcttggaagagtttgtcaacttcgaccttgaaatatcagtcatcgtgtctggaaatggtcaggatgtgacggtctttcccgttcaggaaaatatccaccgcaacaatatcctgtcaaaaaccatcgtaccagctcgcatctcagaccaactagctgacaaggctaaggaaatggctgtgcagattgccaagaaactccagctatcaggaaccctctgtgtggaaatgtttgcgaccgcagatgacatcatcgtcaatgaaattgccccacgtccccacaactcagggcactactctatcgaagcctgcgacttttcacagtttgacacccacatcttgggcgtactgggcgcaccgcttccgccaatcaaactccatgctccagccgttatgttcaatgtcctaggacaacatgtccagcaggcaattgaccatgttgcccaaaaccctagcgcccacctccacatgtatggtaaactagaagcaaaacataaccgcaaaatgggacacgtgacggtgtttagcgatgtacctgatgaggtggaagagtttgaagaaaggatggatttc

SEQ ID NO: 9462 - protein, 363 aa, Streptococcus agalactiae
MNSFKTIGIIGGGQLGQMMAIAAIYMGHKVITLDPASDCPASRVSEVIVAPYDDVEALGTLAARCDVLTYEFENVDADGLDAVVSAGQLPQGTDLLRISQNRIFEKDFLANKAGVTVAPYKVVTSSLDLEGLDLTKTYVLKTATGGYDGHGQKVIRSAEDLPEAQQLANSAQCVLEEFVNFDLEISVIVSGNGQDVTVFPVQENIHRNNILSKTIVPARISDQLADKAKEMAVQIAKKLQLSGTLCVEMFATADDIIVNEIAPRPHNSGHYSIEACDFSQFDTHILGVLGAPLPPIKLHAPAVMFNVLGQHVQQAIDHVAQNPSAHLHMYGKLEAKHNRKMGHVTVFSDVPDEVEEFEERMDF

SEQ ID NO: 9463 - DNA, 2640 bp, Streptococcus agalactiae
atgactgaaaaaactaaagcagtagaaactacagatgttgctcttgcaattgatacattggttcaaaatggtttaaaagcacttgatgagatgcgtcaacttaatcaagaacaagttgattatattgtagctaaagcttctgttgcagccttggatgcccatggagaacttgctcttcatgcagtagaagaaactggtcgtggtgtctttgaagataaagcgacaaaaaatttatttgcatgtgaacacgtcgttaacaacatgcgtcatacaaagacagtgggagttattgaagaagacgatgtcacaggcttgacattaattgctgaaccagtgggagttgtctgtggtatcacgccaacaaccaacccaacttcaactgctattttcaagtcattaatctctcttaaaacacgtaatccaattatttttgccttccacccatcagcacaagaatcatcagcacatgcagcacgtattgttcgtgatgctgctattgctgctggagctcctgaaaattgtgtccaatggattgaacaaccatcaattgatgcaactaatgctttgatgaaccatgatggtattgccactatccttgcgacaggtggtaatgcgatggttaaagctgcctactcatgtgggaaacctgcccttggtgtaggtgctgggaatgttccagcttatgttgaaaaatcagctaatatccgacaagccgctcacgatattgttatgtctaaatcatttgataacggtatggtatgtgcatcagaacaggctgttattattgataaagaaatttataaagaatttgttgaagaatttaaatcttatcatacctatttcgttaataagaaagaaaaagctcttcttgaagaattctgttttggtgcaaaagcaaatagcaaaaactgtgctggtgcaaaattaaatccaaatattgttggaaaatcagcagtttggattgctgaacaagctggatttactgttccagaaggaacaaatattcttgccgcagaatgtactgaagttagtgaaaaagaacctttgacacgtgaaaaactatcacctgttattgcagtattgaaagctgaatctacagaagatggtgttgaaaaagctcgtcaaatggttgagtttaatggtctagggcactcagctgctattcatacaaaagatgcagacttagctcgtgaatttggaactagaattcgtgctatccgtgttatttggaattctccttctacttttggtggtattggggatgtttacaatgctttcttgccatcattgactcttggttgtggttcgtatggacgtaactcagttggtgataacgttagtgctataaatctcttgaatatcaaaaaagtaggaagacgtagaaataatatgcaatggtttaaagtcccttcaaaaacatacttcgaacgtgattctattcaatatttgcaaaaatgtcgcgatgttgaacgtgtcatgattgttacagatcacgccatggttgagcttggtttcttggatcgtatcattgaacaacttgatcttcgtcgcaataaagttgtttatcagatttttgctgaagtagaaccagatccagacattacaacagtaatgaaaggaacagatttgatgcgtaccttcaaaccagacactattattgcattaggtggtggttctcctatggatgctgcgaaagttatgtggctcttctatgaacaaccagaagttgatttccatgacctcgttcaaaaattcatggatatccgtaaacgtgcgttcaaattcccagaacttggtaagaaaacaaaatttgttgctattccaacaacttctggaacaggttctgaagtgacaccatttgccgttatctctgacaaagcaaataatcgtaaatatccaatcgctgattattcattaacaccaactgtagctatcgttgatccggcccttgttatgactgttcctggttttattgcggctgatacgggtatggatgtattgacacatgcaacagaggcttatgtttcacagatggcaaatgattatacagacggacttgctcttcaagcaattaaaattgtgtttgactacttagaacgctcagtaaaagatgctgattttgaagcacgtgaaaagatgcacaatgcgtcaactatggcaggtatggctttcgccaatgcattcttaggtatttctcactcaatggcgcataaaattggcgcacaattccataccgtacacggacgtacaaatgcaattcttttgccgtatgttatccgctataatggaactcgtccagctaaaacagcaacatggcctaagtacaattactatcgtgctgacgaaaagtatcaagatatcgctaaattactcggcttaccagcagcaacaccagaagaagctgtcgaatcatatgcaaaagctgtgtatgaccttggaacacgtttaggtattaagatgaatttccgcgaccaaggcattgatgaaaaagaatggaaagaaaaatctcgtgaactagctttcttagcatatgaagatcaatgttcaccagcaaatccacgccttccgatggtagatcacatgcaagaaatcatcgaagatgcttattatggttatgaggaacgtccaggacgtcgtaag

SEQ ID NO: 9464 - protein, 880 aa, Streptococcus agalactiae
MTEKTKAVETTDVALAIDTLVQNGLKALDEMRQLNQEQVDYIVAKASVAALDAHGELALHAVEETGRGVFEDKATKNLFACEHVVNNMRHTKTVGVIEEDDVTGLTLIAEPVGVVCGITPTTNPTSTAIFKSLISLKTRNPIIFAFHPSAQESSAHAARIVRDAAIAAGAPENCVQWIEQPSIDATNALMNHDGIATILATGGNAMVKAAYSCGKPALGVGAGNVPAYVEKSANIRQAAHDIVMSKSFDNGMVCASEQAVIIDKEIYKEFVEEFKSYHTYFVNKKEKALLEEFCFGAKANSKNCAGAKLNPNIVGKSAVWIAEQAGFTVPEGTNILAAECTEVSEKEPLTREKLSPVIAVLKAESTEDGVEKARQMVEFNGLGHSAAIHTKDADLAREFGTRIRAIRVIWNSPSTFGGIGDVYNAFLPSLTLGCGSYGRNSVGDNVSAINLLNIKKVGRRRNNMQWFKVPSKTYFERDSIQYLQKCRDVERVMIVTDHAMVELGFLDRIIEQLDLRRNKVVYQIFAEVEPDPDITTVMKGTDLMRTFKPDTIIALGGGSPMDAAKVMWLFYEQPEVDFHDLVQKFMDIRKRAFKFPELGKKTKFVAIPTTSGTGSEVTPFAVISDKANNRKYPIADYSLTPTVAIVDPALVMTVPGFIAADTGMDVLTHATEAYVSQMANDYTDGLALQAIKIVFDYLERSVKDADFEAREKMHNASTMAGMAFANAFLGISHSMAHKIGAQFHTVHGRTNAILLPYVIRYNGTRPAKTATWPKYNYYRADEKYQDIAKLLGLPAATPEEAVESYAKAVYDLGTRLGIKMNFRDQGIDEKEWKEKSRELAFLAYEDQCSPANPRLPMVDHMQEIIEDAYYGYEERPGRRK

SEQ ID NO: 9465 - DNA, 354 bp, Streptococcus agalactiae
gtgatttcgaaaccagataaaaataaaatccgccaaaaacgccaccgtcgtgttcgcggtaaactctctggaactgctgatcgcccacgtttgaacattttccgttctaatacaggcatctacgctcaagtaattgatgacgtagcgggtgtaacgctcgcaagtgcatcaactcttgataaagaagtttctaacggaacaaaaacagaacaagccgttgttgtcggtaaacttgttgctgaacgcgcagtagctaaaggtatttctgaagtggtgtttgaccgcggtggatatctctatcacggacgtgtaaaagctttggctgactcagctcgtgaaaacggattgaaattc

SEQ ID NO: 9466 - protein, 118 aa, Streptococcus agalactiae
MISKPDKNKIRQKRHRRVRGKLSGTADRPRLNIFRSNTGIYAQVIDDVAGVTLASASTLDKEVSNGTKTEQAVVVGKLVAERAVAKGISEVVFDRGGYLYHGRVKALADSARENGLKF

SEQ ID NO: 9467 - DNA, 1161 bp, Streptococcus agalactiae
atgggtgaacttccatttctaaatatgcttaacttagttagtggtaatgcaatgagaaacttttcggtattctctatgggagttagcccttacattactgcgtctattgttgttcagttacttcaaatggatattcttccgaagtttgttgaatggggaaaacaaggagaggtaggtcgtcgtaagcttaaccaagctacacgttatatttctttgttccttgcattcgtacaatcaattggtattactgctggttttaacactctatcaagtgttgctttagttaaaactccgaatgtacaaacatatttgcttattggtgcaatccttacaacaggtagtatggtggttacttggctaggtgaacaaattactgataagggattcggaaatggagtgtctatgattatctttgcgggtatcatttcttccattccaagtgcaattacaactatctacgaagatttctttgtaaatgtacgctcttcagcaattacaaattcttacatctttgtcgggatccttatcgtagcagtattagcaattgtattttttacaacatttattcaacaagctgaatacaaaattccaatccaatatacaaaacttgttcaaggagctcctacaagttcatatcttcctctaaaagtaaatccagctggtgttattcccgttatctttgctagctcgattacaacaattccaagtacgattattcctttctttcaaaatggcaaagaaattccttggcttactaaactccaagaattacttaattatcaaaccccagtcggtatgattatctatgctatcttgattattctgttctctttcttctatacttttgtacaagtaaaccctgaaaagacagcagagaatcttcaaaaaaattcgtcctacattccaagtattcgaccaggacgagaaacagaagaatatatgtcatcgctattgaaaaaattagcaacaattggttcagtatttctagcatttatttccttgttaccaattattgctcaacaagcgttgcatttgtcatcaagtattgcgttaggtgggacaagcttactcattttgattgcaacgggtattgaaggtatgaaacaactcgagggctatcttttgaagagacgctatgttggattcatgaatacaacagaa

SEQ ID NO: 9468 - protein, 387 aa, Streptococcus agalactiae
MGELPFLNMLNLVSGNAMRNFSVFSMGVSPYITASIVVQLLQMDILPKFVEWGKQGEVGRRKLNQATRYISLFLAFVQSIGITAGFNTLSSVALVKTPNVQTYLLIGAILTTGSMVVTWLGEQITDKGFGNGVSMIIFAGIISSIPSAITTIYEDFFVNVRSSAITNSYIFVGILIVAVLAIVFFTTFIQQAEYKIPIQYTKLVQGAPTSSYLPLKVNPAGVIPVIFASSITTIPSTIIPFFQNGKEIPWLTKLQELLNYQTPVGMIIYAILIILFSFFYTFVQVNPEKTAENLQKNSSYIPSIRPGRETEEYMSSLLKKLATIGSVFLAFISLLPIIAQQALHLSSSIALGGTSLLILIATGIEGMKQLEGYLLKRRYVGFMNTTE

SEQ ID NO: 9469 - DNA, 459 bp, Streptococcus agalactiae
ttgtttgataaagtaaagccaatcgtaatgaagctgagaagaaattattttgttcaactttgggaatatgatgattggattcaagaaggacgtattgtactttttaggttgcttgaagagcatccgtatttattggataatgaaagcaaactattcatttactttaaaacaaaattttcaaattatttaaacgatgtattaagacaccaagattgtcaaaagcgacaatttaataaaatgccttatgaagaaataagtgaagttagtcactatgttaagagtaaaggactagttttagatgactatattgcttatcgtgatactttaacaaaagtggaagaaactttgtcagatattgataaagaaaaatttgaaaaactgattagtggtgaacgttttgcggggaagaaacaattcatacgagatattcaaccctttttcaatgcttttaaagcggat

SEQ ID NO: 9470 - protein, 153 aa, Streptococcus agalactiae
MFDKVKPIVMKLRRNYFVQLWEYDDWIQEGRIVLFRLLEEHPYLLDNESKLFIYFKTKFSNYLNDVLRHQDCQKRQFNKMPYEEISEVSHYVKSKGLVLDDYIAYRDTLTKVEETLSDIDKEKFEKLISGERFAGKKQFIRDIQPFFNAFKAD

SEQ ID NO: 9471 - DNA, 444 bp, Streptococcus agalactiae
atgtcaaaagtacgtggctttgaattagttagccaatttagcaataaagagttattaccaaaacgagaaacagctcacgcagctggctatgatttaaaagtagctaaaaaaacggttattgaacctggtgaaattacattggtcccgaccggtattaaagcatacatgcaaccaggggaggtcctgtacctttatgatcgttcatcgaatccacgtaaaaaagggattgtcctaataaattcagttggtgttattgatggtgactactataataaccaagtcaatgaaggacatatttttgcacagatgcaaaatattactgatcaggctgttattttagaagaaggggaacggattgttcaggctgtttttgccccattcttattggcagatgacgatcaggctacaggaatgcgtacaggtggttttggtagtactggaaaa

SEQ ID NO: 9472 - protein, 148 aa, Streptococcus agalactiae
MSKVRGFELVSQFSNKELLPKRETAHAAGYDLKVAKKTVIEPGEITLVPTGIKAYMQPGEVLYLYDRSSNPRKKGIVLINSVGVIDGDYYNNQVNEGHIFAQMQNITDQAVILEEGERIVQAVFAPFLLADDDQATGMRTGGFGSTGK

SEQ ID NO: 9473 - DNA, 1206 bp, Streptococcus agalactiae
atgtacgggggaacatgtatcaacattggatgtattccgacaaaaacgcttttagtatcagctagcaaaaatcatgattttcaagaagctatgactactagaaatgaagttacaagtcgtttacgtgctaaaaattttgctatgttggataataaagacactgtggatgtttataatgctaaagcccgctttatatcaaataaagtggtcgaattaacaggaggagctgacaaacaagaacttacagctgatgttattattatcaatactggtgctaagtcagtacaattaccaatcccaggattagctgattctcaacatgtttatgattcaacggcaatccaagaattggctcatcttcctaaacggttaggtatcattggaggcggtaatattgggcttgaatttgcgactttatattccgaattagggagcaaagtgacagttattgatagtcaatcccgtatctttgcgcgtgaggaagaggaattatcagagatggctcaagattatttagaagagatggggatatcttttaaattatcagccgatatcaaatctgtgcaaaatgaagatgaagacgttgttattagctttgaggatgaaaaattaagctttgatgcagtattatatgcaacaggacgtaagccaaatacagaaggtttagcacttgaaaatacagatattaaattgacagaacgtggagctattgctgttgatgaatattgccaaacttctgttgagaatatttttgcagttggtgatgttaatggcggccctcaattcacatatatttctttagatgactcacgtattgtcttaaattatttgaattgtgataaggattattctctaaaaaatcgaggagcagtaccgacttcaacctttacaaatcctcctttagcaacggtaggtctagatgaaaagaccgctaaggaaaaaggatatcaagttaaatctaatagccttcttgtttctgccatgccacgtgcacatgttaataatgaccttagaggtatttttaaagttgtggtagatactgagacaaatcttattttgggagctcgcttatttggtgcagaatcccatgaattaattaatatcatcacaatggcaatggataataaaatcccatatacttatttccaaaaacaaattttcactcacccaacaatggtagagaattttaatgatttgtttaacttt

SEQ ID NO: 9474 - protein, 402 aa, Streptococcus agalactiae
MYGGTCINIGCIPTKTLLVSASKNHDFQEAMTTRNEVTSRLRAKNFAMLDNKDTVDVYNAKARFISNKVVELTGGADKQELTADVIIINTGAKSVQLPIPGLADSQHVYDSTAIQELAHLPKRLGIIGGGNIGLEFATLYSELGSKVTVIDSQSRIFAREEEELSEMAQDYLEEMGISFKLSADIKSVQNEDEDVVISFEDEKLSFDAVLYATGRKPNTEGLALENTDIKLTERGAIAVDEYCQTSVENIFAVGDVNGGPQFTYISLDDSRIVLNYLNCDKDYSLKNRGAVPTSTFTNPPLATVGLDEKTAKEKGYQVKSNSLLVSAMPRAHVNNDLRGIFKVVVDTETNLILGARLFGAESHELINIITMAMDNKIPYTYFQKQIFTHPTMVENFNDLFNF

SEQ ID NO: 9475 - DNA, 1452 bp, Streptococcus agalactiae
ttggctaataagattcgtgtgcgttatgcaccaagtccaacaggattgttacacatcggaaatgcgcgtactgcgctctttaactacctttatgctcgccatcatggtggggattttgttattcgtattgaagatactgaccgaaaacgccacgtcgaagatggtgaacgctctcaattggagaacttacgttggctaggtatggactgggatgaaagtcctgaaacacatgaaaattatcgtcaatcagaacgccttgagctctaccaacgttatattgatcagttgttagcagaaggtaaagcctacaagtcctatgtgactgaggaagaattagcagcagagcgtgaacgccaagaattggcaggcgaaacacctcgctatatcaacgaatttatcggaatgtcagaaactgaaaaagaagcttacattgcagagcgtgaagcagcaggcatcattccgacagtacgccttgctgttaatgaatctgggatttataaatggactgatatggtaaaaggtgacattgagtttgaaggctctaatatcggcggagactgggttattcagaagaaagatggttatccaacttacaatttcgcagtagtcattgatgatcatgacatgcaaatttcgcatgttatccgtggcgatgaccatattgcaaatacgccaaaacaattaatggtttatgaagcactcggttgggaagcgccacaatttggtcacatgacattgattataaactcagagactggtaagaaattatcaaaacgcgacaccaatactcttcaatttatcgaagactatcgtaaaaaaggttatatgtcggaagctgtctttaatttcattgcccttcttggctggaatcctggtggagaagaagaaatcttctcacgcgagcaattaattaatctatttgatgaaaatcgtcttagcaaatcaccagcagcattcgatcagaagaaaatggattggatgagtaatgattacctaaaaaatgctgattttgagagtgtttttgcactttgcaaaccattcttagaagaagctggtcgacttacagacaaagctgaaaaattagttgagctttatcaacctcaattaaaatcagctgatgagattgtaccattaacagaccttttctttgcagattttccagaactaacagaagccgaaaaagaagtaatggcagctgaaacagtcccaacagtcttatctgcttttaaggaaaagttagtatcgctttctgacgaagaattcactagagatactattttccctcaaattaaggctgttcaaaaagaaacaggtattaaaggtaagaacctatttatgcctattcgtattgcggtttctggtgaaatgcatggaccagagttaccagatactatttatttattaggtaaagaaaaatcagttcaacatatcgataatatgttagcaaaatta

SEQ ID NO: 9476 - protein, 484 aa, Streptococcus agalactiae
MANKIRVRYAPSPTGLLHIGNARTALFNYLYARHHGGDFVIRIEDTDRKRHVEDGERSQLENLRWLGMDWDESPETHENYRQSERLELYQRYIDQLLAEGKAYKSYVTEEELAAERERQELAGETPRYINEFIGMSETEKEAYIAEREAAGIIPTVRLAVNESGIYKWTDMVKGDIEFEGSNIGGDWVIQKKDGYPTYNFAVVIDDHDMQISHVIRGDDHIANTPKQLMVYEALGWEAPQFGHMTLIINSETGKKLSKRDTNTLQFIEDYRKKGYMSEAVFNFIALLGWNPGGEEEIFSREQLINLFDENRLSKSPAAFDQKKMDWMSNDYLKNADFESVFALCKPFLEEAGRLTDKAEKLVELYQPQLKSADEIVPLTDLFFADFPELTEAEKEVMAAETVPTVLSAFKEKLVSLSDEEFTRDTIFPQIKAVQKETGIKGKNLFMPIRIAVSGEMHGPELPDTIYLLGKEKSVQHIDNMLAKL

SEQ ID NO: 9477 - DNA, 984 bp, Streptococcus agalactiae
atgagtacgattagacaagtcgccgagaaagctggcgtatcaacatctactgtctcaaggtatatatcccaaaatggttacgttagtcaaaaagcaagtcaaaaaatcgagcaagctatccgcgaactccattatgttccaaatttccttgcacaatctctgaaaaccaaaaaaaatcaacttgttggattactacttcccgatatttcaaaccctttctttccaagacttgctagaggagttgaagaatttctaaaagaacagggttatcgtgtcatgcttggcaacacaaataacaagagccatttagaagaagagtacttaaatgtgctattacaaagtaatgctgcagggattattacaacacacgatttcaccaaaaatcatcctgaaatagatattccagttgtagttgttgaccgcgttaatcaagaaacacagtacggcgttttctctgataataaagagggaggaaaattagcagctcaagctatttggacagcaggtgctaccaatatattactcattcgtggtccgctagataaagctgataaccttaatcaaaggtttcaaggaagccaaaattacctattaaacaaaggggcttgttttgctatcgaagatagtgccagttttgattttgcagagattcaaattgaagcgaaaactttacttgaccaccatccagacattgatagcattatcgctccatctgatatacatgctattgcctacctacacgagattcttaatcgagggaagcgaatccctgaagatgtacaaattattggttatgatgatattttaatgagccaatttatctacccttcgttgtcaactattcaccaatcatcatatattatgggacaaaaagcagctgaattaattttcaaaattactaatcaattacctattaccaataagcgtattaaattacccgttcattatgtcgaacgtgaaaccctaaggaggaaaatagatgag

SEQ ID NO: 9478 - protein, 328 aa, Streptococcus agalactiae
MSTIRQVAEKAGVSTSTVSRYISQNGYVSQKASQKIEQAIRELHYVPNFLAQSLKTKKNQLVGLLLPDISNPFFPRLARGVEEFLKEQGYRVMLGNTNNKSHLEEEYLNVLLQSNAAGIITTHDFTKNHPEIDIPVVVVDRVNQETQYGVFSDNKEGGKLAAQAIWTAGATNILLIRGPLDKADNLNQRFQGSQNYLLNKGACFAIEDSASFDFAEIQIEAKTLLDHHPDIDSIIAPSDIHAIAYLHEILNRGKRIPEDVQIIGYDDILMSQFIYPSLSTIHQSSYIMGQKAAELIFKITNQLPITNKRIKLPVHYVERETLRRKIDE

SEQ ID NO: 9479 - DNA, 882 bp, Streptococcus agalactiae
atgtcattaattattcttacggttattttggttttagtgattgttctgttgataacttctttatacgttgttaaacaacagacagtagccatcattgaacgctttggtaaatatcaaaagactgctactagcggtattcatattcgtgtaccattgggtatcgataagattgcagcacgagtgcagttacgtcttttacagagtgaaattatcgttgagacaaaaacaaaagataatgtttttgtcactttaaatattgctacacaatatcgtgtcaatgaaaataacgttacagacgcttattacaaattaataaagccagaagctcagattaaatcttatatcgaagatgctttgcgttcatcagtacctaaacttacattagacgagctatttgaaaagaaagatgaaatagccttggaagttcaacatcaagtggcagaagaaatgtcaacatacggctacatcattgttaagactttaattactaaggttgagccagatgcagaagtaaaacaatccatgaacgaaatcaatgctgcacaacgtaaacgtgtagcagctcaagaattagcgaatgctgataagatcaaaattgtaactgctgcagaagcagaagcagaaaaagatcgtctacatggtgtgggtattgcgcaacaacgtaaagcaattgtagatgggttagctgattcgattcaagaattgaaagatgctaacgtgacattgacagaagaacaaatcatgtctatcttgttaacaaatcaatatttagatactttaaatacatttgctattaatggtaatcaaacgattttcttaccaaataacccagaaggtgttgaagatattcgtacacaagttttatctgctcttaaaacaaga

SEQ ID NO: 9480 - protein, 294 aa, Streptococcus agalactiae
MSLIILTVILVLVIVLLITSLYVVKQQTVAIIERFGKYQKTATSGIHIRVPLGIDKIAARVQLRLLQSEIIVETKTKDNVFVTLNIATQYRVNENNVTDAYYKLIKPEAQIKSYIEDALRSSVPKLTLDELFEKKDEIALEVQHQVAEEMSTYGYIIVKTLITKVEPDAEVKQSMNEINAAQRKRVAAQELANADKIKIVTAAEAEAEKDRLHGVGIAQQRKAIVDGLADSIQELKDANVTLTEEQIMSILLTNQYLDTLNTFAINGNQTIFLPNNPEGVEDIRTQVLSALKTR

SEQ ID NO: 9481 - DNA, 1881 bp, Streptococcus agalactiae
atgaagaaatgttttttggctatttgtttagctcttagtttttttatggtttcagttcaagcagatgaggtggactataacattcctcattatgagggtaatctaactattcacaatgataatagtgctgattttacagagaaggttacttaccaatttgattcgtcctataatggacagtatgtcacattaggtacggcgggtaagttacctgacaattttgatattaataataagccacaggttgaagtttcaattaatggtaaagtaaggaaagttagttaccagatagaagatttggaggatggctaccgtttgaaagtgtttaatggtggtgaagcaggtgatactgttaaagtcaatgttcagtggaaactaaaaaatgttctatttatgcataaggatgttggtgaacttaactggattcctattagcgactgggataaaacgttagagaaagtagatttttggatatcaactgacaaaaaggttgctctttctcgtctttgggggcacttgggttatcttaaaactcctcctaaaataagacaaaataataatcgttaccatttgacagcttttaatgtaaacaaacgattagaatttcatggttattgggatagatcttattttaatctacctacaaacagtaaaaataattacaagaaaaaaattgaatatcaagagaagatgatagagcgtcatggttttatcctaagtttcttgttaaggatattattaccttcattctttattattgtgacactattcatctcaattagggtgttcctgtttagaaaaaaagttaataaatacgggcaattccctaaggaacatcatttatatgaagcacctgaggacctttcaccactagagttaactcaaagcatttatagtatgagttttaaaaattttcaagatgaggagaagaaaactcaccttatcagtcaagaacaactcattcagtcaattctattagacttgattgatagaaaagtattgaattatgatgataacttgttatctctagctaacttagatagagcttctgatgcagaaatagattttatagagtttgcttttgcggattctacgagtttgaagccagatcaactcttttctaattaccaatttagttataaagaaacactacgtgaactgaaaaagcagcacaaggcttcagatctgcaaactcaaatgagacgccgaggaagtaatgccttatcaagaattacgcgtctcacaaggttgatttctaaagacaatataaactctcttagaagaaagggaatttcatccccttatcgtaaaatgtcttcagaagagtctaaagaattatctaggttgaaaagattcagttacctatcacctcttatttcttttgttgttataatttatacgctttttttaaattattttacctatttctgtatctatctcttattgtttggtgttatcctgttgttgaataaaatcatttttatgatgacaagaaaaataagtaacggttatattgtaactgaagatggagcaagtcgtgtctaccaatggactagttttaggaacatgctaagggatatcaaatcgtttgatcgttcagagttagaaagtatcgtattatggaatcgaatattggtttacgctactttattcggctacgctgaccgtgttgagaaagcactcagagtgaaccaaatagatattccagaaagatttgcaaacattgatagtcatcaatttgcgatttcagtcaatcaatctagtaatcatttttcaacgataactgaagatgttagtcacgcttctaattttagtgttaattcaggcggttcttcaggtggtttctcaggcggcggaggcggcggaggtggtggtgccttc

SEQ ID NO: 9482 - protein, 627 aa, Streptococcus agalactiae
MKKCFLAICLALSFFMVSVQADEVDYNIPHYEGNLTIHNDNSADFTEKVTYQFDSSYNGQYVTLGTAGKLPDNFDINNKPQVEVSINGKVRKVSYQIEDLEDGYRLKVFNGGEAGDTVKVNVQWKLKNVLFMHKDVGELNWIPISDWDKTLEKVDFWISTDKKVALSRLWGHLGYLKTPPKIRQNNNRYHLTAFNVNKRLEFHGYWDRSYFNLPTNSKNNYKKKIEYQEKMIERHGFILSFLLRILLPSFFIIVTLFISIRVFLFRKKVNKYGQFPKEHHLYEAPEDLSPLELTQSIYSMSFKNFQDEEKKTHLISQEQLIQSILLDLIDRKVLNYDDNLLSLANLDRASDAEIDFIEFAFADSTSLKPDQLFSNYQFSYKETLRELKKQHKASDLQTQMRRRGSNALSRITRLTRLISKDNINSLRRKGISSPYRKMSSEESKELSRLKRFSYLSPLISFVVIIYTLFLNYFTYFCIYLLLFGVILLLNKIIFMMTRKISNGYIVTEDGASRVYQWTSFRNMLRDIKSFDRSELESIVLWNRILVYATLFGYADRVEKALRVNQIDIPERFANIDSHQFAISVNQSSNHFSTITEDVSHASNFSVNSGGSSGGFSGGGGGGGGGAF

SEQ ID NO: 9483 - DNA, 621 bp, Streptococcus agalactiae
atggatgaattagacttgccagaaaactttaaaaatagtggtatgttaagttttcgagtaacacctaaaaaagatcgcattgatgtttttgttacaaagtctgaattaagtaaagatttaaatttagaagaattagcagatttgggtgacatttcaaaaatgtctccagaagacttttttaaaacattggaacaatcgatgttggaaaaaggggatacggatgcccatgccaaattagcagaaattgaaaatatgatggataaagcaactcaagaagtagttgaggaaaatgtttctgaagaacaacctgaaaaggaagtagaaacgattggatatgttcactatgtctttgattttgataatattgaagctgtagttcgattttcacaaacgattgattttccaatagaagcttctgaactctataaaaatggtaaaggctatcatatgacaattttgctagacttggaaaaccaaccaagctactttgctaatttgatgtatgctcgaatgcttgaacatgctaatgtgggcacaaaaacacgagcttacttgaaagagcatagtattcaattgattcatgatgatgctatttcaaaattacaaatgattgagatggga

SEQ ID NO: 9484 - protein, 207 aa, Streptococcus agalactiae
MDELDLPENFKNSGMLSFRVTPKKDRIDVFVTKSELSKDLNLEELADLGDISKMSPEDFFKTLEQSMLEKGDTDAHAKLAEIENMMDKATQEVVEENVSEEQPEKEVETIGYVHYVFDFDNIEAVVRFSQTIDFPIEASELYKNGKGYHMTILLDLENQPSYFANLMYARMLEHANVGTKTRAYLKEHSIQLIHDDAISKLQMIEMG

SEQ ID NO: 9485 - DNA, 1107 bp, Streptococcus agalactiae
ttgtatgaaaaagatgctaacaaacccgctgctattgcttccttgactaaaataatgaccgtttatatggtctataaagaaattgataacggtaacctcaagtggaataccaaagtaaatatatctgactacccttatcaactaacacgcgaatctgatgctagtaatgttcctttagaaaaaaggcgctatactgttaaacagctcgtggacgctgccatgatttctagtgctaacagtgcagccattgctttggctgaacatatttcaggaaccgaaagtaaatttgttgataaaatgactgctcaattggaaaagtggggaattcatgatagccacctagtcaatgcttctggcttaaataatagtatgttaggcaatcacatttatccaaaatcgtcacaaaacgacgaaaataaaatgagtgcacgtgatattgctattgttgcctaccatttggtcaacgaatatccttccattcttaagattactagtaagtccgttgctaaatttgataaagatattatgcattcttataactacatgctaccagatatgcctgtctttagaccaggtattacaggtttgaaaactgggacaacggaattagctggccaatcttttattgctacatctactgaaagtggaatgagactactcactgttattatgcatgctgataaggccgataaagacaaatatgctcgctttacagcaactaactctctcttgaactatatcacaaacacctacgaacctaaccttgtattagctaaaggagctgcatataaaggtaaagaagcaagtgtgagagacggaaaagaacaatcggtcatcgctgttgctaaaaacgatttgaaagtagtacagaagaaaaatatcactaaacaaaatcagttaaaaattaactttaaaaaagagcttactgctcctattacaaaaaaagagaacctagggaaagcttattacgttgaccttaataaggttggaaaaggctatctcataaaggaacctagcgttcatttagtggcaaaagatagtattgagcgcagtttcttcctcaaagtgtggtggaatcattttgtgcgctacgttaacgaaaaactt

SEQ ID NO: 9486 - protein, 369 aa, Streptococcus agalactiae
MYEKDANKPAAIASLTKIMTVYMVYKEIDNGNLKWNTKVNISDYPYQLTRESDASNVPLEKRRYTVKQLVDAAMISSANSAAIALAEHISGTESKFVDKMTAQLEKWGIHDSHLVNASGLNNSMLGNHIYPKSSQNDENKMSARDIAIVAYHLVNEYPSILKITSKSVAKFDKDIMHSYNYMLPDMPVFRPGITGLKTGTTELAGQSFIATSTESGMRLLTVIMHADKADKDKYARFTATNSLLNYITNTYEPNLVLAKGAAYKGKEASVRDGKEQSVIAVAKNDLKVVQKKNITKQNQLKINFKKELTAPITKKENLGKAYYVDLNKVGKGYLIKEPSVHLVAKDSIERSFFLKVWWNHFVRYVNEKL

SEQ ID NO: 9487 - DNA, 810 bp, Streptococcus agalactiae
atgctacttgatatgctttcctatgattttatgcaacgagcgctcttagcagttgtggctattagtatttttgctccaattttaggcatcttcctaattttacgtcgtcagagtttgatgagtgatactttgagtcacgtttccttagccggtgttgcattaggcgttgttttaggtatctcgcctacatggtcaactattttcgttgttactttggcggcagttgtattagagtatttgcgtactgtatacaaacattatatggaaatatcaactgctatcctgatgtcgatggggttggctatatctttaatcgttatgagtaaagctcataatgttggtaatgtcagtcttgaacagtatttatttggttctattattactattgggaaggaacaagtgattgctttgtttgttattgcattaatcacttttattttaaccatcctatttattagaccaatgtatatattaacgtttgatgaggatacagcttttgtagatggattgcctgtgcgtacaatgtctattttgttcaatgttgttacaggtattgctattgcattaacaattcctgccgcaggtgctctattggtgtcaactattatggttttaccagctagtattgctatgcggttaggtcgaaattttaaaactgttatttttctgggtatgttaattggatttgtgggaatggtagctggtattttcctttcgtattattgggagacacctgctagtgcaacaataacgatgatttttattggcattttcctattagttagcttagtaggcttgcttcgcaaacgt

SEQ ID NO: 9488 - protein, 270 aa, Streptococcus agalactiae
MLLDMLSYDFMQRALLAVVAISIFAPILGIFLILRRQSLMSDTLSHVSLAGVALGVVLGISPTWSTIFVVTLAAVVLEYLRTVYKHYMEISTAILMSMGLAISLIVMSKAHNVGNVSLEQYLFGSIITIGKEQVIALFVIALITFILTILFIRPMYILTFDEDTAFVDGLPVRTMSILFNVVTGIAIALTIPAAGALLVSTIMVLPASIAMRLGRNFKTVIFLGMLIGFVGMVAGIFLSYYWETPASATITMIFIGIFLLVSLVGLLRKR

SEQ ID NO: 9489 - DNA, 846 bp, Streptococcus agalactiae
atgaataaggcattattagagggaaaagatttatcaaaaatgttaggagagttaggtttttctgacactgttatcacacaggttgcattagctgatttgcatggtaacatttcaaggagcctactaaagattgagtcttatttagctaatcttttgttagttagaaaaaaagtaatagaagtagctacttacccattgatattattgtcttttctggtgctaattatgattggccttaggaattatttaatgccccaattaggagaaaataattttgcaactagactgattacaaatgtgccgaatattttcttattacttttagcagttgtacttatttttagtttaatattttatattattcaaaagcgattgtcgcgcattaaagtagcttgttttttaacaacaattcccttagttggatcatatgttaagctttatttaactgcttactatgcccgtgagtggggaaatttattaagtcaaggtattgaattggaccaaattgttaaagtaatgcaaaatcagaaatccaaactttttagggaaataggatatgacatggaagaaggttttctatcaggtaaagcatttcaccaaaaagtattagactatccgtttttcttaactgagcttagtttaatgattgaatatggccaagttaaggcgaaattaggaacagagttagatatatatgctgatgagaagtgggaggatttttttacaaaattagctagagcgacccagttaatccaacccgttatttttatttttgtagctcttatcattgttatgatttatgcagcaatgctgttaccaatgtatcaaaatatggagatattatca

SEQ ID NO: 9490 - protein, 282 aa, Streptococcus agalactiae; identical to SEQ ID NO: 8494

SEQ ID NO: 9491 - DNA, 663 bp, Streptococcus agalactiae
gtgtcatttattattagaaaaggcaaaattttagctttgctaatagcatttttagttattaatcaacttgttcctatattggctgtgtggctcctaaagaatcactatcaaacgccttttactagtatattgttgattggcttagaattacttattattgctcttttcctttattatgccaaggttaaacaaataatcagatggaaagcattattgacaaggaaagcattagttactattctcttaggttggttatcattgagggttccacaaattattggttacctcattatgactatgcaaggggttaaagatacagcaaatcaaacagtaattatggaattaacaaagcaacttccactagctttgatgttaatttttgccataattggtgcccctattatggaagaaattatatttcgctatattatccctaaagaactttttgcgaaacatcaaaaatggggttttgtcatcggtactttagcttttgctcttattcattccccttctgatataggtagttttattatttatgctgggatgggtgctattttatcttttgtttattataaaactgagcacttagaatatagtataatgattcattttattaacaatgctcttgcttatagcgtgttaatcagtacaatgatgaataac

SEQ ID NO: 9492 - protein, 221 aa, Streptococcus agalactiae
MSFIIRKGKILALLIAFLVINQLVPILAVWLLKNHYQTPFTSILLIGLELLIIALFLYYAKVKQIIRWKALLTRKALVTILLGWLSLRVPQIIGYLIMTMQGVKDTANQTVIMELTKQLPLALMLIFAIIGAPIMEEIIFRYIIPKELFAKHQKWGFVIGTLAFALIHSPSDIGSFIIYAGMGAILSFVYYKTEHLEYSIMIHFINNALAYSVLISTMMNN

SEQ ID NO: 9493 - DNA, 642 bp, Streptococcus agalactiae
atggaaaaagtcattatttttgatatggacggcgttattgttgattccgagtacacgtttttagataataagacagaaatgttacgtgaggagggtattgatacggacgtctcgtatcaataccagtacatggggactacttttgaattcatgtggcaagctatgaaagaggagtttggcttaccgaaaacagtaaaagagtatattgctgagatgaacagacgtcgacaagcgattgtggcgcgtgatggtgttaggcccatcaaaggagctcagcgactgattcattggttacaccaacatggctatcgcttagcagttgcgtcctcatctccaatggtagatattaagcgtaatctaaaagagttgggtgtgacagaatgctttgaatacatggttacaggagaagatgtatcgtcttctaaaccagcaccagatgtttttcttagagctgcagagcttttagatgtagaccctaaagtttgtatagttatagaagatacaagaaatgggagtttagctgctaaggcagcaggaatgtattgctttggctttgctaatcctgattatccaccgcaagatttatcaatggcagacaaggttatttcagattatcaagatatctatatttatcttccggag

SEQ ID NO: 9494 - protein, 214 aa, Streptococcus agalactiae
MEKVIIFDMDGVIVDSEYTFLDNKTEMLREEGIDTDVSYQYQYMGTTFEFMWQAMKEEFGLPKTVKEYIAEMNRRRQAIVARDGVRPIKGAQRLIHWLHQHGYRLAVASSSPMVDIKRNLKELGVTECFEYMVTGEDVSSSKPAPDVFLRAAELLDVDPKVCIVIEDTRNGSLAAKAAGMYCFGFANPDYPPQDLSMADKVISDYQDIYIYLPE

SEQ ID NO: 9495 - DNA, 738 bp, Streptococcus agalactiae
atgaaaattttaattcttgatgatgaaatgtttgccagacaagaattatcgtttttagttgaacatagccaggaggttgacaaccctgagatttttcaggctgaggatatcagtgaagccgaaaaaatcttatttagacagcaaattgatttaatttttttagatatttcgcttagtgaagaaaatggctttactttggctaatcagttgagccaacttgcacatcccccacttgttgtttttgcgacagcttatgataactacgctgtgaaagcttttgaaagtaacgctgttgattatatcatgaaaccgtttgaacaacagcgcgttgatatggctctatcaaaagtgaagaaattgagccaactcaccactgcttcagatgtagagcaagcaatacctaaaaaagccagtgttgaattgttaaccttgacattatcagatcgcagtgttgttgttaaaatgcaagatattgttgcagctagtgttgaagatggcgaattaactgttagtacagttcagaaaacttacactattcggaagacactcaattggtttaagtcacgcgctgtagcaccatattttctccagattcatcgaaacacagtgattaatctagagatgattgaggaaattcaaccttggtttaatcatactttgttactaattatgtctaatggagagaaatttccagtaggtcgatcgtatttaaaagacctaaatgagcatttaaccatg

SEQ ID NO: 9496 - protein, 246 aa, Streptococcus agalactiae
MKILILDDEMFARQELSFLVEHSQEVDNPEIFQAEDISEAEKILFRQQIDLIFLDISLSEENGFTLANQLSQLAHPPLVVFATAYDNYAVKAFESNAVDYIMKPFEQQRVDMALSKVKKLSQLTTASDVEQAIPKKASVELLTLTLSDRSVVVKMQDIVAASVEDGELTVSTVQKTYTIRKTLNWFKSRAVAPYFLQIHRNTVINLEMIEEIQPWFNHTLLLIMSNGEKFPVGRSYLKDLNEHLTM

SEQ ID NO: 9497 - DNA, 990 bp, Streptococcus agalactiae
atggaagattttattgaaatgaatgaaccattgtttgcgacctacgttgatttgagtgaaggttgtccgtctcatgataccttagagcgtgtgattagtcttgttaattcagaccgtttaaaagagcttaaagttcaatttgagcaatcattgacaagcttagatgccgttcatcaactgatttcagtggacggtaaaacgattcgaggcaatcgaggtaaaaatcagaagcctgttcatattgtaacggcttatgatgggggtcatcatcttagtttgggacaggtagcggttgaggagaaaagtaatgaaattgttgccattcctcagttattgcggacaattgatatccgtaaaagcattgtaacgatagacgcaatgggcacgcagacggctatcgttgatacgattataaaaggtaaagcagactattgcttagccgtcaaaggaaatcaagaaacactttatgatgatattgctctttattttagtgatgtcaacttattggaagaactccaagaaaatgcgcagtattatcagactgttgaaaaatctaggggacagattgaagttagagaatactgggtgtcttccgatatcaaatggttgtgtcaaaaccatcccaaatggcataagttacgtggtattgggatgactcgtaacacgattgataaggatggtcagctgagtcaagagaatcgttattttatctttagctttaagccggatgtcctcacatttgccaattgtgtacgaggtcattggcagatagagagtatgcactggttattggacgttgtttatcatgaagatcatcatcagacattggataaaagagccgcatttaacctaaatcttatccgaaaaatgtgcttatattttctcaaagtgatggtatttcctaaaaaagacctcagttatcgtcgcaaacaacggtatatttctgtccatttggaagattatttagtccaattatttggagaaagaggc

SEQ ID NO: 9498 - protein, 330 aa, Streptococcus agalactiae
MEDFIEMNEPLFATYVDLSEGCPSHDTLERVISLVNSDRLKELKVQFEQSLTSLDAVHQLISVDGKTIRGNRGKNQKPVHIVTAYDGGHHLSLGQVAVEEKSNEIVAIPQLLRTIDIRKSIVTIDAMGTQTAIVDTIIKGKADYCLAVKGNQETLYDDIALYFSDVNLLEELQENAQYYQTVEKSRGQIEVREYWVSSDIKWLCQNHPKWHKLRGIGMTRNTIDKDGQLSQENRYFIFSFKPDVLTFANCVRGHWQIESMHWLLDVVYHEDHHQTLDKRAAFNLNLIRKMCLYFLKVMVFPKKDLSYRRKQRYISVHLEDYLVQLFGERG

SEQ ID NO: 9499 - DNA, 750 bp, Streptococcus agalactiae
atggtaggccttgcagcagggctcgccattaaaggttacaagccataccttcatacttttggtcctttcgcgtcaaggcgtgtctttgatcaagtattcttatcgttaggttactcacaattatcagctacgattattggctcagatgcaggaattagcgcagaaatgaatggcggaactcatatgccttttgaagagttaggtctactaaggttaattcccaaagcgactatttttgaggttagtgatgatattcagtttgaagcaattttaaaacaaacattaagtattgatggcctaaaatacattagaactattcgtaaggcccccactgcagtttatgagggacgcgaagatttttcaaagggttttatacaattacgccagggaaaagatattactcttgtagcaagtggtattatggtttctagagcgatagaagcagccgactacctcaaagaactagggattgaggcctcagttatcgacctttttaaaattaagccccttccagaagaactgaaaccattactgatagatcaatccattgtaactattgagaatcataaccgtattggcggtatcggaagtgcattatgcgaatggcttagtatggagaaagacactactgttagtcgtatgggtattgatgagcgatttggtcaggtaggtcagatggaatatttattagaggagtatggactcgctgttaaagatatagtacagcattgcaaatcaatttataaatca

SEQ ID NO: 9500 - protein, 250 aa, Streptococcus agalactiae
MVGLAAGLAIKGYKPYLHTFGPFASRRVFDQVFLSLGYSQLSATIIGSDAGISAEMNGGTHMPFEELGLLRLIPKATIFEVSDDIQFEAILKQTLSIDGLKYIRTIRKAPTAVYEGREDFSKGFIQLRQGKDITLVASGIMVSRAIEAADYLKELGIEASVIDLFKIKPLPEELKPLLIDQSIVTIENHNRIGGIGSALCEWLSMEKDTTVSRMGIDERFGQVGQMEYLLEEYGLAVKDIVQHCKSIYKS

SEQ ID NO: 9501 - DNA, 2127 bp, Streptococcus agalactiae
atgtcaaaacaagtctttgaaatgatttttgctggaaaaaaattagttgttgaaactggccaagtggctaaacaagcaaatggatcagttgtcgttcgttatggagattctactgtactcacagcagcagttatgtctaagaaaatgtcaacaggtgattttttcccacttcaagtcaattacgaagaaaaaatgtatgctgctgggaaatttccgggtggctttaacaaacgtgaagggcgtccaagtacggatgctaccttaacagcacgtcttattgatagaccaatccgtccgatgtttgctgagggatttcgtaacgaagtacaggtcatcaatactgttctttcatttgatgaaaatgctagcgcaccaatggctgctatgtttggttcatcattagcattatcgatttccgatattcctttcaatgggccaattgctggagttcaagttgcttatgttgatggtaattttattattaatccgacagcacaagaacaagaggcttctgcgttagaattaacggttgcaggtactaaagaagcgattaacatggttgaatctggagcgaaagaactttcagaagaaatcatgctagaggctcttcttaaaggacatgaggctgtctgtgaattaatcgcctttcaagaagagattgttactgctattggtaaagaaaaagccgaggtagaacttcttcaagttgatccagaacttcaagcagaaattattgctactcataacatagctttacaggctgcagtacaagttgaagagaaaaaggctagagaagcagctacagaagcagttaaagaagtagttataggtgaatatgaggcacgttacgctgaacatgaagaatatgatcgcattatgcgtgatgttgctgaaattttagaacaaatggaacatgcagaagttcgtcgcctcattacagaagataagattcgtcctgatggacgtcgtgtggatgagattcgtccattagacgcagagattgattttttaccacaagttcatggatcaggtctctttacacgaggacaaacccaagcattatcagtattaacgttagcacctatgggtgaagcacaaatcattgatgggctaacaccagagtataagaaacgctttatgcaccactataacttcccacaatattcagttggtgagacgggacgttatggagctgcagggcgtcgtgaaattggtcacggtgctttaggagagcgtgcattagaacaagtccttccaagattggaggagtttccgtatgctatccgactagttgcagaagttttagaatcaaacggttcatcatctcaggcttctatatgtgctggaacgcttgctcttatggcaggtggtgtgcctataaaagctccagttgctggtattgccatggggctcatatcagatggaacaaactatacagtcctcactgatattcaaggattagaagaccattttggcgatatggactttaaagttgcgggtacacgtgaagggattacagcacttcaaatggatattaaaattgaaggtattacccctcaaattttggaagaagctcttgcgcaagctaaaaaagcacgctttgaaattcttgatgtccttcatggagctatcgcagagccacgtccacaattagcaccaacggcacctaagattgatatgataaaaatcgatgttgataagattaaagttgtcatcggtaaaggtggcgaaactatcgataaaatcatcgctgaaacaggtgttaagattgatattgatgaagaaggaaatgtatctatcttctctagtgatcaggctgctattgatcgtacgaaagacattattgcaagtttagtacgtgaagcaaaagtgggagaagtttaccatgctaaagtagttcgtatcgagaaattcggtgcctttgtcaacctctttgataaaacagatgcattggtacatatttcagaaattgcatggacacgtacagcaaatgtagctgatgttcttgaaattggtgaagaagttgatgtgaaagtcatcaaaattgatgataaagggcgagttgatgcttctatgaaagcattgttaccacgtcctccaaaagctgacaatcctaaaaaggaatct

SEQ ID NO: 9502 - protein, 709 aa, Streptococcus agalactiae
MSKQVFEMIFAGKKLVVETGQVAKQANGSVVVRYGDSTVLTAAVMSKKMSTGDFFPLQVNYEEKMYAAGKFPGGFNKREGRPSTDATLTARLIDRPIRPMFAEGFRNEVQVINTVLSFDENASAPMAAMFGSSLALSISDIPFNGPIAGVQVAYVDGNFIINPTAQEQEASALELTVAGTKEAINMVESGAKELSEEIMLEALLKGHEAVCELIAFQEEIVTAIGKEKAEVELLQVDPELQAEIIATHNIALQAAVQVEEKKAREAATEAVKEVVIGEYEARYAEHEEYDRIMRDVAEILEQMEHAEVRRLITEDKIRPDGRRVDEIRPLDAEIDFLPQVHGSGLFTRGQTQALSVLTLAPMGEAQIIDGLTPEYKKRFMHHYNFPQYSVGETGRYGAAGRREIGHGALGERALEQVLPRLEEFPYAIRLVAEVLESNGSSSQASICAGTLALMAGGVPIKAPVAGIAMGLISDGTNYTVLTDIQGLEDHFGDMDFKVAGTREGITALQMDIKIEGITPQILEEALAQAKKARFEILDVLHGAIAEPRPQLAPTAPKIDMIKIDVDKIKVVIGKGGETIDKIIAETGVKIDIDEEGNVSIFSSDQAAIDRTKDIIASLVREAKVGEVYHAKVVRIEKFGAFVNLFDKTDALVHISEIAWTRTANVADVLEIGEEVDVKVIKIDDKGRVDASMKALLPRPPKADNPKKES

SEQ ID NO: 9503 - DNA, 582 bp, Streptococcus agalactiae
atggggtggtggaaagaaagtatagctattgtcaaagaacaagatccagctgctcgtagttctctagaagttattttaacttatccaggaataaaagctcttgcagctcataggctatctcattttttatggaatcataattttaaattgttagcacgtatgcacagtcaattttggcgtttctggacacaaattgaaattcatcccggagcgacgatttcggaaggggtttttattgaccacggttcaggattggtcattggagaaactgccattgtagagaaaggtgctatgctataccatggggttacattgggtggcacaggtaaagacaaaggcaaacgacacccaaccatacgtaaaggagcgctaatttcagcacattctcaaatcattggtccaattgaggttggagaaaatgctaaagtcggtgctgcagcagttgtccttgcagatgtgccagcagacgtaacagtagttggtgttccagctaaagttgtccgtgtccatggtcaaaaggatgatcttcaaatccgaagtattgaacatgatcgagaagaaagttattattcgtccaaactt

SEQ ID NO: 9504 - protein, 194 aa, Streptococcus agalactiae
MGWWKESIAIVKEQDPAARSSLEVILTYPGIKALAAHRLSHFLWNHNFKLLARMHSQFWRFWTQIEIHPGATISEGVFIDHGSGLVIGETAIVEKGAMLYHGVTLGGTGKDKGKRHPTIRKGALISAHSQIIGPIEVGENAKVGAAAVVLADVPADVTVVGVPAKVVRVHGQKDDLQIRSIEHDREESYYSSKL

SEQ ID NO: 9505 - DNA, 297 bp, Streptococcus agalactiae
atgcagggttttaccaaacctaatcagttacatcggaaagcaacccaatatgtttctgctaatgcccaagcattgttaattaatgccatgttagaagaaaatattttaactgatgaagagcagttaatttataaacgaggacgtaatgcgaatagtcatacaaaagctaaaaatgctgatattattacctatcgtatgtctacaggttttgaggctcttatggggtacttggatatgactggtcagataaagcgcttggaaactctaatacagtggtgtattgaaaccattgaaaaa

SEQ ID NO: 9506 - protein, 99 aa, Streptococcus agalactiae
MQGFTKPNQLHRKATQYVSANAQALLINAMLEENILTDEEQLIYKRGRNANSHTKAKNADIITYRMSTGFEALMGYLDMTGQIKRLETLIQWCIETIEK

SEQ ID NO: 9507 - DNA, 444 bp, Streptococcus agalactiae
atgaacaaaacaactttcatggctaaaccaggccaagttgaacgcaaatggtacgttgttgacgcagcagatgtacctcttggacgtctttctgcagtagttgctagcgtacttcgcggaaaaaacaaaccaactttcacaccacacactgatacaggtgactttgtgattgttatcaatgctgaaaaagttaaattaactggtaaaaaagcgtcagataaaatctactacactcactcaatgtatccaggtggtttgaaacaaatctcagcaggtgaacttcgttctaaaaatgctgttcgtttgattgaaaaatcagttaaaggcatgcttccacataacactcttggacgtgcacaaggtatgaaattgaaagtatttgttggcggtgagcatacacatgctgcacaacaaccagaagtacttgatatctcaggacttatc

SEQ ID NO: 9508 - protein, 148 aa, Streptococcus agalactiae
MNKTTFMAKPGQVERKWYVVDAADVPLGRLSAVVASVLRGKNKPTFTPHTDTGDFVIVINAEKVKLTGKKASDKIYYTHSMYPGGLKQISAGELRSKNAVRLIEKSVKGMLPHNTLGRAQGMKLKVFVGGEHTHAAQQPEVLDISGLI

SEQ ID NO: 9509 - DNA, 996 bp, Streptococcus agalactiae
atggtccgactccgaaggggtcggcttggggctactcccccaagaatgtcattttacgtaggcctttgcgcagacaaaaaaatcggcgccgttaggcgaccgccaaaaagaaaggaggtttgtttgaaattaaaagtcagcttagacaatatcactatgacagcctatatcaaatctaaaaagtatttagctatgaaacaactcatagaaacccatttagctattactgttcaaactgcgatgactgacatgtttcgagccaccactggggatggaatccacgttgtgctccatatgaattatgacaaacaaaaaggacaagaccgcaaggctcgtccatttcgcttggagtttaatcccaataaactccgtttagttgacagtgaaattatagatactattataccatttcttgaagatatttcaatatcacgtgctgatttagcttttgatctatttgaggttgattgtagtgagtttgtgctcgaaaaaaagggcagaccaaccgcaaccaaggaatttcgttctagtactggaacgttagaaacaaaatatctaggtgctccacgttctgaaaaacaagttaggctatataacaagaaaaaggaacaactccaaaatggtactgataaagataaagactttgcaagtcaatttaagcactggtggcgcttggaatttcaattaagaagccgttcaattgatgagatattcgaggttattgatactattatttttaaaccattcaatcttaaaggcttatctattgagacccaaatctatctaactgctcttattcacgataaaaatatctggaaaaaactccatagaaatacaagagcaagatacaaaaaaattttagaaactcatcaaacatcagatactgattatttaggtttgctgaaagacttgttgaagcatgaaagaccaagactagaaaatcagctcgcttattatgggggtaggatagacaaaaatagctttcaacccttttgt

SEQ ID NO: 9510 - protein, 332 aa, Streptococcus agalactiae
MVRLRRGRLGATPPRMSFYVGLCADKKIGAVRRPPKRKEVCLKLKVSLDNITMTAYIKSKKYLAMKQLIETHLAITVQTAMTDMFRATTGDGIHVVLHMNYDKQKGQDRKARPFRLEFNPNKLRLVDSEIIDTIIPFLEDISISRADLAFDLFEVDCSEFVLEKKGRPTATKEFRSSTGTLETKYLGAPRSEKQVRLYNKKKEQLQNGTDKDKDFASQFKHWWRLEFQLRSRSIDEIFEVIDTIIFKPFNLKGLSIETQIYLTALIHDKNIWKKLHRNTRARYKKILETHQTSDTDYLGLLKDLLKHERPRLENQLAYYGGRIDKNSFQPFC

SEQ ID NO: 9511 - DNA, 432 bp, Streptococcus agalactiae
atgagaataaaagattatgctgatagtctaggagttagtagccaatctatctataaacgcatacgctctccaaaatataaagaaaggttgaaaggtcatttataccgagacaaccaaaaggttgaaaatcttgatttgataggcattaaaatacttgaagattatcattttgagaatgatgtcattgaactggaaaaaacgctgggtgatattcaagaagaattcgagcaagaaaagaagggaatgcaatatcggatagatagactagctgataagttaactcctttacttgaggataaccaaaacttggtacaaaaaaattatgagttactcaactatgttcggagcttggaacgacagaagctattgctgattattgctttagctgtcatggtaatcactttattagtggcaatatggcttgccatcttt

SEQ ID NO: 9512 - protein, 144 aa, Streptococcus agalactiae
MRIKDYADSLGVSSQSIYKRIRSPKYKERLKGHLYRDNQKVENLDLIGIKILEDYHFENDVIELEKTLGDIQEEFEQEKKGMQYRIDRLADKLTPLLEDNQNLVQKNYELLNYVRSLERQKLLLIIALAVMVITLLVAIWLAIF

SEQ ID NO: 9513 - DNA, 288 bp, Streptococcus agalactiae
atgtcacaaattaaactaacacctgaagaactccgtatttcagcacaaaaatatacaacaggatcacaatcaattacagatgtgttaacagttttgactcaagaacaagctgttattgatgaaaattgggatggtacagcatttgatagctttgaagcccaattcaatgaattatctccaaaaatcacacaatttgcacaattattagaagatataaatcaacaattattgaaagttgcggatgttgtcgaacaaacagactcagatattgcctcacaaattaataaa

SEQ ID NO: 9514 - protein, 96 aa, Streptococcus agalactiae
MSQIKLTPEELRISAQKYTTGSQSITDVLTVLTQEQAVIDENWDGTAFDSFEAQFNELSPKITQFAQLLEDINQQLLKVADVVEQTDSDIASQINK

SEQ ID NO: 9515 - DNA, 102 bp, Streptococcus agalactiae
atggaggaattttgtatggtaagtactcaatatatgaaagtaaccttacgagaaaaattcccagataaattaacatatgttgatttagaagaacttgtgata

SEQ ID NO: 9516 - protein, 34 aa, Streptococcus agalactiae
MEEFCMVSTQYMKVTLREKFPDKLTYVDLEELVI

SEQ ID NO: 9517 - DNA, 924 bp, Streptococcus agalactiae
atgcttaaaaaatcgcactttttacagatatttacactttgcttagccctcttaacgatttctggttgtcaattaaccgatactaaaaagtctggtcataccacaattaaggttgctgcccaaagttctacagagtctagtattatggcaaatattatcaccgaattaattcatcacgaattaggatacaacacaactttaataagcaatcttggttcctctacggttactcaccaagctttgctccgtggtgatgctgacattgctgccacacgttatacaggaacagacatcacagggactcttggtttaaaagctgttaaagaccctaaagaagcttctaagattgtaaaaactgaattccaaaaacgctacaatcaaacttggtatcctacttatggtttttctgatacttatgcattcatggttactaaagagtttgccagacagaataaaatcactaagatctctgatcttaaaaaattatcaacaactatgaaggcaggggttgatagttcatggatgaatcgcgagggagatggatacactgatttcgctaaaacatacggttttgaattttcacatatttaccctatgcaaattggcttagtctatgatgcggttgaaagtaacaaaatgcaatctgtattaggctactccactgacggtcgtatttcgagctatgatttagaaattttaagggatgataaaaaattctttcctccttatgaagcctctatggttgtcaacaattctatcatcaaaaaagatcctaaactaaaaaaattactccatcgactcgatggtaaaatcaatttaaaaacgatgcaaaaccttaattatatggtagatgataaacttttagaaccttcagttgttgccaaacaatttttagaaaaaaaccattattttagaggagataaa

SEQ ID NO: 9518 - protein, 308 aa, Streptococcus agalactiae
MLKKSHFLQIFTLCLALLTISGCQLTDTKKSGHTTIKVAAQSSTESSIMANIITELIHHELGYNTTLISNLGSSTVTHQALLRGDADIAATRYTGTDITGTLGLKAVKDPKEASKIVKTEFQKRYNQTWYPTYGFSDTYAFMVTKEFARQNKITKISDLKKLSTTMKAGVDSSWMNREGDGYTDFAKTYGFEFSHIYPMQIGLVYDAVESNKMQSVLGYSTDGRISSYDLEILRDDKKFFPPYEASMVVNNSIIKKDPKLKKLLHRLDGKINLKTMQNLNYMVDDKLLEPSVVAKQFLEKNHYFRGDK

SEQ ID NO: 9519 - DNA, 159 bp, Streptococcus agalactiae
atgaaaaaatatataaaatggttaattcccatatctattattgggatgttactagtaggctgtcaaatgaataggggacctaaaagtcagtcaaacgaagtaaaaaatagcaagcaatcagaagtgaagaaaggtaaaaatatgataaaaaagaacagt

SEQ ID NO: 9520 - protein, 53 aa, Streptococcus agalactiae
MKKYIKWLIPISIIGMLLVGCQMNRGPKSQSNEVKNSKQSEVKKGKNMIKKNS

SEQ ID NO: 9521 - DNA, 801 bp, Streptococcus agalactiae
atgagcccttatactttcttacgtgctataggccctgagccttggaatgctgcatacgttgaaccatcacgtcgtccagctgacggccgctatggcgaaaatccaaaccgtctttaccaacatcatcaatttcaagtggtaatgaagccttcgccgtcaaatattcaagaactttatttgaagtctttggaattactaggtatcaatccacttgagcatgatatccgttttgttgaagataactgggaaaatccatctacaggttcagctggattaggttgggaagtttggcttgatggaatggaaataacacaatttacttatttccaacaagtaggtggacttcaaacaggtcctgtaacttctgaagttacttatggactagagcgtttagcctcttatattcaagaggtagattctgtttatgatattgagtgggcaccaggtgttaaatatggtgaaatctttactcagccagagtatgagcattcaaaatattcatttgagatatcagaccaagtaatgttacttgaaaactttgagaaatttgaaagagaagcaaaacgtgctttagaagaaggacttgttcatccagcttatgactacgtccttaaatgttcacacacctttaatttattagatgcacgtggagcagtatctgttactgagcgtgcaggctatattgcacgtatccggaatttagcacgtgttgttgctaaaacctttgttgccgaacgtaaaaaacttggtttcccacttttggatgaggaaactcgtatcaaattacttgctgaggaagac

SEQ ID NO: 9522 - protein, 267 aa, Streptococcus agalactiae
MSPYTFLRAIGPEPWNAAYVEPSRRPADGRYGENPNRLYQHHQFQVVMKPSPSNIQELYLKSLELLGINPLEHDIRFVEDNWENPSTGSAGLGWEVWLDGMEITQFTYFQQVGGLQTGPVTSEVTYGLERLASYIQEVDSVYDIEWAPGVKYGEIFTQPEYEHSKYSFEISDQVMLLENFEKFEREAKRALEEGLVHPAYDYVLKCSHTFNLLDARGAVSVTERAGYIARIRNLARVVAKTFVAERKKLGFPLLDEETRIKLLAEED

SEQ ID NO: 9523 - DNA, 1278 bp, Streptococcus agalactiae
atgacttgtgcgcagaaattacgccaattaaatcctaattgggatatcgttttgattgataaagaaattcatccagattatgttccaaatggcttaaattggtattatcgtcacgaaattagtggtttaaatcaggccatgtggcagacagaagaagagcaacggttgcagaatatacgctgtctatttggtctaaaagttgagaaaattaataaagaagatagggaattaatgttatcagatggttcttctgtctattatgatcaattgatttgtgccatgggctcccaagcagaatcaacttatattgatggggctgatgcgcaaggtgttttaacaacaaaaacttatgcaactagtcaaaatgctaagcaggtattagataaaagtcataaggtagcagttgttggggcaggtatcatcggtttagatattgcttatagtttacatgaatcagggaaggcggtcactttgttagaagctcaagaaagaccagacttcaggcatacagatcctgatatgtcccttcctttacttgatgcgatggctgaatcaaaactacattttttccaaaatcaaaaggttgagaaaattactgtaacccgagaagaaaaactttgtttgcgaacgctaacaggagacacctttacagttgatgctgtcatattagctgttaattttcgtccggatagtcgtcttttaactgggttggttgatttaagtgttgataatagtgttgttgtaaatgattatttccaaacgagtgaccctaatatctatgctattggcgatttgatttggtcgtattttaaaggtcttaatagtgcttattatatgcccttaattaaccaagcaatccgttcggcacaaatgttggcataccatttatcgggacatgctgttccaaaattaaaaataacacgcgctacaggatctaaacactttggctattatagagctaacattggattaactgaattggaagctggtttttacgaggataccgttagtgttacttatttccctaaagaacagtatgatttaaggataaaattgattgctaaccaaaaaacgggccatttattgggggctcaattaatctcaaaggaaaattgtttggctactgccaatcagcttgttcaagctatatcgtgtgatatgacagattttgatctggcttttcaagatttcatttatacagctagagaatctgagatggcttatatgttgcatcaagcagctatcaacctttatgaaaagaggattgggctatgcgaa

SEQ ID NO: 9524 - protein, 426 aa, Streptococcus agalactiae
MTCAQKLRQLNPNWDIVLIDKEIHPDYVPNGLNWYYRHEISGLNQAMWQTEEEQRLQNIRCLFGLKVEKINKEDRELMLSDGSSVYYDQLICAMGSQAESTYIDGADAQGVLTTKTYATSQNAKQVLDKSHKVAVVGAGIIGLDIAYSLHESGKAVTLLEAQERPDFRHTDPDMSLPLLDAMAESKLHFFQNQKVEKITVTREEKLCLRTLTGDTFTVDAVILAVNFRPDSRLLTGLVDLSVDNSVVVNDYFQTSDPNIYAIGDLIWSYFKGLNSAYYMPLINQAIRSAQMLAYHLSGHAVPKLKITRATGSKHFGYYRANIGLTELEAGFYEDTVSVTYFPKEQYDLRIKLIANQKTGHLLGAQLISKENCLATANQLVQAISCDMTDFDLAFQDFIYTARESEMAYMLHQAAINLYEKRIGLCE

SEQ ID NO: 9525 - DNA, 1410 bp, Streptococcus agalactiae
atggaaaaagaaaggcgtgttcaatatcggctactttcttttttaagaggctctcctcaggcaatagcactgaagttagctttattagaaactggtttaagtcgagcaacttttcttaaatatatcaataatcttaatagctactttgaacaagaaaaagttaattgtcgaatcgtttattataaggataagttatttttagaagaggattataacttatccaatcaagaagtgttgaaagctctgatgaaagatagtattaaatacactatcttaatatctttatttaatcagcgtcagttcacaatcgttggtctttctcaagaattgatggttagtgaggctactttaaatcgtcatcttgctcatctcaatgaattgttagcggaatttgatattgctatttcacaaggaaaacagattggtgatgaattgcaatggcgttatttttattatgaattattcaagcaactatggtcttatgacaagtgccaaaatatgataaagaaattagacttagactcattaattctattaatagagcgcttggctcaacatactttaactcgagaagctcatcaaaatctgggactttggtttagtatttgtcatcatcgtctccttgctatggaaaaaatatctgataatctcaagcctattgtgaaacattatcaatgtaatgctttttataaacggttagacgcagccttagttttgtatatgagtcgttttgctcttgagtatagggaaggagaagttctggcaacttttgcttttctacattcacaaaatattttaccaatcaatacaatggaatacatcatgggatttggaggcccgattattgattgtgtaaccgaaacaatcatctactttaaaaaggagagtattttagctgacgagacatcagatcaggttatttaccaacttggtcagttatatagccattattatttctttaaaggtcatattttagttgaacaacctgatttagaacaaacgtatcgacttattgatcataatatgagggataagttgcatcatatttcaaagaagattattgcaaatgttaatcgaattagacctttaacagaagatggttgttctttgctgactttacatttgttggaattgcttattttctcgaaaaatagtcaaaaaatgccctttaggattggtctagatatgacaggtaatgctgtggaacagtcattgttggaatatcgcattcgacaacatttctctggtaataattctattcaagtcgaaccttatgacgaaggaaagggatttgatatggttatttatcagagtcactcaagaccttataaagccaaactaacctattgccttaataaaggtgcttcagagcgagaactacaggaaatagattcacttatttatgacaat

SEQ ID NO: 9526 - protein, 470 aa, Streptococcus agalactiae
MEKERRVQYRLLSFLRGSPQAIALKLALLETGLSRATFLKYINNLNSYFEQEKVNCRIVYYKDKLFLEEDYNLSNQEVLKALMKDSIKYTILISLFNQRQFTIVGLSQELMVSEATLNRHLAHLNELLAEFDIAISQGKQIGDELQWRYFYYELFKQLWSYDKCQNMIKKLDLDSLILLIERLAQHTLTREAHQNLGLWFSICHHRLLAMEKISDNLKPIVKHYQCNAFYKRLDAALVLYMSRFALEYREGEVLATFAFLHSQNILPINTMEYIMGFGGPIIDCVTETIIYFKKESILADETSDQVIYQLGQLYSHYYFFKGHILVEQPDLEQTYRLIDHNMRDKLHHISKKIIANVNRIRPLTEDGCSLLTLHLLELLIFSKNSQKMPFRIGLDMTGNAVEQSLLEYRIRQHFSGNNSIQVEPYDEGKGFDMVIYQSHSRPYKAKLTYCLNKGASERELQEIDSLIYDN

SEQ ID NO: 9527 - DNA, 1869 bp, Streptococcus agalactiae
atggcttatgtgctttggaataaattcttaaatgtaaacccaaaaacaagtcgcaattggacaaaccgtgaccgttttgtgctatcagctgggcatggttcagctcttctttatagcctacttcatttagctggctatgatttatcaattgatgatttaaaacaatttcgccaatggggatcaaaaacacctggacatccagaagttaaccatactgatggtgtagaagcaacaactggacctttagggcaaggtattgctaatgctgttggtatggcaatggctgaagctcatttggctgctaaatttaataaaccaggctttgatttagttgatcattacacttatacacttcatggtgatggttgtttgatggagggtgttagccaagaagctgccagtcttgctggacacttaaaacttggtaaattggtccttctttatgattcaaatgatatctcacttgatggtccaacatctcaatcatttacagaagatgttaaaggacgttttgaatcatatggttggcaacatatcttagttaaagatggtaatgatttagaagcgattgctgcagcaattgaagctgctaaagctgaaactgataaaccaaccattattgaagttaaaactattattggatttggcgcagagaaacagggaacatcttcagttcatggagcgccacttggtgcagaaggtattacttttgccaagaaggcttatgtatgggaatatccagactttactgttcctgctgaagttgcagatcgatttgcctcagatcttcaagcgcgtggtgcgaaggcagaagaggcatggaatgatctttttgctaaatatgaagttgagtatccagaattagcaactgaatacaaagaagcttttgctggccaagctgagacagttgaactgaaagctcatgacctaggttcatcagtggctagtcgtgtttcaagccaacaagctattcaacaattatcgactcaattaccgaacctctggggagggtcagcagacctctcagcttctaataacacaatggtagcagcagaaacagatttccaagcaagtaactacgctgggcgtaatatttggtttggtgtacgtgaatttgcaatggctgctgcaatgaatggaattgcgcttcacggtgggactcgtgtttatgggggtacgttctttgtcttctcaaactacttgttaccagcagtacgtatggctgcacttcaaaacttgccaactgtctatgttatgacacatgattctattgctgttggagaagatgggccaactcatgagccaatagaacaattagcatcagtgcgctcaatgcctaatttgaacgttatccgtcccgcagacggtaatgaaacaaacgctgcatggcaacgagctgtatcagagacagatcgaccaacgatgcttgttttaacacgtcaaaacttaccagttcttgaaggaacatcagaattagcccaagaaggggttaataaaggtgcttatattttatcagaagctaaaggtgaacttgatggtatcatcattgcaacaggttcagaagttaaattagctttagatactcaagacaaacttgagtcagagggcatccatgttcgcgtcgtatctatgccagcacaaaacatttttgatgaacaagaggcttcatatcaagagcaagtgcttccatcagctgttacaaaacgtcttgctattgaggcaggatcaagcttcggttggggtaaatatgttggtttaaatgggctaacacttactattgatacttggggagcatcagcaccaggtaacagaattttcgaagagtatggctttacagttgagaatgctgtatcgctatataaagaactt

SEQ ID NO: 9528 - protein, 623 aa, Streptococcus agalactiae
MAYVLWNKFLNVNPKTSRNWTNRDRFVLSAGHGSALLYSLLHLAGYDLSIDDLKQFRQWGSKTPGHPEVNHTDGVEATTGPLGQGIANAVGMAMAEAHLAAKFNKPGFDLVDHYTYTLHGDGCLMEGVSQEAASLAGHLKLGKLVLLYDSNDISLDGPTSQSFTEDVKGRFESYGWQHILVKDGNDLEAIAAAIEAAKAETDKPTIIEVKTIIGFGAEKQGTSSVHGAPLGAEGITFAKKAYVWEYPDFTVPAEVADRFASDLQARGAKAEEAWNDLFAKYEVEYPELATEYKEAFAGQAETVELKAHDLGSSVASRVSSQQAIQQLSTQLPNLWGGSADLSASNNTMVAAETDFQASNYAGRNIWFGVREFAMAAAMNGIALHGGTRVYGGTFFVFSNYLLPAVRMAALQNLPTVYVMTHDSIAVGEDGPTHEPIEQLASVRSMPNLNVIRPADGNETNAAWQRAVSETDRPTMLVLTRQNLPVLEGTSELAQEGVNKGAYILSEAKGELDGIIIATGSEVKLALDTQDKLESEGIHVRVVSMPAQNIFDEQEASYQEQVLPSAVTKRLAIEAGSSFGWGKYVGLNGLTLTIDTWGASAPGNRIFEEYGFTVENAVSLYKEL

SEQ ID NO: 9529 - DNA, 303 bp, Streptococcus agalactiae
atgaagaaggagtgtcgtgatttttatcggcagatacagcatacttacaatgatatatctgtccgtgaagatgcagtgctatcatcaatactattatcagcatcgaatggtttgataaaaactagcgatgtacctcgtgttgcttatgagttaactcagcaattggaaaataatgagatagaaaaatctttcgagtcattagctacagttaaggaattgaaaaaatctgctaaaaaattgtctgagagatatgagcaaaataaggtaacaacgggattgctttctaaagtatttggaaatcat

SEQ ID NO: 9530 - protein, 101 aa, Streptococcus agalactiae
MKKECRDFYRQIQHTYNDISVREDAVLSSILLSASNGLIKTSDVPRVAYELTQQLENNEIEKSFESLATVKELKKSAKKLSERYEQNKVTTGLLSKVFGNH

SEQ ID NO: 9531 - DNA, 894 bp, Streptococcus agalactiae
atgcttgatattaagccggatggtatctatgtagatgctactttaggtggggcaggacacagcgaatatcttctttcacaattaggcccagatgggcacctttacgcatttgaccaagaccagaaggctattgacaatgctcatatacgtttaaagaaatatgtggataccggtcaagtaacctttatcaaagataatttcagaaatctatcttctaacttaaaagcattaggagtgtcggaaattaatggtatttgttatgatttaggtgtatcaagcccacagctggacgagcgtgaacgcggtttctcatataaacaagacgccccccttgatatgcgaatgaatagagagcagagtcttacagcttatgacgttgtgaacacttatagttatcatgatttagtaaggattttctttaagtatggcgaagataaattttcaaaacaaattgctcgaaaaattgagcaagtacgagctgaaaaaacaatatctacaacaacagaattggctgagattatcaaatcgtctaaatctgccaaagaactgaagaaaaaaggtcatccagctaaacaaatttttcaagctattcgtattgaagtcaatgacgaactaggagctgcagatgaatctatacaacaagcaatggacttattagctgttgatggtcgtatatctgtcatcacttttcattctttagaagatcgtcttactaagcaactttttaaagaagcatcaacagtagaagtacctaaaggtcttccttttataccagatgatttacaacctaagatggagctcgttaatcgtaaacccatcttaccaagtcaagaagaactagaagcgaacaatcgtgcccattcagcgaaattgagagtagcgcgtcgtattcga

SEQ ID NO: 9532 - protein, 298 aa, Streptococcus agalactiae
MLDIKPDGIYVDATLGGAGHSEYLLSQLGPDGHLYAFDQDQKAIDNAHIRLKKYVDTGQVTFIKDNFRNLSSNLKALGVSEINGICYDLGVSSPQLDERERGFSYKQDAPLDMRMNREQSLTAYDVVNTYSYHDLVRIFFKYGEDKFSKQIARKIEQVRAEKTISTTTELAEIIKSSKSAKELKKKGHPAKQIFQAIRIEVNDELGAADESIQQAMDLLAVDGRISVITFHSLEDRLTKQLFKEASTVEVPKGLPFIPDDLQPKMELVNRKPILPSQEELEANNRAHSAKLRVARRIR

SEQ ID NO: 9533 - DNA, 2190 bp, Streptococcus agalactiae
atgggatttattatcttagctattgtaataggtgggctcctatttgcatactacgttagtcgttctccgaaattaaccgatcaagctttaaaatccgttaactctagtttggtttatgatggtaataataaacttattgccgatttaggctcagaaaagcgtgaaagtgttagtgcggatagcattccactaaatttggttaacgctatcacttctatcgaagataaacgtttctttaaacatagaggtgtcgatatttatcgtattttaggtgcagcttggcataatcttgttagtagtaatacgcaaggtggttcaacccttgatcaacagttgattaaactggcttacttttctaccaataaatctgaccaaacgttaaaacgtaaatcacaggaagtttggcttgcgcttcaaatggagcgtaaatacaccaaagaagaaattcttactttctatattaataaagtttatatgggaaatgggaattatggtatgagaacaacagctaaatcatactttggtaaagacctaaaggaattatctattgcacaacttgctttgctcgctggtattcctcaagcacctacacaatatgacccttataaaaacccagaatctgctcaaacaagacgtaataccgttcttcagcagatgtatcaagataaaaacatttctaaaaaggaatacgaccaagctgttgcaactccagtaactgatggcttaaaagaattaaagcaaaaatctacttatccaaaatatatggataactacttaaaacaagttattagtgaagttaaacaaaaaactggtaaagatatctttactgctgggctaaaagtgtatactaatatcaacactgatgcacaaaaacaactatatgacatctacaacagtgacacttacatcgcttatccaaacaatgaattacaaatagcatctaccatcatggatgcgactaatggtaaagtcattgcacaattaggcgggcgtcatcagaatgaaaatatttcatttgggacaaatcaatctgtcttaacagaccgcgattggggttctacaatgaaacctatctcagcttatgcacctgctattgatagtggtgtctataattcaacaggtcaatcattaaacgactcagtttactactggcctggtacttctactcaactatatgactgggatcgtcaatatatgggttggatgagtatgcagaccgctattcaacaatcacgtaacgtccctgctgtcagagcacttgaagccgctggattagacgaagcaaaatctttccttgaaaaattaggcatatactatccagaaatgaactattcaaatgctatttcaagtaacaacagtagcagtgatgcaaaatatggtgcaagtagtgagaaaatggcagcggcttactcggcttttgcaaacggcggaacttactataaaccgcaatatgttaataaaattgaatttagcgatggaaccaatgatacttatgcagcgtctggtagccgtgcgatgaaagagactactgcctacatgatgacggatatgctgaaaacagtactaacatttggtactggtactaaagcagctatccctggtgttgcacaagctggtaagactggtacttccaactatacggaagatgagttagctaaaattgaagcaactactggtatctacaatagcgccgttggtacaatggctcctgatgaaaactttgtcggctatacttctaagtacacaatggcaatttggactggttataaaaatcgccttacaccactttatggtagccaactggatattgctactgaggtttatcgtgcaatgatgtcctacctaactggcggatacagtgcagattggacaatgccagaagggctctatcgaagcggaagctacttgtatatcaatgggacaactacaaccggcacttactcttcttctgtctataagaatatctatcaaaattctggacagtcaagtcaaagcagtagttcaacatcctctgagaaacaaaaagaggataagaatacagcaaatgatgccaattcatcatccccacaagtcgaaacacctaataatggtaatgctactacccctaataattccaatcaaactgtgccaggaactggacatggtaatggtaatggtaatggtaacaacaatacagtacctaacggtaat

SEQ ID NO: 9534 - protein, 730 aa, Streptococcus agalactiae
MGFIILAIVIGGLLFAYYVSRSPKLTDQALKSVNSSLVYDGNNKLIADLGSEKRESVSADSIPLNLVNAITSIEDKRFFKHRGVDIYRILGAAWHNLVSSNTQGGSTLDQQLIKLAYFSTNKSDQTLKRKSQEVWLALQMERKYTKEEILTFYINKVYMGNGNYGMRTTAKSYFGKDLKELSIAQLALLAGIPQAPTQYDPYKNPESAQTRRNTVLQQMYQDKNISKKEYDQAVATPVTDGLKELKQKSTYPKYMDNYLKQVISEVKQKTGKDIFTAGLKVYTNINTDAQKQLYDIYNSDTYIAYPNNELQIASTIMDATNGKVIAQLGGRHQNENISFGTNQSVLTDRDWGSTMKPISAYAPAIDSGVYNSTGQSLNDSVYYWPGTSTQLYDWDRQYMGWMSMQTAIQQSRNVPAVRALEAAGLDEAKSFLEKLGIYYPEMNYSNAISSNNSSSDAKYGASSEKMAAAYSAFANGGTYYKPQYVNKIEFSDGTNDTYAASGSRAMKETTAYMMTDMLKTVLTFGTGTKAAIPGVAQAGKTGTSNYTEDELAKIEATTGIYNSAVGTMAPDENFVGYTSKYTMAIWTGYKNRLTPLYGSQLDIATEVYRAMMSYLTGGYSADWTMPEGLYRSGSYLYINGTTTTGTYSSSVYKNIYQNSGQSSQSSSSTSSEKQKEDKNTANDANSSSPQVETPNNGNATTPNNSNQTVPGTGHGNGNGNGNNNTVPNGN

SEQ ID NO: 9535 - DNA, 330 bp, Streptococcus agalactiae
atggcaagtattatttatagcccaaaagatatttttgagcaagattttaaagttagtatgcggggatatgacaagaaagaagtcgatgtatttctggatgatgtcatcaaagattacgaaaattatcttgagcaaattgagaagctccaaatggaaaatagacgtctacaacaagctttagacaaaaaagaaagcgaagcttcaaatgtaagaaattcagggacagctatgtataatcaaaaaccgattgcccaatctgcaaccaattttgatattttaaaacgcattagccgccttgagaaagaagtttttggaagacaaattagagaa

SEQ ID NO: 9536 - protein, 110 aa, Streptococcus agalactiae
MASIIYSPKDIFEQDFKVSMRGYDKKEVDVFLDDVIKDYENYLEQIEKLQMENRRLQQALDKKESEASNVRNSGTAMYNQKPIAQSATNFDILKRISRLEKEVFGRQIRE

SEQ ID NO: 9537 - DNA, 906 bp, Streptococcus agalactiae
atgattgcctggtctacaatgttgacatatattttctacatgacaatttttataaatagtggtttcatctggtatatttactttctgagtaatttactcgtctatcgctttagagataaattgaagtcttttagattcattagttttgcttgtactctagccacagtggtatttttatgcttctttaaggcatcagactttggtgatagaatcatgtttctaattgttcctattttttgtatcggttacatgtggattgctattgaaaatagaaatagcgaagaacaaagagaaaaaattgcagagcaaaatcagtatatcaatattttgtcagctgaaaatgaacgtaaccgtatagggcgtgatttgcatgatagtttaggacatacatttgctatgatgacactaaagacagaactagcgttaaagttgttagaaaaaaggaactatgataaggtacaaaaagaactatcagaattaaatcatattagtcatcaatcgatgagtgaggtccgtcaaattgtttctaacctcaagtatcgtacagtagtggaagaaattgatgagttgtaccgcttgtttcaattatctaacattaagttaacagttgttaataagttagagacgtcacaactaagtccagtaacacaatctacaatcacaatgatattaaaggaattatccaataatattgttaagcatgctgaagctgatagcgtggagttgagtttagtaaggcaaggtgctactataaatattgagatgattgataatggttgtggttttacaaaccttgacggagatgagttgcatagtattcaagagagattaactatcgttgaagggacactaacgattttgtcccgaagtaaaccaactcatattcaggtggtattgaaagaggta

SEQ ID NO: 9538 - protein, 302 aa, Streptococcus agalactiae
MIAWSTMLTYIFYMTIFINSGFIWYIYFLSNLLVYRFRDKLKSFRFISFACTLATVVFLCFFKASDFGDRIMFLIVPIFCIGYMWIAIENRNSEEQREKIAEQNQYINILSAENERNRIGRDLHDSLGHTFAMMTLKTELALKLLEKRNYDKVQKELSELNHISHQSMSEVRQIVSNLKYRTVVEEIDELYRLFQLSNIKLTVVNKLETSQLSPVTQSTITMILKELSNNIVKHAEADSVELSLVRQGATINIEMIDNGCGFTNLDGDELHSIQERLTIVEGTLTILSRSKPTHIQVVLKEV

SEQ ID NO: 9539 - DNA, 1887 bp, Streptococcus agalactiae
atggcggatgtttatctagctcgagatctaattttagataatgaagaggtcgcaataaaagtattgcgaaccaattatcaaacagatcagattgcggttgctcgcttccagagagaagcacgagcaatggctgagctgacacatcctaatattgtcgctattcgtgatataggtgaagaagacggacagcagttcttagtaatggaatatgttgatggattcgatttaaaaaagtatattcaagacaatgcacccctatcaaataatgaagttgttcgaatcatgaatgaagtcctttcagccatgtcactggcacatcagaaaggtatcgtacaccgtgatttaaaacctcaaaatattttattaactaaaaaagggactgtaaaagttacagatttcggtattgcggtagcgtttgctgaaactagtttaacgcaaacgaattctatgttaggtagtgttcattatttatcgccagagcaggcgcgtggttcaaaagcgactgttcagagtgatatttatgccatgggaatcatgctttttgaaatgttaactggccatattccttatgatggggatagtgcagttactattgccctacagcacttccaaaaaccactaccatcaatccttgcagaaaataaaagcgttccacaagctttggaaaacattgtcattaaagcaacagctaaaaagctaacagatcgctataagacaacttatgagatgggacgtgatttatcaactgctctaagctcgacacgtcaccgtgaaccaaaacttgtttttaatgatactgagagtactaagacactacccaaagtaacatctacagtatcatctctaacgacagaacaactgttgcgtaatcaaaaacaggccaaaacaacagaaaaaataactcctgattctgcgagtaacgataaaacgaagtctaaaaagaaggcttctcatcgacttcttggtacaatcatgaaattattctttgcactctgtgttgtaggaataattgtatttgcttataaaattttagtaagtcctacgactattcgtgttccagatgttagcaacaaaacagtagctcaagcaaaaatgacattggaaaattctggattgaaagtaggagctattcgtaatattgagagtgatagtgtttcagaaggacttgtcgtaaaaacagaccctgctgcaggacgttctcgcagagaaggggctaaagttaatctttatattgccactccaaacaagagtttcactctaggtaattataaggaacataattacaaagatatcctcaaagatcttcaaggcaaaggtgttaaaaaatctttaatcaaggttaagcgtaaaattaataatgattatactactggtacaatcttagcacagtcgcttccagaaggaacatcttttaatcctgatggtaataagaaattaacacttacggttgctgttaatgatccaatgattatgcctgatgtaacaggtatgactgttggagaagtaatagaaaccttgacagacctcggattagatgcagataatcttgtcttctatcaaatgcaaaatggcgtttatcaaacagtagtaacacctccatcttcaagtaagatagcaagtcaggatccttattacggaggagaagttggattaaggagaggagataaagttaagctgtatcttcttggttctaaaacaacgaataactcatcatctacgccaatagattcttcggcttcaagctcaacaggaacaactacctcggattctgtaagctcatcaacggatgctagcacttctgatagtagtagcacttctacaagtagttcaacactaccaagtgatagtacaactaatacaggaacagctaacaatccattaactcaa

SEQ ID NO: 9540 - protein, 629 aa, Streptococcus agalactiae
MADVYLARDLILDNEEVAIKVLRTNYQTDQIAVARFQREARAMAELTHPNIVAIRDIGEEDGQQFLVMEYVDGFDLKKYIQDNAPLSNNEVVRIMNEVLSAMSLAHQKGIVHRDLKPQNILLTKKGTVKVTDFGIAVAFAETSLTQTNSMLGSVHYLSPEQARGSKATVQSDIYAMGIMLFEMLTGHIPYDGDSAVTIALQHFQKPLPSILAENKSVPQALENIVIKATAKKLTDRYKTTYEMGRDLSTALSSTRHREPKLVFNDTESTKTLPKVTSTVSSLTTEQLLRNQKQAKTTEKITPDSASNDKTKSKKKASHRLLGTIMKLFFALCVVGIIVFAYKILVSPTTIRVPDVSNKTVAQAKMTLENSGLKVGAIRNIESDSVSEGLVVKTDPAAGRSRREGAKVNLYIATPNKSFTLGNYKEHNYKDILKDLQGKGVKKSLIKVKRKINNDYTTGTILAQSLPEGTSFNPDGNKKLTLTVAVNDPMIMPDVTGMTVGEVIETLTDLGLDADNLVFYQMQNGVYQTVVTPPSSSKIASQDPYYGGEVGLRRGDKVKLYLLGSKTTNNSSSTPIDSSASSSTGTTTSDSVSSSTDASTSDSSSTSTSSSTLPSDSTTNTGTANNPLTQ

SEQ ID NO: 9541 - DNA, 930 bp, Streptococcus agalactiae
atggaagggaaaagccaatctgagattgccaatgaattaggaatttatcgtacaacaataagtcgtatgttagccaaagcgagagaagaaggtcttgttagaatcgaaatttcagattttaatccagaaatttttcagttagaatcctattttaaaagtaaatatcaccttaaagatattgagattgtttcttcgcgaaaagatagcgatacttcagagatagagaaggatttagcacatgtagctgcagctatgattcgaaaaaaaattaaagagaatgacaaggtggggattgcttgggggaggacacttagtaaagtagttgaagcaatgcgtcctcatccggtttctcaagtttcttttgttcctttggccggaggtccaagtcatattaatgcacgctatcacgttaatactctggtttacgaaatgtcaaggcgtttccaaggaagttgtactttcattaatgcaactctagttcaagaaaacgctaatttagcgaaaggaatattaacttcaaaatattttgaggggctaatggataattgggaaaaacttgatgtggcaattgtgggcgttggtggtaaacctaaaagcaatgaacaacagtggcttgaccttttaaatcaagatgattttcaatgcttggatgaagaagcagctgtaggtgaaattacttgtcgtttttttaatcattcaggtgatcctgtgaatcaacatttagctaaaaggacaataggaattaccttagaacaactacagaaagttcctaatagaatagcggttgctcatggcaattataaggctgcggcactcttagccgttttaaaaaaggggtatattaatcatttagttactgatttttccacagccttaaatattttaagattagataaagacacctttgtggatactatatatcaaaagagc

SEQ ID NO: 9542 - protein, 310 aa, Streptococcus agalactiae
MEGKSQSEIANELGIYRTTISRMLAKAREEGLVRIEISDFNPEIFQLESYFKSKYHLKDIEIVSSRKDSDTSEIEKDLAHVAAAMIRKKIKENDKVGIAWGRTLSKVVEAMRPHPVSQVSFVPLAGGPSHINARYHVNTLVYEMSRRFQGSCTFINATLVQENANLAKGILTSKYFEGLMDNWEKLDVAIVGVGGKPKSNEQQWLDLLNQDDFQCLDEEAAVGEITCRFFNHSGDPVNQHLAKRTIGITLEQLQKVPNRIAVAHGNYKAAALLAVLKKGYINHLVTDFSTALNILRLDKDTFVDTIYQKS

SEQ ID NO: 9543 - DNA, 321 bp, Streptococcus agalactiae
atggaaatcatagtcgcagaccaaattattatggggctcattttgaatgctggggatgctaaacaacatatctatcaagccttaaaacttgcaaaagaaggaaattttgcagaaagtaagattgaaatagaactagcagatagtgcactcctagaagctcataatcttcaaacacaattccttgcacaagaagcaggagggacaaggacagatatctcagcactctttattcattctcaggatcatttgatgacaagtattactgagattaacttgattaaagaaattattgatttacgccaggaattacatattcaaaaa

SEQ ID NO: 9544 - protein, 107 aa, Streptococcus agalactiae
MEIIVADQIIMGLILNAGDAKQHIYQALKLAKEGNFAESKIEIELADSALLEAHNLQTQFLAQEAGGTRTDISALFIHSQDHLMTSITEINLIKEIIDLRQELHIQK

SEQ ID NO: 9545 - DNA, 1086 bp, Streptococcus agalactiae
atgaaagttttcgcaagtccatcgcgctatatacaaggaaaggatgctttattccaaagtattgaacatatcaaatctttaggtcagactccacttatcctttgtgatgatgttgtttataatatcgttggagaaaggtttttatcttatctacaagacgatttgttaccacatcgtgtttcctttaacggagaagcatctgataatgaaatcaatcgtgtcgttgctgttgcgaaagaaaagaatagtgaccttattattggacttggtggtggaaaaactattgactctgcaaaggcaattgcagataaagttaatttaccagtggtcattgcaccaacagtagcttcaacagatgccccaacatcagcgttatcagtaatctatacagatgaaggagcttttgaaaaatatattttttattcaaagaatccagacttagttttagttgatactcaagtaattgcccaagcgccaaaacgtttactagcttctgggatagcagatggcttagctacttgggttgaagcgagagcagtcttacaaaaaaatgggatagcgatggctggcggtagacagactttagcgggcgtggcaattgcccaagcatgtgagcgtactttatttaatgatagtttacaagctttagcggcttgtgatgccaaagtggttacaaaagctttagaaaatgttattgaagctaataccttacttagtggtttaggttttgaaagtgcaggattagctgcagctcatgctattcataatggttttactgccttgagtggagatattcatcacttaacccatggtgaaaaagttgcctatggaacgttgacgcaacttttcctcgaaaatagaccaaaggaagaaattgatcgctacattaatctttaccaagcgattggaatgccaactacacttgcagaactccatttgggtgatgcaacatatgaagaacttttaaaagttggtcagcaagcaacaattgaaggtgaaacaatacatgaaatgccattcaaaattagtgcagaggatgtcgctgcagccctgttaacggttgaccgttatgtttcaaatcatcaa

SEQ ID NO: 9546 - protein, 362 aa, Streptococcus agalactiae
MKVFASPSRYIQGKDALFQSIEHIKSLGQTPLILCDDVVYNIVGERFLSYLQDDLLPHRVSFNGEASDNEINRVVAVAKEKNSDLIIGLGGGKTIDSAKAIADKVNLPVVIAPTVASTDAPTSALSVIYTDEGAFEKYIFYSKNPDLVLVDTQVIAQAPKRLLASGIADGLATWVEARAVLQKNGIAMAGGRQTLAGVAIAQACERTLFNDSLQALAACDAKVVTKALENVIEANTLLSGLGFESAGLAAAHAIHNGFTALSGDIHHLTHGEKVAYGTLTQLFLENRPKEEIDRYINLYQAIGMPTTLAELHLGDATYEELLKVGQQATIEGETIHEMPFKISAEDVAAALLTVDRYVSNHQ

SEQ ID NO: 9547 - DNA, 1209 bp, Streptococcus agalactiae
atgacagatgctttgatacaatattatcaaaattatattaacggtaaagatattgttaaagaccaaacttggattatcaatcgttatcaagaaattattagtgatttgtctttaggaagcactattgcagaagaaattactcgctctatagagcagctagcttcacttcccatagaaaataatcagtttttatatgattgttttttagcagccggtgaagataacaacgcaaagttagttgcaacgttttttaatcaaaatgacattcctgcaagatatgttcatccaaacgaagcaggaattattgtaactaaagaaccatgtaatgcacgaattattccaggaagttatgataagattgagaacttatgtctatacaatgaggttcttgttatccctggattttttggagtcacagaagataaccaaatttgtaccttttcaagagggggatctgacattactggatccctaattgcagcaggcataaaagcagacctttatgagaacttcacagatgttgatggtatatttgcagcacatccaggtgtagttaagaaccctcacgctatccctgagcttacttataaagaaatgcgtgaattagcctatgcgggtttttcggttttacatgatgaagctttacttcctgcctatcgtggcagaatccctcttgttattaaaaatacaaataatccccaacagcctggtacaaaaatagttttaaagcatactcgtagtaacatagcagtaactgggatcgcttctgatagccgttttgctagcataaacgtatctaaatacttaatgaatagagaagtaggtttcggccgaaaagtactacaaattttagaggatttaaatattagttttgaacatatgccaactggcatagatgatctatccattgtcttacgtgaaaaagaattgacaccaatcaaagaacaagaaatcttaaattacctaactcgtaaactagaagtagattacgttgacatccaacacaatctatctacaatcgtaattgtaggtgaaaatatgaaaagtcagattggagtcactgcaacagcgacacaagccttatcaagagaaaaaatcaatatcaccatgatatcacaaggttcaagcgaagtctccattatgttcgttataaacagtaaggatgaaaaaagagctattaaagcactatatgaaacattcttccaaaaa

SEQ ID NO: 9548 - protein, 403 aa, Streptococcus agalactiae
MTDALIQYYQNYINGKDIVKDQTWIINRYQEIISDLSLGSTIAEEITRSIEQLASLPIENNQFLYDCFLAAGEDNNAKLVATFFNQNDIPARYVHPNEAGIIVTKEPCNARIIPGSYDKIENLCLYNEVLVIPGFFGVTEDNQICTFSRGGSDITGSLIAAGIKADLYENFTDVDGIFAAHPGVVKNPHAIPELTYKEMRELAYAGFSVLHDEALLPAYRGRIPLVIKNTNNPQQPGTKIVLKHTRSNIAVTGIASDSRFASINVSKYLMNREVGFGRKVLQILEDLNISFEHMPTGIDDLSIVLREKELTPIKEQEILNYLTRKLEVDYVDIQHNLSTIVIVGENMKSQIGVTATATQALSREKINITMISQGSSEVSIMFVINSKDEKRAIKALYETFFQK

SEQ ID NO: 9549 - DNA, 585 bp, Streptococcus agalactiae
gtgatgaaagctgctgttgagagcgatgatattagctcattaactaaaattgctgagttagttaatcagatatcgtatgatttactacagctagagaaacctgttgttatgtgtgtagatggggctgtagctggtgccgcagctaatattgcattagcagctgattttgttatcgcaagcaagaagagtaaatttatccaggcttttgtgggtgtcggtttagctccagatgcaggaggtttattgttacttagtaaatcaatcggtataactcgtgcagtgcaactagctttaactggagaaagcttatctgctgaaaaagctgaagctttgggaattgtttataaactttgtgaatcagataaaataggtaaaattaaggatcaactattaaagcgtttaagtagacattctataaactcatatcaagccataaaatcattagcttgggaagctgcttttaaagattgggaacaatataaaaagcttgaattacaactgcaagaatcattagcctttaagcaagattttaaagaaggtgttcgggcacacgctgatagaaggcgtcctaattttttaggcaaa

SEQ ID NO: 9550 - protein, 195 aa, Streptococcus agalactiae
MMKAAVESDDISSLTKIAELVNQISYDLLQLEKPVVMCVDGAVAGAAANIALAADFVIASKKSKFIQAFVGVGLAPDAGGLLLLSKSIGITRAVQLALTGESLSAEKAEALGIVYKLCESDKIGKIKDQLLKRLSRHSINSYQAIKSLAWEAAFKDWEQYKKLELQLQESLAFKQDFKEGVRAHADRRRPNFLGK

SEQ ID NO: 9551 - DNA, 222 bp, Streptococcus agalactiae
atggcagtatttgaaaaagtacaagaaattattgttgaagaacttggtaaagatgcagaagaagtaacgttgaacactacttttgacgatcttgatgctgattcgcttgatgttttccaagtgatttcagaaattgaagatgcatttgatatccaaattgagacagaagaaggactaaatactgttggtgatttagttgcttatgttgaagaaaaagtaaaa

SEQ ID NO: 9552 - protein, 74 aa, Streptococcus agalactiae
MAVFEKVQEIIVEELGKDAEEVTLNTTFDDLDADSLDVFQVISEIEDAFDIQIETEEGLNTVGDLVAYVEEKVK

SEQ ID NO: 9553 - DNA, 498 bp, Streptococcus agalactiae
ttggatattcaagagattaaggatttaatgactcaatttgatgagtcaagtctgagagaattttcattcaaaacaagtgacggtgagctgtcttttagtaaaaatgagggaaaagctccacttgtcccaactatgtctcctatgagtcatcaacctgaagcgactccaactatagcaactcctgtctctaatgaagcaggtgagcaaacgaaacaagctactgaagtagtttcagaaatcccagagtcgactgtgactgttgcagaaggtgacgttgtcgaaagtcctttagttggggttgcttatttagcttctggaccagataaacctaactttgtttcagtaggtgatagcgtgaagaagggacaaactttgatgattattgaggcaatgaaggtgatgaatgaagtgcctgccccccatgatggtgtagttactgaaattcttgtagccaatgaagaagttattgaatttggtaaaggattggtacgaatcaaa

SEQ ID NO: 9554 - protein, 166 aa, Streptococcus agalactiae
MDIQEIKDLMTQFDESSLREFSFKTSDGELSFSKNEGKAPLVPTMSPMSHQPEATPTIATPVSNEAGEQTKQATEVVSEIPESTVTVAEGDVVESPLVGVAYLASGPDKPNFVSVGDSVKKGQTLMIIEAMKVMNEVPAPHDGVVTEILVANEEVIEFGKGLVRIK

SEQ ID NO: 9555 - DNA, 615 bp, Streptococcus agalactiae
ttggcagggcgtcctgtgacgattgtcggtattcaaaaaggtaagaaccttcaagataatttagaccgtcattttggtcaaccacatcctgaaggttatcgtaaggctttacgtttaatgaaacaagctgagaagtttggaagacctgttataaccttcatcaatactgctggagcatatcctggggtaggtgctgaggagcgaggtcagggtgaagcaattgctagaaacctcttagaaatgagtgatttaaaagtccctattatagctattattattggtgaagggggttctggaggagcattagctttagctgttgccgataaggtttggatgttggaacatactgtttattctattttaagtcctgagggctttgcctctattttatggaaagatggtacaagaacaacagaagcagcacaattaatgaagatgactgctggagaactttaccatatggaagttgtagacaaagtaatccctgaacatggttatttttcaagtgagattgtcgatatgattaagacaagtttaatttcagagttagaagtgctctcacaattatctcttgaggatttattggaacaacgttaccaacgttttagaaaatat

SEQ ID NO: 9556 - protein, 205 aa, Streptococcus agalactiae
MAGRPVTIVGIQKGKNLQDNLDRHFGQPHPEGYRKALRLMKQAEKFGRPVITFINTAGAYPGVGAEERGQGEAIARNLLEMSDLKVPIIAIIIGEGGSGGALALAVADKVWMLEHTVYSILSPEGFASILWKDGTRTTEAAQLMKMTAGELYHMEVVDKVIPEHGYFSSEIVDMIKTSLISELEVLSQLSLEDLLEQRYQRFRKY

SEQ ID NO: 9557 - DNA, 630 bp, Streptococcus agalactiae
atgtatcaagaattaaatgattatttagaattccaatcaatgaagtatattatgcctgagaaggcaggcgctttaaaggacgatatgcaaacttttaaggcaaagggccaacttgctaggaatagctttacagagttatcaagagccttagaacaacgtatggatggctttaaaatgcaaagagtgagtaattgggctaatcaagctcaagtagggcgtccacatttttgggtttattatcgaaaggatacagaccaattagatgatgtggctgttgcgctaagggtttatggtgtaaaagatagttttggggttagccttgaggtaagctttgtagagaggcaaaaatctgataagacactcgagaagcaggctagagtgttatcgattccgattgcctctccattgtattttatggtccaaaggcaaggtgaaactcatcgagaagaaggcaatgaggaaaatcgtcaacgtttaatgcaagaaattaagtcagggaaggtaaggaaagtattggtaaaatatgacgttcttttgactgaaaaccagagcttagaaaatattctgcaacgattgttagaaggctttgagaaagtgttaccttactatcaagtttgtcaaactattagc

SEQ ID NO: 9558 - protein, 210 aa, Streptococcus agalactiae
MYQELNDYLEFQSMKYIMPEKAGALKDDMQTFKAKGQLARNSFTELSRALEQRMDGFKMQRVSNWANQAQVGRPHFWVYYRKDTDQLDDVAVALRVYGVKDSFGVSLEVSFVERQKSDKTLEKQARVLSIPIASPLYFMVQRQGETHREEGNEENRQRLMQEIKSGKVRKVLVKYDVLLTENQSLENILQRLLEGFEKVLPYYQVCQTIS

SEQ ID NO: 9559 - DNA, 990 bp, Streptococcus agalactiae
atgttcatgattgttattacgcatgttcttggaaaaggtggtctgagatcttcggttgagggacacgcagactcctattttatagtaacgtggattatccaagtcttagtttatggggccgttaactgttacgcactaataagtggttatgtgggaattaattcgcgttatcgttactcaaaattactgtctatctgggcacaggtttttttctacacctttacaataacagcactttttgcaatcacaggtcatgaagtgaccttgcttaattggagagatgcttttttccctattgtcagtgggcagtattggtacattactgcttactttggtctattggtttttatgcctgttattaataatggattaaatgccttgactgataaacaattaaaacaattggttttgttaatgtttattattttttcaattttaccagctgttttaaataatcgtgttccagaattttcattgagcaagggttttgaaatgacttggctactgattttatatattattggtgcctatttgaaacgtattgatttaaatatatttaaaacgtcatatttacttataatttatctattatcattggttgctacttatgccatgaagtttagcgttggtgatatttggtattggtatgtttcgcctactttaactttaggggcggtaagtttgtttatattatttgctagagcaagcattaagccctcgggattcttaaagaaaataattgttgtattagccccttcaaccttgggagtttatctctgtcatctccacccactaatagtaaaatattttgtaagagattttgcagagacgtttgtttatgagtccatttatctttacccatttttaattttaggagcagggattttaatttatttgttggcttttattgtagaacgtattagattacgaatatttaaagcaatccatttttctaactttttgagatggtttgatgacaagttcccatat

SEQ ID NO: 9560 - protein, 330 aa, Streptococcus agalactiae
MFMIVITHVLGKGGLRSSVEGHADSYFIVTWIIQVLVYGAVNCYALISGYVGINSRYRYSKLLSIWAQVFFYTFTITALFAITGHEVTLLNWRDAFFPIVSGQYWYITAYFGLLVFMPVINNGLNALTDKQLKQLVLLMFIIFSILPAVLNNRVPEFSLSKGFEMTWLLILYIIGAYLKRIDLNIFKTSYLLIIYLLSLVATYAMKFSVGDIWYWYVSPTLTLGAVSLFILFARASIKPSGFLKKIIVVLAPSTLGVYLCHLHPLIVKYFVRDFAETFVYESIYLYPFLILGAGILIYLLAFIVERIRLRIFKAIHFSNFLRWFDDKFPY

SEQ ID NO: 9561 - DNA, 300 bp, Streptococcus agalactiae
atggggaataaagttggaaaatttttagttggtgaccaggcattagaattctataacgataaaaatgtcaacgactatattcaaattccatggacatcaatcaatcaaattggagctaatgttagtcgaaaaaaaattagtcgtcactttgaggtctttacagaccaaggaaaatttttattcgcctctaaagactctggaacgatattaaagcatgcgagacgacatattggagacgataaagttgttaagcttcctaccctcatccagaccattttaaaaatattcaagtttaaaaaa

SEQ ID NO: 9562 - protein, 100 aa, Streptococcus agalactiae
MGNKVGKFLVGDQALEFYNDKNVNDYIQIPWTSINQIGANVSRKKISRHFEVFTDQGKFLFASKDSGTILKHARRHIGDDKVVKLPTLIQTILKIFKFKK

SEQ ID NO: 9563 - DNA, 723 bp, Streptococcus agalactiae
atgttaaaaattgaaaatgttacaggggggtatgttaatatcccagttttaaaaaatatttcttttgaagtaaatgatggagagttagttggattaattgggcttaatggtgcaggaaaatcaaccactattaacgagattattggtattttgagaccctatcaaggagatattacaattgatggtattagtcttgaagccgaccaagaactttatagaaagaaaataggctttattcctgagacaccaagtctctatgaggagctaactctcagggaacatttagaaacggtagctatggcgtatgatattgccaccgatgaagttatggcacgtgcgcaaaaactattagagatgtttcgtctaacagataaattagactggtttccaatgcatttttcaaagggaatgaaacaaaaggttatgattatttgtgcttttgttgtatctccaagtttatttattgttgatgaaccatttttaggtttggatccactagctatttcagatttgattaatcttctagcagaagaaaaagctaaagggaaatctattttgatgtcaacacacgtattagattctgccgaaaaaatgtgtgatcgttttgttattttacataaaggagaaatacgggcagttggaaccctagaggaattacgggctatttttggagacagtaatgctaatttaaatgacatctacatagctctgacaaaagaggtg

SEQ ID NO: 9564 - protein, 241 aa, Streptococcus agalactiae
MLKIENVTGGYVNIPVLKNISFEVNDGELVGLIGLNGAGKSTTINEIIGILRPYQGDITIDGISLEADQELYRKKIGFIPETPSLYEELTLREHLETVAMAYDIATDEVMARAQKLLEMFRLTDKLDWFPMHFSKGMKQKVMIICAFVVSPSLFIVDEPFLGLDPLAISDLINLLAEEKAKGKSILMSTHVLDSAEKMCDRFVILHKGEIRAVGTLEELRAIFGDSNANLNDIYIALTKEV

SEQ ID NO: 9565 - DNA, 1137 bp, Streptococcus agalactiae
atgctagaagccttccgtattttggaagaagaaaaacacattaataaagaagatattattgatgcagttactgagtcactaaaatctgcctataagcgtcgttatggtcaatcagaatcatgcgttattgaatttaacgagaagaaagcagactttaccgtctatactgttcgtgaagttgttgatgaagtttttgatagccgtttggaaattagcctaaaagatgcccttgctattagctcagcgtatgaacttggtgataagattcgctttgaggaatctgttacagaatttggacgcgtggcagctcagtcagcaaaacaaactattatggaaaaaatgcgtcgtcaaatgcgtgaagtaaccttcaatgaatacaaacaacacgaaggtgaaattatgactggtactgttgaacgatttgaccaacgttttatttatgtcaatctcggttcacttgaggcgcaattatcgcatcaagatcagattcctggagagagctttaaatctcatgatatgattgatgtttatgtctataaagtggagaataatcctaaaggagtcaacgtttttgttagccgtagtcatccagagtttatcaaacgcattatggagcgagaaattccagaagtatttgatggaactgttgagattatgagcgtctctcgtgaggctggagatcgtactaaagttgctgtacgcagtcataattcaaacgttgatgcgattggaacaattgttggacgcggtggaagtaacattaaaaaagttatcagtaatttccatcctaaacgcgttgatgctaaaacaggattggagatcccggttgaagaaaacattgatgttattcaatgggttgaagatccagcggaattcatttacaatgctattgcaccagccgaagttgatatggtactttttgatgatgaagatacaaaacgtgctactgtagttgttccagatagcaagttatcgctagctattggtcgccgaggacaaaatgtgcgtttagcagctcatttgactggctatcgtattgatattaaatctgcaagtgaatacgaaaaaatggaagcgcaagaacttcaaactgaggaagtagctcaagaatctgaagttatttcagataaggcagaa

SEQ ID NO: 9566 - protein, 379 aa, Streptococcus agalactiae
MLEAFRILEEEKHINKEDIIDAVTESLKSAYKRRYGQSESCVIEFNEKKADFTVYTVREVVDEVFDSRLEISLKDALAISSAYELGDKIRFEESVTEFGRVAAQSAKQTIMEKMRRQMREVTFNEYKQHEGEIMTGTVERFDQRFIYVNLGSLEAQLSHQDQIPGESFKSHDMIDVYVYKVENNPKGVNVFVSRSHPEFIKRIMEREIPEVFDGTVEIMSVSREAGDRTKVAVRSHNSNVDAIGTIVGRGGSNIKKVISNFHPKRVDAKTGLEIPVEENIDVIQWVEDPAEFIYNAIAPAEVDMVLFDDEDTKRATVVVPDSKLSLAIGRRGQNVRLAAHLTGYRIDIKSASEYEKMEAQELQTEEVAQESEVISDKAE

SEQ ID NO: 9567 - DNA, 348 bp, Streptococcus agalactiae
atggctaatcatcgtattgatcgcgttggaatggaaattaaacgtgaagtcaatgagattttgcgtctccgagttaatgatccacgtgtacaagatgtcacaattactgatgttcagatgttgggtgacctttcaatggctaaagtattttatactattcattcgacacttgcttctgataatcaaaaagcacaaattggtttagaaaaagcaactggtactattaagcgtgaacttggcaaaaaccttactatgtataaaataccagatttacaatttgttaaagatgaatctattgaatacggaaataagattgatgaaatgttgcgcaatctagataaaaaagat

SEQ ID NO: 9568 - protein, 116 aa, Streptococcus agalactiae
MANHRIDRVGMEIKREVNEILRLRVNDPRVQDVTITDVQMLGDLSMAKVFYTIHSTLASDNQKAQIGLEKATGTIKRELGKNLTMYKIPDLQFVKDESIEYGNKIDEMLRNLDKKD

SEQ ID NO: 9569 - DNA, 810 bp, Streptococcus agalactiae
atgataaaattaattgctattgatatggatggaacgcttttaaatgatgaaaagaaaattccaaaggaaaatatccaagctattaaagaagcaactcaagcaggtattaaaattgtactgtgtactgggcgaccgatgtcaggtatacttccttattttaatgaactaggtttaacaaaagaggagtatattatcatgaataatggttgtagcacttatagcacgaaagattggcaattgattgattctgcaactttaacacatgatgaactcatctttcttgaggaggttgttaaagaatttcccaacgtttgtttaacattaacagctgaaaatacattttacgctgttggagaggaagttcctgaaattgttgcttatgatgctgatttagtttttacaaaagcaaagtcaacaagtttagatgctcttcgcaatcaagaagaaattgtctttcaagcaatgtacatgggattagatgcagatgtaactgcttttcaagaagctgttgaagaagccttaatctcgaaatttagtggagttcgaagccaagactatatttatgagattatgcctcaaggagtaacaaaagcaagaggcttaaaatccttgatagcaaaattaggactggatattaatcaagttatggccatcggtgatgctcctaacgatattgaattattagatttagttcccaatagcgttgctatggggaatgcatcagatgagattaaatctagatgtaaatatataacggtggataataacaaagcaggggttgctaaagctatttatgactatgctttacgt

SEQ ID NO: 9570 - protein, 270 aa, Streptococcus agalactiae
MIKLIAIDMDGTLLNDEKKIPKENIQAIKEATQAGIKIVLCTGRPMSGILPYFNELGLTKEEYIIMNNGCSTYSTKDWQLIDSATLTHDELIFLEEVVKEFPNVCLTLTAENTFYAVGEEVPEIVAYDADLVFTKAKSTSLDALRNQEEIVFQAMYMGLDADVTAFQEAVEEALISKFSGVRSQDYIYEIMPQGVTKARGLKSLIAKLGLDINQVMAIGDAPNDIELLDLVPNSVAMGNASDEIKSRCKYITVDNNKAGVAKAIYDYALR

SEQ ID NO: 9571 - DNA, 438 bp, Streptococcus agalactiae
atggtttatcattttcaaaatccaagtgattttatgttaaaaaattatttaacaaaagcaaagaccatcgcagttgtaggactgtcagaccgtcaagaaactgcagcttatcaagtatcaaaaataatgcaagaagcaggttatcaaattattccagttaatcctaaaaatgcaggacagaaaatacttgggcaaatgacatatgcctcacttaaggatgtcactgaacatattgatattgttaatatttttcgacgtagcgagtatttacctgatattgcaagagaatttttagaagtagacgctgatattttctgggctcagcttggacttgaaagtcaagaagcagagacaattctaaagcaagcaggacacaaacagattgtcatgaataaatgtctgaaagttgaatgccaaaaattacactcagaaactaac

SEQ ID NO: 9572 - protein, 146 aa, Streptococcus agalactiae
MVYHFQNPSDFMLKNYLTKAKTIAVVGLSDRQETAAYQVSKIMQEAGYQIIPVNPKNAGQKILGQMTYASLKDVTEHIDIVNIFRRSEYLPDIAREFLEVDADIFWAQLGLESQEAETILKQAGHKQIVMNKCLKVECQKLHSETN

SEQ ID NO: 9573 - DNA, 477 bp, Streptococcus agalactiae
atggacagtcattcacatggtcatagacctctcgatgcttatgaaaacgtcctagagcatctccgtgaaaaacgtattcgaattactgagactcgaaaagctattatttcctatatggttaatagtcgtgagcatccgagtgcagaaaagatttacaatgatttattaccagaatatcctaacatgagcttggcaacagtttacaataaccttaaggtccttgtggatgaggggtttgtgacagagctaaaactttgcaattatagtacaacttattatgattttatggggcatcagcacctaaacattgcctgtgaagattgtgggaaaatcgttgattttgtcgatgttgacttattggatatttctagagaagcacaccaacaaacaggttttgaagtgactagagttcagttagtagcttatggtatctgtccggagtgtcagaggaagcgtaaggataaatataaaaaagat

SEQ ID NO: 9574 - protein, 159 aa, Streptococcus agalactiae
MDSHSHGHRPLDAYENVLEHLREKRIRITETRKAIISYMVNSREHPSAEKIYNDLLPEYPNMSLATVYNNLKVLVDEGFVTELKLCNYSTTYYDFMGHQHLNIACEDCGKIVDFVDVDLLDISREAHQQTGFEVTRVQLVAYGICPECQRKRKDKYKKD

SEQ ID NO: 9575 - DNA, 738 bp, Streptococcus agalactiae
atgacgaattcagaaattaaaaatgaggcaaaaactatattaagcaatcttcaaggtaagaatcaactttttttactcccgattctccttagtattattacgttatatatatcattttattatcaatataataatatgacactacttgatttttttgtacctcttccagtttatttcttttacacactttttattatttcagtcagttttgtaatgttagatgtcgtcaaaaatcagaaactaaacgttagattctcggacaatacttatgtattttcaagccatattttctggaaattactctcagtacttgttctaaaaggactaattttatctttcttttatctactaagtacttttggtctactaatcatcatttcaagttttaggctacttttgagtggtaaccttatccttgcccctgttttaatagttgttagtagcctaattactactaaggcagttataaaactcgttcaacaatattactcctatagtatctcaactttagtattttacactcaattagaaagtggaaactatgagggaccgtctaaagtactggttgctagtcgagaactaatgaatggtaataaacttagactcttccttttagacttaagttttattggttggcagttccttacaatcttcagtttcggattagtctatatctatctccttccttaccaaactactgcgcgcttaatcttttatagaaacattacaaaaaatagc

SEQ ID NO: 9576 - protein, 246 aa, Streptococcus agalactiae
MTNSEIKNEAKTILSNLQGKNQLFLLPILLSIITLYISFYYQYNNMTLLDFFVPLPVYFFYTLFIISVSFVMLDVVKNQKLNVRFSDNTYVFSSHIFWKLLSVLVLKGLILSFFYLLSTFGLLIIISSFRLLLSGNLILAPVLIVVSSLITTKAVIKLVQQYYSYSISTLVFYTQLESGNYEGPSKVLVASRELMNGNKLRLFLLDLSFIGWQFLTIFSFGLVYIYLLPYQTTARLIFYRNITKNS

SEQ ID NO: 9577 - DNA, 1140 bp, Streptococcus agalactiae
atgactgatcatccaataaaatatcgattaattaaacaggaaaaacacacaggagccagacttggtgaaataatcacaccacatggtacatttccgacaccaatgtttatgcctgttgggacacaagcaactgttaagacacaatctcctgaagaactaaaagaaatgggttcaggaattattctatcaaatacctaccatttatggttacgtccaggtgatgaattgattgctaaagctggaggtttacataaattcatgaactgggatcaggctattctaacagacagtggaggctttcaggtttattctttggctgatagtcgaaacatcactgaagaaggagtaacctttaaaaaccatttaaatggtgcgaaaatgtttttatcaccagaaaaagctatttcaattcaaaataaccttggttctgatattatgatgagttttgatgagtgtccacaattttaccagccttatgattatgtaaaaaaatcaattgagcgaacaagccgttgggcagaacgtggattaaatgcccaccgccgtcctcatgatcaaggactatttggtattgttcaaggggcagggtttgaggatttacgtcgtcaatcagcacgagatttagtatcgatggattttccaggttattcaattggagggcttgcggtcggagaaacacatgatgagatgaatgcagttcttgattttactgttccaatgcttccgaatgataagcctcgttatttgatgggagttggtgcaccagatagtttaatagacgccgttatccgaggagtagatatgtttgattgcgtcttacctactcgtattgctcgaaatgggacatgtatgacaagtcaaggtcgcttagttgttaagaatgctaaatttgcagaagattttacgcctcttgatccaaattgcgattgctatacttgtaaaaattatacacgcgcttatattcgtcacttattgaaagcagatgaaacttttggtattcgtttgactagttaccataatctttatttccttgtcaatcttatgaaagatgtcagacaagctattatggatgataatcttctagaattccgtcaagattttatggagcgctatggctatggcatgaataaccgtaatttt

SEQ ID NO: 9578 - protein, 380 aa, Streptococcus agalactiae
MTDHPIKYRLIKQEKHTGARLGEIITPHGTFPTPMFMPVGTQATVKTQSPEELKEMGSGIILSNTYHLWLRPGDELIAKAGGLHKFMNWDQAILTDSGGFQVYSLADSRNITEEGVTFKNHLNGAKMFLSPEKAISIQNNLGSDIMMSFDECPQFYQPYDYVKKSIERTSRWAERGLNAHRRPHDQGLFGIVQGAGFEDLRRQSARDLVSMDFPGYSIGGLAVGETHDEMNAVLDFTVPMLPNDKPRYLMGVGAPDSLIDAVIRGVDMFDCVLPTRIARNGTCMTSQGRLVVKNAKFAEDFTPLDPNCDCYTCKNYTRAYIRHLLKADETFGIRLTSYHNLYFLVNLMKDVRQAIMDDNLLEFRQDFMERYGYGMNNRNF

SEQ ID NO: 9579 - DNA, 327 bp, Streptococcus agalactiae
ttgaaaaaaacctatcgggtaaaaagtgataaggattttcaaatgattttcagcagaggtaaaaatgttgctaatcgaaaatttgttatctactatttagaaaaagaacaaaaacactttcgtgtgggaatctctgttagtaagaaattaggaaatgctgttgttcgtaacgctattaaaagaaaaattaggcatgttttactctctcagaaaacagcgctgcaagattatgattttgtcgtgattgcgcgtaaaggtgtagaggaattggactatcaagcattagaaaaaaatcttatacacgttttaaaaatagcaggactcatc

SEQ ID NO: 9580 - protein, 109 aa, Streptococcus agalactiae
MKKTYRVKSDKDFQMIFSRGKNVANRKFVIYYLEKEQKHFRVGISVSKKLGNAVVRNAIKRKIRHVLLSQKTALQDYDFVVIARKGVEELDYQALEKNLIHVLKIAGLI

SEQ ID NO: 9581 - DNA, 3699 bp, Streptococcus agalactiae; identical to SEQ ID NO: 8525

SEQ ID NO: 9582 - protein, 1233 aa, Streptococcus agalactiae
MDKHHSKKAILKLTLITTSILLMHSNQVNAEEQELKNQEQSPVIANVAQQPSPSVTTNTVEKTSVTAASASNTAKEMGDTSVKNDKTEDELLEELSKNLDTSNLGADLEEEYPSKPETTNNKESNVVTNASTAIAQKVPSAYEEVKPESKSSLAVLDTSKITKLQAITQRGKGNVVAIIDTGFDINHDIFRLDSPKDDKHSFKTKTEFEELKAKHNITYGKWVNDKIVFAHNYANNTETVADIAAAMKDGYGSEAKNISHGTHVAGIFVGNSKRPAINGLLLEGAAPNAQVLLMRIPDKIDSDKFGEAYAKAITDAVNLGAKTINMSIGKTADSLIALNDKVKLALKLASEKGVAVVVAAGNEGAFGMDYSKPLSTNPDYGTVNSPAISEDTLSVASYESLKTISEVVETTIEGKLVKLPIVTSKPFDKGKAYDVVYANYGAKKDFEGKDFKGKIALIERGGGLDFMTKITHATNAGVVGIVIFNDQEKRGNFLIPYRELPVGIISKVDGERIKNTSSQLTFNQSFEVVDSQGGNRMLEQSSWGVTAEGAIKPDVTASGFEIYSSTYNNQYQTMSGTSMASPHVAGLMTMLQSHLAEKYKGMNLDSKKLLELSKNILMSSATALYSEEDKAFYSPRQQGAGVVDAEKAIQAQYYITGNDGKAKINLKRMGDKFDITVTIHKLVEGVKELYYQANVATEQVNKGKFALKPQALLDTNWQKVILRDKETQVRFTIDASQFSQKLKEQMANGYFLEGFVRFKEAKDSNQELMSIPFVGFNGDFANLQALETPIYKTLSKGSFYYKPNDTTHKDQLEYNESAPFESNNYTALLTQSASWGYVDYVKNGGELELAPESPKRIILGTFENKVEDKTIHLLERDAANNPYFAISPNKDGNRDEITPQATFLRNVKDISAQVLDQNGNVIWQSKVLPSYRKNFHNNPKQSDGHYRMDALQWSGLDKDGKVVADGFYTYRLRYTPVAEGANSQESDFKVQVSTKSPNLPSRAQFDETNRTLSLAMPKESSYVPTYRLQLVLSHVVKDEEYGDETSYHYFHIDQEGKVTLPKTVKIGESEVAVDPKALTLVVEDKAGNFATVKLSDLLNKAVVSEKENAIVISNSFKYFDNLKKEPMFISKKEKVVNKNLEEIILVKPQTTVTTQSLSKEITKSGNEKVLTSTNNNSSRVAKIISPKHNGDSVNHTLPSTSDRATNGLFVGTLALLSSLLLYLKPKKTKNNSK

SEQ ID NO: 9583 - DNA, 906 bp, Streptococcus agalactiae
atgaaaacgataaaagattggcaaataaatatttgcttagcgacctataatggtcaaaaataccttcgccagcaattagatagcataatacaacaaggttatactgactggatttgtttaataagggacgatggatctactgatgatacagtagctattattaaagaatatgttaatagagattcacgttttatatttattaattctaacgatgacagaaagttaggaagtcaccgcagtttttacgagttggttaactataaaaaagcagatttttatgttttctcagaccaggatgatgtttggaaagaaaatcgtttagaacgttaccttgaagaagcagagaaatttaaccaagaactaccattgcttgtttattcgaactggacttctgtagatgaaaaattaacagtattgaaagaacataatccagcaacagttattcaagaacaaattgcctttaaccaaataaatggtatggttatcatgatgaatcatgagttagcaaagctttgggaatatcgtcaaattggcgcccatgattcttatgttggaactctagcttacgccgttggaaatgtggcttatatttctgacagtacagtcctttggcgtagacaagtaggggcagagtcgctaaacaattacgggagacaatatggggtggctacgttttggcagatgataaatacttcttttgatcgtgcttcgcttatttttgctcaagtatccgataaaatgtccctggagcgtaaactcttctttagtcgttttatagaattaaaaaatgccaatctaatgagaaggatttatcttttatcaaaattaaaactccgtcggaaatcattgaaagaaacagttgctatgactatcctacttttaacaggttacggtaaaccaaaagca

SEQ ID NO: 9584 - protein, 302 aa, Streptococcus agalactiae
MKTIKDWQINICLATYNGQKYLRQQLDSIIQQGYTDWICLIRDDGSTDDTVAIIKEYVNRDSRFIFINSNDDRKLGSHRSFYELVNYKKADFYVFSDQDDVWKENRLERYLEEAEKFNQELPLLVYSNWTSVDEKLTVLKEHNPATVIQEQIAFNQINGMVIMMNHELAKLWEYRQIGAHDSYVGTLAYAVGNVAYISDSTVLWRRQVGAESLNNYGRQYGVATFWQMINTSFDRASLIFAQVSDKMSLERKLFFSRFIELKNANLMRRIYLLSKLKLRRKSLKETVAMTILLLTGYGKPKA

SEQ ID NO: 9585 - DNA, 396 bp, Streptococcus agalactiae
atgatacttgctggagtaactttagaaaatgtaaagtcaaatcaagaaggtatccagcaagccattggcatttgtaaaacacaacctgattttcgtttcgattacagtgccacttatcaagtagagacaagtgtccaagccccaaaagggttagaaattattaggatcccaagcgctacctatgcagtcatttctgttaaaggtccaatgccatcgagtcttcaagaaacatggcgaaaaataatacaaggattttttcaagagaataatctaaaaccagctaactcgccaaacttagaaatttattcatctcaacatccacaagatactgattatcaaatggaaatttggcttgctatcgcagatattactaataactcgaaaacaaacttaatc

SEQ ID NO: 9586 - protein, 132 aa, Streptococcus agalactiae
MILAGVTLENVKSNQEGIQQAIGICKTQPDFRFDYSATYQVETSVQAPKGLEIIRIPSATYAVISVKGPMPSSLQETWRKIIQGFFQENNLKPANSPNLEIYSSQHPQDTDYQMEIWLAIADITNNSKTNLI

SEQ ID NO: 9587 - DNA, 522 bp, Streptococcus agalactiae
atggtaaaagatagacaaattcagaaaacaaaagtagcgatttataatgcttttataagcttgctacaggaaaatgattattctaaaataacggttcaagatgtaatcggacttgcaaatgtaggaagatcaactttttactctcactatgaaagcaaagaagtgttactcaaggagctctgtgaagacctttttcaccacttatttaagcagggtagagatgttacgtttgaagagtatttagttcatatcttaaaacattttgaacaaaatcaagatagtatcgctacgttattattatctgacgatccctattttttattacgctttagaagtgaattagaacacgatgtttaccctagattgcgtgaggagtatattacaaaggtggacattcctgaagatttcttaaaacaatttcttttatccagttttatcgagaccttaaagtggtggcttcatcaaagacagaaaatgactgttgaagatttactaaaatattatttaactatggtagagagg

SEQ ID NO: 9588 - protein, 174 aa, Streptococcus agalactiae
MVKDRQIQKTKVAIYNAFISLLQENDYSKITVQDVIGLANVGRSTFYSHYESKEVLLKELCEDLFHHLFKQGRDVTFEEYLVHILKHFEQNQDSIATLLLSDDPYFLLRFRSELEHDVYPRLREEYITKVDIPEDFLKQFLLSSFIETLKWWLHQRQKMTVEDLLKYYLTMVER

SEQ ID NO: 9589 - DNA, 1191 bp, Streptococcus agalactiae
atgattgattttctactgttgaaatcattacacagtcttctaggtctaactattactgtttgtgatcaaaatttttctgttatcagagagtataaatccgagaaaactatttcacttttttacaatcattaccttattttaagtaactttagtaaaactcaacatgattttttatttcattatggctctttaggagaactttttcttgtccaccatattcaacaatattatattatcatcggtccctggcgtagcaatgttattgaccctttacttcttaagaaaaagctgactgaaacacaaatcaatgctagtgaacaagactactttattgatagactatcccaattacctttcttctcacttagtcaaatccgagaattactaatagtaaccaattattgtctaactggggttgtgaaagataaattatcagagcccttacattactacacgaaagggtggagcaactcctttgatctagataaaattaagcaattttctaaacagaatatgagttcttacaaatatcagtatcattttgaaaataatattctaaaagctgttaaatcaggtagtgaatttcttttgaaagaaacagtggaacaatttagcaattctatcgtacctataatcagtggagatgaattgcgatctgaaaaaaactactccatcatgatttatgatcgtctctcacaggctaccatccaagcaggacttgatatcgaaacagcttatcgagcacgagatcgttttataaaagaaaacgagtcaactataagtctaaatgaagttttaaaattacgtgatactgctatcttattctatactcaacaagttcattctttaaaaaaacatctcgaaacccctcattctcaaactattgtcgcagtgattcgatatcttgaaaataatctaaatcgctttattaaaacagaagaaatagctaaagaatgtcacatgagtgaatcgaagttacgaaaactatttaagcaagaaaaacacatcactattcaacaatattttctaaacttaaaaatcgaagctgctaagcaattactagatgaaaataagaaagtagaagaagtttccaatttacttggattttccacttcttctaatttttcaaggacatttaaaaaaatagtgggaattagcccactagaatataagcaaaagcctaagacaata

SEQ ID NO: 9590 - protein, 397 aa, Streptococcus agalactiae
MIDFLLLKSLHSLLGLTITVCDQNFSVIREYKSEKTISLFYNHYLILSNFSKTQHDFLFHYGSLGELFLVHHIQQYYIIIGPWRSNVIDPLLLKKKLTETQINASEQDYFIDRLSQLPFFSLSQIRELLIVTNYCLTGVVKDKLSEPLHYYTKGWSNSFDLDKIKQFSKQNMSSYKYQYHFENNILKAVKSGSEFLLKETVEQFSNSIVPIISGDELRSEKNYSIMIYDRLSQATIQAGLDIETAYRARDRFIKENESTISLNEVLKLRDTAILFYTQQVHSLKKHLETPHSQTIVAVIRYLENNLNRFIKTEEIAKECHMSESKLRKLFKQEKHITIQQYFLNLKIEAAKQLLDENKKVEEVSNLLGFSTSSNFSRTFKKIVGISPLEYKQKPKTI

SEQ ID NO: 9591 - DNA, 1362 bp, Streptococcus agalactiae
  misc_feature (1)..(1362): n = a, c, g, or t
atgtttagaaggtctaaaaataacagttatgatactttacagacgaaacaacggttttcaattaagaagtttaagtttggtgcagcttctgtactaattggtattagttttttaggaggttttactcaagggcaatttaatatttctacagatactgtgtttgcagctgaagtaatttcaggaagtgctgttacgttaaacacaaatatgactaaaaatgttcagaatggtagagcatatatagatttatatgatgtgaaaaatgggaaaatagatccattacaattaattacgttaaattcacctgatttaaaagctcagtatgtcattaggcaaggcggcaattatttcacacaaccttctgaattgactactgttggtgcagctagtattaattatacagtattgaagacagatggaagtcctcatacgaagcctgatggacaagtggatattgtaaacgtttcattgactatttacaattcttcagctttgagagataaaatagatgaagttaaaaagaaagcggaagaccctaaatgggacgagggaagtcgcgataaagttttgataagtttagatgatatcaaaacagatattgataataatcctaagacgcaatcagacattgccaataaaataactgaagttactaatttagaaaaaatactagtacctcgaatcccagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaannnnnt

SEQ ID NO: 9592 - protein, 454 aa, Streptococcus agalactiae
  MISC_FEATURE (1)..(454): Xaa = Any Amino Acid
MFRRSKNNSYDTLQTKQRFSIKKFKFGAASVLIGISFLGGFTQGQFNISTDTVFAAEVISGSAVTLNTNMTKNVQNGRAYIDLYDVKNGKIDPLQLITLNSPDLKAQYVIRQGGNYFTQPSELTTVGAASINYTVLKTDGSPHTKPDGQVDIVNVSLTIYNSSALRDKIDEVKKKAEDPKWDEGSRDKVLISLDDIKTDIDNNPKTQSDIANKITEVTNLEKILVPRIPDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYPDGSKXX

SEQ ID NO: 9593 - DNA, 4167 bp, Streptococcus agalactiae
atgtttagaaggtctaaaaataacagttatgatactttacagacgaaacaacggttttcaattaagaagtttaagtttggtgcagcttctgtactaattggtattagttttttaggaggttttactcaagggcaatttaatatttctacagatactgtgtttgcagctgaagtaatttcaggaagtgctgttacgttaaacacaaatatgactaaaaatgttcagaatggtagagcatatatagatttatatgatgtgaaaaatgggaaaatagatccattacaattaattacgttaaattcacctgatttaaaagctcagtatgtcattaggcaaggcggcaattatttcacacaaccttctgaattgactactgttggtgcagctagtattaattatacagtattgaagacagatggaagtcctcatacgaagcctgatggacaagtggatattgtaaacgtttcattgactatttacaattcttcagctttgagagataaaatagatgaagttaaaaagaaagcggaagaccctaaatgggacgagggaagtcgcgataaagttttgataagtttagatgatatcaaaacagatattgataataatcctaagacgcaatcagacattgccaataaaataactgaagttactaatttagaaaaaatactagtacctcgaatcccagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatggtaaaggaaataaactaccagcaacaggtgagaatgcaactccattctttaatgttgtagctttgacaattatgtcatcagttggtttattatctgtttctaagaaaaaagaggat

SEQ ID NO: 9594 - protein, 1389 aa, Streptococcus agalactiae
MFRRSKNNSYDTLQTKQRFSIKKFKFGAASVLIGISFLGGFTQGQFNISTDTVFAAEVISGSAVTLNTNMTKNVQNGRAYIDLYDVKNGKIDPLQLITLNSPDLKAQYVIRQGGNYFTQPSELTTVGAASINYTVLKTDGSPHTKPDGQVDIVNVSLTIYNSSALRDKIDEVKKKAEDPKWDEGSRDKVLISLDDIKTDIDNNPKTQSDIANKITEVTNLEKILVPRIPDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNGKGNKLPATGENATPFFNVVALTIMSSVGLLSVSKKKED

SEQ ID NO: 9595 - DNA, 183 bp, Streptococcus agalactiae
ttgtataactattgtatcactaaatgcaatacaacgcaaacaaaaaaggaaatcgtctttcccaatgaagaggctctagaatactatctagtcacactatttaatgattacaacttcaagcaagaacaacgaatccacaaaggttttggccaatgtacagacacacttgaaagcctatttgat

SEQ ID NO: 9596 - protein, 61 aa, Streptococcus agalactiae
MYNYCITKCNTTQTKKEIVFPNEEALEYYLVTLFNDYNFKQEQRIHKGFGQCTDTLESLFD

SEQ ID NO: 9597 - DNA, 309 bp, Streptococcus agalactiae
atggcaaagcgtattaaaccgaataaaaaaagagagcttttgaaagctaaagggatcaattggaaggatgttcgactatctcaaactttacaagaagtcgcattaccgaaaaagacggctcctgaagcgccaaaggcagtcgatcttttagaaggtttaactgctaataaacaagatgttttaaaagaagctggccttgtcagccttgaagcatttgcgaaagtaagtgaagcagatgttttagcactaaaaggtattggtccagcagctattaaacagttagttgataatggtgttgtttttgcaaaa

SEQ ID NO: 9598 - protein, 103 aa, Streptococcus agalactiae
MAKRIKPNKKRELLKAKGINWKDVRLSQTLQEVALPKKTAPEAPKAVDLLEGLTANKQDVLKEAGLVSLEAFAKVSEADVLALKGIGPAAIKQLVDNGVVFAK

SEQ ID NO: 9599 - DNA, 576 bp, Streptococcus agalactiae
ttgaagtatatgcagattctagaagatttcgatggcaaagcattaccaaaactagaaacggatcggcttatcttgcgtcagcgaacggtgggggatgtcccagccatgtttgattacgtttgcttggaagaggttgcctatccagcaggactcagcccaatagcttctttagaagatgagtacgattattttgaaaatcgctactatcaaaatctggaaaaggcaaaattaccatctggttatggtattaccgttaaaggaagtgatcgtattatcggatcctgcgcctttaaccatcgccatgaagacgatgttttcgagatttgctatctgcttcatcctgactactggggtcatggctatatgacagaagctgtcgccgctttgattgaagtcggttttacccttctcaatctccacaaaatcgaaatccgctgctatgattacaataagcaaagccggcgcgtggcagaaaaactaggattcacccttgaagctaccattcgtgatcgtaaggataatcaagacaatcgctgtgtcaatttgatatatggtttgctgaggagtgagtgggag

SEQ ID NO: 9600 - protein, 192 aa, Streptococcus agalactiae
MKYMQILEDFDGKALPKLETDRLILRQRTVGDVPAMFDYVCLEEVAYPAGLSPIASLEDEYDYFENRYYQNLEKAKLPSGYGITVKGSDRIIGSCAFNHRHEDDVFEICYLLHPDYWGHGYMTEAVAALIEVGFTLLNLHKIEIRCYDYNKQSRRVAEKLGFTLEATIRDRKDNQDNRCVNLIYGLLRSEWE

SEQ ID NO: 9601 - DNA, 1173 bp, Streptococcus agalactiae
atgacccagtttaccacagaattacttaacttcctagctcaaaaacaagatattgatgaatttttccgttcgtctcttgaaactgccatgaatgaccttctccaagtggagctatccgccttccttggctatgaaccatacgataaggcaggttacaacaccggtaatagtcgtaatggtgcttatacacgtcgatttgagaccaagtatggtgttgttaatttgttgatccctagagatcgaaacggggagttcagtccagccttaatcccaagttacggtcgtcgagacaatcatttagaagaaatggttatcaagctttatcgaactggagtcacaacacgtgaaatcagcgacatcattgagcgtatgtatggtcatcattacagtccagcaacagtatctaatatctcgaaagcgacacaggaaaacgtggctagctttcatgaacgttccttagaagctaactataccgtattatatcttgatgggacttaccttcctctgagacgtggtacagttagtaaggaatgcatccacattgcactaggcgtcacatcatatgggcataaggctatccttggatatgacatcgcacccaatgaaaacaatgcttcgtggtcagaccttctagaaagatttaagggtcaaggtgtacaacaagtctctcttgttgtgagtgatggttttaatggacttgatcagcttatccagcaagccttcccaatggccaaacaacagcgttgccttgtccatattggccgaaatattgcaagtaaggtgaaacgagcagatcgtgctctaattttggagcagtttaaaacaatttatcgcgcgatcaatgtagaggaagcaaagcaagccttagatagctttatcaatgagtggaaaccacactacaagaaggtaatagagaccttagaatcaatcgaaaatctattgatcttttatgaatttcctcatcagatctggggaagtatctactcgaccaaccttattgaatcacttaacaaagaaatcaaacgtcaaaccaaaaagaaagtcgtctttcccaatgaagaatccctagaacgctatctcgtcacactatttagtgattacaacttcaagcaaggacaacgaatccacaaaggttttggccaatgtacggacacacttgaaagcctatttgat

SEQ ID NO: 9602 - protein, 391 aa, Streptococcus agalactiae
MTQFTTELLNFLAQKQDIDEFFRSSLETAMNDLLQVELSAFLGYEPYDKAGYNTGNSRNGAYTRRFETKYGVVNLLIPRDRNGEFSPALIPSYGRRDNHLEEMVIKLYRTGVTTREISDIIERMYGHHYSPATVSNISKATQENVASFHERSLEANYTVLYLDGTYLPLRRGTVSKECIHIALGVTSYGHKAILGYDIAPNENNASWSDLLERFKGQGVQQVSLVVSDGFNGLDQLIQQAFPMAKQQRCLVHIGRNIASKVKRADRALILEQFKTIYRAINVEEAKQALDSFINEWKPHYKKVIETLESIENLLIFYEFPHQIWGSIYSTNLIESLNKEIKRQTKKKVVFPNEESLERYLVTLFSDYNFKQGQRIHKGFGQCTDTLESLFD

SEQ ID NO: 9603 - DNA, 537 bp, Streptococcus agalactiae
atgagagtagtagcaggaacatttggagggcgtcctttaaaaacgcttgatggaaaaacaactcgtccaacaactgataaggttaaaggcgctatttttaatatgattggtcctttttttgaaggtggtcgtgttttagaccttttttctggcagtggtagcttagctattgaggcgatctcaaggggaatggaccaagctgtcctagttgaaaaagataggcgtgcgcaggtcgttattcaagaaaatattgcaatgactaagagtccggagcaatttcaattattaaaaatggaagccaaccgtgctttagaacaattaacgggacaatttgatttggtcttgttggacccgccatatgctaaggaagaaattgtaaagcaaatccaaatcatggatagcaagggtttattaggcgatgatatcatgattgcttgtgaaacggacaaatcagttgatttacctgaagaaattgcttcttttgggatatggaaacagaaaatttatggcatttctaaagtaacggtctacgttcgt

SEQ ID NO: 9604 - protein, 179 aa, Streptococcus agalactiae
MRVVAGTFGGRPLKTLDGKTTRPTTDKVKGAIFNMIGPFFEGGRVLDLFSGSGSLAIEAISRGMDQAVLVEKDRRAQVVIQENIAMTKSPEQFQLLKMEANRALEQLTGQFDLVLLDPPYAKEEIVKQIQIMDSKGLLGDDIMIACETDKSVDLPEEIASFGIWKQKIYGISKVTVYVR

SEQ ID NO: 9605 - DNA, 432 bp, Streptococcus agalactiae
atgctgttttacgcaggtgcagatgttgctattatcaattctggcttaattgttcagccatttgaaaaagacttttcgaggaaaaatctccacgaatcattacctcatcaaatgcgcctcgctaaattgacagtgagtagtcaagaacttttagagatttatgaaactatttatcaacaaggtcaatttttagcgcaacaaaagattcatggtatgggctttcgtggcaagtgctttggagaagttttacattcgggatttgattacaaaaatggaaaaatagtgtataatgagaaagatattgatgccaaagaagaagtgattcttgtaatcgttgatcagtattattttgcatcgtattttgagtgtttaaaaacgaaaaaagtagacttgcttttcctgaattactcagagatgtggcagcagattatt

SEQ ID NO: 9606 - protein, 144 aa, Streptococcus agalactiae
MLFYAGADVAIINSGLIVQPFEKDFSRKNLHESLPHQMRLAKLTVSSQELLEIYETIYQQGQFLAQQKIHGMGFRGKCFGEVLHSGFDYKNGKIVYNEKDIDAKEEVILVIVDQYYFASYFECLKTKKVDLLFLNYSEMWQQII

SEQ ID NO: 9607 - DNA, 1104 bp, Streptococcus agalactiae
atgcctaaaaaaactgatacacccgcctataaaccctctatttatagcttaactcgcgatgaactaatagcttgggctattgaacatggagaaaagaaattccgtgcttcacaaatctgggactggctctataaaaagcgtgtgcaaagcttcgatgaaatgactaacatttccaaagattttattgcacttttgaacgagaattttgttgttaatcctctaaaacaacgtattgttcaagaatctgctgatggaactgttaaatacctttttgaattacctgatggcatgctgattgagacggttttgatgcgtcaacattatggtttatcagtatgtgtaacgactcaagttggttgtaacattggttgcactttctgtgcaagtggtttaataaagaaacaacgtgatcttaacaatggcgaaatcactgctcaaattatgcttgttcaaaaatattttgatgaacgtggacaaggtgagcgcgttagtcacattgtggtcatgggaataggtgaaccctttgataactataccaatgtattaaaattcttgcgtacagttaatgatgataatggattagctattggtgcacgtcacattacagtgtctacttcaggtttagcacataaaattcgtgaatttgcaaatgaaggtgtacaagttaacttagcagtatctcttcatgctccaaataacgatttacgatcaagtatcatgcgtattaatcgttctttccctcttgaaaagttgtttgcggctattgaatattatattgagacgactaaccgtcgtgtaacatttgagtatattatgttaaatggtgtcaacgataccccagaaaatgctcaagagttagcagatttaacgaaaaagattcgcaaattatcttatgtcaatttaattccttacaatcctgtctcagaacatgaccagtatagtcgtagtcctaaagagcgtgtagaagctttctatgacgttttgaagaaaaatggagttaactgtgttgttcgtcaagaacatggtacggacattgatgcagcttgcgggcaattacgttcaaacacaatgaaacgcgatcgtcaaaaagcgaaggtagggcag

SEQ ID NO: 9608 - protein, 368 aa, Streptococcus agalactiae
MPKKTDTPAYKPSIYSLTRDELIAWAIEHGEKKFRASQIWDWLYKKRVQSFDEMTNISKDFIALLNENFVVNPLKQRIVQESADGTVKYLFELPDGMLIETVLMRQHYGLSVCVTTQVGCNIGCTFCASGLIKKQRDLNNGEITAQIMLVQKYFDERGQGERVSHIVVMGIGEPFDNYTNVLKFLRTVNDDNGLAIGARHITVSTSGLAHKIREFANEGVQVNLAVSLHAPNNDLRSSIMRINRSFPLEKLFAAIEYYIETTNRRVTFEYIMLNGVNDTPENAQELADLTKKIRKLSYVNLIPYNPVSEHDQYSRSPKERVEAFYDVLKKNGVNCVVRQEHGTDIDAACGQLRSNTMKRDRQKAKVGQ

SEQ ID NO: 9609 - DNA, 585 bp, Streptococcus agalactiae
gtgcaaggaaaggtctataaaatgttactattggtagataattacgattcttttacctataatttaaagcaatatttaagtgtctataaagaggtattcgtcataaaaaatgatgttcctaacctttttttattagctgagagcgcagaagccatcgtcttatcacctggaccaggacacccaaaggatgctgggaaaatggtagaattaatcaatcagtttataggaaagaaacctattctaggtatctgtttggggcatcaagcgcttgccgagtgcttgggtgggcgattaaatttagcaaatcacgttatgcatggtaaacaaagttgggtaacaataaacgaccatactagtttgtttaagggaattgatagtccaacccaagttatgcgttatcattcattggtagtgactgatttaccagagaatattgctgttattgcacgatcaaatgaggataatgaaatcatggcattccattgccccagcttaaaggtatatgcgatgcagtttcatcctgagtcaatcgggagtattgatggaatgaaaatgattgaaaactttttgacgttaattaatgac

SEQ ID NO: 9610 - protein, 195 aa, Streptococcus agalactiae
MQGKVYKMLLLVDNYDSFTYNLKQYLSVYKEVFVIKNDVPNLFLLAESAEAIVLSPGPGHPKDAGKMVELINQFIGKKPILGICLGHQALAECLGGRLNLANHVMHGKQSWVTINDHTSLFKGIDSPTQVMRYHSLVVTDLPENIAVIARSNEDNEIMAFHCPSLKVYAMQFHPESIGSIDGMKMIENFLTLIND

SEQ ID NO: 9611 - DNA, 990 bp, Streptococcus agalactiae
atgtcatttcaaacaaattatatccatttggctgacgaaatattatctggaaagactagcatttcttatgaacaagcgctggaaattctaaatagcgatgagaactggtgggaaatctacgctgctgccttataccttaaaaatcaagttagccgaaataatattcgccttaacgttttattaagtgctaagcaaggactttgtgcagaaaattgtggttactgttctcaatctaaagaaagcactgctgacattgataaatttggtctgcttcctcaaaatgtcattctaaaacaggctattgtcgctcatcaaaatggtgctagcgtcttttgtattgcgatgagtggaactaagcctagcaagagagaaattgagcagttatgtcaagtcatccctgaaatcaaaaaaagcctccctctagaaatatgccttaccgctggttttttggatagagaacaacttcatcagctaaaacaagcaggaattgaccgtatcaatcataatctcaacacccccgaagaaaactaccccaacattgcaacgacgcatagcttcaaagatcgttgtgatactttagaaagaattcacaatgaagacattgatgtttgttctggattcatttgtggtatgggagagagcgatgaggggctcatcacattagctttcagactaaaagagctggacccctattctatccctgtcaattttttacttgctgttgaaggaacacctcttggaaaatataactatttgactcccattaaatgcttaaaaattatggccatgttgcgttttgtttttcctttcaaggaattaagattaagcgctggacgagaggtccattttgagaattttgaatcattagtcaccttacttgttgactcaacttttttgggaaattacctaacagagggcggtcgcaatcaacataccgatattgaattcttggaaaaattacaactaaatcatactaaaaaggaattaatt

SEQ ID NO: 9612 - protein, 330 aa, Streptococcus agalactiae
MSFQTNYIHLADEILSGKTSISYEQALEILNSDENWWEIYAAALYLKNQVSRNNIRLNVLLSAKQGLCAENCGYCSQSKESTADIDKFGLLPQNVILKQAIVAHQNGASVFCIAMSGTKPSKREIEQLCQVIPEIKKSLPLEICLTAGFLDREQLHQLKQAGIDRINHNLNTPEENYPNIATTHSFKDRCDTLERIHNEDIDVCSGFICGMGESDEGLITLAFRLKELDPYSIPVNFLLAVEGTPLGKYNYLTPIKCLKIMAMLRFVFPFKELRLSAGREVHFENFESLVTLLVDSTFLGNYLTEGGRNQHTDIEFLEKLQLNHTKKELI

SEQ ID NO: 9613 - DNA, 492 bp, Streptococcus agalactiae
atgaaaaaactatttaaaaaagcgatagctatgtgccgagatttgccgcttaattttgtaattgttgaacttagtttgtatcaaagagaggatggctcatctgataatattaaatggatttctaagagaattcttgaggtaacggtaactgatcagcaatggatttaccatttgaggatgcttaatttaccaaaacttaagccaatgtcactagcatccagtgactgtcctgcaagggaagagaaggctagtcttatttcaatagaagaatgtcaaaaattcactagcttagtgcgagataaaaatccttttcaccaaggggaagcagctattgtgcctgcggctctattattggaaaaaataatggaagttagaaaaggaaaaataaaggagattcatttgacttttttatctccagtaagggtgaatcaagaattctcagtgcaagtagtggataacacagtgattatttttcagcatcaaatattatgg

SEQ ID NO: 9614 - protein, 164 aa, Streptococcus agalactiae
MKKLFKKAIAMCRDLPLNFVIVELSLYQREDGSSDNIKWISKRILEVTVTDQQWIYHLRMLNLPKLKPMSLASSDCPAREEKASLISIEECQKFTSLVRDKNPFHQGEAAIVPAALLLEKIMEVRKGKIKEIHLTFLSPVRVNQEFSVQVVDNTVIIFQHQILW

SEQ ID NO: 9615 - DNA, 1353 bp, Streptococcus agalactiae
atgaaaacaataacaacatttgaaaataaaaaagttttagtccttggtttagcacgatctggagaagctgctgcacgtttgttagctaagttaggagcaatagtgacagttaatgatggcaaaccatttgatgaaaatccaacagcacagtctttgttggaagagggtattaaagtggtttgtggtagtcatcctttagaattgttagatgaggatttttgttacatgattaaaaatccaggaataccttataacaatcctatggtcaaaaaagcattagaaaaacaaatccctgttttgactgaagtggaattagcatacttagtttcagaatctcagctaataggtattacaggctctaacgggaaaacgacaacgacaacgatgattgcagaagtcttaaatgctggaggtcagagaggtttgttagctgggaatatcggctttcctgctagtgaagttgttcaggctgcgaatgataaagatactctagttatggaattatcaagttttcagctaatgggagttaaggaatttcgtcctcatattgcagtaattactaatttaatgccaactcatttagattatcatgggtcttttgaagattatgttgctgcaaaatggaatatccaaaatcaaatgtcttcatctgattttttggtacttaattttaatcaaggtatttctaaagagttagctaaaactactaaagcaacaatcgttcctttctctactacggaaaaagttgatggtgcttacgtacaagacaagcaacttttctataaaggggagaatattatgtcagtagatgacattggtgtcccaggaagccataacgtagagaatgctctagcaactattgcggttgctaaactggctggtatcagtaatcaagttattagagaaactttaagcaattttggaggtgttaaacaccgcttgcaatcactcggtaaggttcatggtattagtttctataacgacagcaagtcaactaatatattggcaactcaaaaagcattatctggctttgataatactaaagttatcctaattgcaggaggtcttgatcgcggtaatgagtttgatgaattgataccagatatcactggacttaaacatatggttgttttaggggaatcggcatctcgagtaaaacgtgctgcacaaaaagcaggagtaacttatagcgatgctttagatgttagagatgcggtacataaagcttatgaggtggcacaacagggcgatgttatcttgctaagtcctgcaaatgcatcatgggacatgtataagaatttcgaagtccgtggtgatgaattcattgatactttcgaaagtcttagaggagag

SEQ ID NO: 9616 - protein, 451 aa, Streptococcus agalactiae
MKTITTFENKKVLVLGLARSGEAAARLLAKLGAIVTVNDGKPFDENPTAQSLLEEGIKVVCGSHPLELLDEDFCYMIKNPGIPYNNPMVKKALEKQIPVLTEVELAYLVSESQLIGITGSNGKTTTTTMIAEVLNAGGQRGLLAGNIGFPASEVVQAANDKDTLVMELSSFQLMGVKEFRPHIAVITNLMPTHLDYHGSFEDYVAAKWNIQNQMSSSDFLVLNFNQGISKELAKTTKATIVPFSTTEKVDGAYVQDKQLFYKGENIMSVDDIGVPGSHNVENALATIAVAKLAGISNQVIRETLSNFGGVKHRLQSLGKVHGISFYNDSKSTNILATQKALSGFDNTKVILIAGGLDRGNEFDELIPDITGLKHMVVLGESASRVKRAAQKAGVTYSDALDVRDAVHKAYEVAQQGDVILLSPANASWDMYKNFEVRGDEFIDTFESLRGE

SEQ ID NO: 9617 - DNA, 603 bp, Streptococcus agalactiae
atggcattaaaagatagatttgacaaaattatttcttattttgacactgacgatgtaagtgaaaatgaagtacacgaagtacaagagagaacttcagtgcaaagagattccagagcagctacagcacaggaagcttctcagcgtagtcatatgactaactccgcagaggaagagatgattggtagtcgtccgagaacttatacctatgatcctaatcgtcaggagagacaaagggtacagagagacaatgcttatcagcaagctactcctagggttcaaaataaagactcagttcgacaacagagagaacaagtaacaattgctctgaagtatccccgtaagtatgaggatgcacaagaaattgttgatttacttatcgttaatgaatgtgtcttgattgattttcaatatatgcttgatgcgcaagcacgacgttgcttggattatattgatggtgcaagtagagtattatatggttcattacaaaaggttgggagttcaatgtttctattaacaccagccaatgttatggttgatattgaggagatgaatattccaaagactggtcaagagacgagttttgattttgatatgaagagacga

SEQ ID NO: 9618 - protein, 201 aa, Streptococcus agalactiae
MALKDRFDKIISYFDTDDVSENEVHEVQERTSVQRDSRAATAQEASQRSHMTNSAEEEMIGSRPRTYTYDPNRQERQRVQRDNAYQQATPRVQNKDSVRQQREQVTIALKYPRKYEDAQEIVDLLIVNECVLIDFQYMLDAQARRCLDYIDGASRVLYGSLQKVGSSMFLLTPANVMVDIEEMNIPKTGQETSFDFDMKRR

SEQ ID NO: 9619 - DNA, 690 bp, Streptococcus agalactiae
atgaatttttcatttttaccacaatattggtcctattttaattatggtgtgatggtaaccattatgatttcaacatgtgttgttttttttggaactattataggtgtgttaattgctttagtaaagcgtactaatttacattttctcacaatattagctaatttctatgtatgggtatttcgtgggacaccgatggtagttcaaattatgattgctttcgcatggatgcattttaacaatttaccaacgattagctttggtgttttagatttagattttacacgacttttacctggtatcattatcatttccttaaatagtggtgcctatatttcggaaattgtacgtgcagggattgaggctgtaccatctggacaaatagaagcagcttactcgttggggattcgacctaaaaatacacttcgctatgttatcttaccccaagcttttaaaaatattttacctgctctagggaatgaatttattacaattattaaagatagtgctctccttcaaactattggtgtcatggaattatggaacggagcacaatcagttgtaacggctacttactcaccagttgcaccgttattatttgcagcattttactatttaatgttgacaacgattctctcagctttgttaaaacaaatggagaaatatcttgggaaaggggtaaaaatagatggt

SEQ ID NO: 9620 - protein, 230 aa, Streptococcus agalactiae
MNFSFLPQYWSYFNYGVMVTIMISTCVVFFGTIIGVLIALVKRTNLHFLTILANFYVWVFRGTPMVVQIMIAFAWMHFNNLPTISFGVLDLDFTRLLPGIIIISLNSGAYISEIVRAGIEAVPSGQIEAAYSLGIRPKNTLRYVILPQAFKNILPALGNEFITIIKDSALLQTIGVMELWNGAQSVVTATYSPVAPLLFAAFYYLMLTTILSALLKQMEKYLGKGVKIDG

SEQ ID NO: 9621 - DNA, 1692 bp, Streptococcus agalactiae
atgaattataaagagatttatcaagagtggttagaaaacgactcactcggtaaagatattaagtcagatttagaagctattaaaggcgatgaatctgaaattcaggatcgtttttacaaaacattagaatttggaacggcgggattgagaggtaaacttggagcaggaaccaatcgtatgaatacttatatggtggggaaagcagcacaagcattagctaatacgattattgatcatggccctgaagctattgcacgtggaattgcagttagttatgatgtccgttatcaatctaaggaatttgcagaattaacttgttccattatggcagcaaatggtattaagtcttatatttataaagggattcgcccaacaccaatgtgctcatatgctattcgtgctctaggatgtgtttcgggtgtgatgattactgctagtcataatcctcaagcttataatggttataaggcatattggaaagaaggatctcagattttagatgatattgctgatcaaattgccaatcatatggatgctataaccgattatcagcaaattaagcaaataccctttgaagaggctctggcaagtggttcggcaagttatatcgatgagagtattgaagaagcatataaaaaagaagtgcttggtttaactattaatgatactaatattgataagtcagtccgggtagtttatactcctttaaatggcgtaggaaatttacctgtgcgcgaagttttaagacgccgtggttttgaaaatgtttatgtggtacctgagcaggaaatgcccgatcctgattttacaacggttggctatccaaaccctgaagttcctaaagcatttgcctattcagaatctctaggaaagtcagttgatgcagatatcttacttgccacagatccagattgtgaccgagtagcattggaagtcaaagatagtaagggagaatatattttcttaaatggtaataagataggggcacttctttcctattatattttttcacaacgatgtgccttagggaatttgccacatcatcctgtattggtaaaatccattgtaactggtgatctatcaaaagttattgcagataaatataatattgaaactgttgaaactttaacaggatttaaaaatatttgtggaaaagctaatgaatatgatatctcaaaggataaaacttatctctttggctatgaagaaagtattggtttttgctatggcacttttgtacgtgataaagatgctgtgagtgcttcaatgatggtagtagaaatgactgcctattataaagaacgagggcaaacacttttagacgttttgcaaaccatttacgataaatttggctattacaacgagcgccaattttctcttgagttagagggtgctgaggggcaagaacgtattagtcgtattatggaggattttagacaggacccaatattacaagtaggtgagatgacattggagaattctattgatttcaaggatggttataaggattttccaaagcaaaattgtttaaaatattattttaatgagggttcatggtatgctttaaggccgtcagggacggaacctaagataaaatgttacctttatacgattggttgtacagaagcagatagtttatcgaaacttaatgcaattgagtcggcttgtcgtgctaaaatgaatagtactaaa

SEQ ID NO: 9622 - protein, 564 aa, Streptococcus agalactiae
MNYKEIYQEWLENDSLGKDIKSDLEAIKGDESEIQDRFYKTLEFGTAGLRGKLGAGTNRMNTYMVGKAAQALANTIIDHGPEAIARGIAVSYDVRYQSKEFAELTCSIMAANGIKSYIYKGIRPTPMCSYAIRALGCVSGVMITASHNPQAYNGYKAYWKEGSQILDDIADQIANHMDAITDYQQIKQIPFEEALASGSASYIDESIEEAYKKEVLGLTINDTNIDKSVRVVYTPLNGVGNLPVREVLRRRGFENVYVVPEQEMPDPDFTTVGYPNPEVPKAFAYSESLGKSVDADILLATDPDCDRVALEVKDSKGEYIFLNGNKIGALLSYYIFSQRCALGNLPHHPVLVKSIVTGDLSKVIADKYNIETVETLTGFKNICGKANEYDISKDKTYLFGYEESIGFCYGTFVRDKDAVSASMMVVEMTAYYKERGQTLLDVLQTIYDKFGYYNERQFSLELEGAEGQERISRIMEDFRQDPILQVGEMTLENSIDFKDGYKDFPKQNCLKYYFNEGSWYALRPSGTEPKIKCYLYTIGCTEADSLSKLNAIESACRAKMNSTK

SEQ ID NO: 9623 - DNA, 711 bp, Streptococcus agalactiae
atggcagctttggcctgtgtcaaaactggtgcaggattagttactgtagcaacccaaagttgcaatatcccctctttgcatagtcaactaccagaggtaatggcgtttgatagtgatgattacaaatggttggaaaaatcaattgttcaaagtgatgttattgtaattggtcctggattaggagtatcagaatcatctcgaaaaattttgaaccagaccatggagaagattcaatcacatcaaagtgtcatccttgacggatcagccttgactctgttatcagaaggtgcgtttccgcaaacaaaggctaaaaatttagtgttgacacctcatcaaaaagaatgggagcgattgtcaggtatcgctgtatcgcaacagacaaaagaaaatacccaaaccgctcttaaatcttttcccaaagggacgattttagtcgctaagagttcgcatacgcgtatttttcaagatttagacgaaaaagaaattatagtaggaggtccttaccaggcgactggagggatgggggatactttgtgtggtatgattgcaggtatgttagcgcaatttaaagaagcctctcctctagataaggtatcagtgggagtttatctacattcggcaattgctcaaggattatctaaagaagcctatgttgttctaccgacaacgattagtgatgagattccaaaagaaatggctagactatctaaa

SEQ ID NO: 9624 - protein, 237 aa, Streptococcus agalactiae
MAALACVKTGAGLVTVATQSCNIPSLHSQLPEVMAFDSDDYKWLEKSIVQSDVIVIGPGLGVSESSRKILNQTMEKIQSHQSVILDGSALTLLSEGAFPQTKAKNLVLTPHQKEWERLSGIAVSQQTKENTQTALKSFPKGTILVAKSSHTRIFQDLDEKEIIVGGPYQATGGMGDTLCGMIAGMLAQFKEASPLDKVSVGVYLHSAIAQGLSKEAYVVLPTTISDEIPKEMARLSK

SEQ ID NO: 9625 - DNA, 1218 bp, Streptococcus agalactiae
atgtatcatgttaccgttggaatatccgaaaaagaatatgatgcctttgctattgcatcgtctcaaaccaatctcctccactcttcaaagtgggcacaagtaaaatcaaattggcaaaatgaacgtttaggcttttataaagatgaccaattagttgctgtagctagcatcttaattaaatcattaccacttggttttacaatgctttatattccacgtggacctattatggactacagcaataaagaattagttaactttgtgttaaaaacactaaaaaactttggacgaaagaaacgtgctgtttttgcaaaattcgatccagcacttcttctacgtcaatatcaccttaaagaagagaatgtcgccgaagagatagatgaaagtagacaggcaattgataatcttaagtcagcaggtgcccaatggataggtccaacgaaagccatttccgaaaccatccaacctcgttttcaagcgaatatctataccaaagcaaatatagaagaaaactttccaaaacacactaaacgtctgataaaagatgcaaagcatcgcggtgttcaaatttatcgtgccaacattgatgatttacctaaattcgccacggttgtagcattaaccgagaatcgtaaaggtgtagctttacgtaatgaaaactatttccatcaactaatgacaatttatggagaagatgcctatctctatttagctaaagtcaatcttcctaaaagattagcgcaatttaaagaacaacttcttcaaatccaaaaagatttatcagaaactccatcccatcaaaaaagtcgcctgacaaggctaaatcaacaagaagcttctgttaaacaatatatccttgaatttcaggagtttagcaagaaatatccagatgagcctgtcattgcaggaattttgtccattcgttttggcaatgtcctggagatgttgtatgctggtatggatgatagcttccgtaaattttatccacagtatctcttgaatgctagggtgttcgaagatgctttcaaaaacgatattgtatctgctaatctaggcggtgtcgagggaagtcttaacgatggtttaacaaaatttaaaagtaacttcaatccaatgtttgaagaatatattggcgagtttaatctagcaatcaatccattattatataaattggccaacctagcctatactattcgaaaaaaacaaagacactctcac

SEQ ID NO: 9626 - protein, 406 aa, Streptococcus agalactiae
MYHVTVGISEKEYDAFAIASSQTNLLHSSKWAQVKSNWQNERLGFYKDDQLVAVASILIKSLPLGFTMLYIPRGPIMDYSNKELVNFVLKTLKNFGRKKRAVFAKFDPALLLRQYHLKEENVAEEIDESRQAIDNLKSAGAQWIGPTKAISETIQPRFQANIYTKANIEENFPKHTKRLIKDAKHRGVQIYRANIDDLPKFATVVALTENRKGVALRNENYFHQLMTIYGEDAYLYLAKVNLPKRLAQFKEQLLQIQKDLSETPSHQKSRLTRLNQQEASVKQYILEFQEFSKKYPDEPVIAGILSIRFGNVLEMLYAGMDDSFRKFYPQYLLNARVFEDAFKNDIVSANLGGVEGSLNDGLTKFKSNFNPMFEEYIGEFNLAINPLLYKLANLAYTIRKKQRHSH

SEQ ID NO: 9627 - DNA, 810 bp, Streptococcus agalactiae
atgacttcaattaaacttgttgccgtagatattgacggcaccctattaaatagtaagcgtgaaattacacctgaagtggctaaagctgttcaagaagcaaaatcaaaaggcgttaaaattgttattgctacaggacgtccaatcatcggagtccaagatcttttagaagaattgaaactcaatgaagagggagattatgttatcacctttaacggcggtctagttcaagacacagccacaggagatgacatcatcaaagaaaccttaacctatgaagactatctggatttcgaactgttagcgcgtaaattaggcgtccacatgcacgccattacaaaagaaggaatttacacagcaaatcgtgatattggtaaatatacaatacacgaagtaactttagttaatatgccgctcttctatcgtactcctgaagaaatgggagacaaagaaatcattaaactaatgatgattgatcaacctgacatcttagatgcagcaattgctaaaattccaaaaaaagttctcgataactacactattgtaaaatcaactcctttttatttagaaattttacccaaaaacgttaataaaggcactgcacttctccaccttgcagagaaaatgggattaactgtagatcaaacaatggctattggtgatgaagaaaatgaccgtgctatgcttgaagttgttggaaatcctgttgttatgcaaaacggcaatcctgaactaaaaaaaatagcaaaatatatcaccaaatcaaacgaggaaagtggcgtagcctacgcactacgtgaatgggtaataaac

SEQ ID NO: 9628 - protein, 270 aa, Streptococcus agalactiae
MTSIKLVAVDIDGTLLNSKREITPEVAKAVQEAKSKGVKIVIATGRPIIGVQDLLEELKLNEEGDYVITFNGGLVQDTATGDDIIKETLTYEDYLDFELLARKLGVHMHAITKEGIYTANRDIGKYTIHEVTLVNMPLFYRTPEEMGDKEIIKLMMIDQPDILDAAIAKIPKKVLDNYTIVKSTPFYLEILPKNVNKGTALLHLAEKMGLTVDQTMAIGDEENDRAMLEVVGNPVVMQNGNPELKKIAKYITKSNEESGVAYALREWVIN

SEQ ID NO: 9629 - DNA, 927 bp, Streptococcus agalactiae
atggttatcatgattaatttctttagacatttctgggaatcgcttaaaaacttgaaacgtaacttttggatgacttttgcttctgtaacatcagttaccataaccttacttcttgtaggcttgttttcatcagttttactgaatgttgaaaagttaacaactgatgtttcaggtaattttactatcagtgcctttttaaatgttgactcaacggatgctcaaaaacaagtcaaagataaggacggaaagctaaaagataatcctgattatcataaagtttacgacaaaattaaacgtatttctggtgtagagaaagtcacttattcaagtaaagctgaacaattaaaagaagttcaaaaagagtatggttcagatgttattgatgatacctataaagatgctttgttagatgtttacgtagttgggacaagttctgcaaaagtttctaagagtgtcagtgaagcaattggacgcattgaaggtgttgattatactaaagaacctattgattcaacaaaactatctaatctcacagataacatccgtatatggggatttggtggtgttgccttattaattgtccttgctatctttttgatttcaaatactattcgtatgtcgattatgtcacgccgtacagatattgaaatcatgagattagttggcgctaaaaattcttatattcgaggaccgttcttttttgaaggtgcttgggtagggattttaggggctatcgttccatcgctgattttctattttggttatcaatttgtgtttaacaagtttaatccaaaatttgagacaagccatgtttcattgtatcctatggatattatggttccagcaattattggtggtatggtgattattggtattattattggctcacttgggtctgtcctatcaatgagacgttaccttaagatt

SEQ ID NO: 9630 - protein, 309 aa, Streptococcus agalactiae
MVIMINFFRHFWESLKNLKRNFWMTFASVTSVTITLLLVGLFSSVLLNVEKLTTDVSGNFTISAFLNVDSTDAQKQVKDKDGKLKDNPDYHKVYDKIKRISGVEKVTYSSKAEQLKEVQKEYGSDVIDDTYKDALLDVYVVGTSSAKVSKSVSEAIGRIEGVDYTKEPIDSTKLSNLTDNIRIWGFGGVALLIVLAIFLISNTIRMSIMSRRTDIEIMRLVGAKNSYIRGPFFFEGAWVGILGAIVPSLIFYFGYQFVFNKFNPKFETSHVSLYPMDIMVPAIIGGMVIIGIIIGSLGSVLSMRRYLKI

SEQ ID NO: 9631 - DNA, 762 bp, Streptococcus agalactiae
atgtcaaaagttgctattgttactggtgctggtcaaggaattggatttgctattgcgaaacgtcttcatgcagacggctttaaaataggcgttttagactataatgaagagactgctcaggctgcggttgataaactatcacctgaggatgctgttgcagttgtagcagatgtttcaaaacgtgatcaagtttttgatgctttccaaaaagttgtagatacttttggtgatttgaatgttgttgttaacaatgcaggtgttgccccaacaactcctcttgacactattactgaagagcagtttgaaaaggcttttgcaatcaatgtcggaggaactatttggggaagccaagcagctcagaaacattttagagaattaggtcatggcggaaaaattataaatgcaacttcacaagcaggatgtgaagggaatcctaatttgactgtttatggtggtacaaaatttgcagttcgtggtattacacagactttggcaaaagatttagcatcagaaggaatcacagtcaatgcttacgcaccaggtattgttaaaacacctatgatgtttgatattgcccatgaagttggtaagaatgcaggcaaagatgatgaatggggtatggagcagtttgccaaagatatcactttgaaacgcttgtctgaaccagaagatgttgctaatgcagtaggcttcttagcgggagatgattcaaattatatcactggacaaacaatagttgtcgatgggggtatggtattccat

SEQ ID NO: 9632 - protein, 254 aa, Streptococcus agalactiae
MSKVAIVTGAGQGIGFAIAKRLHADGFKIGVLDYNEETAQAAVDKLSPEDAVAVVADVSKRDQVFDAFQKVVDTFGDLNVVVNNAGVAPTTPLDTITEEQFEKAFAINVGGTIWGSQAAQKHFRELGHGGKIINATSQAGCEGNPNLTVYGGTKFAVRGITQTLAKDLASEGITVNAYAPGIVKTPMMFDIAHEVGKNAGKDDEWGMEQFAKDITLKRLSEPEDVANAVGFLAGDDSNYITGQTIVVDGGMVFH

SEQ ID NO: 9633 - DNA, 1191 bp, Streptococcus agalactiae
atgacctatttgtcagaacgtgtactcaatatggaagagagtgttactttagctgcgggagctaaagcaagagaactcagagtacaaggaagagatattcttagtttaactttaggggagcctgactttgctactcctaaaaacattcagcaagcggctattgaggctataacagatggacgtgcaagtttttacacaccatcaagtggtttgccggagttgaagtcagcaattaatgcgtattttgaacgtttttatggctactcccttaaacctaatcaggtggttgtgggaactggtgctaagtttatcctttatactttctttatgacagtactgaatcccggtgatgaagtaattattccgactccttattgggtatcttatgctgatcagattaagatggctgaaggtaagccagtttttgtcacagcaaaagaagttaatcacttcaaagtaactgtggaacagttagaagctgttaggactgataagacaaaagtcatacttcttaatagtccatcaaatcctacaggtatgatttataaagctgaggagttggaggctattggaaattgggcagtcgaacatgatatcctaattttagcagatgatatttacggtcgattggtttacaatggcaatatttttacccctatttcaagcctttcagagtctattcgaaaccaaacgatagtcataaatggagtttctaagacttatgcgatgacaggttggcgtgttggttttgcagtgggtaatcatgatattatagcggcaatgtctaaagtagtcagtcaaacaacttctaaccttacggctgtctcacagtatgctactattgaggctttaaatggttctcaagagtcatttgaaaaaatgaggctagcatttgaagaacgccttaatatcatttatccattgttgtgtcaggtccctgggtttgaggttgttaaaccacaaggtgctttttatcttttcccaaatgttacaaaagcaatggaaatgaaaggatatacggatgttacagcattcacggatgccattcttgaagaagttggacttgctttagtaacgggtgctggttttggagcgccggaaaatgttcgtctgagttatgctacagatcttgaaacccttaaagaagctgttcgtagactgcatgtctttatgggaagtaatgaaattaat

SEQ ID NO: 9634 - protein, 397 aa, Streptococcus agalactiae
MTYLSERVLNMEESVTLAAGAKARELRVQGRDILSLTLGEPDFATPKNIQQAAIEAITDGRASFYTPSSGLPELKSAINAYFERFYGYSLKPNQVVVGTGAKFILYTFFMTVLNPGDEVIIPTPYWVSYADQIKMAEGKPVFVTAKEVNHFKVTVEQLEAVRTDKTKVILLNSPSNPTGMIYKAEELEAIGNWAVEHDILILADDIYGRLVYNGNIFTPISSLSESIRNQTIVINGVSKTYAMTGWRVGFAVGNHDIIAAMSKVVSQTTSNLTAVSQYATIEALNGSQESFEKMRLAFEERLNIIYPLLCQVPGFEVVKPQGAFYLFPNVTKAMEMKGYTDVTAFTDAILEEVGLALVTGAGFGAPENVRLSYATDLETLKEAVRRLHVFMGSNEIN

SEQ ID NO: 9635 - DNA, 711 bp, Streptococcus agalactiae
atggtagttgacatgcgtagtcgtcttttctttagagaaattaactctattttggatagccttgaaattaatgataatattaactttaagattctatttttagatgctactgacaccgagctagtgtcacgatataaagagacacgtcgtagccaccctcttgctgccgacggcagagtgttagatggtatttctctagagagagaactattagcaccgcttaaaagtatgagtcagaacgttgtggacactagtgaattaacaccaagacaactacgtaaggtcatttctaaagaattctcaaatcaagatagtcaaagttcttttcgtatcgaagttatgagttttggttttaaatatggtatacctttggatgcggatttagtattcgatgtgcgttttttaccaaatccatactataaaccagaattaagagataagacaggtttagatactgaggtttatgactatgtcatgagttttgatgaatcagatgatttttatgaccatcttcttgccttaataaagccaatcttaccaggctatcaaaatgaagggaaatctgttttgactgtggcaatcggatgtacaggtgggcaacatcgtagcaccgcttttgctcatagattatcagaagatttaaaagcagattggacagttaatgaaagccatcgtgataaaaataagcgtaaggagacggtaaatcgttca

SEQ ID NO: 9636 - protein, 237 aa, Streptococcus agalactiae
MVVDMRSRLFFREINSILDSLEINDNINFKILFLDATDTELVSRYKETRRSHPLAADGRVLDGISLERELLAPLKSMSQNVVDTSELTPRQLRKVISKEFSNQDSQSSFRIEVMSFGFKYGIPLDADLVFDVRFLPNPYYKPELRDKTGLDTEVYDYVMSFDESDDFYDHLLALIKPILPGYQNEGKSVLTVAIGCTGGQHRSTAFAHRLSEDLKADWTVNESHRDKNKRKETVNRS

SEQ ID NO: 9637 - DNA, 258 bp, Streptococcus agalactiae
atgaaaaaagacatccatccagattatcgtccagttgttttcttagatacaactacaggttacaaattccttagtggttcaactaaatcaactaaagaaacagtagaattcgaaggtgaaacttacccacttattcgtgtggaaatctcatcagattcacatccattctatacaggacgtcaaaaattcactcaagcagatggacgtgtggaccgtttcaacaaaaaatatggtctcaaagacgcaaacgctgctcaa

SEQ ID NO: 9638 - protein, 86 aa, Streptococcus agalactiae
MKKDIHPDYRPVVFLDTTTGYKFLSGSTKSTKETVEFEGETYPLIRVEISSDSHPFYTGRQKFTQADGRVDRFNKKYGLKDANAAQ

SEQ ID NO: 9639 - DNA, 441 bp, Streptococcus agalactiae
atggctttagcaaagattgtttatgctagcatgaccggaaatactgaagaaattgctgacattgttgctgataaattacgtgacttgggtctagatgttgaagtagaagagtgtacgatggttgatgctgcagattttgaagatgctgacattgcaattgttgccacttatacatatggtgatggagatttaccagatgaaatcgtggacttttatgaagatttagcagaggttgatttatctggtaaagtttacggcgtagtgggttcaggtgatactttctatgattacttctgcaaatctgttgatgagttcgaggctcaattcgcattaacaggagcacaaaaaggtgctgattgtgttaaagttgatttagcggcagaagacgaagacattgaaaacttagaagcttttgctgaagaaattgcttctaaacttaac

SEQ ID NO: 9640 - protein, 147 aa, Streptococcus agalactiae
MALAKIVYASMTGNTEEIADIVADKLRDLGLDVEVEECTMVDAADFEDADIAIVATYTYGDGDLPDEIVDFYEDLAEVDLSGKVYGVVGSGDTFYDYFCKSVDEFEAQFALTGAQKGADCVKVDLAAEDEDIENLEAFAEEIASKLN

SEQ ID NO: 9641 - DNA, 345 bp, Streptococcus agalactiae
atgaatccattaattcaaagtttgacagaaggtcaacttcgttctgatatccctgagttccgtgctggtgatactgtacgtgttcacgctaaagttgtcgaaggtactcgcgaacgtattcagatctttgaaggtgttgttatctcacgtaaaggtcaaggaatctcagaaatgtacacagtacgtaaaatttctggtggtatcggtgtagagcgtacattcccaattcacactcctcgtgttgataaaatcgaagttgttcgttatggtaaagtacgtcgtgctaaactttactacttacgcgcattgcaaggtaaagctgcacgtattaaagaaatccgtcgt

SEQ ID NO: 9642 - protein, 115 aa, Streptococcus agalactiae
MNPLIQSLTEGQLRSDIPEFRAGDTVRVHAKVVEGTRERIQIFEGVVISRKGQGISEMYTVRKISGGIGVERTFPIHTPRVDKIEVVRYGKVRRAKLYYLRALQGKAARIKEIRR

SEQ ID NO: 9643 - DNA, 795 bp, Streptococcus agalactiae
atgcatctaggaaaatatataaaaaagtatcgagataccaataatctgagcatggctgaattcgctaaagaatcaggcatcagcaaagcttacgtttctattcttgaaaaaaacagagatcctcgtaacggaaaagaaatcatcccatctattccgattataaagaaagtttctgacacaattggcatctcttttgatgatttattaaattcgctagacgaaaatcagatagtcgcgttaaatgaaacgaaaactgaaaaaaatctaacttcctctaccctacaaaaaatcacttctacttcttctcaattagaacaacctagacaagaaaaagtccttagcttcgctaacgaacaattagaagaacaaaataaagttgtttctatgttcgatagaaaagttgaggagacagaaaattatatcactgactacgttgaggggttagttgctgctggtctgggggcataccaagaagacaatttacatatggaagttaaactacgggctgatgatgtccccgataagtatgatactattgcgaaagtagctggtaattcaatggaaccacttattcaagataacgatttactgttcgtcaaggtatctagtcaagtcgatatgaatgatatagggatattccaagtcaatggaaaaaactttgtaaaaaaactcaaacgtgattatgacggcgcttggtacttgcaaagtttaaataaaagctatgaggaaatctatctttcagagaacgacaacatccgcacgataggagaagtcgtagatatttacagggagaat

SEQ ID NO: 9644 - protein, 265 aa, Streptococcus agalactiae
MHLGKYIKKYRDTNNLSMAEFAKESGISKAYVSILEKNRDPRNGKEIIPSIPIIKKVSDTIGISFDDLLNSLDENQIVALNETKTEKNLTSSTLQKITSTSSQLEQPRQEKVLSFANEQLEEQNKVVSMFDRKVEETENYITDYVEGLVAAGLGAYQEDNLHMEVKLRADDVPDKYDTIAKVAGNSMEPLIQDNDLLFVKVSSQVDMNDIGIFQVNGKNFVKKLKRDYDGAWYLQSLNKSYEEIYLSENDNIRTIGEVVDIYREN

SEQ ID NO: 9645 - DNA, 747 bp, Streptococcus agalactiae
atgaatcaactaataaacatcaccctaaacgaaaatcaagaaccagttgtcagtggtagagatttacacaatgtacttaatataaaaactcaatatactaaatggcttgaaaggatgtcggaatatggttttgaagaaaacgttgactatatagctattagtcaaaaaagactaacagctcaaggtaaccgtacagaatatatagaccacgttctcaagctagacatggcaaaagagattgctatgttacagcgaaacgagaaatcaaaacaggtacgcaaatacttcatccaggttgaaaaagacttcaatagtcctgagaaaatcatggcgagagccttgctcatggcagataagaaaatcactaacttaacgatggaaaataatcaattgcagttagatttaaaagaagctcaaaagcaagcgcgttatcttgatctaatcattgagagcaagggagctttgcgagtaacacagattgctgctgattatggtatgtctgtcaataaattcaataaaacactattagaatttggtgtgcagcacaaagtgaatggacaatggattctctataaacgacatatgggcaaaggttacacagacagtcacacatttgactatcaagacaaaaacggccatacaagagccaatgtgacgacgacgtggacacaaaaggggcgtctattcctgtacgagttgttgaaagacaacaatattttgccactaattgaacaggaagacattgta

SEQ ID NO: 9646 - protein, 249 aa, Streptococcus agalactiae
MNQLINITLNENQEPVVSGRDLHNVLNIKTQYTKWLERMSEYGFEENVDYIAISQKRLTAQGNRTEYIDHVLKLDMAKEIAMLQRNEKSKQVRKYFIQVEKDFNSPEKIMARALLMADKKITNLTMENNQLQLDLKEAQKQARYLDLIIESKGALRVTQIAADYGMSVNKFNKTLLEFGVQHKVNGQWILYKRHMGKGYTDSHTFDYQDKNGHTRANVTTTWTQKGRLFLYELLKDNNILPLIEQEDIV

SEQ ID NO: 9647 - DNA, 222 bp, Streptococcus agalactiae
atggaaaatccaatgacaggagtagcaatactagcatttatcgctttacttgcatatctcggcaatcgtaatagcaatcaaaagacaattactaagactgttgagacggtgttagataactaccaagttgtgcgaaaggttgagagaccaaaacgcacggattttatagagttacctaccccaggatcatgcgggaaagtttggggcaaggatagacctttt

SEQ ID NO: 9648 - protein, 74 aa, Streptococcus agalactiae
MENPMTGVAILAFIALLAYLGNRNSNQKTITKTVETVLDNYQVVRKVERPKRTDFIELPTPGSCGKVWGKDRPF

SEQ ID NO: 9649 - DNA, 252 bp, Streptococcus agalactiae
atggttgaaatcagaattaacggtgagtcaatcacatttgatagcaattttagggatgcgcttatatttacggtagatcacctaaaaaattatgacgatccttctttgaggcagacttacaacgagtttaaagattatacagacgaggacttgatgggatatatcagcacagaatttgatgtagacccggaaatgtttgttgatactaattcagacagcagatggaaaattaaacaacgaattttagaggac

SEQ ID NO: 9650 - protein, 84 aa, Streptococcus agalactiae
MVEIRINGESITFDSNFRDALIFTVDHLKNYDDPSLRQTYNEFKDYTDEDLMGYISTEFDVDPEMFVDTNSDSRWKIKQRILED

SEQ ID NO: 9651 - DNA, 384 bp, Streptococcus agalactiae
atgaccaaggatgccgaacttcgttatacaccaagtaatcaagcggtagctactttttcacttgcagttaatcgtaattttaaaaatcaatctggcgaacgtgaggctgattttattaactgtgttatttggcgccaacaagctgaaaacttggctaactgggcaaaaaaaggtgctttggttggaattacaggtcgtatccaaacgcgtaattatgaaaaccaacaaggtcaacgtatctatgtaacagaagttgttgcggaaaatttccaattattagaaagtcgcaatagccaacaacagactaatcaaagcggcaatagttctaattcttattttggcaatgccaacaaaatggatatttcagatgatgacttaccattc

SEQ ID NO: 9652 - protein, 128 aa, Streptococcus agalactiae
MTKDAELRYTPSNQAVATFSLAVNRNFKNQSGEREADFINCVIWRQQAENLANWAKKGALVGITGRIQTRNYENQQGQRIYVTEVVAENFQLLESRNSQQQTNQSGNSSNSYFGNANKMDISDDDLPF

SEQ ID NO: 9653 - DNA, 474 bp, Streptococcus agalactiae
atgacttttaagacagaatttgaaataccaatcgaaccaaaacctcaaactagacctaagttcagcaaatttggtacgtacgaagatccaaagatgaagagatggcgaaaagaggtttctggatggatagaaaaaaattatgatggaccgtttttcgatgattgcataaaggtagaggtaaccttttacatgaaagcccccaaaacgctatcaaaagagcctacacaacgttctaaaggtaaaacaatacaaatatatcagaacttcgtgcgtgagcttatatggcacgctaagaagcctgatattgataatctgattaaagctgtttttgatagtatttccgatgcaggttacgacagaatacagaaatcaggtatcgtttggtcagatgacaatatcgtatgcgatttaagagcaaagaaaaaatacagtcagaatccaagaataaaagtgaggattgaagagattgacaga

SEQ ID NO: 9654 - protein, 158 aa, Streptococcus agalactiae
MTFKTEFEIPIEPKPQTRPKFSKFGTYEDPKMKRWRKEVSGWIEKNYDGPFFDDCIKVEVTFYMKAPKTLSKEPTQRSKGKTIQIYQNFVRELIWHAKKPDIDNLIKAVFDSISDAGYDRIQKSGIVWSDDNIVCDLRAKKKYSQNPRIKVRIEEIDR

SEQ ID NO: 9655 - DNA, 345 bp, Streptococcus agalactiae
ttgacagatgaattaataaatcaattttacaaaatttttgacaatgggattgtaaggcaaattaaaaagctagatgtagattgtaaaaaagccgagcaaataagatgtagcgttacaaataacagacgtcgaaaaaccctgccaagaccgtacgttatcgaagcgtttaaagattattttgacgaagatacctatgcacagatgtatatcaaatcatatcgtgagtatcacaacccaaatgaccacgagacggaactttttgtaaaactaaaaagagcgcacaaagatactaagttagagcattacaaggaagttaagcgattgatgtacgcagcaatgaccttt

SEQ ID NO: 9656 - protein, 115 aa, Streptococcus agalactiae
MTDELINQFYKIFDNGIVRQIKKLDVDCKKAEQIRCSVTNNRRRKTLPRPYVIEAFKDYFDEDTYAQMYIKSYREYHNPNDHETELFVKLKRAHKDTKLEHYKEVKRLMYAAMTF

SEQ ID NO: 9657 - DNA, 267 bp, Streptococcus agalactiae
atgactgaacaacagatgattgattgcttgctttatgagttagcaaaaaaagacaaattgaacattagacgaaacaatatcataacgtttttatcgattgtgctgatggctatatctattttaaacgtcgcactgcaagaccactacaagtcgcaaattacagaattacggacacagttaagcaggacacaaaagcagcttaaacgtgctagtgatgatagagctagacagacaaaacggattgctgagctgactggaaatggggga

SEQ ID NO: 9658 - protein, 89 aa, Streptococcus agalactiae
MTEQQMIDCLLYELAKKDKLNIRRNNIITFLSIVLMAISILNVALQDHYKSQITELRTQLSRTQKQLKRASDDRARQTKRIAELTGNGG

SEQ ID NO: 9659 - DNA, 462 bp, Streptococcus agalactiae
atgtcagaatttaaagttattgaaacacaagaagagttggacacgattgtgaaagctcgcattgctcgagaacgtgagaagtatcaagattacgaccaactgaaaactcgtgttgaagaactagaaaccgaaaacagcagcttacaaactgctttgaatgatgctaaatcaaacactgatagctatacagagaaaattaccactttggaaaatcaaatcgctggttatgaggcagcaaatttacggacaaaggtagcgttacagtatggcttaccaatcgatttagctaatcgtttgcaaggcgatgatgaagacgggctcaaggtggatgcagaacgcttagcatcttttatcaagccgtctcaaccacaaccgccaacaaagtcaaatgaaccgattattaccgaccaaaaagaagcaggttggattgaaatggcacgtaatttagttaacaaaggagaa

SEQ ID NO: 9660 - protein, 154 aa, Streptococcus agalactiae
MSEFKVIETQEELDTIVKARIAREREKYQDYDQLKTRVEELETENSSLQTALNDAKSNTDSYTEKITTLENQIAGYEAANLRTKVALQYGLPIDLANRLQGDDEDGLKVDAERLASFIKPSQPQPPTKSNEPIITDQKEAGWIEMARNLVNKGE

SEQ ID NO: 9661 - DNA, 327 bp, Streptococcus agalactiae
atgtttacaattaacacaaaattcccacaagttcttgaggataaaagtattatgggagtgactgcaattgtgtcagttgatttaccacacgtgaaaggtaacttaacttttgatttaccacctgagtctgaaaataaatcttttgcagaaacgcttgaaaagtgtgagcagatattttacgacgaaaagtataaagataaagctcagtctgaaaaaatgactgaactaagtacatcaacatcaacaggcacacaaacacttatcaatctgataagtacgctttacgcaaaagaggttttaaaagatgaagatcttattgctattggt

SEQ ID NO: 9662 - protein, 109 aa, Streptococcus agalactiae
MFTINTKFPQVLEDKSIMGVTAIVSVDLPHVKGNLTFDLPPESENKSFAETLEKCEQIFYDEKYKDKAQSEKMTELSTSTSTGTQTLINLISTLYAKEVLKDEDLIAIG

SEQ ID NO: 9663 - DNA, 969 bp, Streptococcus agalactiae
atgaaacaacctttagctttgacatgggaagatcaaattagactacttgaaaaacgtggattaattgttaaagctgatgatgtagagaaaatcaaacatatcagttattatagaattaaagaatttgcaaaaccacttgaaataaagcaacaagatggtgaggagcaggatattttatatgataatattgagtttgcagaagttttggcaagatattatcaggataaaaacttaagaatctatctactgcacgctattgaaaaaattgaagtgtctattaaaacaaaaatttcttttgttttgggggatagatatggggcgttcggatatttaaatttctcttcatgggctaataggaataagtttacaaaatatgatattgaaaaaagacaatttaggattaaaaagaatttattgaatactgtaagaaaatctcaactaactgagttacaaaaatcaattaaccttgatctagatggattcccaacagtgtggcttgctattgatttattgatgtttggtgacatcgtttcaatcttaacaatcatgagtgagaagaacattaaacagatttgtcaatattacagttgtacaccagaagaacttgtttcgtggcttaaatgtttgaatttcataagaaatgtatgtgctcataattcaaatgtactggatattcaaatcacaacaaagcctaaacttcgttcagaatggagaaattatattgatacagtaataattaaacataacgtgactaaaccttctaataagttatccgttattattgctattgtagtctatcttgtaaatactattaattccaaatatcaatggagaaatatacagtctagtttgaaggctctttgtaaagaagatgacagtagggcaaagcttttaggttttaaagattatgattctgttaaagcaatgattaatgggataaagtgtactacttttacaaattcaaaaaaa

SEQ ID NO: 9664 - protein, 323 aa, Streptococcus agalactiae
MKQPLALTWEDQIRLLEKRGLIVKADDVEKIKHISYYRIKEFAKPLEIKQQDGEEQDILYDNIEFAEVLARYYQDKNLRIYLLHAIEKIEVSIKTKISFVLGDRYGAFGYLNFSSWANRNKFTKYDIEKRQFRIKKNLLNTVRKSQLTELQKSINLDLDGFPTVWLAIDLLMFGDIVSILTIMSEKNIKQICQYYSCTPEELVSWLKCLNFIRNVCAHNSNVLDIQITTKPKLRSEWRNYIDTVIIKHNVTKPSNKLSVIIAIVVYLVNTINSKYQWRNIQSSLKALCKEDDSRAKLLGFKDYDSVKAMINGIKCTTFTNSKK

SEQ ID NO: 9665 - DNA, 651 bp, Streptococcus agalactiae
atgaaaatattaactgttgaagatgataagttgataagagagggaataagtgaatacctttcagaatttggatatactgttattcaggctaaagatggaagggaagccttgtcaaaatttaatagtgatataaacttggttatcttagacattcagataccttttataaatggtttagaagtgttgaaagaaattagaaagaaaagcaatttaccaattctaattttgactgcatttagtgatgaagaatataaaattgatgcatttactaatttagtagatggatatgtagaaaaaccattttcattgcctgttttaaaggctagaatagattctttaattaagaagaattttggacatttagagaagtttgaatataagaatctttcggtaaattttaatagttatacagctaaaataaatgatgaaaaaatagatgtaaatgcaaaagaactcgaaatactaaaatgtttattggataatgatggacaagttttaacaagaatgcaaattattgattatgtctggaaggatagcgaagagatcccttatgatcgagtagtagatgtatatataaaagaacttagaaaaaaattacaattagactgtataactactataagaaatgtaggatataaattggagagaaaa

SEQ ID NO: 9666 - protein, 217 aa, Streptococcus agalactiae
MKILTVEDDKLIREGISEYLSEFGYTVIQAKDGREALSKFNSDINLVILDIQIPFINGLEVLKEIRKKSNLPILILTAFSDEEYKIDAFTNLVDGYVEKPFSLPVLKARIDSLIKKNFGHLEKFEYKNLSVNFNSYTAKINDEKIDVNAKELEILKCLLDNDGQVLTRMQIIDYVWKDSEEIPYDRVVDVYIKELRKKLQLDCITTIRNVGYKLERK

SEQ ID NO: 9667 - DNA, 585 bp, Streptococcus agalactiae
atggctaccgttaagacaaaaacagctcttaaaaagactcaaaaaacgtatcctcaaaacttactcaaccagaaatttaatcctgataaacctaatcaagtatggtctactgacttcacctatatttctattggatataagaaatatgtctatctctgcgcaataattgatctctattctagaaaatatattgcttggaaattgagtcatcgtatggatgcaaagttagcatgtgacactctagaattagctcttaataaaagaaagattgaaggaacacttctctttcattccgaccaagggtcacaatttaaggccagggaatttagaaaaataattgatgacaacaatatcatgcattctttttctaaacctagatatccttatgataatgccgtaactgaagcatttttcaagtatttaaagcatagacaaatcaaccaaaaaaattatcaaaatatcaaacaggttcaattagactgctttgaatacattgagaatttttataacaattacatcccacatacggctaatctaggactaacccctaatcagaaagaagaaaattattttaacgcaataaaa

SEQ ID NO: 9668 - protein, 195 aa, Streptococcus agalactiae
MATVKTKTALKKTQKTYPQNLLNQKFNPDKPNQVWSTDFTYISIGYKKYVYLCAIIDLYSRKYIAWKLSHRMDAKLACDTLELALNKRKIEGTLLFHSDQGSQFKAREFRKIIDDNNIMHSFSKPRYPYDNAVTEAFFKYLKHRQINQKNYQNIKQVQLDCFEYIENFYNNYIPHTANLGLTPNQKEENYFNAIK

SEQ ID NO: 9669 - DNA, 1203 bp, Streptococcus agalactiae
atgtcacaaaaatcaaactattttaaagggcaaattgattatgctgttgtgataccagtattttttttattaatgattggtttagcctcaatttatgttgcaacgatgaatgattatccttctaatatctatatcgcgatgtttcagcaggtgtcttggattattatggggtgtattattgcatttgtcgttatgcttttcagtactgaatttttatggaaagccacgccctatctgtatgctttaggactaaccctaatggttcttcccttaattttttatagtccacagctttttgcggcaacaggtgctaaaaattgggtgaccattggctcggtaactttgtttcaaccgtcagagtttatgaagatttcctatattttaatgttatctcgaataactgttagttttcatcagaaaaatcgcaaaacttttcaagatgattggaagttgctaggattgtttggtttggttacattgccagtgatgattcttctaatgttacaaaaagatttaggaacagcattagttttccttgccattttgtcaggtttaatccttttatcgggcatatcttggtggataatcttgccaattttatctactatcgttctttttatagctagctttttgatgatttttatctcaccaaacggcaaggaatggttttataatttggggatggatacatatcaaatcaaccgtttatctgcttggattgatccatttagttttgcagactcaattgcttatcaacaaacacagggtatggtatcaattggaagtggcggggtaacaggtaaaggttttaatattttagagctctcggttcctgttcgtgaaagtgacatgatttttactgtcattgctgagaattttggcttcattggttcggcgattgttttagggttatatctcattatcatttaccgtatgttaaggatcaccattgaatctaataatcaattttatacttttatatcaactggttttatcatgatgattgttttccatgtttttgaaaatattggtgcagcagttggtatattacctctaacaggaatcccacttccgtttatttcgcaaggtggaagttcattactaagtaatcttattggaattggattggtcttatccatgtcttatcaaaatacagttcgtcaggccaaggctaatggatcacatttgaagtatcgtagtata

SEQ ID NO: 9670 - protein, 401 aa, Streptococcus agalactiae
MSQKSNYFKGQIDYAVVIPVFFLLMIGLASIYVATMNDYPSNIYIAMFQQVSWIIMGCIIAFVVMLFSTEFLWKATPYLYALGLTLMVLPLIFYSPQLFAATGAKNWVTIGSVTLFQPSEFMKISYILMLSRITVSFHQKNRKTFQDDWKLLGLFGLVTLPVMILLMLQKDLGTALVFLAILSGLILLSGISWWIILPILSTIVLFIASFLMIFISPNGKEWFYNLGMDTYQINRLSAWIDPFSFADSIAYQQTQGMVSIGSGGVTGKGFNILELSVPVRESDMIFTVIAENFGFIGSAIVLGLYLIIIYRMLRITIESNNQFYTFISTGFIMMIVFHVFENIGAAVGILPLTGIPLPFISQGGSSLLSNLIGIGLVLSMSYQNTVRQAKANGSHLKYRSI

SEQ ID NO: 9671 - DNA, 1860 bp, Streptococcus agalactiae
atgcgtccaggcatgtatatcggttcgacttcgaaagaagggcttcatcaccttgtatgggaaattgttgataactcaattgatgaagccttagctggatttgcaggacatattaaagtttacattgaaccagataactctattacagttgttgatgatggtcgcggtattccggtagatatccaagaaaaaactggaagaccagctgtagagacagtttttacagttctccatgccggtggtaaatttggtggtggcggatacaaggtttctggtggcttacatggtgtagggtcatctgttgttaatgcattgtcaacacaattagatgtcaaggtttataaaaatggcaaggttcattatcaagaataccaacgcggtgttgttgttaatgatcttgaaattatcggtgatactgacttatcaggaacaacagttcactttacgcctgacccagaaattttcactgaaaccactgtatttgattttgataaattagccaaacgtattcaggaattagcttttttaaatcgtggactaagaatctccatttcagacaagcgagaaggtcaagaagttgaaaaagaatatcactatgaaggtggtataggttcatacgttgagtttatcaatgagaacaaagaagtgatttttgaaaatcctatttatactgacggtgaattagatggtatttcagttgaagtagcaatgcagtatactactggatatcaagagactgttatgagttttgcaaataacatccacactcatgaaggaggaacgcacgaacaaggatttcgtactgccttgacacgtgtgattaatgattacgctaaaaagaataagattctcaaagaaaatgaagataatttaactggagaagatgttcgtgaaggtttaacagcagttatatctgttaaacatccaaatccacaatttgaaggacaaactaaaacaaaacttggaaattctgaagttgttaaaattacaaatcgtctctttagcgaagctttcaatcgattcctattagaaaatccacaagtagctaagaagattgttgaaaaaggaattttggcatctaaagcccgtattgcagcaaaacgggcgcgtgaagtaacacgtaaaaagtcaggcttagagatttcaaacttacctgggaaactggctgattgctcatctaataatgctgagatgaatgaactttttatagtggagggagattctgcgggagggtctgcaaaatcaggacgtaatcgtgagtttcaagcaattttaccgattaggggtaagattctaaacgttgaaaaagctacaatggataaaattttagcaaacgaagaaatccgaagtctcttcacagctatgggaactggatttggtgcagattttgatgtatcaaaagtcagatatcaaaaattagtcattatgactgatgccgatgttgatggagctcacatcagaactttacttttaactctgatttatcgttttatgcgacctgttttggaagcaggatatgtttatatcgctcaaccaccaatctatggtgtcaaagtaggaagtgagattaaagcttatattcagccaggggtcaatcaagaagaggaattacgtcaagctctagatacctatagttcaggacgttcaaaacctactgtacaacgttacaaaggtctaggtgagatggatgaccatcaactttgggaaacaacaatggatcctgaaaaccgcttgatggcacgtgtctcagttgatgatgcagcagaagcagataagattttcgatatgctaatgggagatcgagtagaaccacgacgtgaattcattgaagctaatgctgtttatagtaacttagatatc

SEQ ID NO: 9672 - protein, 620 aa, Streptococcus agalactiae
MRPGMYIGSTSKEGLHHLVWEIVDNSIDEALAGFAGHIKVYIEPDNSITVVDDGRGIPVDIQEKTGRPAVETVFTVLHAGGKFGGGGYKVSGGLHGVGSSVVNALSTQLDVKVYKNGKVHYQEYQRGVVVNDLEIIGDTDLSGTTVHFTPDPEIFTETTVFDFDKLAKRIQELAFLNRGLRISISDKREGQEVEKEYHYEGGIGSYVEFINENKEVIFENPIYTDGELDGISVEVAMQYTTGYQETVMSFANNIHTHEGGTHEQGFRTALTRVINDYAKKNKILKENEDNLTGEDVREGLTAVISVKHPNPQFEGQTKTKLGNSEVVKITNRLFSEAFNRFLLENPQVAKKIVEKGILASKARIAAKRAREVTRKKSGLEISNLPGKLADCSSNNAEMNELFIVEGDSAGGSAKSGRNREFQAILPIRGKILNVEKATMDKILANEEIRSLFTAMGTGFGADFDVSKVRYQKLVIMTDADVDGAHIRTLLLTLIYRFMRPVLEAGYVYIAQPPIYGVKVGSEIKAYIQPGVNQEEELRQALDTYSSGRSKPTVQRYKGLGEMDDHQLWETTMDPENRLMARVSVDDAAEADKIFDMLMGDRVEPRREFIEANAVYSNLDI

SEQ ID NO: 9673 - DNA, 1281 bp, Streptococcus agalactiae
atgaaattactgactaatgcaaatactctcaagggaaccatccgtgttcctggcgataaatcaataagtcacagggctattatttttgggagtatatctcagggagttacccgaattgttgatgtcttaagaggcgaggatgttttatcaactatagaggcttttaaacaaatgggggttctaattgaagacgatggcgagataatcactatctatggcaaaggatttgcaggtttaacacaaccgaataatctcttagacatgggaaactctggtacttcaatgcgtctgatagcaggtgtgttagctggtcaagagtttgaagtgacgatggttggagacaatagtttgtcaaagagacctatggatcgtatagcattgcctttaagcaaaatgggagctagaatttcgggagtaactaaccgtgatttaccaccattaaaacttcaaggtacaaaaaaattaaaacctattttttaccatttacccgtagcttctgcacaagtaaaatcagctttaatttttgcggctttacaaactaagggagaatctctcattgtagaaaaagagcaaacaaggaatcatactgaggacatgattcggcaatttggtggacatttggatattaaagataaagaaattcgactcaatggcggtcagagcttagtaggacaagatataagagttcctggtgatatttcgagtgctgccttttggatagtagcgggtcttattattcctaacagtcatattattttagaaaacgtaggtataaacgagacacgaactggaatccttgatgtcgtcagtaaaatgggtggaaaaattaagttatcttcggttgataatcaagtaaaatcagcaacccttacagttgattactctcatctacaagctactcatatttctggggctatgattccacgtctgattgatgaattacctattattgctcttttagcaacacaagctcaaggcaccacagtcatagcagatgctcaggaattaaaggtgaaagagacagatcggattcaggtcgttgtcgaatcgctaaaacagatgggtgctgatattactgctacagcagatggtatgattatacgtggtaatacccctcttcacgctgcttcacttgattgtcatggagatcatagaataggaatgatgatagctattgctgctctcttggtcaaagaaggcgaagtagatttatctggtgaagaagctattaatacaagctatcctaactttttagaacatttggagggattagttaatgcc

SEQ ID NO: 9674 - protein, 427 aa, Streptococcus agalactiae
MKLLTNANTLKGTIRVPGDKSISHRAIIFGSISQGVTRIVDVLRGEDVLSTIEAFKQMGVLIEDDGEIITIYGKGFAGLTQPNNLLDMGNSGTSMRLIAGVLAGQEFEVTMVGDNSLSKRPMDRIALPLSKMGARISGVTNRDLPPLKLQGTKKLKPIFYHLPVASAQVKSALIFAALQTKGESLIVEKEQTRNHTEDMIRQFGGHLDIKDKEIRLNGGQSLVGQDIRVPGDISSAAFWIVAGLIIPNSHIILENVGINETRTGILDVVSKMGGKIKLSSVDNQVKSATLTVDYSHLQATHISGAMIPRLIDELPIIALLATQAQGTTVIADAQELKVKETDRIQVVVESLKQMGADITATADGMIIRGNTPLHAASLDCHGDHRIGMMIAIAALLVKEGEVDLSGEEAINTSYPNFLEHLEGLVNA

SEQ ID NO: 9675 - DNA, 1353 bp, Streptococcus agalactiae
atgttacataaaaatgatattattgaaactgaaattagcgacattagccatgagggaatgggtattgccaaagtagatggctttgttttctttgttgaaaatgctcttccaggtgagattattaagatgcgcgtcttgaaattacgtaagcgtataggatatggaaaagttgaggaatatttaacgacttctcctcaccgaaatgaaggattagactatacctatttacgtacagggattgctgatttgggacatcttacttatgaacaacagctgttatttaaacaaaaacaagtagctgataacctttataaaattgctcatatatctgatgttttagtagaacctactcttggtatgacaatccctttggcatatcgaaataaagctcaggtaccagttcgtcgtgttgatggacagctagagacaggttttttcagaaaaaattcacatactctggtatccattgaagattatttaattcaggaaaaagagattgatgctctgattaattttacacgagatttattaagaaaatttgatgttaaaccatatgacgaagagcagcaatctggtttaattagaaatctcgttgttcgtcgaggacattatacagggcaattaatgttggttttggtgacaacacgtcctaaaatattccgcattgaccaaatgattgaaaagttggtgtctgcctttccttctgttgtttcaattatgcaaaatattaatgatcgtaatagcaacgttatttttgggaaagaatttcgtactctatatggttctgatactattgaggaccaaatgttaggaaatacttacgctatatcagcccaatctttttaccaagttaatactgaaatggctgaaaaactgtaccaaaaagcaatcgatttttcagatttaaactcagaggatatcgttattgatgcctattcaggtataggaacaattggcttatctgttgctaaacaagtaaaacatgtttatggtgttgaagttgttgaaaaagcagtaagtgatgccaaagaaaatgctactcgaaatgggataactaacagtacctatgttgctgattcggctgaaaatgcaatggcaaagtggcttaaagaaggtataaaaccaactgttataatggttgatccaccacgaaaaggattaacggagagttttgtatattctgctgcccaaacaaaagcagataaaatcacttatatttcttgtaattcagcgacaatggcgcgtgatatcaaactatttgaagaattagggtatcatttagtaaaaattcaaccagtagacttattcccaatgacacatcatgtggagtgtgtggctctgctcgtaaaagcc

SEQ ID NO: 9676 - protein, 451 aa, Streptococcus agalactiae
MLHKNDIIETEISDISHEGMGIAKVDGFVFFVENALPGEIIKMRVLKLRKRIGYGKVEEYLTTSPHRNEGLDYTYLRTGIADLGHLTYEQQLLFKQKQVADNLYKIAHISDVLVEPTLGMTIPLAYRNKAQVPVRRVDGQLETGFFRKNSHTLVSIEDYLIQEKEIDALINFTRDLLRKFDVKPYDEEQQSGLIRNLVVRRGHYTGQLMLVLVTTRPKIFRIDQMIEKLVSAFPSVVSIMQNINDRNSNVIFGKEFRTLYGSDTIEDQMLGNTYAISAQSFYQVNTEMAEKLYQKAIDFSDLNSEDIVIDAYSGIGTIGLSVAKQVKHVYGVEVVEKAVSDAKENATRNGITNSTYVADSAENAMAKWLKEGIKPTVIMVDPPRKGLTESFVYSAAQTKADKITYISCNSATMARDIKLFEELGYHLVKIQPVDLFPMTHHVECVALLVKA

SEQ ID NO: 9677 - DNA, 747 bp, Streptococcus agalactiae
ttggataatcaaatttataaaaaacaaatacttgagatttataccaaagcaaacaaaagacttggtgtgaagtctatcaaagtcattcttcaaagagactacgacacaaaaatctctgaaggaagaatttaccatctgatgaagaatatggcgctccctaaaatggctaccgttaagacaaaaacagctcttaaaaagactcaaaaaacgtatcctcaaaacttactcaaccagaaattttatcctgacaaacctaatcaagtatggtctactgacttcacctatatttctattggatataagaaatatgtctatctctgcgcaatacttgatctctattctagaaaatgtattgcttggaaattgagtcaccgtatggatgcaaagttagcatgtaacactctagaattagctcttaataaaagaaagattgaaggaacacttctctttcattccgaccaagggtcacaatttaaggccagggaatttagaaaaataattgatgacaacaatatcatgcattctttttctaaacctggatatccttatgataatgccgtaactgaagcatttttcaagtatttaaagcatagacaaatcaaccgaaaacattatcaaaatatcaaacaggttcaattagactgctttgaatacattgagaatttttataacaattacatcccacatacggctaatctaggactaacccctaatcagaaagaagaaaattattttaacgcaataaaa

SEQ ID NO: 9678 - protein, 249 aa, Streptococcus agalactiae
MDNQIYKKQILEIYTKANKRLGVKSIKVILQRDYDTKISEGRIYHLMKNMALPKMATVKTKTALKKTQKTYPQNLLNQKFYPDKPNQVWSTDFTYISIGYKKYVYLCAILDLYSRKCIAWKLSHRMDAKLACNTLELALNKRKIEGTLLFHSDQGSQFKAREFRKIIDDNNIMHSFSKPGYPYDNAVTEAFFKYLKHRQINRKHYQNIKQVQLDCFEYIENFYNNYIPHTANLGLTPNQKEENYFNAIK

SEQ ID NO: 9679 - DNA, 1206 bp, Streptococcus agalactiae
atggttacattcgattttaaacatgttcaaacattgcataccatatctcaactacctatttcagtcatgtcacgagacaaggaactcgttcagttatatggtaacgaagactatctgttgccttactatcagtttttaaaacatttagctatcccttataaccaagatatcactgtttatgagggtctttttgaagaatcattcttaatttttcctgtctgtcaatatcttattgctattggaccattttatccctatagccctgatatcaataggcaagaacagttatccagtcgctttctagaacaattttctcatcgtaataaaaaagaaatcttatcctatataaagcttgtcccttgttttcctactaccagtatacgtagtcttcttgtgtctatcgatgcctttttccaaacacagtttgaggctagttgccaacaagtcatcaatcatttattagaagagtcagaacagattgttgcggatcctgatattgttcttcacctaaaacatactaagaaaaactcttttcagttacccactgttttaaaccatctcaatcacattattgatctcgttaagctgggtaacactcaactgttaaagcaagaaattaatcgcctcccatcatccagtgttacctcatcttcaatccctgccctaagagctgaaaagaacttaactgttgtttacttaacaaaattactagaattaagtttcgaggaaaatactgatgtggctaaaagttatgcgctggtaaagcactatatggctttaaacgaagaggctcctgatcttattgatgtttcaagaattcgctgtgcagctcttattgatttttcagaatccttaaccaataagagcatctctgacaagcagcaaatgtacaatagtattctccattatgtggacaaccacctctactccaaactcaaagtatctgatattgccaactacctatatatctcagattcccacttacgctcagtttttaaaaaatactctgacatttccttgcaaagttatattctaaaggcaaaaattaaggagggacaattactactgcaaagaggggtaccgattggggaagtagcgaaattattacatttttacgacaccacacattttcttaaaacctttaaaaaatacgtgggaatatcttcaaacgaatatcttactaaatatcgtgagacctcatgccag

SEQ ID NO: 9680 - protein, 402 aa, Streptococcus agalactiae
MVTFDFKHVQTLHTISQLPISVMSRDKELVQLYGNEDYLLPYYQFLKHLAIPYNQDITVYEGLFEESFLIFPVCQYLIAIGPFYPYSPDINRQEQLSSRFLEQFSHRNKKEILSYIKLVPCFPTTSIRSLLVSIDAFFQTQFEASCQQVINHLLEESEQIVADPDIVLHLKHTKKNSFQLPTVLNHLNHIIDLVKLGNTQLLKQEINRLPSSSVTSSSIPALRAEKNLTVVYLTKLLELSFEENTDVAKSYALVKHYMALNEEAPDLIDVSRIRCAALIDFSESLTNKSISDKQQMYNSILHYVDNHLYSKLKVSDIANYLYISDSHLRSVFKKYSDISLQSYILKAKIKEGQLLLQRGVPIGEVAKLLHFYDTTHFLKTFKKYVGISSNEYLTKYRETSCQ

SEQ ID NO: 9681 - DNA, 990 bp, Streptococcus agalactiae
atgtcaatgattgaagtttctcaccttcagaaaaattttataaaaaccgttaaagcaccagggttaaaaggagcatttcaatcatttcttcgtcctgaaaaacacacctttgaagctgttaaagatttaacatttgatgtgcctaaaggacaaattctgggatttattggagcgaacggtgcaggaaaatctacaacaattaaaatgttaactgggattttaaaaccaacttcgggcttttgccgtattgatggcaaattgccacaagaaaaccgacaaaattatgttaaggatattggagtcgtttttgggcaacgtacgcagttatggtgggatttagctctacaagaaacctatacagtgttaaaagaaatctatgacgttcctgataaagaatttcgcaaacgcatggcttttttaaatgaggttttggaactaaatgactttataaaggatcctgttagaactttgtctctcggacagcgtatgagagcggatatcgcagcttctttattacataacccaaaggttcttttcttagatgaacccaccattggcttggacgtttcagtgaaagataatatccgacgtgcaatcacacaaattaatcaagaagaagagacaacgattttactaacgacacatgacctcagtgatattgaacaactttgtcatcgtatttttatgattgatagaggacaagaaatatttgatggcacagtttctcagctaaaagagacatttggaaagatgaaaactctttcttttgatttgcgcccaggacaagagcatatcagctctagtttaattggaaagtcggagattaatattaaacgtaatgacttagttttagatattcagtatgatagttctcgctaccaaactgctgacataattcagcagacattagcagatttttctgtacgtgaccttaaaatgacagatgcggatattgaagatatcattcgtcgcttctatagaaatgagcta

SEQ ID NO: 9682 - protein, 330 aa, Streptococcus agalactiae
MSMIEVSHLQKNFIKTVKAPGLKGAFQSFLRPEKHTFEAVKDLTFDVPKGQILGFIGANGAGKSTTIKMLTGILKPTSGFCRIDGKLPQENRQNYVKDIGVVFGQRTQLWWDLALQETYTVLKEIYDVPDKEFRKRMAFLNEVLELNDFIKDPVRTLSLGQRMRADIAASLLHNPKVLFLDEPTIGLDVSVKDNIRRAITQINQEEETTILLTTHDLSDIEQLCHRIFMIDRGQEIFDGTVSQLKETFGKMKTLSFDLRPGQEHISSSLIGKSEINIKRNDLVLDIQYDSSRYQTADIIQQTLADFSVRDLKMTDADIEDIIRRFYRNEL

SEQ ID NO: 9683 - DNA, 957 bp, Streptococcus agalactiae
ttgcctcaggaaggatgttggtatcagaaaatggaaattaaactcaaaaatattggaaaaaaatatggttcttttgaagcattgagagacattaatctcatctttgaagagggaaaattttatggccttcttggacctaatggagctggtaaaacaactttatttaaccttttaattcaaaattttaagcaaacgtcaggcgatattaagtgggaggtggatggaaaacctctatctattaaagatttttatcgtcacattggtattgtcttccaaagtaatcgcttagatgataatttaacggttgaggaaaatctaatttctagaggtgctttgtacggtttatctaaatcacaagtacgtaatcgccttaaagatcttcaaacgtatctagatatcacagcaataaaaaaacaaaaatatggcagtttatcaggaggtcaaaaacgaaaagttgatattgcacgcgccttgctgccacaaccttctctattattattagatgaaccaacgactggtttagaccctcaatctcgtcgcgatttatgggatgctatcgcacaactaaatcaacaatcgcagatgacagttgtactaattactcattatcttgaagaaatgtctgcttgtgatgttttaaatgttcttattgaaggaaacatttattattcgggagatattaaaagctttattgagcaacattccacaacaaacttgaatgtggtattgaaaccagaaaagtcattagaccaactttcgatagctgattttgttaataaatgtcaagtcctttcagaaagggagatagtatttaaggatatttctgttgaggaaatgatgcaggttatctcagacaatcaagataaatctattattgagacatttaatgttgaatattcgaacttagaggcggcgtatctcaacttgcttagagaaaaagaaaggaaaaacaatgtt

SEQ ID NO: 9684 - protein, 319 aa, Streptococcus agalactiae
MPQEGCWYQKMEIKLKNIGKKYGSFEALRDINLIFEEGKFYGLLGPNGAGKTTLFNLLIQNFKQTSGDIKWEVDGKPLSIKDFYRHIGIVFQSNRLDDNLTVEENLISRGALYGLSKSQVRNRLKDLQTYLDITAIKKQKYGSLSGGQKRKVDIARALLPQPSLLLLDEPTTGLDPQSRRDLWDAIAQLNQQSQMTVVLITHYLEEMSACDVLNVLIEGNIYYSGDIKSFIEQHSTTNLNVVLKPEKSLDQLSIADFVNKCQVLSEREIVFKDISVEEMMQVISDNQDKSIIETFNVEYSNLEAAYLNLLREKERKNNV

SEQ ID NO: 9685 - DNA, 696 bp, Streptococcus agalactiae
atggttaattattggctcattgcaggtttgacgactattatttcaatgactagtacattaggtgcctttggagttatggtgtccgacaaagaaaaaaaattaaatgaagattttaaggtcagtcctatatcaaatatcaaaattgaattgtcctatgctatatttgccgttttatttggtattgtcatgacgatgttctcttgcatctttgctatcggtatttttaacggctttaattccttgctagagtattcagctatggattatttaactattttagggatcgtttccttagggactgttttatctgcggcgatgattttacctattttagcctttattcatactagttcagcttttacgactcttagcacaattgtagggacttttattggttttatttcaggagtatatctctcaattggctcggtaggaaaagcattacaacaggttatgacatggtttccattgactcaaatcaattctcttttgaaacaggtcttaatgaagggttctattgcgaaggtatttgacaaagccaacgaagccactgtctctaactataaagaatcatatggtgttgttttgcgtaatgctgatggagaaaggctgagtaatcactttatgttgatttatatcattgccctcattcttattttattggcaattcattttattattaaaaaggttaaaaaa

SEQ ID NO: 9686 - protein, 232 aa, Streptococcus agalactiae
MVNYWLIAGLTTIISMTSTLGAFGVMVSDKEKKLNEDFKVSPISNIKIELSYAIFAVLFGIVMTMFSCIFAIGIFNGFNSLLEYSAMDYLTILGIVSLGTVLSAAMILPILAFIHTSSAFTTLSTIVGTFIGFISGVYLSIGSVGKALQQVMTWFPLTQINSLLKQVLMKGSIAKVFDKANEATVSNYKESYGVVLRNADGERLSNHFMLIYIIALILILLAIHFIIKKVKK

SEQ ID NO: 9687 - DNA, 2154 bp, Streptococcus agalactiae
ttgggaaagaattatagcgagcataaacagcatctcttcgacttaaaagaaggaatttctaaacatttatataaaaatcacgactctattttagaatcttatacaggaagcataactagtgacccagaggttcctgagcaatacaaagatgagacacgtaattttaaatttgcttttaccgcttttgaagaggctcttgcttcttcaggtgttaatttaaaagcttatcataatattgctgtgtgtttagggacctcacttgggggaaagagtgctggtcaaaatgccttgtatcaatttgaagaaggagagcgtcaagtagatgctagtttattagaaaaagcatctgtttaccatattgctgatgaattgatggcttatcatgatattgtgggagcttcgtatgttatttcaaccgcctgttctgcaagtaataatgccgtaatattaggaacacaattacttcaagatggcgattgtgatttagctatttgtggtggctgtgatgagttaagtgatatttctttagcaggcttcacatcactaggagctattaatacagaaatggcatgtcagccctattcttctggaaaaggaatcaatttgggtgagggcgctggttttgttgttcttgtcaaagatcagtccttagctaaatatggaaaaattatcggtggtcttattacttcagatggttatcatataacagcacctaagccaacaggtgaaggggcggcacagattgcaaagcagctagtgactcaagcaggtattgactacagtgagattgactatattaacggtcacggtacaggtactcaagctaatgataaaatggaaaaaaatatgtatggtaagtttttcccgacaacgacattgatcagcagtaccaaggggcaaacgggtcatactctaggggctgcaggtattatcgaattgattaattgtttagcggcaatagaggaacagactgtaccagcaactaaaaatgagattgggatagaaggttttccagaaaattttgtctatcatcaaaagagagaatacccaataagaaatgctttaaatttttcgtttgcttttggtggaaataatagtggtgtcttattgtcatctttagattcacctctagaaacattacctgctagagaaaatcttaaaatggctatcttatcatctgttgcttccatttctaagaatgaatcactttctataacctatgaaaaagttgctagtaatttcaacgactttgaagcattacgctttaaaggggctagaccacccaaaactgtcaacccagcacaatttaggaaaatggatgatttttccaaaatggttgccgtaacaacagctcaagcactaatagaaagcaatattaatctaaaaaaacaagatacttcaaaagtaggaattgtatttacaacactttctggaccagttgaggttgttgaaggtattgaaaagcaaatcacaacagaaggatatgcacatgtttctgcttcacgattcccgtttacagtaatgaatgcagcagctggtatgctttctatcatttttaaaataacaggtcctttatctgtcatttcgacaaatagtggagcgcttgatggtatacaatatgccaaggaaatgatgcgtaacgataatctagactatgtgattcttgtttctgctaatcagtggacagacatgagttttatgtggtggcaacaattaaactatgatagtcaaatgtttgtcggttctgattattgttcagcacaagtcctctctcgtcaagcattggataattctcctataatattaggtagtaaacaattaaaatatagccataaaacattcacagatgtgatgactatttttgatgctgcgcttcaaaatttattatcagacttaggactaaccataaaagatatcaaaggtttcgtttggaatgagcggaagaaggcagttagttcagattatgatttcttagcgaacttgtctgagtattataatatgccaaaccttgcttctggtcagtttggattttcatctaatggtgctggtgaagaactggactatactgttaatgaaagtatagaaaagggctattatttagtcctatcttattcgatcttcggtggtatctcttttgctattattgaaaaaagg

SEQ ID NO: 9688 - protein, 718 aa, Streptococcus agalactiae
MGKNYSEHKQHLFDLKEGISKHLYKNHDSILESYTGSITSDPEVPEQYKDETRNFKFAFTAFEEALASSGVNLKAYHNIAVCLGTSLGGKSAGQNALYQFEEGERQVDASLLEKASVYHIADELMAYHDIVGASYVISTACSASNNAVILGTQLLQDGDCDLAICGGCDELSDISLAGFTSLGAINTEMACQPYSSGKGINLGEGAGFVVLVKDQSLAKYGKIIGGLITSDGYHITAPKPTGEGAAQIAKQLVTQAGIDYSEIDYINGHGTGTQANDKMEKNMYGKFFPTTTLISSTKGQTGHTLGAAGIIELINCLAAIEEQTVPATKNEIGIEGFPENFVYHQKREYPIRNALNFSFAFGGNNSGVLLSSLDSPLETLPARENLKMAILSSVASISKNESLSITYEKVASNFNDFEALRFKGARPPKTVNPAQFRKMDDFSKMVAVTTAQALIESNINLKKQDTSKVGIVFTTLSGPVEVVEGIEKQITTEGYAHVSASRFPFTVMNAAAGMLSIIFKITGPLSVISTNSGALDGIQYAKEMMRNDNLDYVILVSANQWTDMSFMWWQQLNYDSQMFVGSDYCSAQVLSRQALDNSPIILGSKQLKYSHKTFTDVMTIFDAALQNLLSDLGLTIKDIKGFVWNERKKAVSSDYDFLANLSEYYNMPNLASGQFGFSSNGAGEELDYTVNESIEKGYYLVLSYSIFGGISFAIIEKR

SEQ ID NO: 9689 - DNA, 1209 bp, Streptococcus agalactiae
atgagtaaatttttatttgctcctttcatgatgaatttaggagagagccaaagattatcaaaactggctaattgtttatatgaacaaggacatgatattcatatccttggagacaattattatccatttttatttaataatgatgcttatcgctatcaccactgtgtagaagataaatctgtttataatagtaagcgatatgatgctttcttttctctttcaacagactttaattttttatcagaagaagaaattgaacgcatctgttctattgaaagagacttgttacgccaagaaaaatttgatgctgtattgacaggttaccgtctatctattgttacaagttgtcgtttagaaagcataccattaatttggattatttcaggggcaacgcatatcagtgaaattgttgaaaactcagaaggaatattgcctaatgggaagataagtaaagctagtaagcctcaaacaaaggattttatcaaaagagtaatcactacttattcaacaaatgttaaaacgtggaataactatattaaaaaatatggtggcaaaacttttaataatgctttagaattatttactggtgatctaaacttggtaacagattactctttgttttatgaatttgataaagattcgtcctataaaacgataggacctattttgatagataatgtaggtttttcaaaatgcagccaaattaatcaagacaataagactgtactgctcagctttggtacttcatttaaacgagattgggtggaatcttttttaaagacattaccaaggcattatcattatttactgacaagctgtggtgaggctataaacattccaggaagttatattgagatagttgattttattgattttaaaaccatagataaagagatttatttcgctattatacacggtgggcaaggaacagtttatgcgatggctgcacaaggtattccctttataggtatccctttctttaacgaacaattttggaatattaagaagttcagtaaagaaaagtgcgcttatttggtaaagaaacctgatgtaagagagatacgtaaagcaattagctgtcttgaaagagactatgatatctataaaagttatatgataagactaagccaaggaattaaagaagaagcagaggcatctttacaaaaagcggaggcagaaattgaatcctttatcagaaaaagacaaagt

SEQ ID NO: 9690 - protein, 403 aa, Streptococcus agalactiae
MSKFLFAPFMMNLGESQRLSKLANCLYEQGHDIHILGDNYYPFLFNNDAYRYHHCVEDKSVYNSKRYDAFFSLSTDFNFLSEEEIERICSIERDLLRQEKFDAVLTGYRLSIVTSCRLESIPLIWIISGATHISEIVENSEGILPNGKISKASKPQTKDFIKRVITTYSTNVKTWNNYIKKYGGKTFNNALELFTGDLNLVTDYSLFYEFDKDSSYKTIGPILIDNVGFSKCSQINQDNKTVLLSFGTSFKRDWVESFLKTLPRHYHYLLTSCGEAINIPGSYIEIVDFIDFKTIDKEIYFAIIHGGQGTVYAMAAQGIPFIGIPFFNEQFWNIKKFSKEKCAYLVKKPDVREIRKAISCLERDYDIYKSYMIRLSQGIKEEAEASLQKAEAEIESFIRKRQS

SEQ ID NO: 9691 - DNA, 1083 bp, Streptococcus agalactiae
atgcaaagaaaatcctatttaaaatccatgagtgttcttactttaacagcttgtcttatatcaggatatgtggttaaagatattgctatgttacatgcagtatctgccagtgagaagaaagcaaataatgtcagtccgagagaaaatctctacagggctgtcaatgataattggctagccaatacaaaactcaaacaagggcagactagtgttaatagtttttcagaaattgaggataaattaaagcaactgttagtgtctgatatggctaaaatggcctcaggaaagattgaaacaaccaatgatgaacagaaaaaaatggttgcatactataaacaaggtatggactttaaaacaagagataaaaatggtctcaaacctctaaaaccagttttacaaaaacttgaagcagtctcttcaatgaaagactttcaaagtttggcccatgattttgtgatgagtggttttgttttaccatttggtttgactgtggaaaccaatgctcgagataatagccaaaagcaattggtgcttcgtcaagcacccgcattacttgaatcacctgaccaatataagaagggcaataaagaaggtgaggctaaattatcagcttaccgtacttcagcaatggctttgcttaaacaagctggaaaaagtaacattgaagatagaaaactagttaaacaagctatagcatttgatagactcttatcagaaaaaacgcaagttgatcaaagtaaaatcacagctgaaagtgagacagctgcggggcgatataaccctgaaagtatggaaacggttcacaattacgccaaggaatttgactttaaagaattgattgaaaaactagttgggccaacgaataaggcagtcaatgtagaagataaaacttattttaaacaggttaatgatgttataaatagtaaacaattagccaatatgaaagcatggatgatgatttctatgctagttgatcaatcagattttctaggagaacaaaatcgtcaagcagcgagtgcttttaagaatgttgcgtctggtttgactcagattgaatcgaaagaaaaaatgcttacacccaat

SEQ ID NO: 9692 - protein, 361 aa, Streptococcus agalactiae; identical to SEQ ID NO: 8764

SEQ ID NO: 9693 - DNA, 858 bp, Streptococcus agalactiae
atgcatccccaaggcgctgttgatttgacaaaatataaggcaaaaccggtcaaagattatggtaaaaaaatcgatgttggtgatggcaagaaaatgaacatttatgaaactggtcagggaaaaattccaattgtttttattcctggtcaagctgagatttcgccacgctatgcttataagaatttaattgagcggttaagtaaaaaatataaaatttatacagtagaaccattaggctatggtctcagtgatattcctactaaaccacgtacgctagaaaacattacaaaagaaattcacacaggcctaaataaaattggagttaaaaatttctaccttgcagctcactcacttggcggtatgtattctttaaattatgctaaaaattatccagaagaagtcagaggatttattggtatggataccagtacaccttggatggaaggggaacaaaaaacaaagtatgaccctgaaagtgctaaatgggcaatgaaattaccagatgttgatgataagactaacgaacagtatctgtcaattgcgaaaaaaattaacggcaataagtctcaacgagatgaagatgagcgcttaggtgataatcttggtaaattgaagaatgtaaaattccctaaagggatgccaactaagtattttcttgctgatcaatctgtggagggaatcaagctacgtcaagcagattttaaaggtttgaaaaattgggatcagcagcatattgatttatctgaagatccaaaagatgcttccgttgaaatttttaaaggtagtcacaatattttccaaacacaatatgaacatatggctaaagctattgatggatttatccaatcccatcaaaag

SEQ ID NO: 9694 - protein, 286 aa, Streptococcus agalactiae
MHPQGAVDLTKYKAKPVKDYGKKIDVGDGKKMNIYETGQGKIPIVFIPGQAEISPRYAYKNLIERLSKKYKIYTVEPLGYGLSDIPTKPRTLENITKEIHTGLNKIGVKNFYLAAHSLGGMYSLNYAKNYPEEVRGFIGMDTSTPWMEGEQKTKYDPESAKWAMKLPDVDDKTNEQYLSIAKKINGNKSQRDEDERLGDNLGKLKNVKFPKGMPTKYFLADQSVEGIKLRQADFKGLKNWDQQHIDLSEDPKDASVEIFKGSHNIFQTQYEHMAKAIDGFIQSHQK

SEQ ID NO: 9695 - DNA, 1227 bp, Streptococcus agalactiae
gtgaacctatggacattaagtttagcttatttgaaacgtcaaaaaatgaaaacagtaaccttgttcttagtttttctaactataggcacatgtttaatcagtctgatgagtattcagcattctttggaaaaaaatatcctaacaaaacaagggaaaagcatttatttaacctccaaagaaaaggcttattggcctgaacaagcatacgaagctttgaaaaaagcaaaaatggttgagtcagtagaggcaagtttaagcattgatgttggtagccgtttaaaatctgtatcaccatataactcttctaaagaagagaatcaagttacattagcaggttatcaaagtacagaagatttacgagcttttcagacaaaagcattggtcttaaagaaaggaagccatttagcggccgataatacaaaacaagtactagttccattgaagttagcacaaaagaatcatttaagtgtgggtaacaaattgagattaggcaaagaaaatgttactattgcaggaatttatgatgcgaatagtgctaagtctaaaaatacttttaatcccaatattgataatacattgattgctcaggcaacattggttaggaagattagtaaacaaaaaggttatcagacggttgcagtgcgcttaagtgataaacgtttagtggatacagttatccaaaacatcaaacaatggccgcttgatttcgggaaattagatgttcaaacagctaaagagttttatggagattcttatcgtaatatcgagacattgcatcgtctagtgggacgaatcattcttattgttagtctcgtggcgatggcaatattagttgtcatgctaacattttggattaataaccgcattaaagagacgggaattttactcgctatcggaaaaactaagtttgaaatcataggtcattatctgatagaagtactgttagtagcaggtgctgccttcacactatctattattggtggtgtctttcttggaaaaacatttgcagctggccttttatcacaagttaatggtggtgtgagttcacaaattgtacaaaatagtagtctaattattgatagaattgataacctcgctgtttctgttggagtaatggatgtctttagactctatgctcagggtgctttaatttgcttatttgcagttgtattatctagttattctattcttaaactacaaccaaagcaaatattgtcacgaatgtca

SEQ ID NO: 9696 - protein, 409 aa, Streptococcus agalactiae
MNLWTLSLAYLKRQKMKTVTLFLVFLTIGTCLISLMSIQHSLEKNILTKQGKSIYLTSKEKAYWPEQAYEALKKAKMVESVEASLSIDVGSRLKSVSPYNSSKEENQVTLAGYQSTEDLRAFQTKALVLKKGSHLAADNTKQVLVPLKLAQKNHLSVGNKLRLGKENVTIAGIYDANSAKSKNTFNPNIDNTLIAQATLVRKISKQKGYQTVAVRLSDKRLVDTVIQNIKQWPLDFGKLDVQTAKEFYGDSYRNIETLHRLVGRIILIVSLVAMAILVVMLTFWINNRIKETGILLAIGKTKFEIIGHYLIEVLLVAGAAFTLSIIGGVFLGKTFAAGLLSQVNGGVSSQIVQNSSLIIDRIDNLAVSVGVMDVFRLYAQGALICLFAVVLSSYSILKLQPKQILSRMS

SEQ ID NO: 9697 - DNA, 579 bp, Streptococcus agalactiae
atgtcggatgttgtcgaaaaacaaacaactaaatcgtttataatgaacgtattaaatggtttagctttagggactgttattgtcttgataccaggagcaatccttggagaattaatgaaagctttactgccaatgtggagcggctttgcaactttaatcgctgcaacagcagttgcaacaagtatgatggggcttgttattggtattatggttggtctcaattttaaatttaatcccattcaatcagcatcactaggattagcggttatgtttgcaggtggagctgcaaccttccttaaaggcgctattatgctaaaaggaacaggcgatatcattaacatgggaattactgctgccttaggtgtccttttgatccaatttttatctgacaagacgaaatcattcactttgattgtcattccaacagtaacactcttactagttggaggagtaggtcatgtgttattaccttatgtcaaaatgattaccaccatgattggacaagggacacgccgtacgcatgaaaactttctcttcatccttttgtgcccggacatcaattttgaaaagattcctttt

SEQ ID NO: 9698 - protein, 193 aa, Streptococcus agalactiae
MSDVVEKQTTKSFIMNVLNGLALGTVIVLIPGAILGELMKALLPMWSGFATLIAATAVATSMMGLVIGIMVGLNFKFNPIQSASLGLAVMFAGGAATFLKGAIMLKGTGDIINMGITAALGVLLIQFLSDKTKSFTLIVIPTVTLLLVGGVGHVLLPYVKMITTMIGQGTRRTHENFLFILLCPDINFEKIPF

SEQ ID NO: 9699 - DNA, 1023 bp, Streptococcus agalactiae
atggcaaaaattatttcattaggtgaggttcttttgcgattatctccacctcaatatcacacactgatgcaggctaatcacctaaaatgccaattcggtggttcagaacttaatgtcttagcaagccttgctcaactaggttaccatgtaggattggtctcagctttgcctgataatgatttgggcaagatggcaagtcaatttatattgtcacagcaaattagtccagctgctataattaaaaaagaaggacgactaggaatttattactatgaacaaggattttcggtaagaacaaataaggttatctacgatcgtaactattcatctttttgggaaagtaccttgagtgattatgattttacttctatttttaagggagtggattggtttcatgtttctggaattactccagcactaaccaaggacttatatgaggtgactcggttccttatgacaaaagctaaagaaggaggtgtaaaagtatcgattgatctcaattttcgtgagagtttatggtcatcttttcaagaggcacgtgagcaattatcgccactattaggattattagatgtttgctttggcttagagccgatttatttagctggcgaaagtgaagatttaaaagatgagttgggcttatccagaccttaccttgatattgaattacttgaaaagataacccaaaagattgtccaagaatatgggttagactatattgcctttactcaaagggaaatggaatatactaatcagtatatgttaaaatcatatttgtatcataataatatgttatatcaaactgataaaactggcgttgaagtattagatcgtgtggggacaggagatgcctttgctgcaggtttaattcatgcgcttctggaaaaagaaactcctcaaagggccttagaaatagctatggctacatttaaatacaaacataccattcaaggagatatcaatatcatgacacgagatgatattgcttacctcattgaaaaagaaacaaatgatattaaacga

SEQ ID NO: 9700 - protein, 341 aa, Streptococcus agalactiae
MAKIISLGEVLLRLSPPQYHTLMQANHLKCQFGGSELNVLASLAQLGYHVGLVSALPDNDLGKMASQFILSQQISPAAIIKKEGRLGIYYYEQGFSVRTNKVIYDRNYSSFWESTLSDYDFTSIFKGVDWFHVSGITPALTKDLYEVTRFLMTKAKEGGVKVSIDLNFRESLWSSFQEAREQLSPLLGLLDVCFGLEPIYLAGESEDLKDELGLSRPYLDIELLEKITQKIVQEYGLDYIAFTQREMEYTNQYMLKSYLYHNNMLYQTDKTGVEVLDRVGTGDAFAAGLIHALLEKETPQRALEIAMATFKYKHTIQGDINIMTRDDIAYLIEKETNDIKR

SEQ ID NO: 9701 - DNA, 1797 bp, Streptococcus agalactiae
atgttatatccattattgacaaaaacaagaaatacttatgatttaggcggtatttggaactttaaattaggagaacataatccaaatgaattactaccttcagatgaagtcatggttatcccgacttcatttaatgatttgatggtaagtaaagaaaaacgtgattatataggtgatttttggtatgaaaaagtcattgaagtacctaaagtatcagaggatgaagagatggtgctgcgttttggctcagtgacacatcaagctaaaatttatgttgacggtgtattggtaggagagcataagggaggttttactccttttgaagttcttgttcctgaatgtaagtataataatgagaaaattaaggtatcaatttgtgctaataacgttttagactataccacgcttccggtcggaaattatagtgaaatcattcaagaagatggtagcattaagaagaaagtacgtgagaattttgatttcttcaattatgcaggtgtgcatcgtcctcttaagttgatgatacgtcctaaaaatcatatttttgatattacaattacaagtcgtctatcagatgatttacagtcagcagatttacattttttagtggagactaatcaaaaggttgacgaagttagaattagcgtttttgatgaagataacaaactagtgggtgaaacgaaggatagcagattatttcttagtgatgtccatctttgggaagttttaaatgcctatctgtacacagcgcgtgttgaaatttttgttgataatcaactccaagatgtctatgaggaaaattttggtcttagagaaatagaagtgacaaatggtcaattcctattgaatcgcaaacctatttattttaaaggatttggtaaacatgaagatacgttcattaatggcagaggtttgaatgaagctgctaacttaatggatttgaatcttttgaaggatatgggggcaaactcttttagaacatcccattatccttattctgaagaaatgatgcgtttagcagatcgaatgggagtgttagtgatagatgaggttccagcagtagggttatttcaaaattttaacgcttccttagatttgtcaccaaaagataatggtacgtggaatttgatgcaaacaaaagcggcgcatgaacaagctatccaagaattagtgaagcgtgataaaaatcatcctagcgtcgtgatgtgggtagtcgctaacgaaccggctagtcatgaagcgggagcacatgattattttgagccattagtaaaactttataaagatttagaccctcaaaaacgtcctgtcaccttggttaatattttaatggcaaccccagatagagaccaagtgatggacctggttgatgttgtctgccttaatcgttactatggttggtacgttgaccacggtgatttaacaaatgcagaagtaggtataagaaaagagttattagaatggcaagataaatttcctgacaaaccaattatcataacggagtatggcgctgatacgttaccgggattacattctacttggaatattccatatacagaagaatttcaatgtgatttttatgaaatgagtcatcgtgtttttgatggtattcctaatttagttggtgagcaagtctggaattttgcagactttgaaactaatctgatgatacttcgtgtacaggggaatcacaaaggtctcttttcaaggaatcgccagccgaaacaagtcgtcaaagaatttaaaaaacgctggatgactattcctcattaccataataaaaaaaatagtgtaaaa

SEQ ID NO: 9702 - protein, 599 aa, Streptococcus agalactiae
MLYPLLTKTRNTYDLGGIWNFKLGEHNPNELLPSDEVMVIPTSFNDLMVSKEKRDYIGDFWYEKVIEVPKVSEDEEMVLRFGSVTHQAKIYVDGVLVGEHKGGFTPFEVLVPECKYNNEKIKVSICANNVLDYTTLPVGNYSEIIQEDGSIKKKVRENFDFFNYAGVHRPLKLMIRPKNHIFDITITSRLSDDLQSADLHFLVETNQKVDEVRISVFDEDNKLVGETKDSRLFLSDVHLWEVLNAYLYTARVEIFVDNQLQDVYEENFGLREIEVTNGQFLLNRKPIYFKGFGKHEDTFINGRGLNEAANLMDLNLLKDMGANSFRTSHYPYSEEMMRLADRMGVLVIDEVPAVGLFQNFNASLDLSPKDNGTWNLMQTKAAHEQAIQELVKRDKNHPSVVMWVVANEPASHEAGAHDYFEPLVKLYKDLDPQKRPVTLVNILMATPDRDQVMDLVDVVCLNRYYGWYVDHGDLTNAEVGIRKELLEWQDKFPDKPIIITEYGADTLPGLHSTWNIPYTEEFQCDFYEMSHRVFDGIPNLVGEQVWNFADFETNLMILRVQGNHKGLFSRNRQPKQVVKEFKKRWMTIPHYHNKKNSVK

SEQ ID NO: 9703 - DNA, 615 bp, Streptococcus agalactiae
atgttaaatcaattgaaaaacaactatttctttgctgttattcgagggaaatcatctgaggatgcgctcgaaatcgcaaagcatgctattttgggtggtattcggaatattgaagtaactttttcgactcctgaagcaagcaaagtcatcaaacaattatcagatgactttaaaaataataaagaaattattgtgggggccggaacggtcatgacaactgaacttgctaaagaggctattgatgctggagctaaatttttggttagcccacactttgattcagatattgctaatttagctaatgaaaacaaggtttattatttcccaggctgtgcaacggcaacagaaatcgtggtagctagaaagtataaatgtcagattataaagctttttccaggtggagttgtgggtccaggttttatcaaagatattcatggtcctattccagatgttgatttaatgccatcaggtggcgtctctgtttcaaatgtagttgaatggagaaaagcaggagcagttgcggttggtgttggctcagcattatctagtaaagtagccacagaaggctatgatagtgttactaaaatagctaaacagtttgtttctgcacttgat

SEQ ID NO: 9704 - protein, 205 aa, Streptococcus agalactiae
MLNQLKNNYFFAVIRGKSSEDALEIAKHAILGGIRNIEVTFSTPEASKVIKQLSDDFKNNKEIIVGAGTVMTTELAKEAIDAGAKFLVSPHFDSDIANLANENKVYYFPGCATATEIVVARKYKCQIIKLFPGGVVGPGFIKDIHGPIPDVDLMPSGGVSVSNVVEWRKAGAVAVGVGSALSSKVATEGYDSVTKIAKQFVSALD

SEQ ID NO: 9705 - DNA, 837 bp, Streptococcus agalactiae
atgtcaaaaacaattacatttaccaataaagttgtcgtcataacaggtgcaggcggtgttctctgtggttatatggctaaagaatttgcgaaagcaggcgctaaagtggcattattagatttgaatcaagaagctgctcaaacatttgctgatgaaattgtagaagaaggtggtatcgctaaggcttataaagctaacgttttgtctaaagaaaaccttgaagaagtgcatcaagccgttttagaggatcttggaccaactgatattttagttaatggtgcaggaggcaacaatcctaaagctacaactgataatgaatttcacgaattagacttaccttcagaaacaaaaaccttctttgagttagatgaagctggtattagctttgtttttaacttaaattatttaggaacattattgccaacgcaagtatttgcccaagatatggttggacgtgaaggagcgaatattattaatatctcttcaatgaatgcttttacccctctgaccaaaataccagcttattctggagctaaagcagctattagtaacttcacacaatggctagctgttcatttctcaaaagttggtatccgttgtaatgctattgcacctggtttcttggtaacaaatcagaaccgaagcttgttatttactgaggacggtcagccaactgcgcgtgctgagaaaattcttaataatacaccaatgggaagatttggagaagcaagtgagctgattggcggattgttctttttagcagatgaaaaatcatcaagttttgttaatggcgttgtccttccgattgatggtggatttgctgcttactctggtgtt

SEQ ID NO: 9706 - protein, 279 aa, Streptococcus agalactiae
MSKTITFTNKVVVITGAGGVLCGYMAKEFAKAGAKVALLDLNQEAAQTFADEIVEEGGIAKAYKANVLSKENLEEVHQAVLEDLGPTDILVNGAGGNNPKATTDNEFHELDLPSETKTFFELDEAGISFVFNLNYLGTLLPTQVFAQDMVGREGANIINISSMNAFTPLTKIPAYSGAKAAISNFTQWLAVHFSKVGIRCNAIAPGFLVTNQNRSLLFTEDGQPTARAEKILNNTPMGRFGEASELIGGLFFLADEKSSSFVNGVVLPIDGGFAAYSGV

SEQ ID NO: 9707 - DNA, 945 bp, Streptococcus agalactiae
atggcaactgttagtcgtgtggtaaatggaaataaaaatgtcaaggaaaatacacgtaagaaagtccttgaagttattgatcgtcttgactatcgtccaaatgctgtggcgcgtggtttagcaagtaaaaaaacgacaactgttggtgttgtcattcctaatatcgcaaatagctacttttcaattttagcgcgtggtattgatgatattgcagcaatgtacaaatataacattgtccttgcttcaagtgatgaagacgatgataaagaggttaatgttgttaatactttgtttgctaagcaagtagacggtattatttttatgggacaccacttaactgaaaagattcgtgcagagttctctcgttcacgcacaccgattgttttagcaggtactgtggaccttgagcatcaattaccaagtgttaatatcgattacaaagcagcagcagttgatgttattgatattttagctggcaatcataaagacattgcttttgtatcaggaccacttattgacgatattaatggcaaggttcgtttggcaggatacaaagaaggtctcaagaaaaatggcttaaactttaaagaggggttggtttttgaagccaactaccgttatgctgaaggctttgcattagctcaacgcgtgattaatgctggagcaacagcagcatatgttgctgaggatgagttagcggcaggtttgttaaatggtctttttgaggcaggtaaacgtgttcctgaagattttgaaattatcacaagcaatgactcgccaatcgcacaatatacacgtcctaacttaacttctatcagtcaaccggtctatgatttgggtgctgttagcatgcgtatgctaacaaaaattatgcacaaagaagagttggaagaaaaagaaatagtgcttaatcacgggattgttaaacgtggcacaacaaataat

SEQ ID NO: 9708 - protein, 315 aa, Streptococcus agalactiae
MATVSRVVNGNKNVKENTRKKVLEVIDRLDYRPNAVARGLASKKTTTVGVVIPNIANSYFSILARGIDDIAAMYKYNIVLASSDEDDDKEVNVVNTLFAKQVDGIIFMGHHLTEKIRAEFSRSRTPIVLAGTVDLEHQLPSVNIDYKAAAVDVIDILAGNHKDIAFVSGPLIDDINGKVRLAGYKEGLKKNGLNFKEGLVFEANYRYAEGFALAQRVINAGATAAYVAEDELAAGLLNGLFEAGKRVPEDFEIITSNDSPIAQYTRPNLTSISQPVYDLGAVSMRMLTKIMHKEELEEKEIVLNHGIVKRGTTNN

SEQ ID NO: 9709 - DNA, 1017 bp, Streptococcus agalactiae
atggcaaagaccgctcttaatattccttttacagttgaagggatagaaaattattatcaaaatataaaaatgatactgtctttagcagataaatggagcatacctaaagatgatctattactttttttaaagggcctcaaggctattgatgatataaaagttggctctcctatttttaagtatttttggacttctttaagtttacaagcacccctcaaagctttagaattcgtgttagagcaggctaaaatgccaactgaattgtcaggagaattatcagaaacacaatacttggtcgcacagttttcagatgagttagctccacatgatgatttctggatagccttatcacaagttatttatgattcttttcctgggaatagtctagccgaagatactgtattaaataggaaactccatcaattccgctatttgatttctagtcagcaagcacagtatgttcgacgatactttaaagatgttggtatgactgatagagatgctttagtaaactacctatcatgtttaagagaaccagatagtatcgcctactatgaatctgctcgcttgcataataaacgtcggagaaatggtgaaatctttggtttcccagatgatgagccggttattaatagtaagcttttaatttcattccatacggaatttattattgatgacaaaggaaactttttaaacgagattgacgcagaagtaataacacgtaatggtattatcaatggagctagctttaattatgcttttaaaaataatacacgtcataaagaattagatgttgatcctgtaaagttagacccaaaatttcgaaacgatatgactagaggttatagatcgccaaatctatctagaaggaaatggtttttctttaaagaagaggattacgattgtagttatttcaataaaaaaggatattacgcatttggaaggcgtagtgctaagcaatcggttgataaacaagtcaaatacttgaagaaggctgtgcagaaaatgcgcatcaac

SEQ ID NO: 9710 - protein, 339 aa, Streptococcus agalactiae
MAKTALNIPFTVEGIENYYQNIKMILSLADKWSIPKDDLLLFLKGLKAIDDIKVGSPIFKYFWTSLSLQAPLKALEFVLEQAKMPTELSGELSETQYLVAQFSDELAPHDDFWIALSQVIYDSFPGNSLAEDTVLNRKLHQFRYLISSQQAQYVRRYFKDVGMTDRDALVNYLSCLREPDSIAYYESARLHNKRRRNGEIFGFPDDEPVINSKLLISFHTEFIIDDKGNFLNEIDAEVITRNGIINGASFNYAFKNNTRHKELDVDPVKLDPKFRNDMTRGYRSPNLSRRKWFFFKEEDYDCSYFNKKGYYAFGRRSAKQSVDKQVKYLKKAVQKMRIN

SEQ ID NO: 9711 - DNA, 684 bp, Streptococcus agalactiae
atgaaagaattaagatcaaagctggaaaaagactatggtattgtttttgctaatcaagaattattagatacagcttttacccatacatcatacgcaaatgagcatcgcctcctaaacatttcacataatgaacgtttggaatttttaggagacgctgttctacaattacttatttcacagtatctttttacaaagtaccctcaaaaggcagaaggtgatttatcaaaattacgttcaatgattgttcgtgaggaaagtcttgcaggtttttcacgtctatgtggctttgatcactatattaaacttggaaaaggagaagaaaaatctggtggacgtaatcgtgacactattttaggagatttatttgaggcttttttaggagctttattattagacaaaggtgttgaagtggttcatgcctttgttaacaaggtaatgatccctcacgttgaaaaagggacctatgagcgtgttaaagattacaagacaagcttgcaagaattacttcaatctcatggggatgtaaaaatagattatcaagttactaatgaaagtggtccagcacatgcaaaggaatttgaggtgactgtatctgtcaaccaagaaaatttgagccaaggaattggacgatcaaagaaagctgctgaacaagacgctgccaaaaatgctttagcaacgttacaa

SEQ ID NO: 9712 - protein, 228 aa, Streptococcus agalactiae
MKELRSKLEKDYGIVFANQELLDTAFTHTSYANEHRLLNISHNERLEFLGDAVLQLLISQYLFTKYPQKAEGDLSKLRSMIVREESLAGFSRLCGFDHYIKLGKGEEKSGGRNRDTILGDLFEAFLGALLLDKGVEVVHAFVNKVMIPHVEKGTYERVKDYKTSLQELLQSHGDVKIDYQVTNESGPAHAKEFEVTVSVNQENLSQGIGRSKKAAEQDAAKNALATLQ

SEQ ID NO: 9713 - DNA, 3357 bp, Streptococcus agalactiae
atgccagacgttatatttgctggtacagaaaatcgtaagccccttaattatgcgcaagtgagtgttactttagataatagcgaccattttatcgaaaatatagctgacgaagttcgagttgaacgtcgtatttttcgaaacggagatagtgaatatttaatagatggacgcaaagttcgcttacgtgatattcatgatttatttatggatactggattaggaagagattctttttctattatttcccaaggacgcgttgaagctatttttaatagtaaaccagaagagcgccgtgccatatttgaagaagccgctggtgttctgaaatacaaaacacgtaagaaagaaacacaatccaaattagaacaaactcaagggaacttagatcgcttagaggatattatttatgaattggacatgcaagtccaaccattagaaaaacaagcaagtattgccaagcgttttttagtattagatgaggaacgacaaggactccacttatctattttgattgaagatattttacaacatcaatcagatttaactactgttgaggaaaagctattgacagtaagaaaagagttagcaacttattaccaacaacgtcagtcccttgaagatgaaaatcaatcgttaaaacagaaacgtcaccatttatctgaagaaattgaggctaaacagttagctcttttagacgttacaaagttaaagtcagatttggaacgccaaattgatctgattcgtttagagtcaaaccaaaaggctgaaaaaaaagaagaggcaggtcaacgcttagcagagttagaaattaaagctaaagattgtagtgaccagattacccaaaaaaatatagagttaactactctgtcggaaaaaatagcccaaataagatcagaaattgttagtacagaaagttccttggagcgtttttcaactaatccggatcagattattgaaaaacttcgagaagactttgttaccttgatgcaagaagaagccgacacttcaaacgctttaacagctttactagctgatatagagaatcaaaaacaagcttctcaagctaaatctcaagaaatacaagaagttagcaaaaatttagaagtattaaaaagtaacgcaaaggtagcattggaacgatttgaggctgcaaagaagaatgttcgtcagttattatctcactaccaagatttaggtcaaaccttgcaaaatctagaaggtgagtataagaatcagcagtcaattttatttgatcatttagatgaaatcaaatcaaagcaagcacgtatttcgagtttagaatctattttgaaaaatcatagtaatttctatgctggagtgaagtcagttctacaggctaaggaccagcttggaggtatcataggtgctgttagtgagcatcttagctttgacaaacattaccaaacagcattggagatagctttgggaggtagcagccaacacatcattgttgaagacgagagtgctgccaaacgttcaattgcttttttaaagaaaaaccgccaaggtagagcgacatttctgcctttaactacaataaaaccaagagaattagcacaacattatctctcaaaattacaaagttctcaagggtttttaggaatagctagtgaattggtaacctatgatcaacgcttgtcaaacatttttaaaaataacttagggttaactgctatttttgatacggttgataatgctaatgtagctgcgagacaattgaattatcaagtacgtttagtaaccttagatggaacagagttacgccctggagggtcgtactcagggggagcaaatcgtcaaaataatactgtttttatcaagcctgaattggataatctaaaaaaagaattgaaacaggcacaaagtaaacaattaattcaagaaaaagaagttgccacattgttagagcaactcaaagagaaacaagaaaccttagcacaacttaagaatgatggagaacaagctcgtcttgaggaacaaagagctgatatagagtatcaacaactatcagaaaagcttgctgatttaaataaactatataatggcttgcaattaagcagcggggcgttggaacaaactacttctgaaaatgaaaaaaatcgtttagaaaaagaacttgaacaatttgctattaaaaaagaagagttgacaacttcaattgctcaaattaaggaagataaagattcaattcaagaaaaagtcaataatctaacaacattattgtcagaggcacagctagaagaacgtgatttgctaaacgagcagaaatttgaacgtgccaactgtacacgtctagagattaccttgtctgaaataaaacgtgacattagtaatttacaaacattactaagccatcaggacagtcaattagacaaagaagagcttccacgtatagaaaaacagttgctacaagtaaataatagaagagaaaatgacgaagaaaagcttgtgagtctccgttttgaattggaggattgtgaagctgctttagatgatttagctgcttctctggctaaagagggacaaaaaaatgaaagtcttattcgtcagcaagctcaattagagtcacaatgtgaacaattatctcaacaattgatgatattctcacgtcaattatcagaagactatcagatgacattggatgaagcgaaggtaaaagcaaatgtcttggaagatattttgatggcgcgtgaacaattgaaatctctacaagctaaaattaaagctttaggacctgttaatattgatgcaattgctcaatttgaagaagttcatgaacgattgaccttccttaacacacagcgagacgacttagttcatgccaaaaatttattactagagacgattacagatatggatgatgaagttaagactcgttttaaatcgacatttgaagccattcgtcatagtttcaaagaaacctttgtacagatgtttggtggaggttctgcggaccttattctgacagaaggtgatttattatcagctggggttgatatttcggttcaacctcctggtaaaaaaatccagtctttaaacttgatgtcaggtggtgaaaaagcattatcagcgttagcattattatttgccattatccgtgttaagacaattccatttgtcatcttggatgaagttgaggccgctttagatgaagcaaatgttaagcgatttggcgattatcttaatcgatttgataaatcaagtcaatttatcgttgttactcaccgaaaagggactatgtctgctgctgatagtatctatggggtaacgatgcaagaatcaggcgtttccaaaattgtttctgtaaaattaaaagaagctcaagaaatgaccaat

SEQ ID NO: 9714 - protein, 1119 aa, Streptococcus agalactiae
MPDVIFAGTENRKPLNYAQVSVTLDNSDHFIENIADEVRVERRIFRNGDSEYLIDGRKVRLRDIHDLFMDTGLGRDSFSIISQGRVEAIFNSKPEERRAIFEEAAGVLKYKTRKKETQSKLEQTQGNLDRLEDIIYELDMQVQPLEKQASIAKRFLVLDEERQGLHLSILIEDILQHQSDLTTVEEKLLTVRKELATYYQQRQSLEDENQSLKQKRHHLSEEIEAKQLALLDVTKLKSDLERQIDLIRLESNQKAEKKEEAGQRLAELEIKAKDCSDQITQKNIELTTLSEKIAQIRSEIVSTESSLERFSTNPDQIIEKLREDFVTLMQEEADTSNALTALLADIENQKQASQAKSQEIQEVSKNLEVLKSNAKVALERFEAAKKNVRQLLSHYQDLGQTLQNLEGEYKNQQSILFDHLDEIKSKQARISSLESILKNHSNFYAGVKSVLQAKDQLGGIIGAVSEHLSFDKHYQTALEIALGGSSQHIIVEDESAAKRSIAFLKKNRQGRATFLPLTTIKPRELAQHYLSKLQSSQGFLGIASELVTYDQRLSNIFKNNLGLTAIFDTVDNANVAARQLNYQVRLVTLDGTELRPGGSYSGGANRQNNTVFIKPELDNLKKELKQAQSKQLIQEKEVATLLEQLKEKQETLAQLKNDGEQARLEEQRADIEYQQLSEKLADLNKLYNGLQLSSGALEQTTSENEKNRLEKELEQFAIKKEELTTSIAQIKEDKDSIQEKVNNLTTLLSEAQLEERDLLNEQKFERANCTRLEITLSEIKRDISNLQTLLSHQDSQLDKEELPRIEKQLLQVNNRRENDEEKLVSLRFELEDCEAALDDLAASLAKEGQKNESLIRQQAQLESQCEQLSQQLMIFSRQLSEDYQMTLDEAKVKANVLEDILMAREQLKSLQAKIKALGPVNIDAIAQFEEVHERLTFLNTQRDDLVHAKNLLLETITDMDDEVKTRFKSTFEAIRHSFKETFVQMFGGGSADLILTEGDLLSAGVDISVQPPGKKIQSLNLMSGGEKALSALALLFAIIRVKTIPFVILDEVEAALDEANVKRFGDYLNRFDKSSQFIVVTHRKGTMSAADSIYGVTMQESGVSKIVSVKLKEAQEMTN

SEQ ID NO: 9715 - DNA, 126 bp, Streptococcus agalactiae
atggctattacgcacaaacgtcaagatgacttagaaagtatgttcgctagttttgctaaagtaccaaaacctaaaaaagttgattctgattcaaaacctgaacagaaagatgattctcagaaagat

SEQ ID NO: 9716 - protein, 42 aa, Streptococcus agalactiae
MAITHKRQDDLESMFASFAKVPKPKKVDSDSKPEQKDDSQKD

SEQ ID NO: 9717 - DNA, 2217 bp, Streptococcus agalactiae
ttgaaatcgctttttaaaactcttcgtaagtcaaaaatatgctataataaaagcgttatggaaaatttaaatattacacaaattgctattgatttaggtattaaagcgtcacaaatcgaaaaggttttagaattaacagatgaaggaaatactattccttttattgcccgttatcgtaaagaaatgacaggtaatttggatgaagttcaaatcaaatcaattattgaccttgataagagtatgacagctctttcagatcgtaaaactacggtcttagccaaaattgaagaacaaggaaagttgactcaagaactcaaaaaggctattgaagaagcaactaaactagcagatgttgaggaactctacctaccttataaagaaaaacgtcgtacgaaagctacgattgcacgtgaagcaggtctttttcctttagcacgtcttattttacaaaataaggataaccttgaggaagaagctcaaaactatcttacagatggttttgagacaactacgaaggcactttctggagcagtagatattcttatcgaagctttttctgaggataataaattacgttcatggacatataatgagatctggaactacagctcaatcactgcagttgttaaagatgagtcacttgatgaaaaacaggtcttcaaaatctactatgacttttctgaaaaaataagtaaactccatggctatcaagttttagcattgaatcgtggtgagaaaatgggtgttcttaaggttaattttgagcataaccttgaaaaaatgtttcgcttttttgctgttcgatttaaagaaactagccaatatatagatgaccttattgtacagactgtcaagaaaaaaatcgttccagctatggaacgccgtatccgtacagaactaagtgaaggagcagaagatggtgcaatttcactgttttcagagaatcttcgtaacttattgttagtctcaccgcttaaggggaaaatggtgttaggttttgaccctgcctttcgtacaggagcaaaattagcagtagtagaccaaactggaaaattaatgacaacacaagtgatttatccagttcctccagctaatcaagcaaaaatcgaacaatcaaaaatagagttagcaaaacttatcaaagaattcaatatagaaattattgctatagggaatggaacagcgagtcgtgaatcagaagcatttgttgcagaagttttacaagattttccagacgtatcctatgtgattgttaacgaaagtggtgcctctgtttattcagcctcagaattggcacgtcatgaatttccagacttaacggttgaaaaacgttcggccatctcaattgcaagacgtctgcaagacccattagcagaactagtcaaaattgatccaaaatctattggtgtgggtcaatatcaacatgatgttagccaaaaaaaattagcagaaaatcttgattttgttgttgaaactgtagttaaccaagtaggtgttaatgttaatacagcaagtccagccttgttagctcatgtttcaggtttaaataaaacaatatctgaaaatattgttaaatatcgtgaagagaatgggcaaattaagtcacgtgctgaaattaagaaagtgcccagattaggagcaaaagcttttgagcaagctgctggattcttacgtattcctaatgctaaaaatttcttggataatacaggtgttcaccctgagtcttatgaagctgttaaaaagttgcttgaccaactgactatcaaagaattagatgatcttgctaaagagaagttacaaaaccttgacttaattgcaacagcagaaagtattggggtaggtcaagaaacattaaaagacattatagaagatcttttgaaaccaggtcgtgatttgcgtgatgattttgaagcgcctgttttgagacatgatgttttagatgtcagtgatttaaaagttggacaggaattgcaaggaactgttcgaaacgtcgttgattttggtgcttttgttgatattggtgttcatgaagatggtctaatccaccagtctcgccttattaagcgaaaacgcgataaaaaaactagaaaaatgcctcctttacaacatccaagcaaatatctctctgttggtgatattgtaactgtttgggttgtagaggtagatgcggagcgtagcagaattggacttagtcttatcaagccagacggacttgac

SEQ ID NO: 9718 - protein, 739 aa, Streptococcus agalactiae
MKSLFKTLRKSKICYNKSVMENLNITQIAIDLGIKASQIEKVLELTDEGNTIPFIARYRKEMTGNLDEVQIKSIIDLDKSMTALSDRKTTVLAKIEEQGKLTQELKKAIEEATKLADVEELYLPYKEKRRTKATIAREAGLFPLARLILQNKDNLEEEAQNYLTDGFETTTKALSGAVDILIEAFSEDNKLRSWTYNEIWNYSSITAVVKDESLDEKQVFKIYYDFSEKISKLHGYQVLALNRGEKMGVLKVNFEHNLEKMFRFFAVRFKETSQYIDDLIVQTVKKKIVPAMERRIRTELSEGAEDGAISLFSENLRNLLLVSPLKGKMVLGFDPAFRTGAKLAVVDQTGKLMTTQVIYPVPPANQAKIEQSKIELAKLIKEFNIEIIAIGNGTASRESEAFVAEVLQDFPDVSYVIVNESGASVYSASELARHEFPDLTVEKRSAISIARRLQDPLAELVKIDPKSIGVGQYQHDVSQKKLAENLDFVVETVVNQVGVNVNTASPALLAHVSGLNKTISENIVKYREENGQIKSRAEIKKVPRLGAKAFEQAAGFLRIPNAKNFLDNTGVHPESYEAVKKLLDQLTIKELDDLAKEKLQNLDLIATAESIGVGQETLKDIIEDLLKPGRDLRDDFEAPVLRHDVLDVSDLKVGQELQGTVRNVVDFGAFVDIGVHEDGLIHQSRLIKRKRDKKTRKMPPLQHPSKYLSVGDIVTVWVVEVDAERSRIGLSLIKPDGLD

SEQ ID NO: 9719 - DNA, 132 bp, Streptococcus agalactiae
atgatgacggttggttctggtaattcatataaaggagatttgctagatgaatctccttttttcttagctttatttagaccactttttcaaaatatcttctttttttcagaaaaacgcgttagcgcttacttt

SEQ ID NO: 9720 - protein, 44 aa, Streptococcus agalactiae
MMTVGSGNSYKGDLLDESPFFLALFRPLFQNIFFFSEKRVSAYF

SEQ ID NO: 9721 - DNA, 771 bp, Streptococcus agalactiae
atgattaatccagtagcaatacgattaggccccttttctattcgctggtatgctatttgcatagtgtctggtatgttgttagcagtttacttagcaatgaaagaggcccctcgtaagaacattaagtcggatgatattctagatttcattctcatggcttttccactatccattgttggagctcgtatttattatgttatcttcgaatgggcttattactctaagcacccagtagagattatcgccatctggaatggcggtattgctatttacggagggttaattaccggggccattctccttgtgattttttcatatcgtcgcttgattaatcccattgattttctggatattgctgctccaggagtgatgattgcccaagccataggtaggtgggggaattttattaatcaagaagcatacggtagggcagtaaaaaatctgaattacgtaccaaactttataaaaaatcaaatgtatattgatggagcttaccgagtacctacatttttatatgagtctctttggaacttcctaggttttgtcatcatcatgtctattcgtcatcgaccgcgcactttaaaacaaggtgaagtggcatgtttttatttagtttggtatggatgtggacggttcattattgaagggatgaggacagatagcctttatttggcgggtttgcgcgtgtcacaatggttatcagttattttagttattatcggaattgtcatgattatttatcgtcgtcgtgaacaacatatttcatattat

SEQ ID NO: 9722 - protein, 257 aa, Streptococcus agalactiae
MINPVAIRLGPFSIRWYAICIVSGMLLAVYLAMKEAPRKNIKSDDILDFILMAFPLSIVGARIYYVIFEWAYYSKHPVEIIAIWNGGIAIYGGLITGAILLVIFSYRRLINPIDFLDIAAPGVMIAQAIGRWGNFINQEAYGRAVKNLNYVPNFIKNQMYIDGAYRVPTFLYESLWNFLGFVIIMSIRHRPRTLKQGEVACFYLVWYGCGRFIIEGMRTDSLYLAGLRVSQWLSVILVIIGIVMIIYRRREQHISYY

SEQ ID NO: 9723 - DNA, 624 bp, Streptococcus agalactiae
atgggtcaagtcagtcgtattcggaatggcataaagtcccaacaattaagtattgatgctcccaaactagtccctttattaagaaaaggggatagcgtagctgttaatggtgtttgtttgacggttcttgacaaaagtgaaacagcttttatagcagacgtcatgccagaaagtatgatgcgaacaagcttagctgctttacgacttcattctaaagttaacttagaattagcactcagaagtgactcaaggttaggggggcattttgttcttggacatgtggatggggttggaaaaatagaaaaaatccaaaaagatgatattgctgtcagattttcaattgatgctccacctagtattatgtcttatattatagagaaaggttcggtggctctagatgggattagcttaacagtggtatcatttacagagcattcttttgaagtttcggtcattccccacacgatggctcaaactaatctatccttaaaaaaggttggggatttattaaatatcgaagtggatgttttaggcaaatatgctgagaaatttttagcacccactaatagaactaatcacacttcatcggtaatggattggtcttttttatcagaaaatggctac

SEQ ID NO: 9724 - protein, 208 aa, Streptococcus agalactiae
MGQVSRIRNGIKSQQLSIDAPKLVPLLRKGDSVAVNGVCLTVLDKSETAFIADVMPESMMRTSLAALRLHSKVNLELALRSDSRLGGHFVLGHVDGVGKIEKIQKDDIAVRFSIDAPPSIMSYIIEKGSVALDGISLTVVSFTEHSFEVSVIPHTMAQTNLSLKKVGDLLNIEVDVLGKYAEKFLAPTNRTNHTSSVMDWSFLSENGY

SEQ ID NO: 9725 - DNA, 1191 bp, Streptococcus agalactiae
atggcctttagtccaataaaaaaacttttacaagacatcaaatcagggaaaatggtagtgttgatggatgacgaaaatagagagaatgaaggagaccttatttgtgcggctgaaatggtgacaaaagagtcgattaattttatggctaaatttgggaaaggattaatttgcttacctctgtctaattactatgctgaaaagttagaattagctcaaatggctagccataatactgataatcatgaaacagcttttaccatatctattgatcatctatcaactagtactgggatttctgcggaagatagagctttgacagctaagatggttgctaacgacagtagcaaagctaaagactttagacgtcctgggcacttatttcccttgttagccaaggaaggaggtgttttagctagaaatggacatactgaagcaaccgttgatctatgtcgtttagctggattaaaggaatgtggactttgttgtgaaataatggctgaagatggtagtatgatgagaaaggatgagttattagcatttgctcaaaagcacgatttagctatcgctaccataaaacaattgcaagactatagacgtcaagaagagggaggggtggttagagaaattgagattcagctaccaacgcaattcggtcattttacggcttatggatatagcgaagttgtggcaaataaggaacatgttgcccttgttaaaggggatattagtagtggtgaagatgttttatgtcgtttacactcagaatgtttgacaggtgatgtctttcattccttgagatgtgattgtggggaacaactggctaatgccctccaacaaatagaggctgaaggtcgtggagtccttctttatatgagacaggaaggtcgaggaattggtttgattaataagttaaaagcttatcatttgcaagaagaaggcttagatactttagaagctaatttggctttaggttttgaaggagatgagagagactatggagttagtgctcaacttttaaaagatttaggtataaattctataaacttactaaccaataatccagataaaatccaacaacttgaagcagaaggaatttgcgtcaaaaacagagtgccattacaggtggcagtaacagcttatgaccttaattatttaaaaactaaaaaagaaaaaatgggacatcttttagat

SEQ ID NO: 9726 - protein, 397 aa, Streptococcus agalactiae
MAFSPIKKLLQDIKSGKMVVLMDDENRENEGDLICAAEMVTKESINFMAKFGKGLICLPLSNYYAEKLELAQMASHNTDNHETAFTISIDHLSTSTGISAEDRALTAKMVANDSSKAKDFRRPGHLFPLLAKEGGVLARNGHTEATVDLCRLAGLKECGLCCEIMAEDGSMMRKDELLAFAQKHDLAIATIKQLQDYRRQEEGGVVREIEIQLPTQFGHFTAYGYSEVVANKEHVALVKGDISSGEDVLCRLHSECLTGDVFHSLRCDCGEQLANALQQIEAEGRGVLLYMRQEGRGIGLINKLKAYHLQEEGLDTLEANLALGFEGDERDYGVSAQLLKDLGINSINLLTNNPDKIQQLEAEGICVKNRVPLQVAVTAYDLNYLKTKKEKMGHLLD

SEQ ID NO: 9727 - DNA, 1488 bp, Streptococcus agalactiae
atgtctaaccaacatattgaagaattaaatgaccaacagattgttcgtcgtgaaaaaatggctgctttgactgaacaaggcattgatccttttggtaaacgatttgaacgtacagcaacatctggtcaattaaatgaaaaatacgctgacaaatcaaaagaagacttgcacgacattgaagaaactgctacaatcgctggtcgtttaatgactaagcgcggtaaggggaaagttggctttgcgcatatccaagatcgcgaaggtcaaattcaaatttatgtccgtaaagattctgttggcgaagaaaactacgaaatctttaaaaaagctgatttaggtgacttccttggtgttgaagggcaagtaatgcgtacagatatgggagaactttctatcaaggctactcatattactcacctttcaaaagcactccgtccacttcctgaaaaattccacggcctaactgatattgaaacaatctatcgtaaacgtcatcttgatttaatctcaaatcgtgacagctttgaccgttttgtaacacgctcaaaaatcatttcagaaattcgtcgctttatggatagcaatggtttcttagaggttgaaacacctgttcttcataatgaagctggtggtgcttctgctcgcccatttatcacacatcacaatgcacaagacattgacatggttcttcgtatcgcaactgaattgcatctaaaacgtcttattgtaggtggtatggagcgtgtttatgaaatcggacgtattttccgtaatgaagggatggatgcaacccacaatccagagttcacatctattgaagcctaccaagcctatgctgactaccaggatattatggacttgacagaaggtattatccagcatgttacaaaaactgtaaaaggtgatggaccaattaattatcaaggcacagaaattaaaattaatgaaccattcaaacgtgttcatatggttgatgcggttaaagaaatcactggtattgacttctggaaagaaatgactcttgaagaagcacaagctttggcacaagaaaaaaatgttccgcttgaaaaacatttcacaacagttggtcacatcattaatgccttcttcgaagaatttgttgaagacactttaattcaaccaacttttgtctttggtcatccagttgaagtgtctccacttgctaagaaaaatgatacagaccctcgttttacagaccgtttcgaactctttatcatgactaaagaatacgctaatgcttttacagaattaaatgacccaattgatcagctatctcgctttgaagcacaagcatctgctaaagaacttggcgatgatgaagcaactggagttgattacgattatgttgaagcacttgaatatggtatgccacctactggtggactaggtattggtatcgaccgtctctgtatgctgttaactgatacaacaactatccgagacgtcctacttttccctacaatgaaa

SEQ ID NO: 9728 - protein, 496 aa, Streptococcus agalactiae
MSNQHIEELNDQQIVRREKMAALTEQGIDPFGKRFERTATSGQLNEKYADKSKEDLHDIEETATIAGRLMTKRGKGKVGFAHIQDREGQIQIYVRKDSVGEENYEIFKKADLGDFLGVEGQVMRTDMGELSIKATHITHLSKALRPLPEKFHGLTDIETIYRKRHLDLISNRDSFDRFVTRSKIISEIRRFMDSNGFLEVETPVLHNEAGGASARPFITHHNAQDIDMVLRIATELHLKRLIVGGMERVYEIGRIFRNEGMDATHNPEFTSIEAYQAYADYQDIMDLTEGIIQHVTKTVKGDGPINYQGTEIKINEPFKRVHMVDAVKEITGIDFWKEMTLEEAQALAQEKNVPLEKHFTTVGHIINAFFEEFVEDTLIQPTFVFGHPVEVSPLAKKNDTDPRFTDRFELFIMTKEYANAFTELNDPIDQLSRFEAQASAKELGDDEATGVDYDYVEALEYGMPPTGGLGIGIDRLCMLLTDTTTIRDVLLFPTMK

SEQ ID NO: 9729 - DNA, 615 bp, Streptococcus agalactiae
atggaaatactgattgcaggtggtagtggttttttaggaaagcagataataaaagcagcgcttacaaaagggcataaagtggcttacttatcaagacatgaaggtaaaggtgatatatttaaggatcctagattaacctacattaggggagatattacagaagctgataagattcatttagaagacagaacttttgatatattaattgactgtattggagcgattaagcccaatcaactagatgagcttaacgttaaagcaacccaaaaagcagtagcactctgtcacaaaaatcaaataccaaagttagtttatatttcagccaacagcggctattcagcttacattaaaagtaaaaggaaggcagagcagataatcaaagcaagcggtctggattatctttttgtaagaccaggtttgatgtatggtgaagagcgacctctctcgattttccaagccaagtgtataaagttatttagtcatttgcctttcttaggtattgttgtacaaaaggtctttccaactaaggttgtgatagtggcagaagcaatcgttactacgcttaggaaaaaaccaacccaaaaaatcctttctattgaagaattaaataataaa

SEQ ID NO: 9730 - protein, 205 aa, Streptococcus agalactiae
MEILIAGGSGFLGKQIIKAALTKGHKVAYLSRHEGKGDIFKDPRLTYIRGDITEADKIHLEDRTFDILIDCIGAIKPNQLDELNVKATQKAVALCHKNQIPKLVYISANSGYSAYIKSKRKAEQIIKASGLDYLFVRPGLMYGEERPLSIFQAKCIKLFSHLPFLGIVVQKVFPTKVVIVAEAIVTTLRKKPTQKILSIEELNNK

SEQ ID NO: 9731 - DNA, 459 bp, Streptococcus agalactiae
gtgttgagatatgcttttgcgcctctgcctaacattcagccaattactgccatttttttgattacagttgtcttattcgatttaaaagaaggtgtagctactgtaactataacaatgctagtttcttcttttttaatgggctttgggccatgggtctttttgcaaatcatttccttcactttaattttatgcttgtggaaatttctgatatatccgctgacaaaagctgtatgttttggtaaaataacggaggtagtacttcaaactttctttgcaggagggttaggggttgtttatggcgtcattattgatacctgttttgcttggttatatcatatgccttggtggacttatgtattagcaggacttagttttaatatggcacacgctttatcaacttgtttattttatcctcttttgttaccgattttaaggagatttaggaatgaaaaaatacat

SEQ ID NO: 9732 - protein, 153 aa, Streptococcus agalactiae
MLRYAFAPLPNIQPITAIFLITVVLFDLKEGVATVTITMLVSSFLMGFGPWVFLQIISFTLILCLWKFLIYPLTKAVCFGKITEVVLQTFFAGGLGVVYGVIIDTCFAWLYHMPWWTYVLAGLSFNMAHALSTCLFYPLLLPILRRFRNEKIH

SEQ ID NO: 9733 - DNA, 990 bp, Streptococcus agalactiae
atggaagattttattgaaatgaatgaaccattgtttgcgacctacgttgatttgagtgaaggttgtccgtctcatgataccttagagcgtgtgattagtcttgttaattcagaccgtttaaaagagcttaaagttcaatttgagcaatcattgacaagcttagatgccgttcatcaactgatttcagtggacggtaaaacgattcgaggcaatcgaggtaaaaatcagaagcctgttcatattgtaacggcttatgatgggggtcatcatcttagtttgggacaggtagcggttgaggagaaaagtaatgaaattgttgccattcctcagttattgcggacaattgatatccgtaaaagcattgtaacgatagacgcaatgggcacgcagacggctatcgttgatacgattataaaaggtaaagcagactattgcttagccgtcaaaggaaatcaagaaacactttatgatgatattgctctttattttagtgatgtcaacttattggaagaactccaagaaaatgcgcagtattatcagactgttgaaaaatctaggggacagattgaagttagagaatactgggtgtcttccgatatcaaatggttgtgtcaaaatcatcccaaatggcataagttacgtggtattgggatgactcgtaacacgattgataaggatggtcagctgagtcaagagaatcgttattttatctttagctttaagccggatgtcctcacatttgccaattgtgtacgaggtcattggcagatagagagtatgcactggttattggacgttgtttatcatgaagatcatcatcagacattggataaaagagccgcatttaacctaaatcttatccgaaaaatgtgcttatattttctcaaagtgatggtatttcctaaaaaagacctcagttatcgtcgcaaacaacggtatatttctgtccatttggaagattatttagtccaattatttggagaaagaggc

SEQ ID NO: 9734 - protein, 330 aa, Streptococcus agalactiae; identical to SEQ ID NO: 9498

SEQ ID NO: 9735 - DNA, 177 bp, Streptococcus agalactiae
atgccttttatcaattttcatattgtattatttcctttaatatatcaaaaaattaccattatgcattatatcatctttcgaagtaaagtaaaagggagaatagcaacacgccgtacgcatgaaaactttctcttcatccttttgtgcccggacatcaattttgaaaagattcctttt

SEQ ID NO: 9736 - protein, 59 aa, Streptococcus agalactiae
MPFINFHIVLFPLIYQKITIMHYIIFRSKVKGRIATRRTHENFLFILLCPDINFEKIPF

SEQ ID NO: 9737 - DNA, 1194 bp, Streptococcus agalactiae
atggcaaaagaaaaatacgatcgtagtaaaccacacgttaacattggtacaatcggacacgttgaccacggtaaaactactttaacagcagctatcacaactgtattggcacgtcgcttgcctacttcagttaaccaaccaaaagattacgcttctatcgatgctgctccagaagagcgcgaacgcggaatcacaatcaacactgcacacgttgagtacgaaactgaaaaacgtcactatgcccacatcgacgctccaggacacgcggactacgttaaaaacatgatcactggtgctgctcaaatggacggagctatccttgtagttgcttcaactgatggaccaatgccacaaactcgtgagcacatccttctttcacgtcaagttggtgttaaacaccttatcgtattcatgaacaaagttgaccttgttgatgatgaagaattgcttgaattggttgaaatggaaattcgtgaccttctttcagaatacgacttcccaggtgatgaccttccagttatccaaggttcagctcttaaagcacttgaaggcgacgaaaaatacgaagacatcatcatggaattgatgagcactgttgatgagtacattccagaaccagaacgtgatactgacaaacctttacttcttccagttgaagatgtattctcaatcactggacgtggtacagttgcttcaggacgtatcgaccgtggtactgttcgtgtcaacgacgaagttgaaatcgttggtattaaagaagatatccaaaaagcagttgttactggtgttgaaatgttccgtaaacaacttgacgaaggtcttgcaggggacaacgttggtgttcttcttcgtggtgttcaacgtgatgaaatcgaacgtggtcaagttcttgctaaaccaggttcaatcaacccacacactagatttaaaggtgaagtttacatcctttctaaagaagaaggtggacgtcatactccattcttcaacaactaccgtccacaattctacttccgtacaactgacgtaacaggttcaatcgaacttccagcaggaacagaaatggttatgcctggtgataacgttactatcgaagttgaattgattcacccaatcgccgtagaacaaggtactactttctcaatccgtgaaggtggacgtactgttggttcaggtatcgtttcagaaatcgaagct

SEQ ID NO: 9738 - protein, 398 aa, Streptococcus agalactiae
MAKEKYDRSKPHVNIGTIGHVDHGKTTLTAAITTVLARRLPTSVNQPKDYASIDAAPEERERGITINTAHVEYETEKRHYAHIDAPGHADYVKNMITGAAQMDGAILVVASTDGPMPQTREHILLSRQVGVKHLIVFMNKVDLVDDEELLELVEMEIRDLLSEYDFPGDDLPVIQGSALKALEGDEKYEDIIMELMSTVDEYIPEPERDTDKPLLLPVEDVFSITGRGTVASGRIDRGTVRVNDEVEIVGIKEDIQKAVVTGVEMFRKQLDEGLAGDNVGVLLRGVQRDEIERGQVLAKPGSINPHTRFKGEVYILSKEEGGRHTPFFNNYRPQFYFRTTDVTGSIELPAGTEMVMPGDNVTIEVELIHPIAVEQGTTFSIREGGRTVGSGIVSEIEA

SEQ ID NO: 9739 - DNA, 1365 bp, Streptococcus agalactiae
atgaagcttagtttgcatgaagttgctaaagtagttggcgctaaaaatcaagtatcagagtttgaagacgttcccctgggaaatattgaatttgatagtcgtaatatcagtgaaggtgacttatttcttcccttaaaaggagcaagagatggacatgagtttatagagatggcttttgataatggagcaatagcaaccatttcagagaaggaaatagagggtcatccttatcttttagtgtctgatgcacttaaagcatttcaagtcttggcacagtattatattgaaaagatgaacgttgatgttattgcagtaactggctcaaatggtaagacaacaactaaagatatgatagctgcaatcttatcaaccacatataagacttataaaacacaaggaaactacaataacgagattggcttaccctatactgtgctacacatgccagaagatactgaaaaaattattttggagatgggacaggatcatcttggagatatccatgtgttatctgaaattgcaaaaccacgtattgctgttgttactttgattggtgaagcacacttagaattttttggtagtcgagaaaagattgcagaagggaaaatgcaaatcacagatggtatgagttcagatggcatattaattgcaccgggagatccaattattgatccatatcttccagcaaaccagatgactattcgttttggtcatgaccaagaattgcaagtgacagaactcaaagaagaaaaacattccttaacttttaaaactaatgctttggagcaccaattacgtataccagtacctggtaagtacaatgcaactaatgcgatggtcgctgcctatgttggaaaattattagcagtagcagaagaagatatagtggatgctctagaaaatcttcaactaactcgtaatcgcaccgaatggaagaaatcagccaatggagcagatattttatcagatgtttacaatgctaacccaacggctatgcgattgatactagaaaccttttcagctattcccaataatgatggtggaaagaagattgctcttttagctgatatgaaagaactgggagaacaatctgtggatttacataatcaaatgattatgagtatcagacctgactctattgatactttgatttgttatggccaggatattgaggggttggctcaattagcaagccagatgttcccaattggtaaagtgtatttctttaaaaagaatcaagaagtagatcagtttgatcaattgcttgcaaaagtaaaagatactcttaaggagaaagatcaaatattattaaaaggttctaactcaatgaatctttctaaaatagttgatattcttgaagtagga

SEQ ID NO: 9740 - protein, 455 aa, Streptococcus agalactiae
MKLSLHEVAKVVGAKNQVSEFEDVPLGNIEFDSRNISEGDLFLPLKGARDGHEFIEMAFDNGAIATISEKEIEGHPYLLVSDALKAFQVLAQYYIEKMNVDVIAVTGSNGKTTTKDMIAAILSTTYKTYKTQGNYNNEIGLPYTVLHMPEDTEKIILEMGQDHLGDIHVLSEIAKPRIAVVTLIGEAHLEFFGSREKIAEGKMQITDGMSSDGILIAPGDPIIDPYLPANQMTIRFGHDQELQVTELKEEKHSLTFKTNALEHQLRIPVPGKYNATNAMVAAYVGKLLAVAEEDIVDALENLQLTRNRTEWKKSANGADILSDVYNANPTAMRLILETFSAIPNNDGGKKIALLADMKELGEQSVDLHNQMIMSIRPDSIDTLICYGQDIEGLAQLASQMFPIGKVYFFKKNQEVDQFDQLLAKVKDTLKEKDQILLKGSNSMNLSKIVDILEVG

SEQ ID NO: 9741 - DNA, 378 bp, Streptococcus agalactiae
atgggaattttttcgggattaatgggaaatgcttcacaaatggataccgataaagtcgagaatcagttatctgatattctgatttcagatgaacaggttgatttagcttataccttaattcgtgatttgattgtttttactaattatcgtttaattttagtcgataaacagggggtgacaggtaaaaaggtttcttataattctataccttatgcttctatatcacgttttacagtggaaactagtggtcattttgatttagatgctgagttaaagatttggatatcatcagcaatagaaccagcagaagtacttcagtttaagaacgaccgtaacatagtgagtatacagaaagctttggcgacagctgttttaaaa

SEQ ID NO: 9742 - protein, 126 aa, Streptococcus agalactiae
MGIFSGLMGNASQMDTDKVENQLSDILISDEQVDLAYTLIRDLIVFTNYRLILVDKQGVTGKKVSYNSIPYASISRFTVETSGHFDLDAELKIWISSAIEPAEVLQFKNDRNIVSIQKALATAVLK

SEQ ID NO: 9743 - DNA, 942 bp, Streptococcus agalactiae
atgaaagagaagctatttcaggtaattggattcaataaagacgatttagcctattcttattttgatttaagtgaagaagactatcaaaatgcggaattagacttagaaagtttaccttttttatcagactacaaggttgttatttttgatcagtttcaagatattacaactgataaaaaaacttatttagatgaacaagcaatgaagcgctttgaagcctacttgcagaatcctgtagatactacgagacttgttatttgtgctccaggaaaacttgatggaaaacgtcgacttgtaaagttattgaaacgtgatgctcgtgttttagaggctaatactttaaaagaatcagatttaaagacgtattttcaaaaatatgctcaccaagaaggattagtttttgaagcaggtgtttttgatgagttattgattaagtctaactatgattttagtgatactttaacgaatatcgctttcttaaagtcatataaaacagacggtcatatttcgtccaatgatgttagagaggctatccctaaaagcctgcaagataatatatttgatttgactcaagatgtcttacttggcaggatagatttagcgcgtgatttagtaagagatttacgtctacaaggcgaagacgaaatcaaattgattgcaatcatgttaggacagtttcggatgtttttgcaagttaaaatattggctagtaaagggaagtcagagagtcaaattgtttctgaactatcccattacataggacgtaaaatcaacccttatcaagtaaaatttgctgtcagagattctagaaaccttccccttgcttttttaaaagaagcgattaggattttaatcgagactgactatgctattaaaagagggacttatgataaggattatctctttgatttagccttattaaaaattgctcataaaaagccc

SEQ ID NO: 9744 - protein, 314 aa, Streptococcus agalactiae
MKEKLFQVIGFNKDDLAYSYFDLSEEDYQNAELDLESLPFLSDYKVVIFDQFQDITTDKKTYLDEQAMKRFEAYLQNPVDTTRLVICAPGKLDGKRRLVKLLKRDARVLEANTLKESDLKTYFQKYAHQEGLVFEAGVFDELLIKSNYDFSDTLTNIAFLKSYKTDGHISSNDVREAIPKSLQDNIFDLTQDVLLGRIDLARDLVRDLRLQGEDEIKLIAIMLGQFRMFLQVKILASKGKSESQIVSELSHYIGRKINPYQVKFAVRDSRNLPLAFLKEAIRILIETDYAIKRGTYDKDYLFDLALLKIAHKKP

SEQ ID NO: 9745 - DNA, 954 bp, Streptococcus agalactiae
atgggacttttagtagatggcaaatgggttgatcaatggtatgatactgcatcaactggtggtaaattcgtccgaaccgttacacaattccgtcattgggttactaaagatggttcagcagggcctagtggggatgcaggttttaaagcagaatctggacgatatcatctctacgtttcactagcttgcccttgggcatcacgtgtattaatcatgagaaagcttaaaaatctagaatctcatatctctatctccattgttaaccctttaatgttggagaatggttggacttttcaagaatataaaggcgttattcctgatatgattaaccaaagccaatacctttaccaaatctatcaagcaagtcaaagtgattatacaggacgcgtgacagtccctgttctttgggataaaaaattccatacaatcgttaacaatgaatcatctgaaattatgcgtatgttaaatactgcatttaatcatattactggaaatactgacgattactatcccgattccttacaaggacaaattgacgaaatgaataattttatttatccaaaaataaataatggtgtctataaagctggttttgccacttctcagaacgtttatcaaaaggaagttgaaaccttattcacagctttagatcagttagaaaaacacttatctgataaccattatcttgttggagaacaatttaccgaagctgatattcgccttttcacaactttagttcgctttgacaccgtttattatggtcattttaaatgtaatttaaaagcgctacatgattacccacatttatggcattatacaaaacgtatttacaacctacctggaattgctgagacagttaattttgatcatatcaaaaaacactattacggtagccataaaaccattaaccctactggtattattccagctggacctaacttagactggacaatt

SEQ ID NO: 9746 - protein, 318 aa, Streptococcus agalactiae
MGLLVDGKWVDQWYDTASTGGKFVRTVTQFRHWVTKDGSAGPSGDAGFKAESGRYHLYVSLACPWASRVLIMRKLKNLESHISISIVNPLMLENGWTFQEYKGVIPDMINQSQYLYQIYQASQSDYTGRVTVPVLWDKKFHTIVNNESSEIMRMLNTAFNHITGNTDDYYPDSLQGQIDEMNNFIYPKINNGVYKAGFATSQNVYQKEVETLFTALDQLEKHLSDNHYLVGEQFTEADIRLFTTLVRFDTVYYGHFKCNLKALHDYPHLWHYTKRIYNLPGIAETVNFDHIKKHYYGSHKTINPTGIIPAGPNLDWTI

SEQ ID NO: 9747 - DNA, 483 bp, Streptococcus agalactiae
atggctacttttcaaattaaagaaaaaatgttttctctaggcggtaaatttactattacagacctgactgggcttccctgttatcacgttgaaggaagtttgttccctctacctaagacttttaaagtctttgacgaagaggaacatctcattagtcagattgagaagaaggttttaagttttttaccaaagtttaatgtgacattagccaatgggaatcatttcacgattaagaaagatttctcatttttgaaacctcattacaccattgaagaccttgatatggaagttaagggaaatttttgggatatggatttccaactcttaaaagacaatcaagttatagcaaacatatctcaacagtggtttcgtatgacttcaacttatcaggtagaagtttacagtgaaacttacaacgatttgacaatttcgcttgtcatagcgatcgactatgtcaaagagttagaaaaaaatgcatcaaac

SEQ ID NO: 9748 - protein, 161 aa, Streptococcus agalactiae
MATFQIKEKMFSLGGKFTITDLTGLPCYHVEGSLFPLPKTFKVFDEEEHLISQIEKKVLSFLPKFNVTLANGNHFTIKKDFSFLKPHYTIEDLDMEVKGNFWDMDFQLLKDNQVIANISQQWFRMTSTYQVEVYSETYNDLTISLVIAIDYVKELEKNASN

SEQ ID NO: 9749 - DNA, 756 bp, Streptococcus agalactiae
atgaaaaattttataaaacaaagtgatactacatttgttcgaattatcaaaagtcttttaattggtggttttataggggccatacttggttccgtaggagctctttttatcatatttggtcaagataagtacttatctgaaattaatattgttcaatatttcctatgggttagtcgtattgttgtaattataacagctctctttagtctcatctacctctatcagattcaaaaatatcagaaagtttttttcaatgttgatgaaagtcaatctgaagaaatttatcgccagattaatttaagacattcttatgggatgacttttgtgtcaatttcaatagtactcagtatagttaatactttatttaactataaactaaatatttttgatgattcagttactttagttattccaatatatgatttatcactgctatttgttttattgggtttacatatatattttttaaaggtatatcggaatatccgaggtataaaaatgacagtcgctccaactttaaaagagttgaaaaacaatgtcttacaattggacgaagcagagttggaatcaaattataagatgtgttttgatattgtcatgaatttaagtggttttattttccctacgatctattttgtattattctttatctcatttgtttttcaaaaagtggagattgtagcaattattataacaacatctattcatatctacattctcattaagtctttaaaagcagcacgtcatttttataga

SEQ ID NO: 9750 - protein, 252 aa, Streptococcus agalactiae
MKNFIKQSDTTFVRIIKSLLIGGFIGAILGSVGALFIIFGQDKYLSEINIVQYFLWVSRIVVIITALFSLIYLYQIQKYQKVFFNVDESQSEEIYRQINLRHSYGMTFVSISIVLSIVNTLFNYKLNIFDDSVTLVIPIYDLSLLFVLLGLHIYFLKVYRNIRGIKMTVAPTLKELKNNVLQLDEAELESNYKMCFDIVMNLSGFIFPTIYFVLFFISFVFQKVEIVAIIITTSIHIYILIKSLKAARHFYR

SEQ ID NO: 9751 - DNA, 561 bp, Streptococcus agalactiae
atgtcaaaaaataacaacactacctgtcttattgaaactgctatttttgcagcgcttgctatggctttatcaatgattcctgattttgcgtcatggttcactccctcttttggagcaattcctctgatactttttgcattacgtcgtggtacaaaatacggtctatttgctggcttaatttggggcttattgcactttgttctttccaaagtatattaccttagtttatcccaagtttttatagaatacatcttagcatttataagtatgggacttgcaggcgtattttctgctaaatttaaagatgcacttagcagcagctctaaaactaaagctttatcattagcattatctggagcaatattagcaacacttgttcgttatgtttggcattatatcgctggtgttattttttgggctagttatgcaccaaaaggtatgtctgctacattatactcattaagcgtcaatggtactgctggtttgttaactctattttttgtagtcattagtattattattttagttatcagctaccctagcttctttttacctaagaaa

SEQ ID NO: 9752 - protein, 187 aa, Streptococcus agalactiae
MSKNNNTTCLIETAIFAALAMALSMIPDFASWFTPSFGAIPLILFALRRGTKYGLFAGLIWGLLHFVLSKVYYLSLSQVFIEYILAFISMGLAGVFSAKFKDALSSSSKTKALSLALSGAILATLVRYVWHYIAGVIFWASYAPKGMSATLYSLSVNGTAGLLTLFFVVISIIILVISYPSFFLPKK

SEQ ID NO: 9753 - DNA, 957 bp, Streptococcus agalactiae
atgacaacttactacgaagctataaactggaacgaaattgaagatgttattgataaatcaacttgggaaaaactaaccgaacaattttggctcgatacacgtatccctttatcaaatgacttagacgattggcgcaaactttctgctcaagaaaaagatcttgttggcaaggtttttggaggcttaaccctacttgataccatgcaatcagaaactggtgttgaagctattcgtgccgatgttcgcacgcctcacgaagaagctgtcttaaacaatattcaattcatggaatctgttcacgctaaatcttattcttcaattttctcaactttaaatactaaatcagaaattgaagaaattttcgagtggactaataataatgagttccttcaagaaaaagcacgtattatcaatgacatttatgctaatggaaatgcccttcaaaaaaaggtggcttccacctacctcgaaactttccttttttattctggctttttcacacctctttactatttgggaaataataagttagcaaatgttgctgaaatcattaaattaattattcgtgatgaatctgtacatggtacttatatcggttacaaattccagcttggttttaacgaattaccagaagatgagcaagagaattttcgtgattggatgtatgacctcctttatcagctgtatgaaaacgaagaaaaatacaccaagacactttatgatggcgtaggatggactgaagaagttatgacctttttacgctacaatgctaataaagctcttatgaatttaggacaagatcctttattcccagatacagcaaatgatgtcaacccaattgttatgaatggtatttcaacaggaacatcaaaccatgacttcttctctcaagtaggtaatggttacctacttggtagcgttgaagctatgcatgatgatgactataactatggatta

SEQ ID NO: 9754 - protein, 319 aa, Streptococcus agalactiae
MTTYYEAINWNEIEDVIDKSTWEKLTEQFWLDTRIPLSNDLDDWRKLSAQEKDLVGKVFGGLTLLDTMQSETGVEAIRADVRTPHEEAVLNNIQFMESVHAKSYSSIFSTLNTKSEIEEIFEWTNNNEFLQEKARIINDIYANGNALQKKVASTYLETFLFYSGFFTPLYYLGNNKLANVAEIIKLIIRDESVHGTYIGYKFQLGFNELPEDEQENFRDWMYDLLYQLYENEEKYTKTLYDGVGWTEEVMTFLRYNANKALMNLGQDPLFPDTANDVNPIVMNGISTGTSNHDFFSQVGNGYLLGSVEAMHDDDYNYGL

SEQ ID NO: 9755 - DNA, 867 bp, Streptococcus agalactiae
atggcaaatcaacttaatatttcccgcacagctatttggaaaggtataaaaacgttagaagaattaggcctagagattgagtctgtcactaacaagggctaccgattggtatcaggtgacatattattaccagaacaactcgaacaagaaattggtattaaggttagtcttaataataatagtgcttcaacccaactagatgctaaaatggggatagaaagtaaattaaagactccacacctttttttagctcctaatcaaaaaaaagctaaaggacgttttgatagacctttctttacatcaaatcaaggcggcatctatatgtctcttttattacaacctaatgtaccgattgaagatataaaaccttatactgtcatggtagcctctagtgctgtaaaagctatctcacggttaacaggaattactcctgaaattaagtgggtcaatgatatttatttagataataaaaaaatagctggtattttaaccgaggctatcgcttctgttgagagtgggttggtaacgaatgttattataggattaggtatcaatttctatatcaaagagttccctagggcgttaactaagcgcgcaggtagtctctttacagagcaaccgaccataactagaaatcaattgattacagaaatctggaatctctttttcaatattccactagaggatcacttaaaggtatatagagaaaaatccctagtcttagatagaaccgttagctttatggatggtcaaacaatgtattctgggaaagctattgatattacagataaaggatatttagtggttgagttagatgatggtcagttgaaaacacttcgcagtggcgaaatcagtctttcttcttgg

SEQ ID NO: 9756 - protein, 289 aa, Streptococcus agalactiae
MANQLNISRTAIWKGIKTLEELGLEIESVTNKGYRLVSGDILLPEQLEQEIGIKVSLNNNSASTQLDAKMGIESKLKTPHLFLAPNQKKAKGRFDRPFFTSNQGGIYMSLLLQPNVPIEDIKPYTVMVASSAVKAISRLTGITPEIKWVNDIYLDNKKIAGILTEAIASVESGLVTNVIIGLGINFYIKEFPRALTKRAGSLFTEQPTITRNQLITEIWNLFFNIPLEDHLKVYREKSLVLDRTVSFMDGQTMYSGKAIDITDKGYLVVELDDGQLKTLRSGEISLSSW

SEQ ID NO: 9757 - DNA, 564 bp, Streptococcus agalactiae
atgactaatcataaaacaaaaaaattaacggttttagcaattatgattgctttagatgtttttttaacgcccatttttagaatagaaggcatggcctttatgtctagtgtggttaatattatcgctggagttataatgggaccaatctatgcattagttatggcacttgtaacggcttttattcgtattttaactcaagcaggagtagcatctgttgcacctttagctattctaggagctggtccaggagctttcttagcgggttggttttatcggttttatgcgaaagactggatgtcttgggtgggtgagtttataggaacagggataattggagcacttttatcagctccaattatggtctggttttggacttggacagcggatggaaatcacgaagtgttagctaaagcatctgcagctcaatccatttttctttttatgccaaggtttataggggcgactataattggcggtgttattgctttgttgctacttcagggattaaagcgggttcctgtatttatgacaatacaagcattatttaaaggagaaaaagtaaaa

SEQ ID NO: 9758 - protein, 188 aa, Streptococcus agalactiae
MTNHKTKKLTVLAIMIALDVFLTPIFRIEGMAFMSSVVNIIAGVIMGPIYALVMALVTAFIRILTQAGVASVAPLAILGAGPGAFLAGWFYRFYAKDWMSWVGEFIGTGIIGALLSAPIMVWFWTWTADGNHEVLAKASAAQSIFLFMPRFIGATIIGGVIALLLLQGLKRVPVFMTIQALFKGEKVK

SEQ ID NO: 9759 - DNA, 1281 bp, Streptococcus agalactiae
atgagtaaacatcaagaaattttggagtacctagaaaatttagctgttggtaagagggttagtgtacgcagtatttcaaatcatttaaaggtgagtgatggcactgcataccgcgctataaaagaggcagaaaataggggtattgttgagactagaccgcgtagtgggacagtacgtgttgctcaaaaagcaaaggttaatattgaaaaactgacttatgctgaaattgcaaggattagtgactcacaagttgttgcaggaatagagggactcagcaaggagtttagtaaattttctataggtgcaatgactcacagaaatattgaaaaatatttggtgcaaggagggttattgattgttggcgaccgtgatgagatacaacatttagccttacaacatcaaaacgctatcttagttacaggtggctttaatgtttccccatctgtttgtcgtttagcagataaacttcaaattcccgtaatggtaacacactatgatacattcacagtatcaacgatgattaatcacactttgtcaaatgccaaaattcgtactgatttaaagaccgttgaacaagtctatcagtcgcaaatggattacggtttcttagcgcaggatgataccgtaaaagaatttaatcttcttgttaaacaaactaaaaatgttcgttttccaatagtcaaccaagctaatgttgtcgttggtgttgttagtgttcaagatattcttggaaaagataaagaagtaaaattggcaacagtcatgtcaaaaaatatcattgttgctaaacctcgaatgagtctagctaatatcagtcaaaaaatgatttttgaagatttgaatatgatgccagtagtatcggatgactttgaattattaggcgttattacaagacgacaagctgtagaaaatttatcgatgtcgcaagggacggatttatacacctatagtgatcaaatcttgtctaatttacaaattgaagatggtcacttttcgtttttagtagaacccgctatgattgaccatacaggtagcttaacacaaggagttttgacggagttcttaaaagaaatttgtattcgtgtcttaactcgtaagcatcaacgcagtattgttgttaaacaaatgacactttatttcttgcaacctgttcaaattgatgaaataataatggtaacgccaacaattatttcagaaaaacggcgcgaagctacactcgatttagaattaaaattagaaaataaaattattgctaaagctatgatagcggtaaaaattaat
